United States Patent 9,328,346 (POLYCOMB-ASSOCIATED NON-CODING RNAS) - sequence listing, part 39

SEQ ID NO: 6845 - RNA, 66988 nt, Mus musculus
aggcuuuaagaaaaucaauuagcuuaaccuuuauuaagaggcacaggagacagaaguuccgacagaaccuacuuucucaagaacaagccaaugcucaccaggaagguuucaggugagacuugaaaacacaaguccuguacauucaugcgguucuucccaccccgccuacaaaacccaacccaacccaaccaaaccaaaccaaaccaaacccugagcuguaauaaagcccaauccaucgauaucuucugugagacguagaggggcuugucaccaggcaucgguaccccgcacccaagcggaccgucggaguccucccuagcuucccagggaggaucgcggacagcugggacauacacguccaaacaccggacuucacugcucgccucaggcucugccgggaccaccagcuggccaaggccaacgcgguggcgucucuuagggaucgggucccucagcgaagcugcagagcgagacaggagccccgcaccaacgcucagcgcgcucgcuucgacccgcaccaggagggcggcacccaggggaggagcuugcgcacgccccuccggguggagcgcgccaggugagcgcgcgugcgcaguuggaccauuaaaaacuagcccgcccccuucgcuucggcccgccuucgugggggcuggcucgccagugggcggggccgcggagaaggggguggggaguggagaaagcgagcggccgaggacggcgccugcgcggugggcgugauccgggcacuuagggcaggaugaacgcugcuuuccaagauggcgacggagggaggagggaaggagaugaacgagauuaagacccaauucaccacccgggaaggucuguacaagcugcugcagcacucggaguacagccggcccaaccgggugcccuucaacucgcagggauccaacccuguccgcgucuccuucguaaaccucaacgaccagucuggcaacggcgaccgccucugcuucaaugugggccgggagcucuacuucuauaucuacaaggggguccgcaagguaccgacccgggcgucaccgggggcgcgccggcggcgcgggccgaggccgggagcugggcggugacagcgaggccggggugaccggugggggcggccggcacuuguacuuuugagugggccgguaacuccgcugaggugcuccggaggagagggggcuucgggagugaggcgccggcggcagcgcugccuccuaggggaggagggggcucuggagccgggucgcggagaugccccgggaguagccggucgccuccucccccggcggggucugucagguuccgaucccgcccgggagcgggccugcgaguccccggaagaggugcggcggccguuuuagguggccucgcuucccgggaggcucgagaguccugcccugggugagagaaccgggacgcgaggcggcuuggaaagguccguaaggcggaaccgggacagggaggcggaggacuuggagacuaggucagaaaggaccugcucggcacgcagggcuacuccaccugcugccgcacugacacuucuccuggugucagcacuguuuccaaaaaccuuuccgggaggucgccugucauugucuccgcggagggaaccgucucccgaaagguuuuugaagagggucauucugucccuugcaguguaagagggcugaguacucaagacuagggagguuggaauuauguuuucaaauaggcuaaguugcuucagagguguugugugugagcgugccuagauuuaucuugucuaacgagucaggcuaugucccaaacagggagggauaggccuuaaaugcuacuuuaaaguaaccagccaagaacuuaacaguaauucugugacgcaugcaaucgaguuuuaaaaugucucguuaaaagcagcaauuuauuggcgcuuuuauuuuauuuuauuuuuuuauuuuuuggucacuggcaagaauugcuuauuuuaacuuuugaccauugagagaguaaggaaauguaugcacuccauagcaccuccaacggaaugugacaaggugauggaagauucacuuauaaauguucaguuagugggaaaguacguuguccauauugaagaggacguguucccagggauggcuauauccaaagucagcugcuguuuauguugcacuguacgguuaggaggacaagggaaggaaugauggugugcaaacguaagcuuguuucuuugguccaaggugaaucuucugacuugucuuuauucuugucagugaacucccgaagcguuuggaaauagcugguugacucuccucucucgggguugggaaaguauccagugguuugaagaguaggaacugaaguuuuagugcaguucccaacccuguuacugacucacugcuggcugaccuuggauaccugggaaacuuuccuuugcacuucuuuaaaaagggaggcugcagugcacauguuauaauucguaauagcugugauggccauuagaguccugacacacucaggagauguaaauuagaguuaaagcaagcauugagaggaacugccgucucaacauuccugcucugacugaaauaccagauuuuucucuggaaauaaauguaagcuuauauuaucaacaccuacauuugggggcuggagcaaaggcucagcggugaagaaccuguacuguucuugcagaggacuccaguucaguuccuaaaacccauguuaggcugcucacagcuaccuguaaccccagcuccagggaauuggauguccuuuucuggguucuggagacccacuuacagcuuacacaaauaaguuuaaaaaauaaaagaaaucuuagaaaaauuguaauuagacccuaccaugguugugcauacuugcaauccuagcacucaaauugugauuuuuguggccagccaggacuauaguugguaaguucagggccaaccugugcuacaauuaucacuuuugaggcaagcaugggcuauauggugggguccucucauaaggaaaaaaaaaaaaucaaaccagguguguaugauagcauguaccuugacagguggaucucugugaguucaagaccagccugcccucuauagaguuucaggccagcuaggacaaaaaacacucgcaauucgaaaaaccaaacagaaauaaugaugauguaaaaauacaguaugcuuaaaaguuaaauucgggggcuggugagauggcucagcguguaagagcacccaaucuucugaagguccuuacuuaguucaaaucccagcaaccacaugguggcucacaaccauccuuaaggagaucugacucccucuucugguguguuugaagacagcuacaguguacuuacauauaauaaauaaauaaauaaaucuuaaaaagaaaaaguuaaauucauagggcauacaguaugcuuaaaaguuaaauucguggggccuggaagacggcucaguaguuaaagagugccugguguucuucugagccuagaccccagcucucacuucggcagcucacaaacaccugugcuuguagcaccagcaccuucaaagcccucuucaaacuucuucggguaccugcacauauguggcauucacacauauguguauaaauaaauaauaaaaaaaacuuuaaaaaguuaaauuuacuucgagagauuacuaguucaggcuucgccuccccccacuucuuuaccacuccgacccccacacccuuggguguggacagaacaucagggccuucggcaugccaggcaaguguucccucccugugcugcacauccagcuauuggaucauucccaugacacacuucaccuggaucuaguaccucugguuuguauaggaaaaaaaaagaccauuugcuuagaaguaucuuuauaaugguguucuaagagcuuuaaaaaaacuacaccaaacauucucugaaacaaguaugaaauacugccagguggugacagcacacuuaauucccacguguggacucaggugguucucugaccuugaggccagccuggucuacagagugaguuccaggauagccaggaccacacaaagaaagccaaucuccaaaacauaacacacaaaaaacaaaccaaaaccaagucagaaaugcaugaacauuggcuuucuuucuuucccuggugaauugagugcuuugaacucugggagggguguguguguguaaguaaaauuuuauguaucuuguaggauacauuuguauuguggcagauauuuaaacucuucuagcuggugaauuaaaguuuuucuuucuagccgggcagugguggcgcacgccuuuaaucccagcacucgggaagcagaggcaggcagauuucugaguucgaggccagccuggucuacaaaguuccaggacagccagggcuacacagagaaacccugucucgaaaaaccaaaaaaaaaaaaaaaaaaaaaaguuuuucuuucuauaagugaguuuguuauaauucugaauaugugaccuuuuguuguuguuguuguuuauuugauaaggucucauauagacuaggcuggccuuaaacuugccaaagcagaggaugauuguaaacuccugauucuccuggccugacccuuucaauuucuaggauuaucgguguguauuaccaggauggccuaauaauaguaagguuuuguaguucugguuucugauuuuaaaguagagcuaauaacuugcccugagugcuggcuugggagaguugagaauuggaccauauaaccauagagugagagcugucucaacaaagcaagcagacaaaaugguauccuuagucauuguuccaggaaagcaggaguuacuauugggguaaguagugagcaggucuuuuacauuuuucacaguuggcuauuuugauauauuuuuguguucuacuuuuuucuucaaggaauaugguaugcaugugugcgugcaugcaugugcaggggauaaaacccaagggccuccuaauagauguuaaacaagcacucuuccacugagacaucuccucagcccaaggcauacgaaguuuuacaauuauugggaccaccuagaagcccuaauguggaagacauucaaauccagauuagacacuugaguaaagugaguaguauuguuuguuuguuuuuguucgacacugcuaagaauugaaccuagggccuuagagcauauugaggagacacuaccacagccagcuagcuguucccucccacccccaauuaauauuugagacaaaguuuuuccauacagcccaggcugaccuugaguuuguauuuugccucuaugaagucugggauugcaggcguuuguggacuguguggauguguacucuuuccucagaggaagcaccauggguccugagggauggagugcuggggagggagucuaauauugaggaguauaauauugacuuuucagaugcauaguggucagggucuagcauuugaugggccugagaggauauguaauuucaucucccucaggaaaccaaggcuagagaaaagaggcaaacauuuauuaguauucuucauuauaaggaaaaugaagcacaucugagcauaaaaaauuuauuuuagacuaaucaggcuuuucaaucuaaggacaccaguguacucacgcuaggcccuucagaacuuaccccaggguuggauuucacauuaucucauugauuuuuuuucuuucuuucuuucuuuuuuuucuuuucuuuuuucuuuuugacauagggucucaauauauagcucuggcuggccuggaacacagagagauccucuugccucugccuccucaccugcaaguguuggguuuaaagugugaaucaccaugccuagccuucauugaaucuaugucagccauaugagggagauuucuuauguaguuugugaaucuguuuugcuuaaccaaaggcaguaugaaaaucaguacugcauuaaucauuucaacaaagauuugagugacuaccauacgaauacuaguaauauagagcaggaugcuaugagagauuagaaagacacuucaaaacuuugaauuccuagcuuuaaaacauuuuaugacauauuuuguuaucauuaaaaaaaaaaaaguuaaccgggcaguuguggcgcacgccuuuaaucccagcacuugggaggcaagguaaaggcagguggaucucuggucuacagugaguuccaggacagccagggcuacacagagaaacccugucuggaaaaacaaaaacaaaaagaacaacaaaaagguuguuuuaggaaaacaaugucaaagcuagcuauuucuauuggaccuguucuuuuaucuuauggagauuguuuuacauaaagguuauuugucuccuuuagaucucaguuuagccaucacuuucucugcaaauccugugaauucacagguuaggucgggucccccaguccccccacguguucucagggcaucauguucuuugccuuccugacaguuucucaguuuguaauugucugugacaauuucucugugacagagcuuccuuacaacagagauguaugugacuuucucugcugccuucucauugagcaugcagugaguucaucauugaguagggcuuuacuguccugucugcugaggugaaugccucgagaggcuuugugugucuaccaagcuacaccuuuauaaagacucccaagaagcugagaaacauccaaguuugggucuaaaaguaacauggguaauuuuuaguaguucauaccuuuaauuuuuuuuuuuuuuuuuuuuugagacaugguuucucuguguagaccuggcugaccugcaacucacuuuguagaccaggcuggccuaagagauuccccuugccucugucuuccaagugcugggaucaaaggcaugugccaucaugcccugcuucuuuacaaaaaguauuuuaguauuaccaauagguaguaaaguuuuaacuuucuuaaaguugcaaauaagagacagugaguacuagaaaguaaacggguugcugcagguuacuuuguuguuuuugagacagucuuacuuuguagccuaggcaggccuccaggcugacucuguagaccaagauggccuggaacucagagaucugucugccuccccagugcuggccugaaagaugcaugccaccacaccugguuugcagacugcuuuugaucgauugcuaucaaaccacacuaaaccaaaccagcucuagucagaauuacugaacaugcagacuaaacauccuuacuccuuucccaccauuucagacucuacacugcuuagggauguuacugauaugacucauguaggugggaaauuguauguuagauggcucuaaggcuuauuagcucuuaagguuguaugauuccauacucuuuuauccauccauccauccauuuuacaucccagcuccccuccuucucccagucccacccucaggccccccucuaccccagaucucccuuuuucagagaaggggaggcccccauggguacuaccccccagcacaucaaguugcaguaggacuaaacacauccuuuacuacugaggccagacaaggcagcccagcuaggagaaagugguccaaaggcaggcaacagagucagagacagcucccacuccaauuguuaggggacccauaugaagccacagcuauacaucuacaaauguguagggggccuagggccagcccaugcaugcucuuuaucuggugguucagucucuuugagccucaauggguucaaguuaguuggcuuaguaggucuucuuacuguguucuugaacccuccaacucgcucaguccuuccucugccacuagacucugagcucugagcuccagcucuugguugacugugggucucugcaucuguuucuaucagcugcuggaugaaaccucucaggagacaguuaugcuaggcuuuugucugcaagcauagcaaaguaucauuaauagugucaaggguuagcucucuccuaugggaugggucucaaguuggccaguccgugguugcccauucccucaaccucugcauauucaaacaaacaaacaaacaaacaaacaaacauuuuuaugugcaucgauauuuugcauacaugcaugucugugggagauugcuagauccucugaaacuggaauaggaguuacagacagcugugaguugccauguggguucugggaauugaacccaaguccucuggaagagcaaccagugcucuuaacuaaggagccaucacuucagcccuccauacucaguuuuaaaagugaaaauaauuuuuuucuuuuguuucuuuuuuuguuuguuuguuuuuguuuuuuccaagacaagaguuuucucuguguagcccuggcuguccuggaaaucacucuguagaccaggcuugucucaaaggaucuuagagauccuccugccucugucuucugaggcugggauuaaacacaugugcgauuacugcccagcuuuuauuuguuaaaauuaaauuuaaaucuagugggguauuuguaaaagcaagcugaaaauaccaugacuuguaggucuuuaacaugcuucauugaaccaaaagaaccaguuaugaccacuuaauuuuauuagaggaaggugagggguaggcugauuggaagaagaugaacauuuugucguauuuugucaaaagccgcagggccgccugugccugcuggugacauugggagagaacaggaucugugugggugaacuagaugucagacaccauguucaaacccuucugucucuuccucucucccuccuuucccugccauuucuccccucaaugccuuucuuguuuuguagggauugauccugaggccuugggcgcuaggcaugcauuguacuccugagcugcauuccugcccuuuuaaaguuguggcuucaaaaaacuguuuuuuagauuuauuuaaguguauuuaguauuuugcuagcagauguguauguguaccaugugugugccugguacuuguggaggcugucagauccucuggaacuggaguuagagaugguugugaaccuccaugugggugcugagaauugaaacugggucuucugcuagagcaacaaguauuuuuugagucaagguuuuaguaacuugucuaggcuguuucagguuuuuguuuuugagauaggguuucucuguguagcccuaagcuauccuggaacuugcucuguagaccaggcuggccuugaacucaaagacuggaucugccucucgagugcugggauuaauuauuuuuuuuaaaaguuaaauuuuguagucauuguuuaaggcaguaaagggagaagaugggauagggucaagaagugugcuguguagcucaggcuggccuggagcuccuggcagucguccuuuaacuuccuagguauguacugucacaccuggcugauuuucagacacuuuguaacauaaucuaguaaggcaggaauuggcaaagcugaaugacagagaaccuuugcuuccuuuaagaacuacuuacuggccaggugugguggcacacgccuuuaaucccagcacucgggaggcagaggcagggggauuucugaguucgaggccaaccuggucuacaaagugaguuccaggagaaaccuugucuuggaauaaaaacaaacaaaaaaagaacuacuuacugacuucugaacuagugauuagauuuuuuucuuacuuuagaaucuugcaucuugaguggaaagcaccuuaguuauuuaaaguaaagaauacuuaucucucuaguagaucuugcaucucuuuuuuuuuuuuuuuugguuuuucgagacaggguuucucuguguagcccuggcuguccuggaacucacucuguagaccaggcugaccucgaacucagaaaucagucugccucugccucccgagugcugggauuaaaggcaugcgccaccacaccuggcuagaucuugcaucucuugaacucaaauaggagacuagcaaugaaugaucuauggguagauuugagcagcaagaaaaagcauauagugagcuggagagauggcuuugugguucagagcacugcagcucauucagagagcccagguuggguucuuagcacccacauggcagcucacagccaucucuaacuccuguuccaggaguuugucauauaaaaauuaaauaacucuaaaaaaaauuaagacgcagagaacaugucugaaaucagugaaacagucaugaaugucagucgcguuuuuaagauuuaauuuuacuauuucuaauuauaugcucguguaugcaugugcuuguagaggugagaggcauugguucuuuggagcuggaguuauacagguguuugugagccucuggagcggguguugggauggagcuccaggccccugcagcagcaguucacugucuguacccguguugccaucuccccaccccugaggcuuacugcauguguugggaagcauguccaccaggcacugauggcaagcuugcugcuguaguuacuaccuuggaggugaugccagcgauguaagugggacucugcaaggagcacaacagugggcuugucacuaguugguuugacuguagagugaaggaaacuuuacaguuaguaagugccugccguauaaguaagaggauuugagcucggagccccaaaacccuggucagaagucaggcccagucagcagugcugugccuguagccccaguacuaggguggggaggggagguggcuagacaggcagauccuggggcucacuagcucaucuugagucagccucaggcucacugagaccugucucaaacaaagacaguggagagugguugaggaaaaacacucaguguuguccucuguucuccucacacacacaucuaaagauggauaacaagauguguguauuuuaauauuuuagagaacauuuccuuuuuguuuuuuucagugaaguuaguuguacagaauuaugaacuaugguccuguuugauuauucaacagaagacauuaagaaaugaacugaauugcaguauggugcuacacucuuguggcuucagcacuggggagguugggcaggaggauuaagagagucugacucuagucugaacuauauagugagacccuguagcaggucaugguggugcaugcguuuaauccuagcacagaggcagaggaagguggccagcucucuuugaggucuaagguagccuggucaguguagcaauucugggucaaccagagcuacauaguuagacccugccucuaaaaaaauaaaaaugauaaauuccucauuagauuaacauuuugucugugcuguaauuuacagacugucuccuaccuuccuauucuaauuugaccuuugcuuguggugggauggacucaaugaggaauuuuacuuuuacaaauuuguaaauuuuuaaauacauuuuuauaauuuuguguuaaaauauguauguauuuauguguucaucuguguggaccagaggccagcauugggugucuaccucauuuauuuuguuuauuuuuauguauuuacuuauuugauuguucaagacagggucucucuguguaacaacccuguccuggaacucuguagucgaggcuggccuugacuucagagaucugucugccucugccuccuaagacagaguacugggaugaaaggugugugccaccaugcccagcuuuucucuuauuuuuugaguugcuucucucacugaaccuggaguuugcugguugugcuggauggcuggccacaccagggauccuccuguccccgccguccuggugcuggguaagaggugcggcugcugcacccagccuuuucccuaccuaagugcugggugucugaacugcuugcauagugagcagcugugcauacugaccgggugagcucggaagcacugagccuugcuugcuugcuugcuugcuugagacaggguuucucucguggcccuggcuguccuggaacuucucuguagaccagguuguaacugaaccauuuuuacagucccuguuuuuguagaguuuugagccacaguuaaccaguuuaucuagcugcaguucuccaagguuuauauaagagggaaaugacuuauauuuuaauagugaugaaauuuuggacucucuuggaaguaaaaguugaaaauugaagugugcuacaaaaagugaguugcugagcugauugguuggugguuuaugagcugagcacccagugucauguaauaaguaacagggagcccaggcucaggauggauuggauuauauugagaaaauggacaggguuugauaagauucacuuggcucugcuuuccauuagccugccagccacgcugcugugggcacuugguggaggggugcgaggcucucugcaccccaugggcuagagggagaccagcacucaguuucuccgaagaacgagguuacuucucagaagccucuuguauuuacugucccaacuuggaucacuaacccguuucugaugccacuagaaaugcacauuauuccagucuuccuuagccacuccuuuagguuaucuacuacccucauugcucuggagauggcucuggaacugggaaaugccaugccacauaggacaacggucugcaccuagauacugaugaggcaacugggagaggcuugagcuccacugagggucuguggugagugcagcgcccugggucgggcacacuugguccugucugcucugcaggccaaccccuguacuccucucccucuucacacaguccucccgguuuuguuuuugccuuguccccuuaaggcugaucuuaagggcagaaaccauacuuuauuuguccauauccauuacacuguuaguacauaguaaacauguugucuugacuuuuuuuuuuuaaagauuuauuuauugauuauauguaaguacacuguagcugucuucagacacuccagaggagggagucagaucucguuacggaugguugugagccaccaugugguugcugggauuugaacucuggaccuucggaagagcgguugggugcucuuacccacugagccaucucaccagcccguugucuugacuuuuauuguuaaauuuuauuuacuuuccuaucuauguacuuugagacaggaucucaguauguacuccaggcuggccucagauuugagacaauucuggaggcucacucacaccuuuaauucuagcacugaggaaguacaggcagggugauugcugugcauuugagaccagacggguacagagagacucugucucaauaaauagagacggaaagaaagaaaagaguugguuuauagucccuaaggacccucuugaaugagucagguagucuuucuacucuuuucacuagcuguaagugcuguguuaccugucauuggugcaggugggcuugcuagccccuuuuguacggguugagaaacuuucagaaauuagucagcggccuggcuucuuggcuaacccaggagaacauucaaggucuucugggcuaacccaggagaaauuuaguguucugaaugccugaagcucgauuugucacuuugaguuccuuauccuggagucuugggggugggagaugggggugggaauaggagguggagaaguccauacuugaccuuccagaaagaauaccucuuuccuguuagugauaggagcuauacagcugcuuuuguugcccgccucagauugugaccuaggugugcaugcagcgagcaagagugaaggcaguagcaucccaccuaacuaaaaguaguagcuguugaccucagggcuucccuugaugugcccaacagcguuuccgugagcugagggcagguggagcagcugcucagagcccgaagcucaguccugucacccucuugauggccacuuagaacccgacuuccuuuucuuuucuuuuuguuuuuuugagacuggguuucucuguguagcucugucuguccuggaacucagaugcgcucaccugccucugucuuccaagugcugggauuaaaggcgugaccaccacugcggcucacuuuucuuucucuugggucugcucugauuucuugguugccucugcuuguuauaaacggcuuugucucagccaaccucugugguuucauucuuacuuccuggcugucaagcacaguggcugcuugguucuguagcuccuguggucccaggcugccucugacacuguuacagugaugcucaggggcuuaccaucagcugggauauuuuagcuucaguguauuuucauaacccauuaccuguugacucuaguugacuuuggcucucagggucaaacucaacauggcccugguuguucagcuuguugccaucaaacccacuggauccacucagcuucucagcagcguuuggugccauuguuagcuuauuauuaauuuuacauuuuuauuuauuuuaguuuguguuuggugggacaugggcaugucacagcaugcaugcuuguuagagaacaguuugugagaguugauacuuucuucccaccagguggauccuggggauccacucaggccauuaggcuaggccauaaauguuaacagcccuuagcuguugagcagucuuaccugugugccuuaccuguauuuauuacuuuuaagccaggcgcuugcuauauauaccuugggcuagccuugaaccuuguauguauuccaagcugucccugaacucucuguccucuugccugccucagccaccugugucaugggauuauagguguguuucaccuugguuugaauuagcacuuuaaauucugacuuuauuuguauuagugguugugcaugugcauggggcaagcaugcaguggugugcauauggagguccgaggguagcuuuaagcaguugcuucucucuuuucugcccuguggguuucacgucagggauagcacucaggaccucaagccugugcagcaagcacuuuaaccuauccauucaucuugcccacccuguccugacuuuugagcuuucuggcccaugucucucuggcuucuugucuuuagccuagguuuuaguuguuuccucagugccuuagucuuaauuccuuucucaauucuguuucuuagcugcaugugaaaucauauuuccuuuuuguuccugaaauacuuuguuuuaucccuuuuuccccuaggaaaauuaucuauuacaguaaaugaaccuaguggguauuucugugagagcacaaaucaguuagggcaauuaaaacuuaaacugacauaugcuucagccaagaucugccucacucaucuucagcuguagaucuucuuucuugauagagagcuguuuugccaguuccuucugcagguccuguugcccucugcuuuccaggccauguaaugcucuaguccuagauguagccaucucuguauaaaacuguggcuuuccuccuggccugcaguauuccauccgaccugcucuagaugucugcuuuggcuuagguggcugcuaggcccugucacuggcuugggcuuuacccucuucauucagauuuuuuccccuuccaaacagauuuacaagauuugcccguuaaauguucuuuucagugauggauggcaguggcacaugccuuuaaugucagcacuugggaggcagggaggcagagagagaggcagguggagcucugugagauugaauucaaggccaaccuggucuacaaagugaguuucagaacagcuaaggcuacacagagaaaccagaauuuuuuuuccaaguucagugugguggcuaaugcuugcaaucucaguacccaaggggcuggggcaugaggauugcugcauguuaaguuccagcuugggucauagugagacucugucucucugcuaccccuugcccccaauacucaguuuccuuuucuguuuuuuuaguuugcucuuuauuccuuuaguuuuguuccccuccccuccccuccccuccccuccccucuccuccuuuucucuccuccuccuccuucuccuccucuuccuccuccucccccccuccucccccuccuccccccccuccuuuaauaugcauugccugugugggugucugugugagaucuccuuauaucuugaugaauauuaaguuguaacaagaauguaggaccugaguaguuuguuauuucaguucuaaucacucuuuaacucuugauucuaagcaaacaggcuuuaguuccuuaauguacuuuuucuuuuaaaauuauugggugaguaugugugcaugcuaggguaugugcagagaucagagggcagcuuuguggaguugaaucccuucugcuguggguucuagagcuugaacucaggucaccagagcuguagagcaagcagcucuauuuacagaaccaucucccagcccagaauguuguucauuauuaaaguuuuuuuuuaauaauuccauuuauuuacuugguagggggugaggaaggacacacacauggcacaguagaggaggucugaggacaacuuuugggaguuggcuuucucuuuccaucauaugggucccaagaaaagaacucagucuuaagacuuaagguuaguggcaagccccguuaccugcugagccaucucacugacccuugucuuugcccucuacugagcccuucugauuccaucgucauugugcuucucucccuuuguccuagguucacucaguuucuuguggguucuuuuguuuguuuguuuuguuuuuuuucgagacaggauuucucuguguagcucuggcuguccuggaacucacuuuguagaccaggcuggccucgaacucagaaaucugccugccucugccucccgagugcugggauuaaaggugugcgccaccaccacccggcuguggguucuuuuuaaaagcaugucgagugcugacuugugugcgcugcucuuguugucugugaccccaacagcuauggccucugccucauggcucgccgccuccugcucccuccuaugcugacucuccccaguuauuagaaugagugaucuuuaaaaaugugaugucauucucaggcuuaaaguauuucagugauguuuguuauugaagcaaggucucaugugucucaggcuggccucacacuggguauguagccaaacaugaccuugaacuugcgauccucuuuaucugccaacuucugagauuauauacaaagucuaccaugcuuagaguauugauucuugcugauucuaccaggaaaacccaaaaaguacuuugcugggacuguagcucaguguaagcugugugccuagcaugcaugcucucaccugcagcgcugcaaaugaacagacaacccugacuuacucgagcuaccugagugagcgcuugccuucucuauuugcaguucuuccauucuuuuucuaauucacuggcuuccacuucauccccuugauaguguuaauuuucuugacacuuauucuuuugugcuuuuaucccuuuuguccuguucucuaaaggggagcuuauccacccuuuauuaccagaacagcaccuugauuuguguuccccuugacuagguuguuugccuguggagcuaccaggcuggcucccucaccuucugauuucucacugugguggguugagugagaauggccuccauaggcucauauguuugagucuaugguuucaaguugauggaacuguucuggaaggauuggcagaugugacauuguuggaggaggugugucacuggggauguguuuugaaguuucaauacuuacaccauuuccagccucugccuccagcuuguggaucaagacaugagcucucaguuguccuuaccacugugccuuugcucugccaucaugggcucuaacccucuggaaccauaagccacaaaauaaugcuuucuguauagauuaccuugaucaguuguuuuaucacaguaacagaaaaauaacuaagacagugucugucucuaugugacuaugcuacuccuuuccagacagggacugccaucuuaccucagucccuuuuugggcuguggcaugggaauagcuuuucccuucaacaggguuucauucuguacaaagucaugguuguccuguagcucaagaugguguugaacucaugguaacccuucuaaaucagcuaaaucagagugugaaaaugagugccauccaguuuggcugacguuucuucauaguccuuuuuacuaucugaaucucagccaacuguuugugccuccugaucuuacacaaagagguauucaucaucguuauucuugagaccuuagagucuaaagcaguaccuggcacuuagaguagaauuuagagaauacuggcugaacugugaauacugugaacugugacagggcuuaucuaagcugaguucauaacaaauuuucuacgugggacauaaguguuggugacugcuugguaggccuguuuuguuguuuaaaaagucaguacauuuacaugguguaggcuaaguuuguccguuccccccccucccccccagacagggucucucuguauagcccuggcuguccuggaacucacuuuguagaucaggcuggccucgaacucagaaauccaccugccucugccucccaagugcugggauuaagccaccacgcccugcucuaggcuaagauuuuuuaaaaccuacauuaguaaggguuuucaaacauuuugacacguguuccccccaaaucucuuucuagcccacuguccagagguaggggagaaaagaugguaaauaggacaaggggauguggaccuguuuagaaguaguucucgggggugauucuaaucuccauuugucgggguauuagcaguccaguuuaguagugucaggauaccaacaguccaguucagaaguggcacccaacacaaauuagcaaugguaggguccagcagaaaccuccaggcuucugcugaauuggcacgagucagcagaaguggccaggaccagccagaaugccaugaguucucugaugugccucucucucucaagugaaugaagaucagugaaguugagagaccgauaaagaguugcacagccagccuugcaagggccuagccauuguccauugagucccacuuauacucucuucaaacauuacguguuauuccaugggucuugccucagcaaaacaccuugugggucuguaucacgugacacaaccagaaacuuucacuucaaccugguuccaaauuuaaaggacaugcaauaaaaagucucccacauccuggccccaggcacuguguucucuuuacaaauaaccaguauuggaggugagcauguggccauguggcucaauggguagaacaauuaauugcuuaucaaauaaaaggccccagguucuggccaaaagaaaaccagaaauaaccaacaguaaguucacacaauauguaguuuuucuuccuucccugccucuggagacagccuaugcuauaagacacaaaauuauaaguauaauucaaucgccaccaaaaugcaaauuuuaacaucuguauguuuaugguuaaacauugugugaaaacaaauuuuguguauuuuuaguuuauaaaugaagaugcaaagaucagaaguagucagaaguaguaauggcugaguagcaauauggagcacauuuaaggcucauacauaaaaacuggagacauaagcauccccuccucuuccugcauugagaccguuugagaucuguuggcuagugccugcuuacauucgcuuagcugguauaguuaggaauaaggcuugaugcugcuguaccuguugugaaacaguuuccugagagauugaaacaucccauccuccauggaaguucuuuauuaggaagagaaacgacucaaaauagccuuuggacaucccugaaacugaccagauucaccaggcccucuucccucccagaauaaacaauaaaccugaagacucuggggggaaacagauacuggacagcugcuuaugagagauuuaagucuccugaggcaccuggacaggacacacuccaaccugcugugcugccugcagugugcuccagguucccagcuuuugugagcugucaugcuagggugggcuuuagugaugcagcugucuuuguaucauuucugcuccuguaagugacccuaaccuauacuccuccuauaaguaacugaauaaaaauaaaacucacugcucaccacgucggccuuugguauauuuguacuuuggucuguccuaggcuucuuaucuggggugaacaggcauguguguugcuucuguccagaaguuuggucacacaguaacaccucuauucccgucuguuguuggcagucuucaugggacuuuccugguagagcagaaguccuuuauggcugcagugguaagaccagguuuuguggucagcuguuaguugguuagugaugaugcuuuccugcuuugcucuuugcuuucuguuuccaugucacuuagccuggccuuaaccauuguccagucuguucuuagccaccacuuuuaccaacaugccugugauggcucacuauuuugauaacaucaaauccaagcugagccacugaauaagcuccccugugaggagcugucucucacggagauuggacuaauugugugaacucacugcugcuuuuguaugcuuguuucaguuuucucuucggugucucaccacagcuuucugcuugccuauaauacuguuugaauaguuacuucuuacacauacaaaaacuuccacaaaaacagccacuaagagcauuuucugcucuugcagaagauccaaguuugguuccuagugccuaccacauggcagcccacaagugucuguaacuccaguuccaggggauacaauucccuccuucugcccucuuagggcaccaggcaugcauaugaugcacauacauauaugcaggcaaaccuccuauacauauuuuguuuguuuguuuugagacagggucucacuauguagcucuuguuauccuagaacuauguagaccaggcuggucucaaaaaucacagagauccaccugccucugccucuucagugcugggauuaaaggugugcgccaccaugccuggcuauuuguuuaaaaaacugccagacuauaaaaacuuugaaccacauuaguaucuuugcaccuuggcacccaguuuuuaaauauguagcuguuuugauagugcacaccuguaaccccagcacuugggaagcugaaguagaaggaucaagaauucaaagucaccauaggcugaauacauucuaagauagcuugggcugcauuguaagacacugccucaaaaaucaaagcagagaaacauuagcuaugaugggauguaccuuuaucucuguaccugggaggcaaagguaggcagaccucugugaguucaaggccagccagggcuauacaguaaggccuuaucucaaagaaaggaaaugaaaaagaaauuuuuuuuuuuuaagauuuauuuauuugguauguauacaguguucugccugaaugugugucugcaggccagaagagggcagaucccauugugagcuaccaugugguugcugcaaauugaacucaggaccucuggaagagcagguggugcucuuaaccagccccgggccuuuuccuaaaaaucagggacauacacuccuuuucuuuuucuuuuuuuuccccugagacaggguuucucuguauagcccuggcuguccuggaacucacucuguagaccaggcuggccuggaacucagaaauccgccugccucugccucccgagugcugggauuaaaggcaccaccgcccggcugacacuccuuuucuuuuuuuuuuuuuuuuuuuuuuuuuuugguuuuuugagacaggguuucucuguauagcccuagcuguccuggaacucacuuuguagaccaggcuggccucgaacucagaaauccaccugccucugccucccaagugcugggauuaaaggcgugcgccaccacgcccggcgacacuccuuuucuuaauagucacucacuuggacugugucagaguuaggagaugagacgggccuuugaagucauauugccagcugcauuuucacauuuaugauaucacauaauacaggcugcuguaugggaaaaccaaaucuauuuccuguucucaaaccacaguagucaacacagaagucuucuguaacugcaaaaaguguauuucucuauccacaaacaguucugaggaguggacucuuagcugcugggugcccuuuaaucuaguugguuucauaccucugagugaucuagcaucagcggcuagggcuugaagacucagcccaucucaggcccaggucaagucagccagagcuucugaugaguugccugcacauugagauuuccuuaacacucucccagguugguuuuucuuaaguggcucauagaauuuaggaaaacacuguuuucaauauuugccaaucuguuuuaaaggauuaaaauuucucuacuuacauuuauuuguuuuguuggugagugucugccauuggcaagcauguggaagucagacaacuuguggaguccguguauggggauugaccucagguugucaggcuuggcagcaggugcccuuaccugccgagccaccucacuggcucuguaaacaauacuuuaagggauacagguaagcagauagaugaggucuggaagggggcuaagcccaggcagggccuuuugugucaguguucuuguuugccuguaagccuccagaugcccucugaacccuggccuuggguuuuguuuuguuuugucuucaguacuuguuauuguuacugcuuacugauuuuguugcuguugcugcuccugcugcuguuuuugagcuagugucucacuggauuggaaauuuaauauguaccccaggcuagccugcaaccuucagucauccuuccaucuuagccucuugaaggcagggauuacaggucugcaccacuauguuaauugugguuuuuugagacagggucuuacuguguagcccagguuacccugguucugauaguucuucuguuccagucucccuaguggugggcuucuggacauggccugccauaccuggauuuuauuuucacuguuuugcagauuggccuugaccuuauggacugacucagugguccugucauaucgcccucccaagcagcugggcauauaaauguacaccucuacaucuggcuccuuugggggcucuaugaagaucauauauuguguuaggcaugguggcuuuuaguaaaccaggcaaggaaagccaccgaggccugucugaugcuauucuucaccagccucuccuccagaauguggcugacacaucaucaucccagggcucgggggacagaggcaggaaggucagagguucagggucacccucggccugucucaaacaaaacagaaauagggguuuuaucaucugcugucaggcaaggugggucauggauuaagguuaugaccucccugcaggguggggguuggguggacagaaacacauaugguaauagagguacucaguguuuucauuuuauaaauuaacuuguacuuuuacugauggauaaguugguguauuauacagaucugacuucugaguuuauuuuauaucuucaaaaauuauacuauauaaaguucaguaaauuauagcugacuagaaaauguaauuuugcuuacuuugauucuuaguuucaaaucuuaccuuuuuuuuaucauuuauauauuuucaacaggcaacuaaauagaaaauauuuuaaaaauauaagagaucaaauguuuguuucuaugcugacuaugcuguaguucuugguugaauacauuuaagaaaugcaaauuuguguuauuuacuuaaagugacauacagguuuggagcuucugggcaugcccggccauaucugggcuuuacuaaguuggaaugcccuccagaauagugauggcaggaguugucaggcuguggaguaguucagaguguggguuuuuggguuagggauguuugucuaguaaagucuaugcaaauauucucaacuuugaaaaacucaagccgggcagugguggcacacgccuuuaaucccagcacuugggaggcagaggcagguggauuucugaguuccaggccagccuggucuacagagugaguuccagaacagccagggcuacacagagaaacccugucucaaaaaacaaaacaaaacaaaacaaaacaaagaacucaaauuuagacgaugcugaaccuagggcauuugauugagauaagggauugucaguauguacuagcuagcuugguuccggccaggcaucuagucauuuuacagguucugacuccugcaaacuccccgggcugcaucugcuaggaccuuuguguuaucuccacuuuucuauuuugugcaguagugauuuggaaggcagguagcuugucugagcucagaggacugaaccugagucaaaucuguguguccuggugccaccucuguuaaucacucuucagaguauacuguugguuuucagccagggucuuuucuccagauguuacuguaauagagacucugaaauacaguguuguucauuuuuggaguuuucucaaguuagggucuguguggagagugcaucugaauucauaggaggaaugaauggaucagauccuuuuaaaguguuacuaaucauguuguugccagggauucagacacagcagugucugguagugaaggcagguggcuucuagaaugggacaguuccugaaugugaguggccgucuccuagugccuuucucugucugcugugcacugagaaggaagggcccggcucauggagcuuuuggagcuuguguccuggcuugcuuucaucauuauucacauggggugaggucucaggaugcugugaaacagugaugcgcuuggacuugcuguucacaagaaacccggagggcguuguguuaggaggcuucacacugaaagcugaaucuguugcagcauucuguggagggacagauuagaugucccccgagcauugaagguaguaagcuuuugccuauggcugcauuagccuuugcugugagcaggugugugccacaccaagcugagcugcuuagcuuuucauaacuaugcagccuaguuuuaaaacguuaccuacuagcagguuguguuugcacgccuuuaagcccagcacggaggaggcagaggcaggcugaucuuugaguuggaggucacccuagucuacauaguaaguuccaugauagccagaguuauauguuaagacccugucacaaaccaacaaacaaacccaaaagauaaaaagguaccuauuucugucaucuuucuuauauuugcauacagaguuuagaauuucacauauauuccuguuggccagaaucuuaguagugagcaucugcccgaguuggugaggugugaagcugcagaaggcauucgggggcuuuggccauaauugaucaggacacaggcaguguugagaacuugccaaacucacuucugccuacuuagucacugccuccuaaugaaguggggcuguggucagaacagagcugugagcccugcucuacauaaaugaguggauuugcauaauccuaggcuccaugaguuuugcaaagcaucuguauuucuuuacuuuguguuauaaacaguacccuugucuauucugacagccugauguugcucuaugauguaguaacaagaaaaucacaauaaaagacaaaagacauugagaagugaagacuuuguucccuuagagaggucucagugugaccuaggcuuguuuccucugcuguaaccugccagguauggggaagggggugggcauggggaggggguaggcauguggaggugggguuaggggagucagggaguaggggagugaggauagaggggggaggaugagagaauguguaagauuccuggguguaguacauuuacagugaacaaaaucagaguucuguuacccucagcagguaagaaaaaaagauacagcaacuucaaccaaagaaauaaacugcaaccaaaacaguuucccccuucccaguuuccccuccacaaucccccuguccuuucccccuccccugccucuaugagggugcuccucuacccacccaccccucccaccccgcccaccucagugcccuagcauuccccuacccugggucauccagccuccauucagugaauucucuacuccuccaccccccaacccuccaaugugcagccuagguuggcccuaaagucauacauacagccaaggauagcuuugaacucugauucuucugcuucuguguccugagugcugggguuacaggugcgggccaccauaccugguucauacaggcaggcccucugccagcugagccacaucuccagcucgugaggugcauuugaaugaagagcuguauagacauacaauugcuggcaugucuucaugcuuagauuuugguugauuugggucuucagugaggaguuugugcuccccuuccccagaggaagcucucucuccucucugggcaguacucagacuuuugaccucugccuuggucuuaggacaauugggauuucagaugcccuccacugcauccaacccaugauuuccaaguggcuuggccugcuaaucugcauuuaaugcagcacugucuuugugguccaccaccuucucuacucaguucacucucucucuuccaggugucuuuuagcuuuucaguguuaaaguguuuaaaugcugaguguuuaaaaacaguuguaugaagccaguuguaugaagccaggcgugguggcacacgucuuuaaucccaggaggcagaggcaggagaauuucugaguucgaggccagccugguauacaaagugaguuccaggacagccaggguuauacagagaaacccugucucgaaaaaccaaaccaaaaaaaaaaaaaaacaaaaaaacaaaaaaacaaaacaauaacaacaacaaaaaaaaccaaaaccaaccccccccccaaaaaaaaacaaaccaguuguauguaagaugaacuauaggcuauuucuuccgaaugaaagauaacuuaagguuuggcuucucucucucucucccucucucccucucuccucccccucuccuucuuccucucugagauagggucucucuguuuagcccuggcugucccggaauucauucuguagaccaggcugaccucaaacucacagagauccgccugccucugccucccgagugcugggauuaaaggcgugcacugccacuguccagcugguuuggcuuuccuaaagccucuagaagaguauagaguucuauagggccauagcucagcauguaggaggcccuggguucagccgcagauaccaccaauacaacaagaagaaaaaacuuuauuuuuuguuuguuuuaauacauccugacugaaguuucccugccuucauuucucucauuucucccucccuccuccccucuccccuagauccacuccuucuccauuucccugcagaaaagagaaggcauagccaccaaaaaauuuuuaauacucaguauucagcccauuugagaaagguuuguguuaauaguuuauaucaguauuagaggaaagaagucaagauacaaucuugggguagcugggcuccagaagacucuucaggaagaguuacugucuguccuguggccagaaggaaguauacugaaccagccauacucgcacgagagaccgacuuccgccuuucuuuguugcuuuggugaccucagacauuuuuaaugugcacucgcauguuaugcauacagggaagcccagugaaggagaaagagagggagagaaugacagggcugaaaaagaggaccuagguuugguucccaacacccacauagugguagcucauaaacacacauauagacacuuacacacaacauaaaaauaaacuuguuuuaaagguauauuauggccuagcauagagucgcagaaaauaugugcuuugagaaauaguacaauagaccaugaccagaacaggcaugguggccaggcuucugcacuacucauugcucuuuuucagcccuugucuuucucucccucuuucuccuuccuuucuuucauccuucccuuuuucccuuucucucuucuccuccuuugucuuuucuucuuccuccucuuucucuucuuccuccccccucuuccucuuucucuccccccccuuuuuuuguagguuacccuggccauaacucacucugccgcucagcguggccucgaaugcaugacagucuuccucuagcuuccuaaggcacucugcccagcuugaaaaauauuuucuaagaauaaauuuguaggaguuggguuuguaugaaaggaaagcucacucuauguugacaagcuggucuuugugacguuugccaguuacacucucaggugccaacugaggccgccauguaugcuuguucuucuaggcugcaguuugcauugcccacuguugaguuacuaggacuguauaaaggcuacuaaauuuuaugcacuugugucuuuuuuuaaugugguagggaaagagaaguaugugagcagcuccugcugacuuggcuauaaaagaagccaugucuccuucccaggcuagcguagcugggggagagaagcuguaagggacagagagaugaugggcugcacuagugccaaggcagaggcacagcucuccugcuuaugcuguagccuucuaguguuuuuggccacuuguuuucauagcuggucuccauuaauauguacaguauauucagugacccuuccuaccaaucucuugcugcugcuuugacaacacagcaauauaguaaaaccaaaaaugucaucacuuaauauaaaauuauucaugcaaguuuauuuauuuaugaaugagauggcaucucauuauguagcuuugacuacaguagaauucagaccaggcaggccuugaacucagaguucaucuaccucuucucuccuuucugaggacuggauuaaauaaaaccucacagugccaccaugccuggauucuguauuauuuuuuugaaguccauauuaauuuacucuacaguuccucauccugucaguguuuggguccuugacuacaagacagacagacuccucuauuucucagugcaguguuccuuguagcauauucaaacaugauuuuugaaaaaggcaugagcuaacuagauccugcacguccuccucuggggucuagccugagaaguguaguucucaccuugcagcaagaaaaucuaucuuuguaacaaacagaaaucugcaaccaaugaaaaugcagaguuguggaacccagucccaguagauacauuggcaauacaacuccugcauguaaggcucagaaaucauugcagaagagaggguggacagaguguaagagccagaggcaaaggguuugcugugagggugugucucuugggaauaucagaagcuccauucauaaauccucgccaacacaaugccugaacacaagcuaaauaaggaggccaccaauagacacacuaacuuggaaagggaaaaacucaugaggccucagcuucaccaagaauuacaggcagcuaaagaaugcugacagcaggggaaagcgucuuuccugggaaaaagcacaggcuggugagauggcucaguggguaagagcacccgacugcucuucccaagguuggaaguucaaauccccagcaaccacaugguggcucacaaccacccguaaugagaucugaugcccucuucuggugcgucugaagacagcuacaguguacuuuacauauaauaaauaaauaaauaaauaaauaaauaaauagaaaaagcacaccaacuggcuauccaguaaguauauauuauauauauuuucuauaugcuucagaguuaagucuagaauuccuagugguagaaagucuagcugagcuagggaugguggcauacucuuuuaaucccaacauucagaagguggugaucucugugaguuugaggccagccuggucuacagagcuaguuccaggacagccagggcuacacaaagaaacaaaacagcaacaacaacaacaacagaaaacagggaccaguucucaggagucugaggcaugaggauuccugugaguucaagaccucaagucuugccuauguagcaagacacugucucagaaaacugaagagaaggucaaauauuauggcaugugcuuucauuucuguacuuucagcagagagagguagaucucugugaguugaaggccagccagccagggcuggacagagagagugucaccuagacagacccuaucucagucagucagucagucaaucgaucagucagucaaucaaucauucaauccauccauccaucccucccucccucccucccucccucccucccucccucccucccucccucccugaagaaagagagaaaagagaugaaguuagccugcugugguuaaaggguaaacgugugcuucugcaagcuggcacaguguguaaagcucuugccaccaagccauuuagguccuauaugguggaaggagaaaacuaacuccccagauuucucccugccuuccacagguguacuaucacacaaagcucaaguccuauagagaaauuaaugggugcaaucuuuuuuuuuuuuuuuuuuuuaaguaugauuaugagcacuggaaacaggcugaccaccaccugucucugggccucccuagccacaacccguuccugggucucccugggggcccucuuuccuguaggguaagaauuggaaggaguuugaaaggcugcugcauaacaggggauuugaggauugcuuuguguuacucagcaacuugaauuggaaaauguaaaacaauaaucugugugcuuugccacauauaauaaucccaaggcuugcuaaaggucaggaggccaacugcgugagacuuaagcugcagguacuauuacucugcugauugacuauuguuuguucgauacagaagcucucucuguagaccaggcuggccuagaacucacagagauucaccugccucuaccuccucagugcugagauuaaaggugugugucaccaugccggaccagucccugguucuugaugucuuuaguugaccagugcuaucuuaguacuuuuacaaagguccagacuuccccucuuccugccucuuuuaaggagaacuuuuauuaauuuauugugaacuguuguuguugugugacuuguuugagacagguccugucuggccuggacuugcuguagcacaccuguguuugccuccugggugcuggaguugcaccugggguuacaaguguaugcuagcaugccuagcuucuucagggagagucugagaaaugcuucccacucuccaguacagucuuuuagcuaaggaugaccuugaacuccugguucucuugccuuccaagugcuaggguuuuaaaugugcuaucaaucccucuuuauguuagaguccaaccugaguuuugugcuugcuagacaaacacuguauuaacugugcucucucuccauccugcuugguugguugguugguugguugguguaaaacagucucauacuguagcccagccuacccuggaacucacuauguaguucagggugcuucaaccuccaucauauccuacaaaauaguuguuuuuuuagaguuuaaaauggguaucuuuugcaaaaauaaaagcauuuucuuuccuuccauuugagauauuggcaguccuguuuggaauagaacuacauaccucuaugcauauuuaacagaaggaucuauuaaaaauaggucauuugaauaugccagcauuuuaaugugaugagaucugguguuagaaugugugcaaauugaauuuaucuaauguuuauucauaguuuuucuuuaaugaaggaauuaguauuucauuagcuuaagugagacaccaggacagcaauuuguaguaagggacucuuugugaugagcaggaaucuguacacaaaaugccacagaaugaagagugguagagaugcaguuuagcaucuuauuagagucauuacaaaaccugcucuguaccugggcaaagcagcccaugccuagacuauucccaaccucugggaggcagaggcagaacacucuggaguuucaaauuggcuugggcuacauaaagagauuugucagacagagaaagauaagaguugaggguguggacaaaagaacuuagaggaaaaacuguucugagaaaaaaaggaguagauuuuauauugcuagcaguuugggauuuucuuagugaaaagcugccuugggaaaaauggcauaugauaacaacagaagcuugucaucuuagcagacaguugcuaacagugcagggccugggagaagaugccaguuugcucuccuggcccucagccucuucccuugcugucaccuguccucccuaaguugcuauucugaauacuguugcuucaaacuguugugccuuuugugagcagcaccccuuuccauuagcugacaggaaggaugcgcucacucacaucugacauggcguugauugccuguguucuugguagcuugcucuuuauugcucuguuuccaccugguucccugcccuaccucagcccugcuacugcugcugcugcacauuugaaacaccucuggcauguggugguaggcucucaucccaggucagcucaucagagcauguugggaggcaccucaccaaaaguuaguuugggugaaagugaauggaucuggaaugccaagcaaaugugggcugugugcuaguguguacaagaacaaaggagcaacuaaaacuaaggagggaaagcagugccaugcucuggaaagucguacuggaaaggaagcaugccagaaauguaggucaguaagaauucuucuggcuuucuuccuuuauaguuuguccacaagccuguaagacaguuagaauuuauguguucacaagggaauuaacuuuacucgugugcccuuuaggcgccagcaauuauguugggaaccacaccauuaucaccccgcuuuagagagaucagugcaucucggcugagcugagcaagaguggaacagcacacagucacacagagauggggacaguugagccugccgugucucucucacuugguuccucucugccucaugcuguuucccuggguacagcaguaggagcugugacucaggcauagugugcugggucaagaacugaugugcacacaguacugcaaacuccaaaggcccuaccaguauuuacugguagaguuugugagguuugaaggguuuuguuuguuugguuugguuuggguuuuauuugguuggcuuucuguuuuuauagauggauacugaagaagguaguuguagcauuuuagucagcaggauuauguuuguaucugugagucucuucuggaucucuuggcuccuuuuccuuuauucuuuuuuuuuguuacgaacauucaguaacacuuucugugugccaggcccaguguuaggagcuagaguggucaguaauguagauaagaugcugacccuugaaacacccagacuguguaguugauugguauuauuauuccugcugagacaagugaguccaagccuacugauuucuuaguuugcugauacauauauguagauauacacaucuguggaugccgugugugugcgcgcgcguguguauacuuauacuuggcucuuuacauagugacuuuuuguuguuguuuguuuuggaaacgguuucucuguguggccuugggucugguacucacuuugaagaucaagcugacuuuaaacucacccaccugccucugccucccaaguucuuucuauagaguuaaugcuauuuguacagauuuggauuugacuguugaacugaaaggccugggaggugaguugugugggugcuuuacaagguuaaccuaccucgagguagaaggagguuugacugcugacaucugcauguguuguacaacuguuguuuguguguuaccccuuugccucuauguguuauaaauggagcuagugaacauagcugagaaugucuguggcucacaaagugugguagcccacacagcggcacgauuaggagguguggccuuguuggaggaagagugucacuguguaggcgggcuuuguauucaagcuccacucaguguggaagagaguucccuccuggcugccuguagaagccaggcuccuccuagcugccuucagaucaagacauagaauucuuagcucuuccugcaccaugucugccuggaugcugccaugcuucccacuauggugauaauggaccaaacuuuugacacugcaagccagccccaauuaaauguuuuccuuuauaaacauggucaugaugucuccuacagcaauaaaauucuaacuaagacaaaaagcuuuaguuuuucuccaguuccagaacuugagugggccagcccaucauuagacuguguaccaauucuugauaggcacuggaaaccucaagucuaacuauggaacagucuuuauaaggcaguuuauuuuggauuucauguuuuaagauaacaugccuguagcucaccuuuuuccccaaaguagguauuuuuugugagcuuggaaagaguauuguuauccuuaucugagauaugaccaagaggacugauggaggccagggagauggcccaguggguaacagugcaugcagggcaagccuacagccugugagccaucuaaaacuccacagagcuguccucugaccucagagaaugugcuguggcaucaguugucucuccacccccauaucaugcacacauacaaacauggucauaaagagucaaggggacgauaguguaaaacaccaguucuaaagauuuucagaauggcaugauggugaccuuugguaccacucaacuuccugcaaaucuauuuauuuauuuauuuauuuauagacaucugcuuaggcuguuugcuucagcagccuucugaccauuucauugaacuugcuaaaagagggaguuggacuuugacagaguaugaaguauuguuaaaccacaccacuaauaauguagucauagugaggacgcucuggaggucaggggaaagaccaccuagaugagaggaagcagcacugugcaggacaagggagaucuguguggaaacggcaguagggaacgguuucugggcaaaaguuggguauaaagccaggcuggcaggcaugcacagacaaaaagcccucugggaggcugggauggcugaacuguccugucuugcgaaacuucuuucgcaugugagcgaccuagggauuccucaagaugaaucuggcaguuuguaugggauuauguggacaagauaggagaggguagaaggaaacuggcacagacugagggaugcucucugaacucccuaguuuuggauuuccauugcugugaagagacaucaugaucacagcaacucuuaaagaggaaaacauuuaauugaggcuggcuuacauuuucagggguucagucuauaucaucauggcgggaagcgugguagcguccaagcagacauggugcuggugaaggagcugagaguucuacaacuugauacaaaggcagcaaggagaaacuggauuugcuucacacauaauugagaauuuaagaccucaaagcuccaccuccacagugacauacuuccucugauaaggccacaccuccuaauagugccauucccuauaggcuaagcagucacacaugucaguguaugggggccaaauuauuaauccaccauagaggcugagccaugcugggccagguugggaugagcaggucuuaggugaguccugaaacugucauuugaacagggagugcuagagcaaagaauuucagaggggaggagugggauuaggugugagaaaagugauugcagacaaagaauacagagcacacucucuauuugagcauuuuaauuguuaaacuuggcaauaaaaggacauuuuagggcuggagaaauggcucagcaguuaagagcacugacugcuuuuuccagagguccuaaguucaauucccagcaaccacaugguggcuuacaaucgucuguaaugggauauguuuuauguauaugaguacacuguugcucucuucagacacuccagaagagggcaucggaucucauuacauaugguugugggccaacaugugguugcugggaauugaacucaggaccucugguagagcagucggugcucuuauccgcuaagccaucucuccagcccuguaaugggaucugaugcccucuucuggugugucucugaagacagcugcaguguacucauauaaauaaaaaauaaauaaaucuuuaaaagaaaaaaaaaaaggggagcuagagaaaguacccaaggagcuaaaggggucugcaacccuauaggaggaacaacaauaugaacuaaccaguacccccagagcugugucucuaguugcauauguagcagaggauggccuaguuggccaucaaugggaggagaggcacuuggucuugcgaagauuauaugucccaguauaggagaaugccagggccaggaagcaggaguggguggauuggggaguaggccagggggggugggguauaggggacuuucgggauagcauuugaaauguaaaugaagaaaauauauaauaaaaaaaugggggaaaaaaaaaaagaaaaaaugucagccuccauggcuaacccuaaccccacauaaguggagcaugguggacacagaaaaagaauguuuuauuguauaaccauauggcuggcugaugccugagaagaccagaggagagugaugaauucccugaaacgggaguuacagauguguuuagccaucauguggacuaacccagguccucugcuagagcagcuaacacucuuuguuuguuuguuuugagacaggguuucuuuguauagccuuggcuguccuggaacucacuuuguagaccaggcugaccucaaacucagaaaucugccugccucugccucccgagugcugggauuaaaggugugcgccaccacagcccgacuccucuugaguuuuaaaggauugguccucucacuguuuagcucuuuguguuuuuguuugauuguugaugccucccaagugcuugcaaguguguacacccaagcuguuggguucauuuugcauuuguuucuuuuugauacgggguuucacacuauacagauuagacuggccuggaauuugucaaucucuugccucagccuggauuaaaagaucuugguuuggguuuggguuuucuguaguuugagacaggccaggccucauacggcauaaguuagccucuggcuuugaauuuuguuguuguuuugugacaggaucucauuuuacccaggcugaccuccagcucauuuuauaaccaaggauaaccuugacucuuuggucuuuuugccucuacucucaagcacuaggaucucuggucuggcaugccuggcaaauaugcauuuuuaaagcauuacuuaaaauguuuacugaggugaggacuaaugaauaugaugagauuaauaacuccauaugcagaacucuuaauucauacacacuuuuuuuuaaagauuuauuuauuuuauguagagaguacacuauagcugucuucagacacaccugaagaagacaucccauuacagaugguugugagcccccaugugguuguuggcaaaugaacucagguucucuggaagagcagccaguguucauaaccacugagccaucucuccaguccucauauacacuuuuaacauugaaaacaaucaagaauaguaaauguaguuucuucaguauuucugucaguaaauauugaguguuugugguaagguggaugcucuauugaggcuagaaaccaaauaugacuugauuuuuaaaacugguaagaagucuaaagaaacuggcucuguuacaaauucauguuuaaaagaguucagaugauugacaguucugaugcaaagcauguagaagccacuaggaagccggaagcugaaagccgaaagccggauuuguagaccaguauaguguacccuacaaguucuacuccuuaagggaguuguuauuguacaugcauguacauguacuugagugccauaaaagggcaucagaucccauuacaaaugguugugagucaccaugugguugcugggaauugaacucaggaccucuggaagaacagccagugcccuuaacugcugaccagucucuccaguccuggaugagaaagguuuuuuucuuuuuuguuuuuuuuuuguuuuuuguuuuuuuuuuucgagacaggguuucucuguauagcccuggcuguccuggaacucacuuuguagaccaggcuggccucgaacucagaaauccgccugccucugccuccugagugcugggguuaaaggcgugcaccaccacgcucggcaagaaaguuuuaaaguugguccuauaccacucuugggacauacagaaacacagcugaauccuaggucaugauaauguauaaacguaauccuggggcuggggauaaggcucagggaguaagagaguguauggccuuucagaggaccuggcucgcuccuuggagguuacagugaugagugcucuagucccaguggaucugaugcccucuggccucaauagguauuguaucacauggggcacaggugugcauacaggcaaaucaccuguacacaugaaauaaaaauaaaucuuaaagaacuaaaaauucugaagccaugcaagugcuuaaucauuuagacuuuguggcauuacuaaagugcuugggaacuuggauaaacugaggagcacagaguuguagccaagagaaccauugggucuuaaaagugacuggcaggauuccugaaggugaccauggagacuacuguagcuaagggcauggcacaggaaagcggcaaaaagaggcucuguccacugaggcuuggcauagugguacagaguaacugaagguagaggggaacacugggccaugacccugcagcccuccacaguuucuucucagacaugaaaugggcuaauggugucaaguucccaguguggggcugcugugcaggaagugcucaguaaagagaacugcugcucugugaaagaagagggggguguggcaaacaggagguuuaugcuuggauuaggacaggagaaagcugucaaggggaagguuagguuaaagcugagugugcacuucacuuugcaagguugaaagucgaaacuuucccuuucugcuagauggccuggagcugggaagccaucuaccagagaguaaugaccucuugaaucggggcagaggcuggcucaggaagugacaucugcuauuaguaucacacgcacaguggagaggaaguaggacagaaauacacagagcuaggugauuggcuguugagaggagacaaucugggagacagccaugcugcuugaacuggcagacugugguggccuucucuucugccuaggcuagauuccagagaucucgaguaccauacauaguagaguccaugaaguauuagaaaagggacuucuguauauggagagucaguucaggcuucacaguaacucugcuugggguagguagcgcagcacuaguauguaugccauuaggggggaggagcuuucacugaagaguagccugaggcaggagagagcaagugucuuaggguccagcugugugguccugaguucaauucccagcaaccacaugguggcucacaaccaucuguaaugguaucugaugcccucuuauagcacacagguaugcaugcauauagaguacuccuauacuuuaaauaaguuuuaaaaaacaaaacaaaacaacaacaacaacaaaaauaccuuucucauccaucuuucuuguuaauuuuuggggguaaggaugacugugguuuugagauaggggugcaaaauguagcccugacuauccuggaauugcucuguagaccagccuggccugaaauucagagaucaccugcuucugucuucugucucccagaugcuaggauuaaagguguguaccaccacugccugacuccaauuguuaguuuaaacaaacaaaaacaaaaguuagacaggccagccuaguccacagagaaacccugucucaaaaagucaaaaaaccaaaaaacaaaaaacaaaaaaaacccaaaccaaaccaaaccaaaccaaaaacuggacuggagagauggcucagaggcuaaaaguauuugcugcucuuccagaggacuuugauuugauucccaggacccauacuggggcacacaaccuaauuccaguuccagggcaucuaaugcccucuucuggccuccucaggcaugcaugugauauaugugagacauguaugagacaaacuguuacauaacauauuuucuaaaaacaguaacugagucauuugaguguucuucucuagcugccgguuguauuauuucacccauuuuuccuugugccgcugucuucauuguugugggguggcuuacuuacgcuguuuccucagucuucuucccucagccucgugggucccuaggugcuuucugcugcugguccucagacuccguacagcugcccuguguccucauccguccccccugcggcaaggccagcgcuggcccuuuuguuugagccaguguucaccauacacuucagugcugucuccugcgcauguuucccuguucugugcuccacucugaguccgcagugggugggacagaaagucucacuguguuuuugauugguuuguguuuugaggcaagaucucaccauguguggccccaaacucugagaucugaccucugccucaaacgcugggaguaaaggugugcaucuuaucuguaccuuacuagaggugagcugggaagguagccugccucuuuugugcugagcuuccaggacagcaugucccucuuguguccuaacuaugaaauccacaguuuccagcuuacucuuagucacaauucugaaguccucuuuucuauuaaguauuuuauuugagagucaaacacaauaaaucauacaguaucacaggcccuuuuggaagaaaagagggcacugggcucuguggguucgcagugaugccuggggugaagaggaagugagaauagauagacgugcugaagagagacugucuccauuggugcuuuuaucuuccccuuuuuaguuacuuacuuuaaaggugucugucugugucugugugguguggaaaggcucacuaggcuuggcagcaagcaccuguaccccugagccaucucgcuagcucaguaugacauucacacauagcggcuaugcccugcugagucaacagaaacagcccaucacacugcgcuugcaugggacacuucuuagagaaaauaugcuuuuuguaaaagaaaggaaaccugccagucugcauucaauccccaugacccgggcaggagaagccgaaggaagccgagccccgacuugcuuaacuuguacaugucucuugcggguguacacguaauaaaugaaaaacaaaaaacaggcacacucucauuccagcgcucaggaggcagagacaggcgaaccucuguaaguccaaggcuaaccaggucuacagccagggcaacacagaaaaccugucucaaaaagaaaaaaaagauuaaugggggaguuggggacccauugaaaagccacuuuuaacucgagccagaaacuguuugcuuuugaccuuggaauguauuagauguauuuucuccuugucugcuuauggucagcagaccugggauccaaauccagcuccgacauuugccaggugggacaaugacuuaaaaguggugacagcagagaaggaagccuuaugugacugacuccagcagugcuucucagaucuuggggcaucggaucaccugaggggccugucaaacuucagcucaggggcuacucccaucauuucuagagcagggucugcagcagggcuugagaguguguucugagcugccuggcagucuguagaccacagcugaguaaguucuaguuagguaacugaggagugggcguucagugaguaguccugcccgagcuuacuguguuagaacucuuggaaugcauucggaagugugggauuuagggucaaagagguuuuccuucugaaauucaggagucauugcuucauguauuugaaggagggaaaguuguggaaaugacaguuaugaaugaguauuuuauaguuagccuaucuaacuggcuacaugugugaaauuguuuuuguaaaauaugcagugaauguuaaagucacaauucaagcaguauuuugaauaacuuuguuuaaaaguuguauuucauaaugggauauaaaguaguuuaccuuagccuucucaccuuagugugcuguguacuuaauacuguucucuucccuccaggcugccgaccugaguaaacccauagauaagaggauauacaaagggacgcagcccacuugccaugacuucaaccuccucacagcuacagcagagagcgucucucuccuagugggcuuuuccgcaggccaaguccagcuuauagacccaaucaagaaagagaccagcaagcuguuuaaugaggaaguaaguagcgcugcaccucagccguggaggagcugugagaguucuguguucuuacucagagggagccggccuuuucacaguuugagcuaagcccaguuuucauuugcucagcugucuuuaccuagaguuaugcaaguuuaaaugugguagauuaauuaauguugcaaaugugucuuuccuuggaguaacuguuuugugcauuuguacagagaaugaucagcagucuacagcagguacuuuaaaacccuucuguauuggggugagggagguggcuuggggggggguguaaagugauacuuuugauuuucagcccccacauagaaagccaggcauggccacguguaucuuucauuccaguccugggaagcggagacugaaggaucccugggaucagcuagucuagaugagucaggugagccccaguuucagugagagacccugguguuuguuuauuuaaaagcagacaguagaggaagcugcagcauguugaccucuggucuaugcggacauacguguccauacacaugcaucaccuguggaaugggggaggggacgacaagauuacuucaaacuuaagaugugauuuuggauuuuuugcugcuguuaugucuuuuuuuuuuuugagacugggcuuugcuguguaacccugacuggucuggaacucauuaugaagaccaagauggacuggaacucacauugauccuucugucguugccucccaaguucugggauugaaggcaugcaccaccauacccagcucuugauauguauaguaaaaaauagagaauuccagacauuguucacaucauuggauaguuucauacagauggaaugaaaugacauaguggugacauguccucaggcugcucaaauuacaguuuaagcuucuguguguguauuugguaggcauuuagcuaagggguagcuuucaugcucuugaaaauauuucuuauacaguuaccugaaaugguuagaccuaaaagugaaucaagaaacacagguuuugcaguguuguuugcacuagggucuugggcacaucuucaguucuguucagagaggaacuugagcugucugaccuauccguuaggaauauaucaggacuuauacagagcagacagaaguuggcaaauagauuguauuuacucaggcuguuacgguggcuuuucaguuccaaguaguagcguguauuuggcacuuuuccucuucuguuucaguaugacuuuccuaggaaguggcagagaugcagcacccuugcugagguggacacucuggguucuaauuuccaccuuguugcgcagccuuugaggaaagguuguauuacaugggcuucacaucagaaggaugcauccuuugccaugcugcuugguuucaauaucauguacauggagcagggaugugcucucaauucuagguuguaagaagugauuuucagaaggagaaggauagccucgaacuugauacacagcagccagagcucuaauucucuguagucuuuauggcagaugcugucugcaguccacgaucauucuggguccuucuggguugauugggaauaaacuuucccuuugaauugacaguuaaagagaaaaacuauuuggcccuauuuucccuuuaaaaaaaaaaaccuuaaucagaaaagaauguuuacccagauuuuuucacugaugucaucugauuuguaaguagcugagugauuugguuuuuuauuuuuuuguuuuuauggggacuugaggacgacagcaaugugggaggcacagaguugcuuuucucugcucuguuaacagaagcuggaguuggagucauugugggacuuuguguuuggguagaagagcgugugauggagugggaauugauugaacccuuugccaaguuguugguaaacaagacccagaggcaguucugaccgaggauggcacagaaugccacucagagaacaagaaagggcugugugcugugcugggggagggcacauggcuuuaagaauacucuggcaacaucagugauggagcugcaggacagaaggcggcuccucccucuucacgauggaagcacacguuccugccuacucuuugauugcgguucaaaccggcuacucagaaugcuagggcuacuguuuaugcuuuaaugccagguuggcauuuggagcugaaaauugaaaagugaauugucuucacaagucuuagugauaugaguccauuucucaggcacgagggcugcgagaguuucucagaguggcaggaauguuggaaaaaggugucccuguguguauguucagcuauacucagcaucagugugugagauggggguucugggacagguacauaggaggggaaaaggggggucuucacuuuacagaugaagagaucuuuaaaggggugcugagugccuugaccacgucagguagcaaguucauagagcuaucaugauagagcuggaaucagaaauuaacuccagaaacucucugccugguucagccuggccuucucagcagcucaguuagucaggauggugagggagacuguaggccuguugccaccgccacagcagugagggucagguggcauaaguacugcauguguucauucuuuuguuuuucacauggagaucagacuggccuagaacucacuuuguagaccaggcuagccuugaacuuacagagcuccaucugcuucugcuucccaagggcugggaucaaagauaugucccaccacacccaacacauguauucuuuaaugugucaaauaaagacuguuuuaaaacuuacuuaauauauguacaugagugcuuugccuacacuugugucugugcaccacauucauccccuggaacugaaguuacagacaguuauuaccaacagauggguggugggcacccaacugguccuuugcaagcuuuuggccacugaagcauuuuccuagacaucccccacccccacccccuucuuuggccagaagcaugggguagcucauugugaggcugaggacugagguagaaggaucucuaauuugaagccagccugggcugcacagauaaccucuaucuugagaaaaauaagaauggaggaagauaagaguuagguuccgagaaggggucugagagguucuuccagaauauaauacugcucugggucuuggggcacuugugagggcaggaaggaggcaaggguacccugcaaacugaagaaauggagccaggcauggggcuaugugccugaaaucccagccugggcuucagaacaaggcccugucuaaaaaaaacaaaucagaacaaaaacagaacuucucugucauugucauuuacuagaacaucaaaugacaacagagugaagucaccgggugguauagcagcagucaucagaaagaggaguuacagccaaauuauuuauguccugcugagagauuuggacuggggggggggggcuuuuaaucaaagaucaaauguguuuuuuuaaauaucacuuuuagaagguggaucguagugaaggaagagacaaugaagguacuagugaguguccaggugagagcagggggcuugaacuagucuuuuuuuuuuuaauuuuuuuauuagauauuuucuucauuuacauuucaaaugcuaucccaaaaguccccuauacccucccccugcccugcuccccugcccacucacucccacuucuuaacccuggcguuccccuguacuggggcauauaaaguuugcuagaccaaggagccucucuucccaaugauggccgacuaggccaucuucugcuacauaugcagcuagagacacgaguucuagggguacugauuaguucauauuguuguuccacuuguaggguuacagaccccuucagcucuuggguaccuucucuagcuccuacauuggcggcccuguguuccauccuauagaugacugugagcauccauuucuguauuugccacgcacuggcaaagccucacaagacacuauaucaggguccuuucagcaaaaccuugcuggcauaugcaauagugucugcauuugguggcugauuaugggauggaccccugggugaggcagucucugguugguccauccuuucaucuuagcucuaaaguuugucuaugcaacuccuuccauggauauuuuauucccagaaaucagucuggcgguuccucagaaagcuggacauaguacuaccgguagauucagcaauaccucuccugggcauauacccagaagauuuuccaacugguaauaaggacacaugcuccacuauguucauagcagccuuauuuauuuauuuauuuauuauuauuauuauuauuauuauuauuauuauuauuauuauuauuauuauauuuugucuuuuuugagacaggguuucucuguguagcccuggcuguccuggaacucacuuuguagaccaggcuggccuugaacucaaaaaucugccugccucugccuccagagugcugggauuaaaggcgugugccaccaccgcccggcagcagccuuauuuauaauagccagaagcuggaaagaacccagaugucccucaauagaggaauggauacagaaaauguggugcauuuacacaauggaguacuacucagcuauuaaaaacaaugaauuuaugaaauucuugggcaaauggauguaucuggaggaugucauccagagugagguaaaaucccaaucacaaaagaagucacuugauaugcacucacugauaaguggauauuagcccagaaagcuagaauacccaagauacaacuuccaaaacacaagaaaaucaagaaggaagaccaacgcguggauauuucauuccucccuagaauagggacuaaaauaucuauggaaggaggaacuagacuuuugacaguucuuuugcucaucagcagaccuugaccaccugcagcagcagauuaacccugcccuuuguccucccucuuggaggagagagguauaaauagcaguagcacccacacacacugcuggcuacacaggggcccauugugggacaggaagaggugcagaugagaaguucugucagaacaaguggugugcuucaaggugggccucucaggaggaggaggaggaggccacaaacauaaggaguuagagacaggccauuucugcaguagggguggcagguaaaccauuugggauagaaaacagcacagaacggggaaccaagacaacggcuucuaggcagagcagugugaggugggaaugagcaugcagggccucguccaggcagaguugcuuaaagaagccuggaucaaaggggauggaaagacaaucagauuguugggguuauuuuuaaagauccuucccucccuccuucccucuccccccuuugucucugugaggucauugccugaggaggccagaagagggcaucaaguucccugaagauggaguuacaggcaguugggagcugaugggggcgcugggaagccccugagcuuauuuuccaguuuccagcucuuuggggcgcuuacugugguuccuucuuagaacugaacugaguuggagggaggcgugaauaaguuuaagguucugccugucacuacacugagugagaauggaaagggagggagggugcauuuuguacuugguuuaagaaaccugcagcuacuucaaguauggaucugaagggcagguuuucuguugguugguugauagguuugcuaaguagggaaauagaugggcaaggugacuuagagaguacaguugccacguuggaugacuugaguuccaucucuggaacgcacguugugaaaggagaaccagcuuacacucugacacacgcacacacaaaacaaacaaguaauacauacauguaaugaaauuuaagaaaggauaaaaacuugagguuugccagcaugugaacacagcucugagaauccaugcaagggucuguggggagaguauucuaggaguaaaaaggcgccugagacggagcugacugcgcuccaggacuguagcccucucaugccguuccucagaacaccagacaaccagauagugccccacagcagcaaauucaguaguaccuagacacagaugcacaccugccaacagaggaggguucaaaacaacuguuugcaugcuguggucugugccucaccucuccucagcugcugggugggaagaacaagauuggagcagauauuguagaaugaauuugaaggauaaagggguuuugggguuuuuguuuaauuuuguagggcagagacccaccauugguaaggcagaguggccugcuugucaaagccauguggucucuuuguaucuuccucacuagaucccuucccugccuaccugcuacuacauucaugguacacaguugcaugccucaguucugaugucugguacugguacauaagacuuucagaugugugaagaaaaugcaauuguaaguucuucauauguacuggaaauaaaaauagauaacauuuuuauaucugaaaacaaguauaauuucaaagguaauauuuuuugccugcaaauuagaacuguaagaauuuuaagugcuuguuuauagaaaaacuagaaaauagaaaagccaggaaaacaucaccuauaaauccuagugcuuacuguuaaccaucauagucucccucuuucccucccucucucucucccucucccccccucugauuuuucuuuuuuguauugggggugguggugguugguuuuuuuuuguuuguuugauuuucaagacagaguuucucuguauaacagcccugacuguucaggaacuuacucuguagaccaggcuggccucaaacuuacagagauccaucugccuccaucucccagugcuaggaucaaaggcgugacguaccuugccuggcuuccuccuuucuuuguuaauggggcaauaacuggagguuucccacuuuucuguagagaggccugcuggccuugagucugccccugguuccuccaggacugaacagaagggagcccuggcacugucuuguuccuaguguugggccuauucccagacacugcagagacucguggaguucugcccacuucugaccagaaggaaggggaaauacccaguccuucuagacucuugugggaagugaaguccucggcucccucuugccucucccuuuucuaguuucuuaaaguagaucugaggucccuguuuauuguuaccuguauguguauugccacacaguucaucaacaagaugguggugucuacccagacguugugaucaggguuucuggcuugcuggagcacccaagagugaguuuguuaacuacuggcuauauguuggggaagaaguguuacaaagggacaccuguuauaauaaccaaauuuuucuuuguaaaaauucugauuugggguauauacacaggauggugacuuaaaggaauuuugaaaguauuuuuguuugcuuguuugcuugcuugguuuuggguuuugagacagggucucucuguguagcucuggcuguucuggaacucacuucguagaccaggcuggccucugccucccccaguacugggauuaaaagcauguacaacuacugcccaacuugaaaguguuuuuuuuuuuuuuaaauauuauguauuaauaaugcauuuauaauaauggcauuuucuuuuuuaaagauuuauucgugugugucuaugcauguaugugcauguucauaccuccucuuggaggucagaaucgagugacagaauccugacaaguaagucuuuaagacuaacaacaaaaaggaaagcacaggugcgggaaucaguccccacgcaugggcggcucuuucccucccagcuucccuucuccagccuguucacucacuuuacuguaauguguggguguuugcuuguguguaaacuggaccaugugcaugucucaggccuuuggaguccagaagaaggccuuagaucuucuggagcugugagccaccaugugugugcugggaauugagucccuguccacuaggagaguaggcagugugcuuaacugcucagccaucucucggucucucugccccuuucuucucuguucccugagccuugggacaggggauagagauguccuacuuaugacggggcauuccccaccauuuauucucuguaguuugacaacuacaagggaauuuuaaguuauguuuugauugugguaagccauaaaauauaaaagagcuuguuaucuuggcuacuuuuauuacugauauuaggacccucuguucuaaacuuugaggccaaagcaggcacacguguccuguguuucgaucaagucuagcuugauuguguguguguguguguguguguguguguguguguguguguguguguuguauguuguguguguguguuggggaggagauggguuauggacggggugauacucccaguucaguuagaguccuccugucuggggacuccaggagcgggaccugcugugcagugcucuaucugacugguucugauguuuaagagugggcugcauuaugucaguuugguuuuguugcuuuuuuuaacugaagaaaugaaaugaguacacagugaucgacuucuuaaaguuuuaacauugguaaaaaugauaucugauccuuucuugguggcuuuaaaaauaccauuuucuaauauaagccuucucugggugagcuucaggccucuccacuuacaucuguuuugcuuuuuguguguguauguguauuuuuauuuuaugucguuuuuaauaguuuuuuuuuaaagauuauuuauuuauuuauuuauuuauuauauguaaguacacuguagcugucuucagacacuccagaagagggagucagaucucauuaugggugguuguaagccaccaugugguugcugggauuugaacuucgaaccuucggaagagcagucgggugcucuuacccacugagccaucucaccagccccuaauaguuuuuuaaaauauuauuauaaauuaaugucuguguaguagaaugcauacccacccccaaauauuuuuccuacuuguccuguugguagaauaagacaaaauaaaagugaaugaaaugcuucagaaagcuucaggucacauuaauuaucauugauguggcuacagauagguuuccuugugaugacccagggacucuccugcuaaugcagugggcagaugcguuuuucuuacuuggugugauuuuuuuuuuccuugaguuacuuugagcaaguccaaagugagcuugcucgaggcugagggagacggugagcucuggcaaguggucaggaccauggagaaccuagagcuugagcccugcccugugcucacaaaaacgucaggguucugcuguggugugggcaugaaaugaguuggguuuuucuuguguucacaaagugguuuugaagacgggcuuuaguccuuaggaagccggcuguuuaauggagagcucuguggucaguauaguaaaaaaugaccagauggccuuguugugcacccucuggguagaguuuuccagaggucuacauuccaccaugcuucauuggagaccccaggaugucacaggcucguguugcucccaaugcugccuugcuugacuuuucugcucauucucagcacaggcguaacuuggggucuuuauacccuucuccccuucuccccacccccacaugucaccucuguucauggccuccuaaccaguucauccccacuugaccuuccauuccgucccuucugcugagggaguccaccuuguucugucccaucccuuuucagagccuuugaugauccugucugcagugguguggacgucaagggauacagagugagcuguagguaugcacucgcaguuucaaagggugaaaaccaggugaaauuaacuuuaagaauauauuguauuuuaucucauacacucaaauauuuuacuguacaauguaaaaacaaggaauaagaugauuggcauuccuuuccauccuacaacugcagaauccaguguguguuuugcauuuacaaugcaucuccuuugaggccagcaacaaggaaggggcaguauagggcuccagggccagagcauggcuccauccugggaccuuagucacagcccugugucccacgugauuguuacuccaggugcuccagccguuuucagcuucucagcugcugugugagagccugggccggcccuuuugcuucugucuccccgccuaccucuguacaguacuaauuacauacagaaauaggguuuugcugggacagcuuuccaaaugcuuaucuaaaugaggguuugcuccugugagagcccagaaccaacgacaagaucccaccaccuaaugcuggcuucuaacaggaaucuaucauuuuuuucagcagauguuuucugaaauaaaaacaugaccuuuuugguguagaggcugggcuguguaaaauuguguuuuguuuuguuuuugagacagucuugccagguccucuuagcuggccugggacucccuguggagcguaacuaccauccauacauucucuuugaaaauuuaauucuuacauuuauaggauaaacuauuccagguguuugcuuauuuauuugaaagcugggcauaggacacuuuuuguucucuuuguuacacucaaaguaauaauaaccuagaacaacuggaauuggugacucuguggugagggggcugcauuucccacuuggcuguggugucagcuaggccaacacucuguugcagggaaccuuugcuggugaccacggcaggcugggcuugagaccagcucacauuuuaccaugggacacaaggcagcuaaccauguuggagccacucucagaagcacacugcuacuguaacagccucuuaagugccugcaucugucccagcuagucccaggucuugucagcauaccuugugcccgccucccuguuuuguccacugaccccuaccagauuaagaggcaucuucuagcugcccuccacccagccuuuccaucaucaccccacaucgacuaugugaaaugggauggcaguuuuaauggaugcuguaugagugccugacaggacacagugcugagugaggaugugaaugggugugacuucagacaaguuugcugaccuuugaacuucuguuucuucaagggcucuaccuuuugauagggaaaguaggcucuggagggaacaaaauuuguuacagucucugugagaggcgauuaggcugccccugugcacaguaggagcuuccagcaucagcugucuaucugugugauuuguaaucucagaagauuucugaaauuauagguugcaucacugaaugggaaagcagaggugagaguugugcugucucuggcaguuaugaggucaugcaccauggauagaugagcuaaucccaguugguccugaguacagaggaggaggccaagagaggcuuucugcugaagucaugcacauguguuaugagugccuucacuguggagggguuguuuggagcauuauagcgugaauguaaagccucuugccaugcugugccccuuggguguggucugucacugcucacacuggugugcucaguucccagggccggaacguaacagugaggauggcauaccgcagcacgugguauggagaguuuucucugucacuuacaugcacacauuguuuagggugaccguagugcacacuucugguucgugagugagacugcccuguaaugcuucuggucacugcaguagcgccacuaaaggcacuguugcugugucgguugggcagucacacuuuuggcugcacuuucuuaccaggauuacauuuuuugaguuacaguaaaauuuuuccauuguaguuuaaggcuguaguuaaaaauuuacuccuaauccuccugcuagaagcuuucgugaccuucaacuuucucaccuguaguagaguaauagugcuuggggaaguggacucggaucagccagcagugcggcucuaacccagcccucccugcacagggaauccacaccuuuagaacaugcccaucugccauagucauguccccgggugcagagugaggagugccggggcaacaugaccuaguggacacacagagacucagcgugagccuucaggcuccggagagcuggaugucucuucauuucuucauccuccuaauauccucuuucccuaaagcuauggucuagccuugaaaaugaccagagcccuugcuaagaaauuaugauggccuaauggaaucuugcagaguagugcuagguguucaggcuacugacauuagcauacggcaggucaccaagcaggaaacaggagucagggaacaacaaacaaacaaacaaacaacaguauccccaaaggcaguacuuacuggucuaagaugccagucauguucugugccaguagcagugguagcugauacucugccuaaaccuaagaacuuggagcuccaggccuccaugcuguggauagacuuuuagggucccaaguauuccugccagugauuuguuaguagucuauuucuugcaaggucuuuucuuuuugcaugagcuugcauuucuuuucuguccuguccuuuaucauuguucuuacugcuguugcucauaacgcuguguaugagacccagauccucaugcagguggcaccccagcuucuguucuuuauuuuuucuuaaaucacaucauuuaauuucuauaauuuuuuguaaaaaaaauugcuuuaacauggucaucagaccaauugggcagauggcuauagcucaagcccauagcagugugcccugagauucauguuggggaaccccagccaguuaggcaaaacggaagugcuuaagcguuucuaggcugacccaguaaagaguguaggcuuaacagagacugccuggcagcuguguggcaggauugggaauugguuauuucugguaaugugauuuugagacuacagccuguagaggguguguguccuagugagcccuaucgcagggucugcacagagaagaaggcuaccccuucuguauaucuugaguggcguucaugucuggcuuucguuaguuugguuuuaaagacaagacacugauacaagcagcuaaagaggcagcuaggucaguggaccagaggugagcacugaacacaaugguagugguagagcagacuccugagcuaaccuccauccuguuccagagagaaugaggagauguggguaagacacucacaguucaucgucuggauugaggaaagccacagugaguccagagcugcauccugcccacccaggaaguaugcuuucaaguucuguguucugcuggucacaggcuacgaugauuccuugcccuugagcagccacaaaaagggacaauguagucagcccauggccugcagugacaaaggcaaagaaagcugugaggacugaaacucguccucugaguccucaucgagaggaagcugcuguaguugaagcaaaacauugagccgccccugccaucaggggcaaaggcugucuugccccugugugcccgggaccugauaccuggcacagaguaggcucucagcagguaguuaucaaaugacugacacccaagugcaguucugggaugggccacaugugcuucacuggccugccugacaaaguguggagugccuggauggaccauuaccuucuuaccaagaagcagacagguuuuuuucuggaaaaguagaccuuaacuucuccauugugauaacguguucucuuugucuucacagagacuaauagacaagucccgcguaaccugugucaaauggguuccugguucggaaagccuuuuccuaguagcccauucaagugggaacauguacuuauauaauguggagcacacuuguggcaccacagccccccacuaccagcuccugaagcagggagaaagcuuugccgugcacacuugcaagagcaaauccacgaggaacccucuccuuaaguggacggugggcgagggggcccucaacgaguuugcuuucuccccagauggcaaguucuuagcgugugugagccaggacggguuucugcguguguucaacuuugacucaguggagcugcacgguacaaugaaaagcuacuuugggggcuugcuuugugugugcuggagcccagauggcaaguacauugugacagguggagaggacgacuuggugacagucugguccuuucuagacugccgaguaauagcuagaggccaugggcacaaauccugggucaguguuguagcauuugaucccuauacuacuaguguagaagaaagugacccuauggaguuuaguggcagugacgaggacuuccaggaccuucuucauuuuggcagagaucgagcgaacaguacacagucuaggcuauccaaacggaacucuacagacagucgcccuguaaguguuacguaucgguuugguucggugggccaggauacacagcuguguuuaugggaccuuacagaagacauccuuuucccucaccagccccucucaagagcaaggacacauacaaacguuaugaaugccacaaguccgccugccggaagcaaugggaacagugucacuacaccugggaacucugugcccccuccauugccacgguccaauagccuuccacauucagcagucuccaaugcugcuagcaaaggcagcgucauggacggggccauugccuccggggucagcaaguuugcaacucugucgcuacaugaccggaaggagagacaccacgagaaagaccauaaacgaaaccauaguaugggacacauuuccagcaagagcagugauaaacugaaccuaguuacuaaagccaaaacggacccagcuaaaacucuggggacaucccuguguccucggauggaagauguucccuuguuagagccacugaucuguaaaaagauagcucaugaaagacugacgguauugguuuuucuugaagacuguauagucacugcuugucaggagggauuuauuugcacaugggcaaggcccgguaaagugguaaguuuuaauccuuaaugcugcaccagaucuagaacuugacuagguagugauuuuuauuucuugugggaggggugggauguacaaugaaugugaaugacacuucuuaauguaaaucuaaaugcaucagagccauaauuuuggauacugcaugccauguaauucugaaucauuugauaauucaccuuagagcauuuaaaaaauauauaaucagacuaauugccagccaagucaaucaucccucuggguauauagagucccaaaguuagcgcuccuguaugaggcuauuucaguuuuagggaaaucaugacaguguggagaaauaaugacauuaaaaugcuaaagucaaaauuuaugcuuuaacugggauauuuuuugcguaaccacucaacuagauuauuguauaccuggucaguguaugucaguacacauggguauuaauuaucauuuauaguccaacuuuuuaucuuaaauuauaaaauaacuuaggaauuuaugaaaguuaacuuaggaacaaagcauucaucaggguugauugauauuauuuuuacauugucuggcaauccacagaaagagaagagccuuaauuuuuaaaacccauuuuagucauuuuaugacaauuaaaauuguuuaauaaacaucuuuuuucaaagaagcaguuuguagaacucugauucaaauugugcacuaaaguccccacguguuccggagcugggcaguuuagauguucgguggccaaggacagcagccacggcuuucagaaggccucccucuugccacaucagcuaagacucacauguuagaugcacauacuuaguuuuuccccaacagcagaagagagggucugacuguuuuguuguauggagugggaggggcaggaaguuggcuggaagccaaggacagguuccucuguucugcucugugaggacuguuagguguccaggcugcagcgugccuccugacuuggcauuugguggguucaggucccccaggggaaaagcacaaagacacacacacacacacacacagccgucauguucuuguacagcagcugagaguccaggacucuuggagacagcacugcuguaggacucagauccuacccugagugccaccccucccuuagcccguguccucaggagcagugcugggucaacugccccuguggcaguuugcuuucagcuccuuagguccagcucagcugcucaaggaauuucuuuucaaacaccaguuuucacaguggaggauaguuccuugagcuggguauuuuguaucaaaaugauaguuauuuuauuucuuaauuuauuuagaacauuuaggauuauuuuucuguguuguacaccuuuguaguuaaauauagcaguaaugaucguuuguauugagucuagagugaacuuggcucaguaaugaagacuuggcuuuuaugucuccaagguaucaagacucugguagacaguggucagcuacuggcuucccuuuccagaaauccaggccauaucccaggccccuucccuugcucuuacauguucaugguggaucugggcgccccccauuccuaucccccccccccccaagaaguggcugcuguuuaaugugguagccaccgaaacauucugccuaugagaugguggcagucuccagcguaucucaccugugugccaaggcauuucauguuguuccaugagcaacuaacucuucacaaggguacucaugucccaucuacccuggaaauugacuccuuuguucguaggguucugaucugagguagcaaagacugcugcuauauagacuuucagaacuucagagaucaaauugagcugcugggugggcaggcuagaaauaaaacacucugugcaguuucugagauauugucaaaugcuucggagucauugaguaugcaguuuccaaauucaagacuguguguuuggccuaaauagggaguggccagucauagguaaguaacguuuauggugaagcauaugguggucucucaguuugaggguaucuuugcuggcagggggccauugcauguguaucuguggacccagcacagaugaugggagcuuacagaugcccuguccugguagcauuccuagacccaugagcugggaucaaggggaaauagauaggaugcugacagugacucgaaucacucgcuagugggaagcgggggagguagaacaggguggaaacuacuuucuuuaaagggggaaagaaaagacccugcugauguugucggauggagaccuaugaauucucuucugcauccccauaaaaacgucacaguuugugauuugggguuuagucacaguauauuucaacuucugcugcuaaguguuguguccuuaaugauuaaccuggaaacccuguuugggguccuuugcugugugugugucuuacccuccugggcucccugcuagguucagggucugguaagagcccaggccagcucuagagggcugucuuaguugcaugaccuggcccaggcuggccccugcauggagggcguggugcugcuccaggcccgcucuaccccccugacugacuccugccccccuuucuuugacagccggcagagcaguucugcaggcaggaggacagagugcaagguguucuccaagaccagaacuaaaggugcggcagcuccagaagagggugcuggugcuggagggcggggcuuccuuccuccuugugcccugcagacagaggugguggggugucaugggguugcaccgauugccaugguggguccugaucuccaaagaaugaggacuagggccacugugcuucuacaguagccacccagagaaauguuuuuaguuuucuaaacaaacuuugagcuuccucaucaaaacuucccugagcguuuucaugagcaagaauaucuuugguaacuagcuacuggacuaaaacagcuacuggcaagaggcucuuaaaggcaggguuccagucugcuugcugugacccagacagagucugcgggcucagugagggccacuggacaguuggacccuccugucuguccugcuugcccaccgcagacaaccuuucuggugacucgagaaagcagcugcccuguagcuauggugaaucagcccccagcuccccccccccccguuuuccuucucugugcauguggugccagggauuaugccaaaggacucaaccccugcccaacacgccacaucccagcccucugcagaggcucagaaguuguaucuuccucuuaaacaaaugcuccagagagacugggugauaccugcagcuaguaguggcuucugccuccagauuagccuacacagggcagaggauuaaguuuguccugaugguugaguuuagaagugcucugagagcugcugaggucaggaugcagggugagggccauuagagaagccagcagggagaggagagcagccacauugucuucagaggcacucuuaaauuagguggacaaggcccaggucaguagucugcucuaguguuugucuuaaacgcucagggcacagcuguuccuuccauccuguaaugaugcauucugaauuugugcuaaaaugagugagccugccuuauaaggcacacgugugccuguguacaaggcccucucaccugcuggagggaaacguuuucuuuguugagcaagcucggaaguguaaagaguaacaggacacaagacacggccggccagccagagcuuagugguggcuuuuccaguggcugaccuuggagugcacgcuacgcugugggcaguuagucacacaucuuggcucaggaccaguuugcagcacugaggcaugugugaccacuguugaggcccucuccuuacccauggagccuccgugcacuucucuggguaggccuguacugacuugaagacauggccucuggcuuggguuugguuucuaaggcugaacuggucucuguccugggaaugcaugggggagccgccacacccccaugcccuguuuaugucagagcaugcuguuugccuugggcugacuggaccaccacaagcuggcuuagguuaacaaggugcucaucaaagugcuaugugguggcugucccagggaacagagacgucaguguggcccugguaaagccuguggcucauuuguggaaaagcacuuguauucagcuguuaccuugacgaaucagaucccagauugaauuguaagacuguucuuuucauggagcaacugucccaugaugcugggguuuucacucaugcugcacuuauuacauuuucuuugugucaugguucaauuccugacucuugagguaaaaguaugaaaaucgugcauuuuuacuucuguguacuuagguuuuaaagacuguuauuaagugacauuguguaaaguuguauggguauauuuauuuucagugaaagucaagguaauacauguauuccuuucuuacauuuucaucugaucucuucacaacuugaauaaauuucaugaagagcccuccugcugugaacuaccaggaaacugagcuccuaaugucgcaauaacuaaugaagcuugaauaucaguauuguuauucauuucugagaaccauguucuguuucacugcuuugucuuuuagcuguucccuugucccugucacagcaaaagauuuaccauauacuugacuucugaaguacuggaggcuguccucuguauauugacauugaauaaacgugugaaugcauuguaaauguagauaaauuuuaagucauuuucacauccaagcuucauaaaaaggaaucucagugagccaaaagagagaagcuguuaaaugcuguaaaauucagagccuuguuaauguuugugagacaccauggaugacucuguguggaccauggucucaguuagcuucuagaugaaaugcagauacugagcagcccagauucugcugugugagcugcucucagugaggcacugggauucucugagugugaaaaggucaaauguaaugcuaaugauaacucucugaaggucuaccaguuggcucugcagccaccuagccagccuagugagccaagggcaccgugggccucuguaggagcucuucccaccucaccccugcugggcuucugugcuggggcuuggcugcugugaucaccuagagcccaggguagcaggagcaguaggugacuucacugcccaggagcaucagccaugcuuguuguccugcucuaaggacaggucccugcccgggcgacaaggugagagggagccggcccaugcugccccauacagcuguugccucuuaguucccgagacacugggcuuuugcuuagcggccuguccuccaggccgguggccugccaagcccuaugcucugccucucagcccucacagaauuccaggguuuccuuacuaccugacuuaaugggugcagguuggguuggcuaggaguccugcaaagcaggagaaauguucaaccuguaguuuaaagugaccucccaauuucccaccacaggagcagcgcggcuuuuucucagcgcuauagcuuuaaagucuaaaaaggcagguuaauagcauuuucaaauguguuuaaagaaaaucauaaugugauuaaaaacaaaacaaaacaacccagaacccuucuaguaugugcgugggagaagugacaucauccuugucccuccguguagggcuggcugccaguggacaguggucguccguuccagcuagugagccugcugcagcaccucugucuuggggcugcgccucuaaaaccagccccucucuuuagggaaggcucugggcagcuucuuggaagggugagcuuuggaggauuucggacccucuuuuccuccauggcagauuugaggggcccagcaggucccaggaugagggccuuagcuggcaaacauuuuuccaagugcacagccucugaggagucuucuguagcuugaaccuuuucuuuucucugucuuccccuagauggcuguaaagagugacugggaacccuuuucucaucagagaccggguuguauagcccaugugugcucucagugagugccugucagugguaggaagacuggucaagggacaagacccagaagccagcaggagccugaguaccaggccauaggacugugaggcagggagggacacagacacugaaagcuuccuaaaccaucucauugagucugggcacgccagccucuuccauggaccuuacacagaacuguggccuucugucaaguuucucucuggcaaguuggaguguauauaauaaauuaauggauucguaagcucagacagauaaggggacccagcaaggggcuaagagcacgugcagguguugucgcuugggaugcuacucauugugccccaucugaagaggcaugaauugcuuaauuacuucgguccuggcuuccaccugagagcaguuccuggcuauagggccuuagggccagccgucccuccaggcugagacacuguagaauccacuggucacuuuucuuaagcucucaggggcaguccgccuggcugcucugggggaguaguuguuguuguuuugguuugguuuguuuuguuuuuucggagcugagggauaaauagcuuugaacaacuaggugggugagaguuggggcacucagccccaacauccauaccuuauccuacacuguuuccuugagguacugucagauauuuauggccaaaggucgcugaggucagauagggaaagggcagcuuucccacagccagagcuggaggcugaaguggacccaacagacccacagggccugucuuagcucuacccugcacagucuaauccagcgucugcucaguuaugacccaucuccgcaguguccaccagggaaggaaaguggacaugcucuuugguaguagugguuuauaagucuuuuucuuguauauccugguggaauaggcuuaauucuauuggcuuuguauuuauuguaaauuagaauccaacccaaaaccaagaucuagaguauuuuguuguguaauuuugaacugaaauauccagcaguuuuggcagcuuuggugagaccagaagagcuuguuaaccauuagguuuaggaguugucuuuguuccagggaucuuuugcuugcuuuugugagcccuuguaggugcugugcuggcucuggugcacacaucccaggcacacacaucuuccugugugcuggucucugagcucaggccuaauccauggagccuccaugccucagacaagagcuauucuucugcuccuuccaccucccaaacucucuuacacuaaugggcucaguggaacucagcuacaccccagaagaaggguauuuuacauugucugucuucagggauugggguuucauagaggucuccuacagcccuggcugccucagguuuccuacguggcugaaaaugaccuaggacucuuuuauauaaauaaaugucaguucacugucacugucuucagaaccaccagaagaggacauuggaucccauuccagaugguugugagccaccaugugguagcugggaauugaacucaggaccucugaaagagcagucaguguuccuaaccacugcaccaucacugcagcuccaacccuggacuccuucuccuccuccuccaccuccccagugcugggguuauaggccuguaccaccacacccagucucacauuuucuuuugaaugucacccacacgucccagcgccugcuguucauucugcaaagccgcauggacuguaagaaguaaacagguguugugguuacuguucuaauacuuaacaucaaaucugggcaguuuucaccugacccaacccagucugacccugcagagacccuucccggcuccacacauuuggcugguagcacucuuccauugucuggcuauggucagaggccacacccacagugacagggcgggccaucuguguuugcagugagugcugccugggcacaggagguugguuacauacucaaguggcugcgcaugugugcuguccucaaccuggggcugggugggccagagcugcuggauccugcgcuaugugcaccagccucccucacuggcgugguggguuugcaggggcugcgaggggcguggcccucccaugcauuaucuggacagggucugaggauaagagcuccuacagaugcagagcagaggcccuugcugcauuccaucucuucuugccucuugguuuugucuugaccaauaaauagauuuccagccugagguaagaaaggcuaggccaggugguuugcagugggccagcucuucccuaccgcccucccagcccagccuggggugaagccgauggcccacucacaacugucagcccucaugucugcacuaacagucuuaggaaaauguagcaggguuuacuuagcauuaaauguugucacuuguaaauaauacucaacaagugaauaauccuucgggacagcugaaagauguuggguucauucccuggagccaaguucuaaugcucugcugcuguaaccgucacauuccuaagaacugagcagcaggcucugaugugacugaguguacacagcccaggagugagugagugcccuuggcucugagggugcuuaggcucugugcuagccaguguggguagcugcuccucccguuacccauccuagcugcaggaaucaccaccagggccuggucuccuuuucugcagcgccuaucuacuggccaaacuaacucuuggggugcugcacaagaaagcaggugcaccccaggagaagaugccuuucuaaaagugccacuagacugcccuuggaggacuaccuggcucugacccuguccucagcuacauugccugagccacacccucucccaaaggcucugauagucuccaguaaacaccuucuccaccuuccuucuagcagcuguugaggcaaaaucucgauccaggcacaguacaaugcucugagaauuagcuaggugaacagagaguguguuaaagccuggcuuccagcccuuggaaaggaugcuggcuggcaagggugagcuccagggcucucugcacugcccugugucuugcuggaauaauggaaacugcuuuguucacagggcuuguugucauccccaaaccaggccacuucuccaggugggacuguaguguagcaggugcacugcugcucccaggcuccccggacacgcguggaccgagggagugacagacgacaacggagccaugagcugcgcuggagccacaggcaggcggcaggcagcagcggccugcagggcuguguggagcugcuaaacccaaagaguuguuuccauuuuuaagucagucuguuggggcugcaguaaaaacugagaaauggaguuuucuugcuuuuuacucuaaaauucaauguaacuaaauccauauauauauauauauauauauauauauauauauauauauauauacacacacauauauacauaguguaaaguaaaauguuucuugaacagaaaccuuaaaucaagcuguucuaaauagcacuuggcucugguuuugcacugauguguguuauacguuagguggucauuagacagccugggaugcacucauggagacagcugucaccuccaacuuaaacacgugcugcagacagacagaugcugcaaucauagacuuaaaacauuguuugcacuuaaauaguuuaaugcuaauagaaaugacuuugacuaugggguaacgggcucccggccucacgauacgagaggagaugcccuuuuuaucuguuaacauuuauuuuaguacuguuguuuccgaugcaaucaagucuguauuauauguguaaauaauguaauucugaaauggggguaaauagucacucccacuaguaauuuucaucauuuaagagugauauuucuaauucacaaaaacauuaauauuaaaauuaucuugaauauac

SEQ ID NO: 6846 - RNA, 48865 nt, Mus musculus
ggaacgccccucccuccuaagggucuggcgguugcuaaggcgacaggaauacaauauggcggccggauccuaacgcuccccagccagggaccaccgcgaagguccucgagccggaagccaccucuggaagggagaaggccgguaccacagucuccucuuuucuuuucgguccggggccguccaggggcugacggcgucauccgcguucaggaugaagagugaguggggccggagaagggcugaggguccccggggccugcggggcggcgccgcagguacccggggcuaggcagcggguucugcuggaguuugaggaguugugucauuucguucauucacucgcucauucguucguucguucguucguucguuugucggaucgcaucugaaaucucaagacauuggccgucggcucugagcgcucacacgguggcuccccgccccugcgggacggcggcuuaaaccgcguucgagagggacgcugggccgccuaucuuacuuucugaguuaaacaguugugguucugaaagcauccuuuuagcggaauguaaaacgguugcuuagaaguugggagaugaggcagucuuucuagaaaauagaaggacuggaaaacuggacuuagugccggguuuguggguaaccuggaguccaaaugcgacuagacaagucgguuuuguugggaccgcuguuugauuuucauagauauacgguuaugauugccugugauaguguagccagaaguguagucucuuaccgugauuagauuguguucucuguaguuacaauaucaaauugacacuacauuuuaauugcagugcaguaauuucuauguaccauaaaugacauaacauuuaaaaaauaagucaucucauucacccuucagucuugugucacugugucacucccuuuaaggaagauuaauguggucuugaggggagugacgggcgcauucauuccccucacuuagaggcagaggcaguugaauuuccaugaguuugaggccagccugaucaguauaacaaauuucaggauagccaagccuacuagacagaaacugucucaaaaaaaaaacaaaaaaaaacaaaaacaaaaucugaugcaguagcaugcaccugcaaucccagcaugccuauggugagaugggagcagagauaagagauucccaaagagcucgaaguucaggcauaugcagugcuaaacaccacagacacuacuacagguguuccucucaccccagcuaugguaucuucucucucccuccacacccuucucucuaguauucucucucucaccacagauccuauagacacacuuaaagaggagaaaaacaaaaacaaaaaaaaauuuaagaaaaguuaaaaaauagacacaucauaaaaugcaaauuauauaugcaaaauauuaauuuaaaaaaauuuaaguuuuauauauauauauauauauauauauauauauauauagagagagagagagagagagagagagagagagacaaggcuagccucaaacucagaaaucugccugccccugcaucccaagugcugggauuaaaugcaugcgccaccaccgcccggcucauuuugguuuuucaagacaggguuucccuuuguagccaaagcuacccuagaacuagcucuguggaccaggcuggccuagaauucagagauuagccuguuucugccucucaagugcuggaauuaaaggcgugcaccaucaccacccuaggccuccagaaaguggauuguggccaaaguuuugguaacacccagguuuagccaguuuuccuguccuccuccuuugccuuguaagucauuugcauagugaguggcaaggugucccaggguaaaguuaagagcauccgcucuggagguggaggacauugcagccaggcacggagcuaggcagacccacagccucaggagucccugccgccucucagcccccucagcucucauccuuaaacagguguagugacagcaaucuccagggaagaugcugaggaugcugaggggucagguaagacgguguguguguguguguguguguguguguguguguguaagacaccacugugucuggcaugcagacugggagugagugccuggcuggcccaguggauggaagacaucgacucgagagagaagaugagcuugaccaauccuuacuugaagacauuuguccuuacuggaucuaauuagaguccuuacuuuuuccucucuagacuguuuuuugguuugguuugguuuuugguucuuugagacaggcuuucucuguguagccccaguugccuuggaacucacucuguagacuaggcuggccuugaacucacaagagauccgacugucucugcucccaaaugcuggcaguaaaggugugugccaccacugccuggccugucugauuuuuuuuuuuuuaagauuuauuuauuuuaugcauguaaguacacuguagcugucuucacauacaccagaagagggcaucagaucucauuacagaugguugugagccaccaucugguugcugggauuugagcucaggaccucuggaagagcagucagugcucuuaaccacugagccaugucuccagccccuauguaaauguuuuaauggauuauuuaaucauaccuacaaaaacaaaagcaaaauuauacauccuaauacaugcuuugccaugcuaucagagguuuuuuuuuuuuaaauauuuauuuauuuauuauauguaaguacacuguagcugucuucagauacuccagaagagggcaucagauuucguuacggaagguugugagcuuccaugugguugcugggauuugaacuugggaccuccggaauagcaguuggcgcucuuaaccacugagccaucucgccagcccccaagguuuuuuuuuuuuuuuuuuuuaagaagagaacaaguuuagucagugugcuccgaaaagagcaucuggagcagccauggaccuguuuagcauucucgcaguguguggguuuucugugugugcacacacuuggaauauacauuuucauguauacucugcagguuugccagugccacggaucucuagucaguugccugggcuaguggaugugguauagauguaaauggcuguaggguuuugaauaauuuugugucuuuuuuuuuccccaccauguuugguaauucaggucguuguugcucaauacagaaaauaauuaguaugguaccgcccucuuuguugaaaguccuggucugguuuuaguagugugguuugaaacacuuaaucucccaaagagacucaaauggauggaguuccuuuuuucugcaaauucuagcuguacuaacgguuaacacccuccagcccuucuuaccccacaguggagcuggguuguacugagggcacgaccugcccuacaacuugggaaagacaguguucacacuugcacaccacaggucccacaaaagcaaauuuuaccucugcuuuucaagugcuaauagguuccuauuccacagacccagauuugauuaaacaagaaugacaagaauuuuaauugaugcaaauggauuccucuguuuuccaugguccaccuucucuguccuugacgcuuguguuuuucccugggugguugauuauuccuguuaguguggggugggacauguguuacccauagcucagcucuggucccccucccuagcccugccuggggcuuucuggguagcugugaagugugugacccagcaggguccccugagagaaagcugcuucuccugggugguuuuccuagggcugcagcugcuuuuucuccucagaccucggaccucucguucuuguuugauaccccagacauuauggcugccagcagagccagggagaaacaaaugagccuuuaucugccugccccagccauggguaggggauccaguucacuuuguugcugggucagugguccagagccagcgaggcgcugccucacucugaguuuguguauuuaacuaucuuaaaguucacagucgacuuuuuuuucuucuucucauguucaaagcaagccugcuuaccuuacuugugaugaaaugcacuuuuggaauuuauugugucagguuugcccuccucuugaagcuaagugcgccacagcugccuguggacggccuuuguacacugaucucaucuuuaagaauguucuuucugaguuucucuucuguuggugcuaagcgcuaagccaggagauuccuuaaaggucuugaaauacccaucuuuacauacaguugagauaaauucauacauugugaacauuaaacaauauagagaagguuaaggaacaacauuaagcuugccuuuauuccuacauagauacaaauguaaaacauuagguuugcauucaguuuccuccugugcacacguguguguucuucuaugcacagauauauguguuccuucugugcacaugugagugugugcauugcuauucuuuuauuucacuuggcaccaggucugcacauuuuccuauauuucuaauuauuaguugaaaguacaguuagcaaaauguuucauaauaucuccuuaauauuaggggaugaucuugaaauaaguuucuaguuuagucuugcuauugugacaugugacaguuguauuugucucuaaauguucaucugcagagaugucuccugggagugaaaaacaguaauuguggaaguauagacucuuuccagagccuuucuccuaccugugcaaguacugugugauaacuggaauguucaagcagaaaugagucagcaggaugcagacgcuacuugcaccucccuguccuaggagcgggaggaugccugggcacugcugcuggcugcugcucuguuuuucccaucagcugcggcaugccuuauaaugaauacauauauuuguuggacaucuuagcagaugucccacccuuuuccaggggauccagcagccucuucuccugacagacagaacacccauacauauaacauaaaaguauuuaaauagccaggcagugaugcuauaguccuuuaaucccagugcuggggagauagggacaggugaauguggaucucugacuuugaggccagccuggucuacagaucgaguuccaggacagccagggcuacacagagaaaccuugccacaaaugaaaaauuaaacacccacccccccccaaaaaaaaaaaacuauuuaaagcaaaaagcaacaacagucagaauuucaagcaaggccugauggugccuuaucuauuuguuuauuuauuucuuuaauuuuuuuuuuuuuuuuugguuuuucgagacaggguuucucuguauagcccuggcuguccuggaccucacuuuguaaaccaggcuggccucgaacucagaaauccaccugccucugccucccgagugcugggauuaaaggcgugcgccaccacgcccggcuaaauuuuuaaaaaagaauuauuuacuuauuacauauauguaaguauauuguagaaguccucagacaugcugaaagagggcaucagaucucaugguugugagccaucaugugggugcugggacuugaacucaugaccucuggaagagcagucaguacuguaaaccccugagccaccucuccagcccagauggcacacaucuuuaauccuagcccuugggaggcagaagcaagcaaaucucucugaguuugaggcuagccuggucuacauugugaguuccuggacuacauaaagagacauugucucugaaaacaaacagcaaaggaagucugaagaggaugcaagcuucacaugcuacagugauaagcaggucuucuucagggcugcgccaaggcaaggcuccgucguguggaugcagucugggucugauggucaaggaggcuuagugcaggcuugcuucucugaggcuguucccacacauguccucgauaagaugcuguccuccuggcuucuuccucugcuucucacaggcgcuuccuuaaagcucugccacugguaguaacuuuucuccuaccauaucugcucacguguaguuugguuuugucuuuugugguacaaaagaugggacucggggccucauaugugcuaggucagcacucuccacugagcccuuugcuguuguauccaaccugacccucccugucuccaucccuagacugguaggcuguggacacucagcaguggacagguccugcuugccacguccagagcagugggugggcagcugcuggcagcuuuggucacaggcgugguccauauaaagcuucccacuugcugcuagucaggcaagccaaacuacucuagagagugcaggcaccacguagcagaucagagacuuacaaacacuugccagggauaguucagugcugggagcagcaacuucaggggcagcugcuggcagccuuuagaaaaucaggccagcgaaaagcucaggaaacugcugcagauggccuggaggcucuguaggagcgaggagggugaauuucagaagacugccagacacugacaucuccccagggccgcagcagcccucaucccguccuucccgcuccacuccaucuagagccauuuagaggccucgcaccucuggucgggaugcagugauggcauccuccggcccagggggccagcacagccccgcucugggguucagacgagcuaggagaacccagccacaguguugucgugaaauuacgcagaggaaaaagucuguagugaaguaaauaugaaagaaauucauaaauuaaacuuuauuuuuaccuauagacuacaaagcaauuggcaagauaggagaggggacguuuucugaaguuaugaagaugcagagucugagagaugggaauuacuaugcgugcaaacaaaugaagcagcacuuugaaagguacgugaccaggcgcauuccagacugcacagacaugggugagucaggaaagcaucuuaaugcuagugggaagacuguagcuacucacuggugugcaagguguaagcagauguccuuggacagcuaagaccgugaacuaacgugcucgguucacugggguuuucucuuguccaaguuggugguaaugucagugacuaccacauacggugugugcuguaaaaguguguuauacuaugcuggguuuuuauaagucaaacccgaaauuagaguuccuugaaaauuuuuuauaugaaucaauuaauguauuaauauauuggaaaaaauaauuuucagauagaaauagagaaauguauucucugggagugaccagcugauguuuggaaaauggaauuauauucuagaacuguaguuucugauggcugaugcuucacuuuuauauacuuuuuuauauuauuuauuuuuauuuuguguguguaaguguguugccugcauguauguauguguaccauuugcauacaaugcccauagaggccaaaagaggacguccauuccccuuggaauuggcaccagggacaauuguuaguugcagugugggcgcuggggauugaacaugguuccucuggaaaggagaguugguucuuguuuucucucucucucucucucucucucucucucucuuguuuuucaagacaggguuucucuauguaguccuagcuguccuggaauucacucuguagaccaggcuggccucgaacucagaaauccgccugccucugccucccgagugcugggauugaaggcgugcagcaagaguuggcucucuuaacugcuaagacaucucuccagguccugggugaaaggucuuaugcuguggcuuuguccacacagcagccccuuauagucuuggaguucguuaacuucucggagaacaucacaccaaggagucagacucuguugugugauguaauaauuacugaccucauuguaaccaagaaaucuugcaauaauagaguuuaagcccaauggguuuguuuuuauauuaaagaaauuaugaagaaaauuugguaacucccccauagugaaacagaaucuuuucuucuuuugguuauuuuacuguuauuauuuuauguuuuuagauuuauucuauguguaugaguguuugccuguguacauguauauguaccauaugcacaccugguacccacagaggucagaagagaccgucagauaacugugagucaccaugagggugcuggaaacggaaccccaguucucugcaagaguagcagugcucggaccauucuuccagccccuguuguuauuguuguuguuguuguuauuuuguucagguaugggaguguuuugcuugcauguaugucuccauuugugugggccugaugccuguggaggccagguguccuggcacuggaugguuguuaacuuccuaagugaccaccguugaccaccuuauccuuugacaaacaucucuuuuccuauuaggaaaauuuuggaauaaaccaaaagaccacuagcucccaugagccaaaguaagcguaagcagucaucagagagcaagcacugcacagacccuuugcuuugcugcagcugcccaccugcugucguucccaaaguguguuuuucuuauguguauucauguggcccgaguguauguguguaucauguguggaggggcuccuggaggccagagaggugucagauccucugaagcugggguuacagguggcugugaacugggugcugggaacugagcagguccccugcaagaaugaacagguccccugcaagaacagcaagugcucuuaacgguugagccaucuauccacuaauguauuuuuuaauugauuuaaacauuucuuuuuuuuuuuuuuuuuuuaaagauuuauuuauuuauuauauguaaguacacuguagcugucuucagacacuccagaagagggagucagaucuuguuacggaugguugugagccaccaugugguugcugggauuugaacuccugaccuucggaagagcagucgggugcucuuacccacugagccaucucaccagccccugauuuaaacauuucuuuguucuguugcuauaagaacuucaggaaacuauuaccacauuggaagaugguauuugagccaaccuguaucuguuccugggcuguguucgcuccccuuugacaccagaauagaccaccugacacacucuguuagcagagcuaugcuuuugcaucgacaaccuuuacaugcuugggauaauuagaagaacagagaaaaggaagaugauaauucuguaauugaauggguccaaguaguggugggcucugaagcugggccccaugcuugcuaggcaggcagucuaccaccugagcagccuccgccagccaggaguucauagcaaacgaacagucuauugagagaaaacaaagaaccaaaaguccaccucagcuaggugucguagcacacgccuuaauccuagcacuauggaggcagagucaggaagaucucugugaguucuaggccagucuggucuacauacugaauaccaggccauucagggcuacauaagacuugacccugucucgaaugaaugaaugaaugaaugaaugaaugaaugaaugaaugaaaagaaacaaugagcucuaugcuggggaggauaaagugaaugcugauacauuguuggugugcuguugggacuguggaaaucaguauggaggcuccucaagcaauuaaauaaauaaaugagcugagcgugguggugcacaucuuuagucccagcccucaggaggcaaagguguguggaucuccgugaguucgaggccagccugguuuacaaguuccagaccagucagggcuacacaggguggguagaaauaauaacuaaaagagccuuggugguuucuuccccuggaacaugggaaagaccagagggugcucaucugucaggagcauggacgugacaaagaaagcuuccauacaguucucuuguuccuuccuuucuuccaccuuaguugguuuaccuucccuuccccaccccacccgugugucccuuggaggauggucugcagggcuggucuuuggaagcccaguuguuuuguuuuguugguucgguuugguuuugagacagggucucacugugcagccuugguuggccuugaaugcacuguguagaccaggcuggaccggaacucagagaggugccugccucugccuccugagugcugggauuaaaagaguguaccaccauaccuggugggagccccagcaggauagcauccgauugugucuaaggcuucugagaguaaaacuguucagaacauguuaaagggaagcuauuuacucuccuccuccuccuccuccugcugcuccuccccuucccccuccucccugccucuucuuuuuuuuuuuuuuuuaaagauuuauuuauuuauuauauguaaguacacuguaguugucuucagauacaccagaagagggcaccagaucucauuacgggugguugugagccaccaugugguugcugggauuugaacuucagaccuucggaagagcagucgggugcccuuacccacugagccaucucaccagccccgucccugccucuucugacaggccucacauggcccauacagagcugagcucacuguagcugaaguuccccaugaacacccccccccccccccccccccgcuccugccccugcauuccacguccugggauuuaagguaagcaucaccacaccagcuguuuucuuuauuccgugagguuugggggaccuuuuuuuauuuuuuacuuuuuugguuuuucgagacaggguuucuuuguauauagcucuggcuggccucgaacucagaaauccgccugacucugccucccaagugcugggauuaaagugcgccaucacugccuggccugggggacuuuuaauaucaacguuaaauuauggccuuuaggagggacaacagcggaccucuuucucaagcguuugcacauggaauuuccuuucaaggcacuuuuuagggccagcgaaguggcucagcguguacaggugcuugcugccaagccugaugauccgaguucagucacuggaacucacacggugggaggacagaccugauuuuuccaaguugaccugugacauaacagagguacaugugcuuacacauacaugugcacgugcgcgcgcgcgcgcgcgcgcgcacacacacacacacacacacacacacagagugaauaaaauaacauuaaugagacacuuuccugauagaucauguucuguagaauacauuguggaaagguguguuuucaaagcauuuauugugguacuauugauguggcagaggauguuaguggggcaggagguacucagccggggacccaugagcagguguaaacacacggauccugaacagaccauguugaaagcucccauccaggcagugaacggcugcugcccugggacuccuguguccuguguccagccuucucaccacauccagaucucccugcgggauaugccaauugagccugccuccagauuguggccucugcuguuucugguuguuguuggggaucccguugcuaacacuuuggauccugggcugggcuggggaaggaaccauggaaggcagucacaaauacacuuagacuauagcgggcuuccacuacugcuccaugggacagccacuuaccaugcagccuuccagcugguaccuagcucgaagaugcugcuagcugggggacuuuguccuggguccugggccuuuuucuggguagcaucuuucauggcucaauaaacucauuucggaggaaaaggcagaacuauacuaaugugcuguuagauguaacuucucaggguaacuaggcagcgugcugaaccuugcacaagggaaaaguugguagacagaacucagccagcggacaggaagauagauagcauagauucuuuuggcaucucagcaauggaagcucuggaacauugggucauuuggcuagguaugacuucaccccccacccccauggcucaccaugucauggucucauggacccacagucucuguagggcagcaguguccaagcucaugccuuugcacuggucuugcugcacuuugagaucugagcugugucaagcacaguggccuucauuaguguagacccaccuguccagagaacacugucaccagcuacgaugacaugugacgcugggaacaugcagacguucucccccucaggagaacggugugucccagaacucugaaaugcugacucucagcuagugugcaccuuaucuaguuggcuaguuccauacauggauuaguaaauuuuauuuauuaccauuaaucaaucuuuucaacacauuuaauuagaauuuuacauggcucuguguuuuuacuacguaaaagaaacaaccaaaaaauccuuuuaugauacuagaugacaacaauuuuaacccuacugaagugagcucccgcuaccaugggaaucacagaaacguuuguaaugucaaguuccugguauaaugggaauagcagaugucuauuuccuacaauccaguuucaucuaaaucuaaccacuguuaugcauguuauggacagcuuucuaauguauacguuuuuuucaaaauguuguucaggagaccaggcaggggcucauuacgcacgggggcuuggaacuggauucauguauuccuaagugaaaacaccuuggugugaggucuggaauaucucucaugugugucucaugacuggcacauguuucauucccaguacuagaaaaaaacaacaacaaguacaaacaaaaaaacccaaaccuugaauuuuguaagauaaugaaggugcaugccgauuuauacuuaauuuccauuucuggggggaaaaaugaacaagguuuuucauguugaucauggcaaauaaauaugauuucauaacucugcuuuuacaguugaccuaauuguaaauuaguugugcauuuuugccuacaucauaguauugagcaagugaacagucugcgagagauccaagcacugaggcgccugaacccacaccccaacauccuugcacugcacgaaguaguuuuguaaguauaucugagcgugggaaguuaccugaaguggacaccuugcuacuaaagaucgcaguucuuuuuauccugguuacuugcuuuguagccgagagagugacaguuacaccuugucuuauguagauuuuuauuugggcaaauugugucucauuccuaagguggaaaugccuucaccuuugugugccugcgcuuggggagccagcgccaguccaggcugggcuccugcagcucagucaggucuccaugaauugcgaauuaugugaguuacuuucucgugacagcacagccucucuggccauagcugaugagguuugauggcauuuuccauccauguucauagaauaguuuguauacaguucacucaucaaucaagaaggcagagagagcauggccacagcccugggccaagucugaugcuuuuuuuaaaaaacacuuauuaacauugugcuucucaacucucugggcugggaagccaggcugcaggaccggccauucuguggguuggugcaacuuugguacucugagaaagugucccuagguguagaagccaugcuauagcuuuaagggagccuggccuacucugaaauucuuguaggaacucaucugcacacuaagguguaguagaugucagucaggggagagcagaguuucaaaucaaaaugcaggucuggucacagguguguggccucucggccuacaguguucuuagaagucagcucagcauucacuugugauaugcacagcaccaaggucucugagcccaggacagacugccuaggcagagggagcccaggaagacagacagaacagcacggagcaagguaguucccgugccuagggucuaaguaagaucgggagaagcuuguggcaguccagagccucuggcccacucagugucagaccugaacaucgcaugaaugaagacacuugucugccuuuucuccuguuuuuauuguaaguuaucccaaacacacuaauacgucauucaaaacuaaacauguugcugggugugauggaacccgucuuugaugggaggcagaggcagguagaucucuaugaauucaagacucuuugaguuugaggccagccugaugugcauagugaauuccaggcuggccagagcuacauaauggagagacccugucuccaaaagccaagcuggugagaaagugaaggugccgccacuaagcacgcccucagcucauugucuguugucuugcguaaccagcccccaagcucuuuccuuguuucugcugguaauuaguguccuguuuucaugaaauaccccuuucaagguguuuuuagagcucuucuuuagaauuuuaauaguauuuuggaucaauuucagccuaaauauugauuugaacuuaaaaccuauauacuguuuuaauaauuucauggcccaaauggucucuugugggaauaccuuauuuaccagaaauguguacaaaugccuauuaagagcuuugauuauguuuuccgauuaagacaagaaaaaguauuuaaaaccugcuuucuucugcagugacagaaaaucugguucucuugcacuaauaugugaacuuauggacaugaauauuuaugagcuaauacgagguaggugaguguuuugaaagguaaucugagaugaucuuguaacaaaugucugugguuguacgugucuuguagucacugcagugcagagugacucuagauagggaaguauacaguacaaagcugccacccuugggcccagaaggcauuauucucacaaugucuuaggggugacuggagccacaagccuucuaggaggcccugugguuuagcugagacuagccgucugcacaaggcugcacucugaggguacuucaugucacugcucccugcuuuccucugcauuuucuucugugcauccaagaagcccaagcucuacccuggcucucauggggaaggcuccucucucuucccauuuggagccagaacuagcugauauuucaggaaguucuucuguuccuuuccucugaacaugaagcacuguucaggaaagcucgcuugccugagaugaccugucacggccuuggaugcuugcagagggaccugaggggucaggaggcaagcuuggccuuuauugagcagguguccccgagagucugacuuggagguucuguuagauguaauugauggaaugcagcuaagaaagcaauagaggggauguucugucuuauagauuacaugguaccagaagacacaugaaaaacugaaucaagcaaaacagcagccaggccugguggaacaccugcaauccaggcuucuugagagaaugauggagacugccaagaccuaaggccagggcuaaguugcaagccucugucucaaaguguuaaaaacaaaaggccugaggauguuagcucagugguagaacgcuugccuggcaugcaaaaagccugugaccaaucccuaguacugaaaauuuuaaauaagaggaugaaagaagugaaaaaggacguguagagucaugugacaccauccuacuugugguagcacuggugaaaccaucaaauaugauguaaaucaucaccucgcacaacugaggccagacuaaagaauguggccagggcuuugccaccuagcagcacccaccaucagcaguuuucauuucagugaaucuguaggccgaguguggcagcucacaccugcagucccaggauacagguggcugaggcagggccagcaucuacagagcaaguccuucgcuacagcacagaccacagggcaaguccuuagcuacagcacagaccacagggcaaguccuuagcuacagcacagaccacagggcaaguccuuagcuauguaauguaaugagacucuaucucaaaaccaaacacaagcagaggagccugcccagucacguccuuugguuguuuagcagcaauucucucugugucugaaggguguauccuuaauauuagaaaccuuauuuuacuucccagggugugauauuuauacuuuauacucaaggagaaaugucuguguugcuauguguuuagacaguugcgaaagcuuggcuuagaaaguaauaucuuuaauuuccaauagcuagaaaguguauaauugaagaaacugaagcauuucuuucuguaucuaccuacagagacugugcaagacacacaguuaguucagcagacagucauuguugacaggcacaucuuaucugccugcucugcagaguacaaaaggcaguuuacucucaagguggucaaggaugaugaauagccaaaucuucaaaucuguugauaggaccuggggcuauucugggacagaggaggguaggaugaaguguugggguagagcaaucagaggucugugcacagguaauuaaauggcauggcuuuuucugggacacaggcucagaaaugaggucaucauaugaucuaaaggugaaguuuucauccccagacacuguguuaggcccaagugaagaggcagugauuuuaacaaaguggacuaaaggucuccaaaaaguaaagugggcaacuguuauuaccaugauccacuugucaaaggaguuauguacagcaaaauaguaggaaaaauaguauuucauuagucugcagaaucuccagagggaugauuuuugaagccagccaaaagcagguaaccaagagguugagguucagaggggagguagggcaagcaaggauuuuguuaccuguguguguaaaagaauuaggaugccugauucacccacacagccccugaaagcuccaacccuaaagugacacagcccugccacuaaccaagggcagcuggucuucuaaauggcguguguucacggugcugcucucaggcugguugggcuucuggaugcugcugguaguucuagucgcucucccucccucucuccucucuuccccucuccuccucucccuucucccucucucccucucacuucuacccccauucuucuccccccucccccuucccccucuccaauguucccucucuuaguuuuuuucaagacaggguuucucuggaacuggcucuguagaccaggcuggucuugaacucacagagauccuccugccucugccucccgagcacuagcugcugggauuaaaggccugugccacacacuuuguccuggcaaguugcuucugaacucugagggauacggauuuacagugagaagcccuuuucuguaaaugccuaauaggggguuguggcuuuaacuugaauguugaguguuuuucacaagcccagggcucuuuugucugcacugaaucuaaguuguugccagccauagccagcauuccagauguuagagucaggauagaacagcuggcagcauguauaaggcauuuaugacuggaauacauagcaugacacagaguuaguaacacacguaggcaggugucuuagaguugaugaugugcaggcugcugcuguagcugaccaguugggcuggucacacuacccaggugcccuucuucuucuucuucuucuucuucuuuuuuuuuuuuauugauuuauuuuuuguauuugagugcuguagcugcauguauaccugugugccagaagaaggcaucagaucguaucauagaugguugugagccaccauguguugcuggguauugaauuuaggaccucugaaagagcagccagugauuccaacuucugagccaucacucuagcccucaggugcuggcuguuuuuuguuuuguuuuguuuugguuugguuuuugguuuuucgagacaggguuucucuguauaacccuggcuguccuggaacuuacuuuguagaccaggcuggccuugaacucagaaauccaccugccucugccucccgagugcugggauuaaaggugugcgccaccacugcccagcucaggugcugcuuuuaauauuuauagaaauguauuaauuacccagugucccccacuccaaggccugauguucauaucucacuuuaagaaugaggaaaucaggggcuggagagaugguucagcgguuaagagcacugacuguacuuccaaagguccugaguucaaaucccaacaaccacaugguggcucacaaccaucuguaaucugaucugauguccucuucuggugugucugaagacagcuacaguguacuuacgaauaauaaauaaaaaaaaaaagaaugaggaaaucaaaguccagaaaaagaagcaacuugccuaaggcuauccaccuuaagugguagaaguccuuggagcuaagcccggcuccagaguccgaguccccaagcauguccaggcacuggcccugucuguguccucuccacagaugggcuaagcaaggacugaaggagagguaguaauccaggguaaagcucuucagagaggccagagccgcacaucagugaucacucaggucugugacuccuucacugugccccuggcgugaccagggcuuuccgugagugccucuccagacuguugcuucucaugauaaugaugcagacuuccuaagaguucucggucacuaaagcuuucgcuucagauagaggucacaugacuugaauaacugcuuccucuguccaguagagcacauaguagcccugucacacacaaaagaacaaccacggagcugagggccacaucaugcuggcuuuggugaguagccacucacauguaccaugugugaggucuggggugggcacgaaucugagaagguggagacucggcaucguaggugugguuuuugacauucaagaugcauguagucuauuacagaaauagcuagaagaagggguccuguggcuguuuuuccuuuguccagcaggugccagggaaggcagggcugaugggaacuggagacucuaggcuucccuggaagguccugccucggccguugcagaggugguaauucagaggauacaggauggcccuggguggagaggcagccucugggaggaggcaggcaggucucugggaagcagaaccaaggaugcugcuugcugaggcugcaccccuggcugcacaguuguugcuccucaccuguccccucccuccuuuugaaugcuuaguguccuaaacccugagacccucuaguggcaacagccuguguuuaccucauuucaagaggaagaggcuggcucagaagaccauuuagaagacaagcugcccuugguuaguggcagggcugugccacuuuaggguuguagcuuucaggggcucugugggugaaucgggcauccuaaaagcaguccaugauauugggagaaugaaacaagguaagagaaaccaaccagagucggcuugacugaggucauauugcauccaucguucccccgcguagccgguguguugugacucaccagcaugaagcagagcuguagugcacaagcugcuguaccaagugagcgacacuucaucagguggccccugaggaccaacaaggauagcaccaguucagauccaguauuuagcacauuuaauccuaccuugauuaagaggauccuuuaguuucccuguacgcauguaugaaggaaaacuguuggcuagguuuuuuuauugaacacuucuuuugugcuggguaguggugucucauaccuugaucccagcacucagaaggcagaggcagguagaucucugugagcuugaggccagacuggucuacagagcaaguucuaggacagccaaggcuacacagagaaaccuuguaucaacccccuccccccacacacacauacacauacacaacacaacuacuuugcauuuuaaauuauuuuuucuucucuguguguguacacaugagccauguguaugcacguuggucagaagagggcaucugauccccuggaguggaacugaaguuucggauuguugggagcaccugacggcgugcugggacuugaacuccggucucugcaagagugguaucuaaguuaaccacugcaccagucuccagcuccccuggcugucuugguuauacagcauuccuaguaguuuccuucugaauguccgacucagaaugacugacagcuuuguuucccugacugucagguucugccauucagcaugugugugagacaacacuugucacuggaguguuucuuucugaaacgaugacaccauccuacuagggguuuuguggguuuuauggaccuguauuaaaugauacauaaugauggcuuucaucuggcauuuucauccaugucuaugauacgcuuugaucuuaucugcccucucuaccaucuuugucccucuccugcuaaucccacuccuguuccccacuaacccucucccucuuuccgucuucuaaggaaauaguugguuuugcccuauguguguaagugucugcuugcaugcauauguguguaucaugggugugcugguuucuuucugugugugagacccagugagcuuagggugagcuuaggguugcucgucagagcauggcugagggguugucugagggagcaugggcacugaccagaagaucugccacugaggaaaaugucuccagaaacugcguguagguccugagggagggguggggccccaugugguccauuucccucucuuacagaauguggaugggcuagccuagggaagcuuguguaggcggccacagcugcugcagguucagcagugcagcgcaugucaggccagaaagacagcgcuccaggcacuuuaccacagcuucuggcuccucccaacuccccccccaccccacccuccugcaguguccccugggccucagagguuugguuuuugugucugaguccagcaguugcagcuguguauccucagaacuccagcaguugggaguuuguagcccuccuguugguuaggaguccugaggugucucagcuccuugguuaugauacggcaugugcucaucugugugcuucugauguccucguggggagcuuggagugucugucucugguguaaaguguggagagccgugcccacccacucaugucuccaucuccagcccugucacccaguucacagugugguagaguuggugagcagucagcgucccagaaugcacuucuaccuugcaucucuauccaggaagcaggcccugucugagaggugaagaaaugaauuucagauaaaaaugaaacguuuucauuuucaguugccuaagacaauggacuuucaaagcgcagaacuggaaggagucuguccuugaguuugccauggcuaauaagcgagagcugccagguucucacucagguuccucuccccucuggucacuggcucugggcucauggcucucugcuuuuccuucagagccuuuugugagagacacgguguuccuuggaucacacagaggccugccuguauacacacaugaggugggcaugaccuuugggccuccaguauggaggaccacuuggcugugcuauguugagaccagcaugcgaccagaaagccagacuuuagcuggaaggcagggcuggaugggcccugacucacaguguggguccgucaccgcuugcugaccugaugguguuuacauuagugagguccucugugacuccguugccucucccugugacugugcucacugagcgcuuaccugccgaagacucgaguuacucagaugagggaaguagcuuuaccauuugccgcccacccagcagacagcagguucuccagugguuacuaagugcucuucuucucuuucuguuuguucuagacuguuugaaaagaagaaacugguaggagccagacaugcacugggccuggaggauugggaucuguuggggaugacuggguagugagcccauuccuuccccaggguguggacgcucugucuggaggaugcuuucccacugcucuccugguaccuagcucucagggggacacccucuuagggacagacagagucaccugggcuugggugaaggagaccaaggaagcgaagaggggugguagcugaucagaacucaugcaggggcccagggaagcuaagaaauccgauuccuggacccugugccgugcuuaggacuuacuagaccugagugugggccuuagcauccacuuccuaacagaccaccggauguuauggugcagagacuuuccgaccaguccacuccugaggucaggugagaugauaaugccaggaucuggaugugggccgggccuggggagauggccgaacagcuaaaggugcuuguugccaaaccuguggaccuaccugugugggagcuuuucaaguuguccucugaccuccacacacacacuuguggcauauguguucacucuugcucucucucucucucucucucucucucucucucucucucucucucucacucucacacacacauacacauuaauaaauaaaugugaauuaaaaaaaaaagaauugaccagaugugguggcuuaagccuuuaauccaagcacaugggagguagaagccuggccuacacauugaguucuaggccagccagggguagaacacagagggacccugucucaaaaauaccccaaaacaaacaaaaaacccacagacaccaguaaaagaucuggacaugaugguggagagcacucccguaacugggacagugugaaggcaggugugaaccaaucccguaacugggacagugugaaggcaggugugaaccaaucccauaacugggacagugugaaggcaggugugaaccaaucccguaacugggacagugugaaggcaggugugaaccaaucccguaacugggacagugugaaggcaggugugaaccaauccuguaacugggacagugugaaggcaggugugaaccaaucccauaacuggaacagugugaaggcaggugugaaccagucccguaacuggaacagugugaaggcaggugugaaccaaugccguaacuggaacagugugaaggcaggugugaaccaaucccguaacuggaacagugugaaggcaggugugaaccaaucccauaacuggaacagugugaaggcaggugugaaccaaggacucuugagaugcaaaggauggaggggauuucaaggggaggucaagaccaauucguggucccaggcaaaccugacgagagccaacaccagccacugugagggagauggaagguacuugcucagaccauccugaaacauggagucuugcugccucagcccuucccagcugggacuguacauuugugucauuauacuugggucuccauuuuuuauauagaggaaaaaauagaccuuuugacaacagguucugauuauuuuuuuaaaaaaaggcuuauuuauuguuuuauguaaguacacuguagcugucuucagacacuccagaagagggcaucagaucucauuauggaugguugugagccaccaugugguugcugggauuugaacucaggcucuuuggaagaacagacagugcucuuaacuacugagccaucucuccagccaugggucugucugauuuuguaguuugagcagguggcacaguaauggggauccucuugcccugaccucccagugcuacaguuaaaagacauaaagacacuguugugccuagcucuguguguguguguguguguguguguguguguguguguguguguguguguaaguacuacuuuuagugaacugagggucuaagcacgcugggaguugaugcacugcugagcuacaucucugucuccacacauaguagguuaucaaaucccucaggccugggaaagcuaagaaaaucuuaauuuuauuuaacuuuuaaaauguauguuuuguaagaguguuuugccugcuuguauaucuguauacuacacgggagccugaugcaaacggaaggcagagguggcagagcaccuggagcuggaguuaggaacagcugugaacaaccauguggguuccgaccaagcccugguccucugcaagagcagcagugcuuuuaaccacuaagcuagcugucauucccuuuauauucuaaaauguauuuuauguguaucugugugugccugaaugaauguauuuggccugcagagcccagaagaggguguugaguccccuggaacaacugcccaguauugugcaagagcaggaagugcucucaacugcugagccaucucuccggcccugauuguuuuguaauuuuaggaauucaugugaaacacuauaauaaaagguuaugguauugaaugaagaguuaauuguacuuaagagcucuuaaaacuuaaguuauuuucuguucuuguuuugagaguggugcuauauagcucaggcuggcuugggacuaauuguauaguguaggcuggccuugaacuuguggcaaucuugucucuaccuccugagcucugcaguuacaacuaccaucuucugcugacuuaaauuauuuucugauuuguuuguuaggaauuguuuuugagacagaguuuuauuuagcuuaggcucuccucaauuuacuauguagcccaggcuagcccuggaaucugauuuugugccucuaccucgugagugcuggguugcaggccugauauugacuguaacuauuuucuuucuuuccuuuuucuuuuuguuuguuuuuauuuucugcuuucuacaaaagguuuucucuguauagcccaggcuguccuggaacuugcucuauagaccaggcuggccucgaacucagagaucuuccugccucugccuccagagcauugggucuaaaggugugcaccaccaccaaccugcuaacuauuuucuacuuacauaucauaacuauccuuguuuagcaguucaaagaaaaagaauaaauguauuuacuaaaaaugguuacacacuuugaacuaacagugucaaguaggaagagagugaaugagccaugguagcuuuaaagaguugaaacuuaguguaaaaacauucaccuguuucaaacugaaaucaagaaaauuucugacaccuuugaaaaacaguagucggugaugcugguagucgagugcgugcagugcggauuugcacuggagagucuccgggguuaagagcuugugccgcucuuccagaggacccgaguucaguucucagcacccacauugggcagcucacaacugccuguaacuccaacucuaggguauccaguguccacucauaugcacaggucaugugcauaaaaacauagacaugagagauuagccugggcaacagagacaucucaucucaaauauauacugacuccauggagacacgaagccugggaauguuggaggguuucaaaugaguccucaugauuucaggagcaacacagaucucagaggaguguccuggaaggcucuggucaggcugugguacccugacaggcacucaguaguauucucacuagaguaaaaauguaugauuuguguggcauuagcugaaauugugccaguguauaagauuuuaaauggugggcuggugagauggcucggcagguaaagguacuucccaccaaacccgacaaccugaauccaaguccugggaccccagugauggagggagagacccggcuccagcaagcuguccucagacugcaaugccggugcccuccccuaacuaacuaaaugagguuuacauuuuaaauggcguguuuacacugucuuuccuaaaaguacuucagguuauuuuucacuggggaaccuaaguugucacguaguuaauuuuguuuugagagaggaaggagucuuuucugagcuaaggccugugugacucaggcuagcacggagcucuuccugacccucuggcuucuccugaaugcuggguucacaggaguguguggcuaccgcagcugcagccggcuuucacacacuguuaaagucgaaggccuuguguuugguuuauaaagguguguguguguguggcauugauaaacuuacugcccauuuccuugucggcacagggagaagacacccauuaucagagaaaaagauuaugcucuacauguaucagcugugcaaaucgcuggaccacaugcacagguauggggcggggguggcuccccagcuggcaugcaggggcguggcucgaggcggagacucucgaggcguaggugcgagucauucucuuucuucugucuuuaacgcucaaugcagaaacgggaucuuucacagagacgugaagccggagaauauccuaguaaagguaaaacgccuguaucgaaaaguuuuauuuugauaccaaaauuaagguagacuauaaaguuuuaaaugguuuauuuuuuucuagaaauguuuaauguuuuaauuaaaauguuuuauuuuaauuaaauauauguuugucugagugcggguaggugcagaagcugaggugcccauagaagaggguagacuugugagagccucggagcuggaguuagggcugugagcugcugugugggugcugggaacugaaccugaguccuuggccagagcaauauacacucuuacgcacugagccaucucuccaacucagcggauaacugugacucacugcacacaucuucuguccagguagcuggaaauaugguuugggugugaguuguuuuuuuguuuuuguuuuuguuuuuagauuuauuuuauuauuuauuuuauauaugugaguacacuguagcugucuucagauaccccagaagacggcaucagaucccauuacagaugguugugagccaccaugugguugcuggcaauugaacucaggaccucugggagagcagucagugcucuuaaccugcugagccaucucuccagcccagggucugaguuuugugggcuggaguagaacccagagcccuguucaugccaggcagacuuugugcccuggccuggaauaucaggcuucauucuccgcaguuguaaaagaaggcuugcuucagcaaaugcugucaacacuauugacgucucuccugaaggaugcaguauaaggagucaguccuucugagcacacagacggcuauucccugccaguagccauucuccuugcugauugucaaugugggagaagaagaguuuagagggcuccaacuuuaagauuucuuaaacuugaggucucuucuggaguauucugugcuacccaagcuuaaaguguacacguauggauucucucugugacuuagaagaguccccuugagccacaaggcuauaggaagccugugugcacugaggcuagaagugaaccaccuagaacagauggcuuugggugcugccauaggaggccgucugugauuggugcugcacuaagccaccuuccaaacccggggaaguuuguaaauguuuucuguucuucuacucgagacacugaagugcucgccaagccuacacaugguguacucugaguugcucagcugcugggacuuucccauaguuuguacauuugaaaugaucugugugguaguggcucuagacugagacagggccaacccuccucucucuccuuugcagcaggauguccugaaacuaggggacuucgggucaugccggagugucuauuccaagcagcccuacacagaguacaucucuacccggugguaccgggccccagagugucuccucaccgacggguucuacacauacaagauggaccuguggagcgcuggcugcguguucuacgagauugccagguagagcugggccagcaccgaagccugaugguccucguaggauaacgugggcaggucacauggugaggcugggcgagacacuuggcagauccuuccuuuaagcuccaaggcuauggucauucugguuucugcuugguuucuacugccuggcuuuccgucagcaggcagcugacuaggaucucagcucacuuccugccaagugcucgcccuuacuuccaucaccugggcagcggcugcagcagcaggucccauggcaggguggggcuugaucacaccauggggaagugagagcaaggggccugccacagugcgagcaugaggcuccucuggccucauuggacuuuucuagaaagcccauucuuccucugaccucuugcuaucauuccugggaagaagaguggcugagaacagccugaguguuuguugcacucagaggugagugcuguccccuuaagcaggggaggggaggagaugacagccauugcucaugguggaucuucaauggaaguaacagcacaggcggggacucgggucaccuauucccaccugcccuaaugacugcuguggaaccaugguauggccacacacuucagggcacacacuucuuugccaauggugacucuacugaggcuguaaaugacagcagacaauucugucaggugcugagauucaugcauuaguuugggaggauauuaaaagacguacaggagaagguaaggcuguaaagaguacagcagccaauguugucugagcacagggccagccagucucaggcaagugagcgagccacuaggaaaccuucugugcucugcagugucaccuccugucccuagggcuguucuuucucuuacagcauccccuuuggucaugaagcuaaagaggaguccuacagucagagcuguaguaaaaguuuuuguuguggcccagaacauagauuggguuauucauauaggucuaauuuuuguuuccaagacaggggucugucugucuguguagcucugacuguccgggaacagucuauugacugucuccuaagaaauacuuagggggcuggagagauggcucagagguuaagagcacuagcugcucucccaaaggaccuguguucaguuuccagcacccacaugauggcucacagccauccacaauucuaaugccaagcuguuugauguccuuuucagggcuccccugagcaccuggcaggcacaggcauacauaauuacccauacauaguuuaaaaaauaauaaaacauuuaaguuuaaaacugucuuuuaaaaaagaaagaaagccgggagugguggugcacgccuuuaaucccagcacucgggaggcagaggcaggcggauuucugaguuugaggccagccuggucuacagaaugaguuccaggacagccaagggcuauacagagaaacccugucucaaaaaaccaaaaaucaaaaaccaaaaaaagaaaagaaauacucggggccacagggaaacucuaggccaaauaaagaccaacagcagucuccaggccagaggccugcugugugguuccgcuguauuucuauggacugagcccgugggggaggccugcuuggaaggcagccccuccuggccucacugcagcauucacuccugugcccuugcagccugcagccccucuuuccuggugugaaugaacuggaccagaucucaaaaauccaugaugucaucggcacaccuugucagaagacccucacuaaguucaaacagugagugucauguguccugggaggcugggguacacucacugucuugggcccagccuuucuacagcagggccagggcuaggauggagaaacuguuuccaugauccccaugacccccauggcauuuucugggccgcucaccuacuugggcuucugugaaaggggagccaacugucucuuuguguggcggggagggcugagagaggugcccucauccuugagucaccaaagcucccucuuggaaggccugcuguuggguuuuguccucagaguauuuaugugggacuucggucuacuugggucagaaaggcugucugugaugaguuccugggaugccagucagcagucagggugacagugauguccagcccuugcggcccuaauguaguuuuguuuugaugauagaugaagcagaggccugcagggaaugggggacuuggugggcgagaucucccagaagccucugguguagaaggucagcagagaggccacugccgugucuucuccucuccaccuuuaguucccgucccacaggaaggcaaggguccugccuucacaggcaaggaaggcuuugcacacuuacagcaugcgcagcccugcucacugggguuuuaguguacaccaaaguuggacaggaacugcagaacugcacucguugcccagcucccugcuggcucagagcagugugcuuuaggucgcagucagaccugugcauuggaggguccucucucggaguucagagauugcaugcucucuucucccuuucacgcuuuuuaaagccuacauugccucagacucuguguagccuaggcuggccuugcauaccugauucuuaccgucuauaucacaagugauuauaggcuuguacaaccacacucaggugaccuccucccuuuugggguuaugaacucuucccuucagugugagucccuuagaguuagggggaugaccaccaguacucuuaauggcaugaucauuuauuaucauugggcuuucaaugcaggucgagagcuaugaguuuugauuuuccuuuuaaaaagggaucaggaauaccucuacugacagccaauuuguccccgcaaugccucucccuccugcacgcaaugguggcuuaugacccugacgaacgaauugcggcucaccaagcccuucagcaccccuauuuccaggugcagagguaggauuucuagauugccugauggugagcgggaagucuggguuuaugagacccaugggauaaggaaguggccugggaacgcucuguccugacagugaucauagccuuugggaccuucucugugauguggccaccuccacuaaugaccuucccaaaugaggcagugagcagcuuccugcccagggauaaaggcucaauggcaagucucuaguagguaagcgccccagagaaccuggcacauguccaguggacacagauugucagggggccacgcauaccaccuagcuuuacuuuuuugaagugcuuggugggaggcgcuucccaagggccucuaacugcacacaucgacacacuccugacuccaacuguuuggcccuagggaggcacauaaaauagugcguguucagauaccucugcucccagcccagacaaugugggaugguugcaggaagggaagagaaagcugcuucuagcucauguggaaagcagcacgaauggcuacccaauuggcagauuguagauggaggaagcagcucuggagccauuaguggagguggccacguucuuuuccuccccugcagggcagcugagacacagacccuggccaaacacagaagagcuuucugucccaaguucuccauggugccagaaucauccagucacaacuggucauucucacaggaaggcagaaagcagguaugagcagaaaugaguaagcuggguggcgacuggaagccuucagguacuugugucugagaaggccaucacaaggcuguggagaguggugucacacuugucccggagggcaucgugucagcugaggccugaacacagugcuacuuuggucucggcuuaggaauguucugauugcccuauggggccuggaucuaacuacccagggccuuuuuugccuugcuagcuauagacucauggcugccauuacaaugugagcaagcccagagaggggacccuuucaugauaccugaccugaugacccugugcagggacguuuuguggucacaccugccuguaucuugagaacgagccugucaggguguacugagaagccacaguagccgagagcuauaguuggugagcacagugggcaagggagcagagcauggccgcggggacuaugcaugcuuccuaucaugacaugacagcuccacugugcagugucgccaucucuucaccuauccucuugcauccugacaugugguacccaguagcuuaguucugucagcguacagcuuuaggcuagcacccaaacucugccuguauuuuuuuuuagccaccuaccagucccuugcuccucucacuuuuauaacccaguggacacauugcuaccagugucugccagagcuuugccugcccugucggaugcagagcaggaggcaggugcacuuguguaguacuaucucccacucugcuccaggcuugcccucagcucccguuaccacagguggccuccagacugcccucucagccauaccacccucugccucaaacuugucugcggggccaaagugcagucacauccaaggugggccugucuccuagcugugguaugcgccacaccuuggaugagagcaccuaagguggcagagccuuguuccagggagcugcacaccaaauauguguuccacauucucuucacaugcuagcaauguggaggaauuuuuuucuauaguuaaaaaaugcagaaacuauugggcaugaugggacacgccuuuaaucccagcacucaggaggcagaagcagcaagaucauggucuacauggcgaguuuaaagccagcuacagcuacauaguaagaccuuaucucaaacacaaacaaugcagaaaccuuuuuuacccugaagcugaacaaaaagccugcugggguaaaugggcuggaaagcccaguuagagcggugguggcugacagcccugcggcaugccuuaagccugcacucccccaucgccgcacuucagguuggccggagcucggcuguaaagcuccauugagggcgugcuugguagggucuguacaauacaagaggcuucaugggaggccugcuuuuguuuguggguuguggggagccgccaccacauucagggcugucugugcaccacagucucacccaaguuuaucaggccaaagagcuuccuuugcuugaccugauuucugacgggcaacugaucaguguucuguuucaagaaacagucccugcggcacgaggagggccaugccagacgacaggggccgaccagcuugauggagcuucccaaacugaggcugucgggaaugaccaaacugucaucauguuccagcccugcacugcggucagugcugggcacuggagcaaauggaaaagucccugugcugagaccccugaagugugcugcugugaacaagaagguaguacgucucuagcuucucuguggggcugcucucagucuggccuuggccuccacucagugucugugguucuucuucaccagacagacacgcagaaggacaucaaaccucaccugaaacacuaucaccugcccacgaucaacaggaaagggggcgaauacugaacggcccgccacccagucguccucuuggagagcaagggcuggcaccauggcaggcguaggccucugcggcugagaguggaugggccagaggcugccccaugcuggugcuccucgcacugcgugguggccaggacaugcugccuugcagccugucucucuccacaagcuggagccuugcguguuugcagcuccagagcggcugcacugaauguuuccguuuaauauauuuguaaaaccaccuuaugcaaggguuuguuucauuuucuuaauguaaggaucugaggugacuuucuaugaaagaacagauaugauggggcauggcagcuagcucgugccuguaauucuagcacucaggaggcagaggaggaggaggccugggcuauacagugaguaucccugccucaaaaagagaaauaaaagauagaccaaaaucugugaugagggacguaggcuuaguugagaggcgguugugcauguuguaccucaguguuuccugacaggacuggcagguauuguagguguugugacugugguaccuccuaggaaugcuguuggagacagaaucccacugaauaaggcacugucacagugucucauccaaacauucuucacuuagauauguugagccacaccuuuguguuugcuuuccugagcugcagaugggcaggcugaucuccgagugccagcuucaaguggccacauugucuuggcugccaaugccuaggcuccuuuagggauguccaccaaguugacuggauugccaguguugcuuggagcaaguaggaaaguuggggcaccuugugcccuggaaaaagacacugggcuagggagauagugugcagguaagaugcuugcugcaucugaggaccugaaucagguuccauagaguccguguaacaucccuauaaccccaucacuggggaagggaacaguacagaaugggaaagacaggagggucucugggggcuuucuggccccuaaagcgugcugaaccaaaacccagcaagcuccagauucagugagauuaucccgugggaaucaaugacucagaaaacaguuaauggcacacuagguguccuccugggacuccugcacaugcgcaugggugcacucuagcacacaguguguguucuccuccugccuguuuuacuacagggaagggauggaaacacuauaaaaacagcacugaguggacucagggcaaaagcagccaucagacagcuggacuugagcacaagaucccccuaagcuccuuagggcuuguuuuugcuuuugccauguggaauccggggccccaugcacucuggguaagcagucuuagcaguagccuagccucugcucaguccuggggaacaaaggaauugaguaugcuuuuuuucuuuucuaucuuuucaaauuuauaccauuuaaaaagcaaaacuucacagggaaguauugagucucaaucugaucccuuccuuaaggacucuacugacccaagcuucaggccaccaggcagguggggggguuggggcagugacaccacaggacaaugugggacagcagagggcaguaugggcguggaacauuguggguauggguguccagcacaggcaggcuugagacuggagauggggcuuagaaugggcagagccagggccuggagggucucuucuacauuuaugugacagucuuguguacccuggcauggaggagagugucugcagagaagggcuguccugccuuugcuguugguuuuaggagucucaguccaguaguauuaaccaggcucacaggcaggccagcacagaaagggcccaacgaugagagcuagcagagcaggccugacagaacggcccaaaggaggaccugcguggcuggcaagcuggacugagccuggggacaggguuaggguaccugccccuggaaaggcugcugcaaggaucugagaggaaagcaagccucucggcuuucucggccuccugugcgucuggcacaccugcccagcacagcagcuucugugaaucgucaccauagcauucugaauggaaaggccaacaagccucaccauucucugacguguaucuaacaugacuguagacacuagggugcagcauucccucuaccucagacuucagaguggcaucugucaucucuuacaguaccagguaagugagcuguuguuacuuccuauggcuccaggaccugcuguaugcugggugucccugguguuagggcagcuauagaaccauauggaagacaucuuagaccucggggcuagggacuaaucuuagaaacagagccagaagauuguuacaggcacagagucaucuaagguaaacugggacacaucuggucaaacacagaccugugacacagacugguggagguuggccccgaguugucagcaagagccgugggguacaacugagcaucucgucaaauggggcucaaguuucccacaaauacuugcugcccugguguccaccugguguccuccugucacuuccuauagaugggggcaucgaggagggagccacucugggaggucaccaggcucugugcugcaggcuuggguuucgagggcaguuccuaaucacuuucuuguggguguuuuggacucauagggcugaguuucucugugugauagaucaguguuccaagaugacaggaacaccaaacuguaaaaugugccaacacuuucuucuaauaugaucugagcaugugauucauaaauuguacuuacauagugagcaggcucaaugccaccgacccucaugaccuaccuugaucaccagaaccugcaugguaggaaaggaggaaagagcucccucgaguguucuaacucccuacgcagugugccucuugaaugaggcacggugguguaugccugaaauccacgcacugagacuuggauggccgagggagcaugacugcuuucauuuugaaguaaucuaagcuacacugugaguuccaggcuagccaaggccugucaaaacagaacacaacagaacaaacaggaaagaagaaagugagucuuggcguccuaugcugcaccuucccaagauggaggcagggcuaggggccuugcaggcagcagcagaaggaagcggcuuccccagccugggagccaggaaccuacggugaaugaagacaaacuugggcuuugcuuugugaacugugcaguagcaucauccuguggcaaauucauccggccuagcuagagcccacacuccuuccuuccacggccccaguuuaaugggcucauuuggagaaauguuuugauaccuuguggcuuacucucacccacauaaagccuacauggaacccgcuguguaugauucuuuaaaagcuguggaagccccccccccccccagcuuggaaacccgggcauugucucuaucaccggcagcagcuccaggugagcgaggaauucaaccagagcaggcagacacaugccagcagaugccaacccuccggaagccccaugugacugauguccgagcuaacucuguucugugcugcggcagaggcuguggaaacgcacaguaugugguuucagcuuucaaggacagcagggggacucuaagccaugagaaaaggucaugugccuacaccaaaguccccaugccgggcagccccauaguguguggacuuggcccagagccaagacuucuccgacaagacgcguuuuuaacagacugacaggaggaucaaggacugugauacacaaaaaaaugaaguacuucaauaccaaccaagaaaugaggccaaaacaaaaagaucuauacaauuuaaguuuaaaaaaggauaaacaaauaguauauucaagauaauuuuaauauuaauguuuuugugaauuagaaauaucacucuuaaaugaugaaaauuacuagugggagugacuauuuacccccauuucagaauuacauuauuuacacauauaauacagacuugauugcaucggaaacaacaguacuaaaauaaauguuaacagauaaaaagggcaucuccucucguaucgugaggccgggagcccguuaccccauagucaaagucauuucuauuagcauuaaacuauuuaagugcaaacaauguuuuaagucuaugauugcagcaucugucugucugcagcacguguuuaaguuggaggugacagcugucuccaugagugcaucccaggcugucuaaugaccaccuaacguauaacacacaucagugcaaaaccagagccaagugcuauuuagaacagcuugauuuaagguuucuguucaagaaacauuuuacuuuacacuauguauauauguguguguauauauauauauauauauauauauauauauauauauauauauauggauuuaguuacauugaauuuuagaguaaaaagcaagaaaacuccauuucucaguuuuuacugcagccccaacagacugacuuaaaaauggaaacaacucuuuggguuuagcagcuccacacagcccugcaggccgcugcugccugccgccugccuguggcuccagcgcagcucauggcuccguugucgucugucacucccucgguccacgcguguccggggagccugggagcagcagugcaccugcuacacuacagucccaccuggagaaguggccugguuuggggaugacaacaagcccugugaacaaagcaguuuccauuauuccagcaagacacagggcagugcagagagcccuggagcucacccuugccagccagcauccuuuccaagggcuggaagccaggcuuuaacacacucucuguucaccuagcuaauucucagagcauuguacugugccuggaucgagauuuugccucaacagcugcuagaaggaagguggagaagguguuuacuggagacuaucagagccuuugggagaggguguggcucaggcaauguagcugaggacagggucagagccagguaguccuccaagggcagucuaguggcacuuuuagaaaggcaucuucuccuggggugcaccugcuuucuugugcagcaccccaagaguuaguuuggccaguagauaggcgcugcagaaaaggagaccaggcccugguggugauuccugcagcuaggauggguaacgggaggagcagcuacccacacuggcuagcacagagccuaagcacccucagagccaagggcacucacucacuccugggcuguguacacucagucacaucagagccugcugcucaguucuuaggaaugugacgguuacagcagcagagcauuagaacuuggcuccagggaaugaacccaacaucuuucagcugucccgaaggauuauucacuuguugaguauuauuuacaagugacaacauuuaaugcuaaguaaacccugcuacauuuuccuaagacuguuagugcagacaugagggcugacaguugugagugggccaucggcuucaccccaggcugggcugggagggcgguagggaagagcuggcccacugcaaaccaccuggccuagccuuucuuaccucaggcuggaaaucuauuuauuggucaagacaaaaccaagaggcaagaagagauggaaugcagcaagggccucugcucugcaucuguaggagcucuuauccucagacccuguccagauaaugcaugggagggccacgccccucgcagccccugcaaacccaccacgccagugagggaggcuggugcacauagcgcaggauccagcagcucuggcccacccagccccagguugaggacagcacacaugcgcagccacuugaguauguaaccaaccuccugugcccaggcagcacucacugcaaacacagauggcccgcccugucacuguggguguggccucugaccauagccagacaauggaagagugcuaccagccaaauguguggagccgggaagggucucugcagggucagacuggguugggucaggugaaaacugcccagauuugauguuaaguauuagaacaguaaccacaacaccuguuuacuucuuacaguccaugcggcuuugcagaaugaacagcaggcgcugggacgugugggugacauucaaaagaaaaugugagacuggguguggugguacaggccuauaaccccagcacuggggagguggaggaggaggagaaggaguccaggguuggagcugcagugauggugcagugguuaggaacacugacugcucuuucagagguccugaguucaauucccagcuaccacaugguggcucacaaccaucuggaaugggauccaauguccucuucuggugguucugaagacagugacagugaacugacauuuauuuauauaaaagaguccuaggucauuuucagccacguaggaaaccugaggcagccagggcuguaggagaccucuaugaaaccccaaucccugaagacagacaauguaaaauacccuucuucugggguguagcugaguuccacugagcccauuaguguaagagaguuugggagguggaaggagcagaagaauagcucuugucugaggcauggaggcuccauggauuaggccugagcucagagaccagcacacaggaagaugugugugccugggaugugugcaccagagccagcacagcaccuacaagggcucacaaaagcaagcaaaagaucccuggaacaaagacaacuccuaaaccuaaugguuaacaagcucuucuggucucaccaaagcugccaaaacugcuggauauuucaguucaaaauuacacaacaaaauacucuagaucuugguuuuggguuggauucuaauuuacaauaaauacaaagccaauagaauuaagccuauuccaccaggauauacaagaaaaagacuuauaaaccacuacuaccaaagagcauguccacuuuccuucccugguggacacugcggagaugggucauaacugagcagacgcuggauuagacugugcaggguagagcuaagacaggcccugugggucuguuggguccacuucagccuccagcucuggcugugggaaagcugcccuuucccuaucugaccucagcgaccuuuggccauaaauaucugacaguaccucaaggaaacaguguaggauaagguauggauguuggggcugagugccccaacucucacccaccuaguuguucaaagcuauuuaucccucagcuccgaaaaaacaaaacaaaccaaaccaaaacaacaacaacuacucccccagagcagccaggcggacugccccugagagcuuaagaaaagugaccaguggauucuacagugucucagccuggagggacggcuggcccuaaggcccuauagccaggaacugcucucagguggaagccaggaccgaaguaauuaagcaauucaugccucuucagauggggcacaaugaguagcaucccaagcgacaacaccugcacgugcucuuagccccuugcuggguccccuuaucugucugagcuuacgaauccauuaauuuauuauauacacuccaacuugccagagagaaacuugacagaaggccacaguucuguguaagguccauggaagaggcuggcgugcccagacucaaugagaugguuuaggaagcuuucagugucugugucccucccugccucacaguccuauggccugguacucaggcuccugcuggcuucugggucuugucccuugaccagucuuccuaccacugacaggcacucacugagagcacacaugggcuauacaacccggucucugaugagaaaaggguucccagucacucuuuacagccaucuaggggaagacagagaaaagaaaagguucaagcuacagaagacuccucagaggcugugcacuuggaaaaauguuugccagcuaaggcccucauccugggaccugcugggccccucaaaucugccauggaggaaaagaggguccgaaauccuccaaagcucacccuuccaagaagcugcccagagccuucccuaaagagaggggcugguuuuagaggcgcagccccaagacagaggugcugcagcaggcucacuagcuggaacggacgaccacuguccacuggcagccagcccuacacggagggacaaggaugaugucacuucucccacgcacauacuagaaggguucuggguuguuuuguuuuguuuuuaaucacauuaugauuuucuuuaaacacauuugaaaaugcuauuaaccugccuuuuuagacuuuaaagcuauagcgcugagaaaaagccgcgcugcuccuguggugggaaauugggaggucacuuuaaacuacagguugaacauuucuccugcuuugcaggacuccuagccaacccaaccugcacccauuaagucagguaguaaggaaacccuggaauucugugagggcugagaggcagagcauagggcuuggcaggccaccggccuggaggacaggccgcuaagcaaaagcccagugucucgggaacuaagaggcaacagcuguauggggcagcaugggccggcucccucucaccuugucgcccgggcagggaccuguccuuagagcaggacaacaagcauggcugaugcuccugggcagugaagucaccuacugcuccugcuacccugggcucuaggugaucacagcagccaagccccagcacagaagcccagcaggggugaggugggaagagcuccuacagaggcccacggugcccuuggcucacuaggcuggcuagguggcugcagagccaacugguagaccuucagagaguuaucauuagcauuacauuugaccuuuucacacucagagaaucccagugccucacugagagcagcucacacagcagaaucugggcugcucaguaucugcauuucaucuagaagcuaacugagaccaugguccacacagagucauccauggugucucacaaacauuaacaaggcucugaauuuuacagcauuuaacagcuucucucuuuuggcucacugagauuccuuuuuaugaagcuuggaugugaaaaugacuuaaaauuuaucuacauuuacaaugcauucacacguuuauucaaugucaauauacagaggacagccuccaguacuucagaagucaaguauaugguaaaucuuuugcugugacagggacaagggaacagcuaaaagacaaagcagugaaacagaacaugguucucagaaaugaauaacaauacugauauucaagcuucauuaguuauugcgacauuaggagcucaguuuccugguaguucacagcaggagggcucuucaugaaauuuauucaaguugugaagagaucagaugaaaauguaagaaaggaauacauguauuaccuugacuuucacugaaaauaaauauacccauacaacuuuacacaaugucacuuaauaacagucuuuaaaaccuaaguacacagaaguaaaaaugcacgauuuucauacuuuuaccucaagagucaggaauugaaccaugacacaaagaaaauguaauaagugcagcaugagugaaaaccccagcaucaugggacaguugcuccaugaaaagaacagucuuacaauucaaucugggaucugauucgucaagguaacagcugaauacaagugcuuuuccacaaaugagccacaggcuuuaccagggccacacugacgucucuguucccugggacagccaccacauagcacuuugaugagcaccuuguuaaccuaagccagcuuguggugguccagucagcccaaggcaaacagcaugcucugacauaaacagggcauggggguguggcggcucccccaugcauucccaggacagagaccaguucagccuuagaaaccaaacccaagccagaggccaugucuucaagucaguacaggccuacccagagaagugcacggaggcuccauggguaaggagagggccucaacaguggucacacaugccucagugcugcaaacugguccugagccaagaugugugacuaacugcccacagcguagcgugcacuccaaggucagccacuggaaaagccaccacuaagcucuggcuggccggccgugucuuguguccuguuacucuuuacacuuccgagcuugcucaacaaagaaaacguuucccuccagcaggugagagggccuuguacacaggcacacgugugccuuauaaggcaggcucacucauuuuagcacaaauucagaaugcaucauuacaggauggaaggaacagcugugcccugagcguuuaagacaaacacuagagcagacuacugaccugggccuuguccaccuaauuuaagagugccucugaagacaauguggcugcucuccucucccugcuggcuucucuaauggcccucacccugcauccugaccucagcagcucucagagcacuucuaaacucaaccaucaggacaaacuuaauccucugcccuguguaggcuaaucuggaggcagaagccacuacuagcugcagguaucacccagucucucuggagcauuuguuuaagaggaagauacaacuucugagccucugcagagggcugggauguggcguguugggcagggguugaguccuuuggcauaaucccuggcaccacaugcacagagaaggaaaacggggggggggggagcugggggcugauucaccauagcuacagggcagcugcuuucucgagucaccagaaagguugucugcggugggcaagcaggacagacaggaggguccaacuguccaguggcccucacugagcccgcagacucugucugggucacagcaagcagacuggaacccugccuuuaagagccucuugccaguagcuguuuuaguccaguagcuaguuaccaaagauauucuugcucaugaaaacgcucagggaaguuuugaugaggaagcucaaaguuuguuuagaaaacuaaaaacauuucucuggguggcuacuguagaagcacaguggcccuaguccucauucuuuggagaucaggacccaccauggcaaucggugcaaccccaugacaccccaccaccucugucugcagggcacaaggaggaaggaagccccgcccuccagcaccagcacccucuucuggagcugccgcaccuuuaguucuggucuuggagaacaccuugcacucuguccuccugccugcagaacugcucugccggcugucaaagaaaggggggcaggagucagucagggggguagagcgggccuggagcagcaccacgcccuccaugcaggggccagccugggccaggucaugcaacuaagacagcccucuagagcuggccugggcucuuaccagacccugaaccuagcagggagcccaggaggguaagacacacacacagcaaaggaccccaaacaggguuuccagguuaaucauuaaggacacaacacuuagcagcagaaguugaaauauacugugacuaaaccccaaaucacaaacugugacguuuuuauggggaugcagaagagaauucauaggucuccauccgacaacaucagcagggucuuuucuuucccccuuuaaagaaaguaguuuccacccuguucuaccucccccgcuucccacuagcgagugauucgagucacugucagcauccuaucuauuuccccuugaucccagcucaugggucuaggaaugcuaccaggacagggcaucuguaagcucccaucaucugugcuggguccacagauacacaugcaauggcccccugccagcaaagauacccucaaacugagagaccaccauaugcuucaccauaaacguuacuuaccuaugacuggccacucccuauuuaggccaaacacacagucuugaauuuggaaacugcauacucaaugacuccgaagcauuugacaauaucucagaaacugcacagaguguuuuauuucuagccugcccacccagcagcucaauuugaucucugaaguucugaaagucuauauagcagcagucuuugcuaccucagaucagaacccuacgaacaaaggagucaauuuccaggguagaugggacaugaguacccuugugaagaguuaguugcucauggaacaacaugaaaugccuuggcacacaggugagauacgcuggagacugccaccaucucauaggcagaauguuucgguggcuaccacauuaaacagcagccacuucuugggggggggggggauaggaauggggggcgcccagauccaccaugaacauguaagagcaagggaaggggccugggauauggccuggauuucuggaaagggaagccaguagcugaccacugucuaccagagucuugauaccuuggagacauaaaagccaagucuucauuacugagccaaguucacucuagacucaauacaaacgaucauuacugcuauauuuaacuacaaagguguacaacacagaaaaauaauccuaaauguucuaaauaaauuaagaaauaaaauaacuaucauuuugauacaaaauacccagcucaaggaacuauccuccacugugaaaacugguguuugaaaagaaauuccuugagcagcugagcuggaccuaaggagcugaaagcaaacugccacaggggcaguugacccagcacugcuccugaggacacgggcuaagggagggguggcacucaggguaggaucugaguccuacagcagugcugucuccaagaguccuggacucucagcugcuguacaagaacaugacggcugugugugugugugugugugucuuugugcuuuuccccugggggaccugaacccaccaaaugccaagucaggaggcacgcugcagccuggacaccuaacaguccucacagagcagaacagaggaaccuguccuuggcuuccagccaacuuccugccccucccacuccauacaacaaaacagucagacccucucuucugcuguuggggaaaaacuaaguaugugcaucuaacaugugagucuuagcugauguggcaagagggaggccuucugaaagccguggcugcuguccuuggccaccgaacaucuaaacugcccagcuccggaacacguggggacuuuagugcacaauuugaaucagaguucuacaaacugcuucuuugaaaaaagauguuuauuaaacaauuuuaauugucauaaaaugacuaaaauggguuuuaaaaauuaaggcucuucucuuucuguggauugccagacaauguaaaaauaauaucaaucaacccugaugaaugcuuuguuccuaaguuaacuuucauaaauuccuaaguuauuuuauaauuuaagauaaaaaguuggacuauaaaugauaauuaauacccauguguacugacauacacugaccagguauacaauaaucuaguugagugguuacgcaaaaaauaucccaguuaaagcauaaauuuugacuuuagcauuuuaaugucauuauuucuccacacugucaugauuucccuaaaacugaaauagccucauacaggagcgcuaacuuugggacucuauauacccagagggaugauugacuuggcuggcaauuagucugauuauauauuuuuuaaaugcucuaaggugaauuaucaaaugauucagaauuacauggcaugcaguauccaaaauuauggcucugaugcauuuagauuuacauuaagaagugucauucacauucauuguacaucccaccccucccacaagaaauaaaaaucacuaccuagucaaguucuagaucuggugcagcauuaaggauuaaaacuuaccacuuuaccgggccuugcccaugugcaaauaaaucccuccugacaagcagugacuauacagucuucaagaaaaaccaauaccgucagucuuucaugagcuaucuuuuuacagaucaguggcucuaacaagggaacaucuuccauccgaggacacagggauguccccagaguuuuagcuggguccguuuuggcuuuaguaacuagguucaguuuaucacugcucuugcuggaaaugugucccauacuaugguuucguuuauggucuuucucguggugucucuccuuccggucauguagcgacagaguugcaaacuugcugaccccggaggcaauggccccguccaugacgcugccuuugcuagcagcauuggagacugcugaauguggaaggcuauuggaccguggcaauggagggggcacagaguucccagguguagugacacuguucccauugcuuccggcaggcggacuuguggcauucauaacguuuguauguguccuugcucuugagaggggcuggugagggaaaaggaugucuucuguaaggucccauaaacacagcuguguauccuggcccaccgaaccaaaccgauacguaacacuuacagggcgacugucuguagaguuccguuuggauagccuagacuguguacuguucgcucgaucucugccaaaaugaagaagguccuggaaguccucgucacugccacuaaacuccauagggucacuuucuucuacacuaguaguauagggaucaaaugcuacaacacugacccaggauuugugcccauggccucuagcuauuacucggcagucuagaaaggaccagacugucaccaagucguccucuccaccugucacaauguacuugccaucugggcuccagcacacacaaagcaagcccccaaaguagcuuuucauuguaccgugcagcuccacugagucaaaguugaacacacgcagaaacccguccuggcucacacacgcuaagaacuugccaucuggggagaaagcaaacucguugagggcccccucgcccaccguccacuuaaggagaggguuccucguggauuugcucuugcaagugugcacggcaaagcuuucucccugcuucaggagcugguaguggggggcuguggugccacaagugugcuccacauuauauaaguacauguucccacuugaaugggcuacuaggaaaaggcuuuccgaaccaggaacccauuugacacagguuacgcgggacuugucuauuagucucugugaagacaaagagaacacguuaucacaauggagaaguuaaggucuacuuuuccagaaaaaaaccugucugcuucuugguaagaagguaaugguccauccaggcacuccacacuuugucaggcaggccagugaagcacauguggcccaucccagaacugcacuugggugucagucauuugauaacuaccugcugagagccuacucugugccagguaucaggucccgggcacacaggggcaagacagccuuugccccugauggcaggggcggcucaauguuuugcuucaacuacagcagcuuccucucgaugaggacucagaggacgaguuucaguccucacagcuuucuuugccuuugucacugcaggccaugggcugacuacauugucccuuuuuguggcugcucaagggcaaggaaucaucguagccugugaccagcagaacacagaacuugaaagcauacuuccugggugggcaggaugcagcucuggacucacuguggcuuuccucaauccagacgaugaacugugagugucuuacccacaucuccucauucucucuggaacaggauggagguuagcucaggagucugcucuaccacuaccauuguguucagugcucaccucugguccacugaccuagcugccucuuuagcugcuuguaucagugucuugucuuuaaaaccaaacuaacgaaagccagacaugaacgccacucaagauauacagaagggguagccuucuucucugugcagacccugcgauagggcucacuaggacacacacccucuacaggcuguagucucaaaaucacauuaccagaaauaaccaauucccaauccugccacacagcugccaggcagucucuguuaagccuacacucuuuacugggucagccuagaaacgcuuaagcacuuccguuuugccuaacuggcugggguuccccaacaugaaucucagggcacacugcuaugggcuugagcuauagccaucugcccaauuggucugaugacc

SEQ ID NO: 6847 - RNA, 3695 nt, Mus musculus
aaggauccguaccagcaaguacccuuucuuuuucaggccuaggaaauggccuaaaaucccuugacaauaacacggguccaggacagguggcaaagucuagggcccucuguucucugggcuuccccuccuguggcccagcacccuggacauucccacccccgggcaugcuguacucaggagcagagcaacaggugcccccgaccaggcuggccacuuuagcagacagcuagccucugcuccuggcagcacaucauggccugcaagccuaugccacaaagguugaauuucacagcccagcaaaaucccaggauagggacgggcccucccccagucucaaaguucccugguaugaacccagcuuugcagccagggccccuuuauccugaaggaugagggugcauucauuaacaagccucccggcuucugaaguguccagcagaaagcagcauuccaaggaugggugagaagccuauccagggugauaacacaggcccacaagcaccaccuaacauccacugugagugauguuagugaguaaggccaucccuggggcugggcagggggaccuggaaggcacaccugguucucaugagacaugaugcaggggacccaaagccuguggggaagcagguggggaaacccaaggcuagcaccugccaaguccugacugaggguaaaagggccaacuccaggcugggguggagaagcaaugauucagugugagaugagaacacagacacacagucuggcucccauucaacaccugcuagagcugccugcucagcucugcuggacacacaucaguccaacccaugggccauuuaugaggcugacagcacaggagggggccacucaaaaccacacaagcuuguccccuuggccucagcacauucuguccucuugcuuggucauuagaguccccacccucuguuccuguuccucuccugcuuggcucagcugucaccuuccccgggacucuagguccucacccuuauccuuggcugagcagcgaguucgcacacuugagcaacuuggcagcccuaccccaaauacaugcaacagaccaggcagaucccucuguacagucaacgauccauauauguaaagugccaaguacaaugcucucaaaaaaauacuucuguccccauauacugugucaggguccccugagucuagcccuugcccgugagguccaagggcugcaaaaacgauggcagaggcaguucaucuaaggccuccgggaagcggccaggugagauaguggugaccaacaccugcauggcacggacaaagagggaggguggcgccagcccugccagccacuggaacuuguccucacccaacaaccgcugccagcguagcuggucuccuagcaguucacaucgagcuggaccuacgacgccccccgggguguacaguacuagcaggucaagcagcagcaggcggcgcugacacaccuccucagacgaagugguguuggcgguggcagcauugaccguggcagaagcugccucagccuuagugggggcugagcuggcguccugguucagcuggcgcaacagcagcuccaaugguguaaagccacugccaucucgaaggccuggagaagcuccguggccaagcagcagaaagaggcacucggggcgugcgagcucacaggccacaugcagcgacgugccaccgcccuccacgcggcugcagccacggcggucgaggaggcgcacgcgcucuuccacugggaaguccugcaccguucgcaggaugcgccgcaggaugcccacgcgguuguagcgcaccgccagcgccacgugaggcccaggcgcggugcagcagcggaagcccgcgcuagguggggcgagugcacaccgcgggaagguagcuagcagguagugugcauaggcuugguggucgugcacaagcgcauagagcagagccuccgaaggcgaauaggccgcagcgcgcccccgcucaucacaguggaaggcuucgcuggcacguauguccucgaguagccaaacuggcagcugaucucgcacugccagguagaaggcgaaggaugacuuccggcacugcuucugcacccgcaagcgagcugcgccgggacccucgggcccuccguuggcgcugcguccaggccuggugucccacggcaugcuggccuccgggagucucaaagcaugggucacaccaccccagaccaaccugugagacgaaguagggucgaaugaaucgggucugccagucacugcccccagcucuauucucuccuggacccagaaccauucuugaauuucugcaccugcacuuccucucuugccugugcuagagaaggcuggaucugcuggagccuuccgugugccaacccucugcagcccuggaaccuucaaaaagcgcuccuuucacaccugagccagguccuuccaacugcaaauaaagaggaacccaugggacaucgcagaagacucaggcucacagcacaaguugagcccaaaucacccucacacccccaaauccagccccaacucuacuucuacccugaccccaagagacuacucaaacuucuuuccaggagggucguggagauuauucacuuagaccuaccugguuccugcaggcggcccuggguucuguagaugcagguauucacucuaacacaccaaaccucaucaacaagaaagugguggcccagggcuggcagugcgcccgcccgcagccagaguuggaaaguggcucuggcucuuuuauccacaaacaauuuuccugcccaucaggaaggagcuccugggaggagggaaaaggugaagucaguggggggauuggagcauacaccaccugcaguccucucgagguccauccacaugaggccgauacugccaucucacuuuucaacgggggacaagcuaguccaaggucagucaccaagucaggcugagccaggacaagagccuaggucuccugcguucuguuugagggccguuccauacacugcagaccccaguuuaaaaacccuaccuccaccuugggucccaagccucaaaccugagcccuggccauucacccuuggucucccugcccaagagcccuacugccuccagcaaggguaagcucuagguuacaagggaccugggacagccagagggccucguccacagugucaugaccauuaacuggguuacagaggugagcacuauagagugggcugcggcagacgccccucugaggggauuggcaugacugcagcuccucccggaaccugggcccccugcgccccagaugcacugugugggcacgcguggggugccgggcggguuacguaaaguucggccgccccacgucacugggcagagucacggccgcggcucugugacuggagcuugggccgccggccagauccucccugaccccucccggggcgcgcccgagugucugcgggccgguggccaggaucaggggcugcaccugcgcaccggggcgcucggggcaggcgacucaccaagccgcgcgacccugucccugcggcgggccggagcgcgcgccguccaugcacgggcgagcagacagagaucccacgacgccgggagcggaggcagcgcccgcugcacucugagccgccgcgacaccgucucccgaugccggugcuggugccgccgaggggagggcggcgggcggcgcagugcggccggggccgggcagga

SEQ ID NO: 6848 - RNA, 3695 nt, Mus musculus
uccugcccggccccggccgcacugcgccgcccgccgcccuccccucggcggcaccagcaccggcaucgggagacggugucgcggcggcucagagugcagcgggcgcugccuccgcucccggcgucgugggaucucugucugcucgcccgugcauggacggcgcgcgcuccggcccgccgcagggacagggucgcgcggcuuggugagucgccugccccgagcgccccggugcgcaggugcagccccugauccuggccaccggcccgcagacacucgggcgcgccccgggaggggucagggaggaucuggccggcggcccaagcuccagucacagagccgcggccgugacucugcccagugacguggggcggccgaacuuuacguaacccgcccggcaccccacgcgugcccacacagugcaucuggggcgcagggggcccagguuccgggaggagcugcagucaugccaauccccucagaggggcgucugccgcagcccacucuauagugcucaccucuguaacccaguuaauggucaugacacuguggacgaggcccucuggcugucccaggucccuuguaaccuagagcuuacccuugcuggaggcaguagggcucuugggcagggagaccaagggugaauggccagggcucagguuugaggcuugggacccaagguggagguaggguuuuuaaacuggggucugcaguguauggaacggcccucaaacagaacgcaggagaccuaggcucuuguccuggcucagccugacuuggugacugaccuuggacuagcuugucccccguugaaaagugagauggcaguaucggccucauguggauggaccucgagaggacugcaggugguguaugcuccaauccccccacugacuucaccuuuucccuccucccaggagcuccuuccugaugggcaggaaaauuguuuguggauaaaagagccagagccacuuuccaacucuggcugcgggcgggcgcacugccagcccugggccaccacuuucuuguugaugagguuugguguguuagagugaauaccugcaucuacagaacccagggccgccugcaggaaccagguaggucuaagugaauaaucuccacgacccuccuggaaagaaguuugaguagucucuuggggucaggguagaaguagaguuggggcuggauuugggggugugagggugauuugggcucaacuugugcugugagccugagucuucugcgaugucccauggguuccucuuuauuugcaguuggaaggaccuggcucaggugugaaaggagcgcuuuuugaagguuccagggcugcagaggguuggcacacggaaggcuccagcagauccagccuucucuagcacaggcaagagaggaagugcaggugcagaaauucaagaaugguucuggguccaggagagaauagagcugggggcagugacuggcagacccgauucauucgacccuacuucgucucacagguuggucugggguggugugacccaugcuuugagacucccggaggccagcaugccgugggacaccaggccuggacgcagcgccaacggagggcccgagggucccggcgcagcucgcuugcgggugcagaagcagugccggaagucauccuucgccuucuaccuggcagugcgagaucagcugccaguuuggcuacucgaggacauacgugccagcgaagccuuccacugugaugagcgggggcgcgcugcggccuauucgccuucggaggcucugcucuaugcgcuugugcacgaccaccaagccuaugcacacuaccugcuagcuaccuucccgcggugugcacucgccccaccuagcgcgggcuuccgcugcugcaccgcgccugggccucacguggcgcuggcggugcgcuacaaccgcgugggcauccugcggcgcauccugcgaacggugcaggacuucccaguggaagagcgcgugcgccuccucgaccgccguggcugcagccgcguggagggcgguggcacgucgcugcauguggccugugagcucgcacgccccgagugccucuuucugcugcuuggccacggagcuucuccaggccuucgagauggcaguggcuuuacaccauuggagcugcuguugcgccagcugaaccaggacgccagcucagcccccacuaaggcugaggcagcuucugccacggucaaugcugccaccgccaacaccacuucgucugaggaggugugucagcgccgccugcugcugcuugaccugcuaguacuguacaccccggggggcgucguagguccagcucgaugugaacugcuaggagaccagcuacgcuggcagcgguuguugggugaggacaaguuccaguggcuggcagggcuggcgccacccucccucuuuguccgugccaugcagguguuggucaccacuaucucaccuggccgcuucccggaggccuuagaugaacugccucugccaucguuuuugcagcccuuggaccucacgggcaagggcuagacucaggggacccugacacaguauauggggacagaaguauuuuuuugagagcauuguacuuggcacuuuacauauauggaucguugacuguacagagggaucugccuggucuguugcauguauuugggguagggcugccaaguugcucaagugugcgaacucgcugcucagccaaggauaagggugaggaccuagagucccggggaaggugacagcugagccaagcaggagaggaacaggaacagaggguggggacucuaaugaccaagcaagaggacagaaugugcugaggccaaggggacaagcuugugugguuuugaguggcccccuccugugcugucagccucauaaauggcccauggguuggacugauguguguccagcagagcugagcaggcagcucuagcagguguugaaugggagccagacugugugucuguguucucaucucacacugaaucauugcuucuccaccccagccuggaguuggcccuuuuacccucagucaggacuuggcaggugcuagccuuggguuuccccaccugcuuccccacaggcuuuggguccccugcaucaugucucaugagaaccaggugugccuuccaggucccccugcccagccccagggauggccuuacucacuaacaucacucacaguggauguuagguggugcuugugggccuguguuaucacccuggauaggcuucucacccauccuuggaaugcugcuuucugcuggacacuucagaagccgggaggcuuguuaaugaaugcacccucauccuucaggauaaaggggcccuggcugcaaagcuggguucauaccagggaacuuugagacugggggagggcccgucccuauccugggauuuugcugggcugugaaauucaaccuuuguggcauaggcuugcaggccaugaugugcugccaggagcagaggcuagcugucugcuaaaguggccagccuggucgggggcaccuguugcucugcuccugaguacagcaugcccgggggugggaauguccagggugcugggccacaggaggggaagcccagagaacagagggcccuagacuuugccaccuguccuggacccguguuauugucaagggauuuuaggccauuuccuaggccugaaaaagaaaggguacuugcugguacggauccuu

SEQ ID NO: 6849 - RNA, 76553 nt, Mus musculus
cggcucccggaguaguuagagccagcgaagugcgggcggcgaugagagccaaaguugcgcuccguucggcaucgggggcuugaggcggcucguugcuccgcccgucugggccuccucuagccccaacucccgccagcggaucccgcgcgcucgcccgcccggcccggcgcccaccugcgcccccugcccgcggcccgccgcccgcgccucgcgagccgggguccccgucacuuuggcccggccccgggccccgccgaugccggccaugguggagaagggccccgaggucucagggaagcggcgagggaggaacacggcgggccuccgcagccucggccgccgccucggccgccucggccgccgccucagccgccgccucggccggcaccgccuccgccucggccgccgccgccgccucggccgccgccgcccccaauaauggccagaauaaaaguuuggcggcggcggcucccaacgggaacagcggcagcaacuccugggaggaaggcagcucgggcucguccagcgacgaggagcacgguagguggcagccgcccccgcgcccggcccguguccgcgcccgcgcugaccgccgugcucugcuuccccgcagguggcgguggcaugcgggugggaccccaguaccaagcggcggugcccgacuucgauccuggugaguagcgagugacgggagcucgggagacaacuuuguuuuuugugcguguuggccuucgguccgcgggggcacacggggcgcgagggcaggcggcgcggcacgcucgcacacgagugugcugcagauucgggugcggggaggccaugggcuccgguggggacagcacugggcccgcagugucccccggcucugagaaagccacaccuggccgggguggagugggaugucucugccuccaggugugguguaccggagcuaggacgggaucccggguggcagugcuggagaguuggcguccuggggcgcucggacccagggcuccgcagagacuucuuacuucaaacuggcuccuagcguuacccugccaacccuacgcucuuauugccucuugacucucaucccgucuugucccguccggucccauccugucccaucccaucccaucccaucccaucccaucccaucccaucccgagggcugguggaguaaagaucuuccugucccuccaccccaaucagguaauaaaagaagugugcuuuccagagagcaucugucuagauaagagagcccgacuuguggcuguuauuuuaagaucuguuuguaaauguguguuuccuuuauuucuuuuuucuuuugggggggaugggguggggaggaagagguugugaaagaauagaaccaucaaaagguuuagcuaaccggccauuuccaucuacuagaaauccuuguccccuaagaaggggcauucuuacuugccuuccuggugaucuguguggaagcaaauuuaaagagguacgggggugggggggggggaauccuaucagacaaaggaauucgccagauuuuaaugccuaugauucugucccaucucuguaugagacugucuuucaagguggugguuacaggaaauguuugaaaggccguggguuuuguuucagaaauaaaauucaaaagacaaucuuguacagcuagagugaaccguccugguuggagggcuuuagaacaggagguuuuucuaaguagguuauaccacuaguuugaaaagauaaaugcuuuuccuuggaaacaagacugcagaaaauugcaaggaucugguccuugaaaaaggagauugcuuuuaaguuguuauuaaggugcugaacucuguguuuagguaaaagugaaagcacagaagagagggauucagggugaguguuuggucaccccaagaauaaaugauuugcaaaugcaugacuccagucccucacaguucuguaguauaacuccccgcuucguaaacuccuguuagcguuuuagauaguuuccccuuuccucacaucuuuuucugggagucacuuuucauuuuuuucauuuuucugagcagggcuucaucccuagcuuggccaccaggggaagcauacugcuuuucacuuacaguugacccuauccucauuuuguaggucaaguccgacugcagugauacauagugaacaugaagcuugccacaaaguuucucucacaaguuacucuuaaaaacugaguggagcagucagaccuuccagaaacuugagucauuuuuguuacauauuuucaaagguuauguaaauguuugaugggaccuaggaaaaggacauauuuaauggucacaggauuuagaucucuuagucucugcauugucauugaggugccuggugccuuuagaguuagacucuucuuugaaacaucaguugucaugggauaaguuuuggacucuugggacauuuuugcuuuugugacauagggucucuccguaauguaggcugucuuaaaaauuugcuauguggcccaaauuggacuuaaauuugguaucauccugcuucagugucuuuagacuuaguuugguuauuaauauuuuuuaggucuuguacauauuuauaucucaagaugugauaguuaacuuuauuuauuuauuuuuugucauggugggauugaacccagguccuuacacauucuagggauauauauuuguuagaguucuagaaaguaaaacacuguaaauguucucaugcauagcuuuauugucaauugauuguucauguuaauauuucaaaacuuccuauuuuguguuuguuuuagucuggagaguaauuuaacugcuaugacauucuuuaaaacccugcuuugucagucugagcacugggacacauuuguuuacuguuucugggugauuuuuuuuuuuuuuuuuugcuaucauugaauguaaauuccaaggaaagucuucugguuuuugucuugugguuuuuuuguuuuuuguuuuuuuuuuuccgagacaguuucucuguguagcucugacuguacuauagaccaggcuggccuccaacucagaaauccaccugccucugcuugccaagugcuggaauuaaaggugugugccaccacugcccggccucuuguguuuuuuugaggcaggguuuuacuguguagcccuagcuguucaaaaguccuugaacuuuuaaacaggccaugcuggccuugaacucacagagcucuaccuuccucugacuucagagugcugauauuaaaggccugagccaccacccuggcugaagaaacauaacagaaauugugcagcaucuuuguuucacagcaguuugcuuuuagacacaagacagugcccccaugucccaagacaggauuucucuguguggcugcucuggacucucuguagaccaggcuagccucaaauucaguaaccuccuugccuuccucugucuccccaacauacccugcccuuuuaaauggguguuuugcuugcucaugucugugcaccacauguguguagugccuucugaggucagaagaggguaccagagucccuggaaccggaguuacauagaugguuguuaguaccauauaggugguaagaaucauauccagguuuuccgaguaaccagugcuuuaauuucugagccaucucuccagcacugcaagacagggucuuuaugugcuuauaaaaaguuagggauugcugggcagugguggcgcacgccuuuaaucccagcaccugggaggcagaggcaggcagauuucuagguucgagaccagccuggucuacaaagugaguucaggacagccagggcuauacagagaaacccugucuugaaaaaccaaaaaaaaaaaaaaaaguuagggguuggagaaauggcucaguggcuacucuuccaaaggccccagguucaguucccaguacccacaugcauggcaggccagaacugucuaacuccauagaucuaauacccucacacucgugcaugcagacaaaacacaaaugcacauaaaauaaaaacaaauuauaagaaaaagaaacuaggaaugccagacauggcaguguacaccuauaaucccagcaccugggaggcugaggcaggcagaggaguucaaggcccugccuuagagccaaaaacaagggcuggggagaugcucugggcaugaguucagagcccugucaccugcgugaaaaaggugggaguggccacacaugccugacucuaagcuuccauguucagugagaggacccugucuaaauacaugcauacauguggagauugcuggagaaagauccugaugucagauugcucuggacucugcuauguguaagcacacagaagaaagcacaaguacgaaaacgugaaaccagaaguaguguuccugcucuuuuccuccgagugcuuccuuucccucuggugcuggggacugcucccagaguccuggcaugcuaauuacaugcuggugcccggcuacaugacugauuguuuugagucaugguuucacuuuauauccuuggcuagcuauguagauugagcuagccucagauucauagagaucugucugccagugccaagauuaaagguguucuucgccaugcccaguucagaggcauccucaaaugcuucugccuaaguuuuuacuuuuuaauuuuuuuggggguacgguuugagacaggguuucucuguguagcccuggcuguccuggaacucacuuuguagaccaggcuggccucaaacucagaaauccaccugccuuugccucccaaguccugggauuaaaggcaugugccacuacugccuggccugccuaaauuuugaaagcauuuccccccuuacggacgggcagacagcuuuccuuucucuuguuuuuuuuuuuuuuuuuagacauugucuuccuuguguagcuuggguuuggcuggccugggauuuggggugaucuuccugucccaacuuccugagugcuggcuuacaugcaggagccaccacacuugguguagaaagcuuaaaaaaccaacugaaccaacaacaaaguaguaagaugugugaaugggcauucauuaauuuuuauuuuauauuuuuaaaaaacagggucucuuuagugaagacuggccucaugccuaugacaggccuuccgcgucagccucugauguaguagugugagccaucaguccuaauuuacuuauuuguagaccucagcuugaccuaauuucuagagugguugaaaguaagaguaccuuaucauguacaaugagaauugaguucuguuauccucccaaauagcaaacgagguggauagagcccgauacuucugagauguuccuguggucguuauucucugguuaggccuaggcuagguuucugaugggcugugauaguugggauaagaauaccaucccuguucacacggagagucuugacccuuuagaggcagaugcugcugcaugugacagccaggcugucuugucacucuugccuccagauuaugcugagcuguccuuaguuucucuuagacucaguauuaaagaggaugucagaggguguuuaagguuaucacugcucuggcugguuucuacauugcuaaagcaucucuuauuugauaugaauagugguuuuuuccccuaaaauaauaugaauguuuccugccucuuguugguaaacaauaagaggaagaaccgugaaaaauuuuaaaaagauuuauuuauuuaauggauaugaguacucuaucugcaugaacaccugugugccagaagagggcaucagauccuaugauagaugcuugugagcccccaugugguuguugguaauuaaacucaguaccucuggaagaacaggcagugcuuuuaacuguugagagccaucuuuccagcccguggacaaugacuuuuuaaauggcuauuuauuuuuauucuuuuuuuaaagauuuauuuauuuauuuuauguauuugaguacacuauagcuguacagaugguugugagccuucauuugguugcuggaaauuaauuuaggaccuuugcuugcuccaguuggccgcauuuuuauucuuuuuaguuguguguaugggccucagagcaguuagagaaacacugugggggggagucagucuccaccuuguggauucuaggaauagaacccagggcuucgguuuguugacaaguuugcugaguuauuuuagugguccuuucuugaguuucugauaguccugugguuaucugcuuaguuuugugugguguuagggguugaacucugguuuagugcaugcuaggcaagaacucaccaacugagcuacaucgcaaacccuuuauauuucuuuagucauuucugugaugcuuuguauuuuuuagcuagaggagcacaguggugggauguuauaguugcuucagcuguuuucuuagauauguguuauguaaguuuauucuguguuuguuuuuucuuuuuuucuuuuuugguuuuucgagacaggguuucucuguguagcccuggcuguccuggaacucacucuguagaccaggcuggccuugaacucagaaauccgccugccucugccucccgagugcugggauuaaaggugugcgccaccaccgcccuuauucuguguuuuuauuaucacaguucagacaugcuaaauagaauuacaaguuucauagaagaggaaauuuuggagggacaggucagggcauccuagguccuguccacgugccuucccacggcgcagccucccacucuccuguaagacuuugccaacuuugagcuugucuucauccucuugcagcugccuccugaguuuauggagaacauugaugcuaccaugccgggugacuuguaaagguguucuuaccaucucauuaccuugugcauaauaggcacuuagaagaaccaguguguucuaucugcuuuucacugaguuuuuuuggggguggaggggagcauuucugggaauuaaacauaauuccaggcaggcacucuauuauugagaaacuuccacagccuacuuuccccccuauuucuuaaaaaauauguccauccaucuagccauccauccauccauccauccauccauccauccaguguauacauuuguaggucagaggacaaccugcaggaguugauuuucucugacauguggguccuaaggauaaacuguacuuuagugagugcccuacccuucugagccauuccccuacucccaggugguuuaugccuuacauagcugaggauggccuacuuaguucucuuaccucuaccucccaauuguugggauuacaggugugugccaccacccugguaccuauucuguuuucuacaugagggaaauagaggccuagggauaaaguggcuuguauuucccagucaugaaaacuaucucgguauagccuucuggaccaaaccuuaccuuuuacuguuuuagauccuuguuaguggguuuaguaaguaauaugugucaacucuaauaagcuuaaaauuuuggaaagagaagaacuaaacuuuuaaaaauugaaaugcuaagauaguuauuauguauacuuugauagugccuuuuuauuuugcaaaucacuguaagguaagguagaaguacaaauauaucauuauaaauaaugauauauaauaauacauuauuaggugugauaacucauccuguaguccuccucauacucaggaggacagaggcaggacagucgacaugaauuugaggcaagcuugcacuaggcagugagccccugcuuuagauaccagaaaagacaggggcagcuggaggggugacucauucauucagagugcuccagauuccaggucccagcauccacuuugggugacuuacaaccaccuguagcuucagcuucagggaaauucaacaccuggcuucauugcccaacuguauucuuaaguacaugcccuccucuaacaugcauaauuaaacauaaaauauaccauaagacaaaauggaacaagcaaaaaauucaggucaaacuauuucagaugggagagugcugaccauggucaccuaagaaugucagguucagcuacggccuacuccuccccucagugugcagcccuggcuguccuggaacuagcucuguagaccaggcuggccucaaacucaggaauuugccugcuucugccuccuaagugggaagaugaaaggcacggccaccacugccugacccccuuacuuuuuuuuaucccccuguaagcaggcaaaauuagaugugccagugaucacugggguagaugcuuaugaagauaaugaggaaagaggcuccaguggccagagccugugugcaugcccugugugaugccugugaaggacaaggggaagaccugaagauucugggaagcuugucuguuugggaacccacuuccuauagaagggaaauugagcgguguauuugaaggaugcuagaacugauuguugauugauuaauggauugauuuuugugggacugggauuaaacccagagucucgugcaugccaggcaaaugcuccgccccgagcugcagccccgcccuuguucuuugcuguuuuggccuggaugugcagccagguuggcuugggaauacccuggccuuccugguccgagucugggguuauggaugugugcagccacacucagcuguugaugcagaaauacuuagguguaaucauuuuauuagguuuuuaguuuguuuauuuuuaaaacuuccucugggggauggagagauggcucagugaagacagcaacuguguacucacauacauuaaauaaauauuuuuaaaaaaccuuuuccuuauuuauuuuaugugugugagucuuuugccuguauauauguaugugcaucgcaugugccagugcccacaaaagucagaagaggacuuuuuagucacccgggacugaaauucuacauggcuccuggaagagcaaugagugcugcugagccaucucuccagaccuuuucuguuuuucuaaaugcuuuucccaauuuaaagugucuuguagcucaagaugcuuaaaauugcuguguagcauuggaugaccuuuaacuuuugauucugcucucugucuccuaaguaggagugugggcguaccagguuguccuugaguuugugacaguuucuguuucagucuuucaagugcuaagagacaguuucacuauauagccauggcuggccugggacucauucuguagggcuugccagccucaggucuagcugcccuucucccaugugcugcuguuaaagauggauacauacucuuuuguuuguuuguuuuuuucgagacaggguuucucuguguagcccuggcuguccuggaacucacucuguaacccaggcuggccucgaacucagaaauccacgugccucugccuccccagugcugggauuaaaggcgugugccaccacgcccagcaaaauggauacucuuuaaaccuuaaagauguuucuggcugacauagauuuacuaacuuuugaaacaugguccuuuguauuuuauuuugcauuuuucaaauuauuguauuucuaagauuggguaucuuuuuuacuucaaagcuuuucuuuacauguguguguguuuucccugcguguguauuaccaugcugugugggugcccaugggggccagaagaggacaccagauacagcuguagcuggaguuacagaugguugugaccaaccccgugggcccuggagaccuggggccuccgcagugggugcucucagcuguggacccgucuuuaugaccucucuucuagguuuuucuuucuauuugcuuuaaucaguguaacuuuuguuuuuucauuuuuauuugugugugugugugugugugugugugugugugugugagagagagagagagagagagagagagagagggagggagagagagaaagaaagaaagaaagacagacagacagacagacagaaagacuguagagaaaaaaaaaaaagaggccaggcgugguggcucacaccuuuaaucccagcacuugggaggcagaggcagguggauuucugaguucgaggacagacuggucuauagagugaguuccaggacagccugggcuacacagagaaauccugucaaguguagaggcaagaagacaacucugauucuucuuggguggguucuggugucacauacagcaaguuguucuaccuggugggccaccugaccaacccaccuuugcuguuuucuguauauuggucauuuucuuucauuuucauuguguuguauguuuuaauugauuacauuuuuggagacagggucucaucauguagcccuggcuggcauaggcuggcuuugaacucacagagaucugcuuccugucuccugaguguuuggauugaaggugugaggcacugugccaaacuuguauguuauguuuugaaacaggcuugugcuguauuguauuggcagacugggaaccagcugcguagcccaggcuggcuggugacaguucuccuuugccuccuaguauuguucuauguaugugcgagccacugugaccuucuuugguggcucuuuuuaaaaaguaauaucuuaaaucuagacuaagcugacugugaaccuauccucuugccucaagagcuggauuucuaagguaugccgccauuaugaauaugccagugucucccccacacccaucuuaacaguuuaaguucauguauuugguuauuaaucuccuguuaguauuguauauauagcuuuuguuuucaauauugagcauuuuaaaguuuauaaaguuauguauuugauuauuaguuuuuuauuagaguuacauauauaguuuuuguuuuuaauauugacuguaggggaaggauuuuaauuucuuugauuaggaaggaauaaauauuucuugauugggguuuguacucaaaagacugguguuggugcauagccccuguaaauaugucacuguagacuccccguuucugagguucauaucuccaagaauugagacuuuuggguauuuucagagcuaauccucuucggcuuauguugguugcuauuaacugguuggcccagauuacugugccagaugcgaaguucuggucuagugccugccuagcaagcaguuacaguagcucauuaaugguuaaagugaaggcuuuucuggaauugccagcuauuuucucagaagggguuaaagugcugugaguuuaacuaaauccagcugccuugggcauuugccacugguauguaagagaaggggaguguguggcucaggagauagaacuugaacaggagauugccaagagugaccuggcauugccagaucaguuaguauuuauuuauuccaggauuguuugaacaccauuagauuacuuaacccuucccaaaguuacaccagggaaaguuauugucuucauuuccuguauucagauacccaaauacuaaguaauuuaguuaaguuaugguuuagucugaaaauauucaguaccuuauuaacccagucuuaaauugucauuagcuuuaagagacuucauuaagaaugggguagggccuaacccucauccuaucucuuuaaucccaccacucgggaggcagagagaggcagguggaucucugaguuccaggacaguuagggcuauacauagacauccugucucaagaaaaacaaaaaacaaaaagggagggaagagcuuauuagcaacauaaucauuaacagaaagaauuuagaccaguguuaauccagaaacaucuuuaaggaaaacauuuggcagcaguguuuggcugcauccauagauuaguucuguccuugugaccuaaauggcuggacuguauguauguauguauguauguauguauguaugugacaggguuucucuguaacccuggcugcauggaacuuacucuauauaccaaguuguccucaaacuuagaaaucugccugccucuguuuccugagugccaggauuaaaggcgugcgccaccacuuccuggcuguuuacuuaaaagcagagccuugcuguagggcucagguuugccucuagcgcucuguauucagccucugaggugcugggaucacaggcauguuucauugcaauggcugaguuucauguaaaugauggaaguagaugcaugagaaacaucagcuuggugacuggaggcagcuggaguggggcaguguguucacuccucgaugcacugaaguagacagcuucacggugcagaauauguguaucgugugcaugugucagcaucauacauguguguguggaggagcucagaagaggggggcaucagcuucucuggaacugaagucucaguugcugugcuuggcucugaacuugggucccacaagagcacaccuguucuuaaccacaaaacagucucuguagccucacuggguguuacuuugcagagaacaccuugcgugguugggugacuuaggguugaaagucuagcagugugggcugcuccgcacuuuaacauuuagauagugcucucucacuuagcagugugaccuccgggauuacauugaaccugagcuguggaacuuauuucaucuuacuguggaugguugcagcugucucugaucccaguauuuuaggagacugacgcaagagcauugaucaagguugaggccgacccaggcaacaaaggaagagaauguuuugaguaaggguaugaggugcucucacuguacagcagagguaacuagauccucaguaguuuaucguucuguagcaaauccccuuccuuuccauguuagucuuguucuuccuccuucagaaccaggcucuuccucaagcucucccuucaccagcaaagccagugugcauaugcauuucuuagaauuaguaaguaccugggcuggagagauggcugcucugcucuuccagaggaccagaguucaauucccagcagccacaugguggcucacaaccaucuguaaugggaucugaugcccucuucuggggugucugaagacagcuacaguguacucauauaaauaaaaauaaaauaaaucuuuaaaaacagaauugguaaguaccuauguuguguuuuucagggauguguagcuggcccuugagugguacaggguugaacugcguagccuauaaguagauucauguuuuggaguuuugcgacagaaaaaauucacagguuugccuuauagcuuagaaaaagugaaaaauuuaagaaaaagcugucuugaauacagauuauuuagaaacuuuuaacuuacuaccauaaacauacaaauguacaagaaauuauuagcugggguccuggugcaaauuguaaugucaguacuugggaggcugaugcaggaggauuguuuagaguuugaggacacuacagugagugccagaccauccagaccuauguuaaauaaacuaagcgggguguguauguaugugugugugugugugugugugugugugugcugaacucacuaaggcucagcacacacagucggaacagcgucaguugguguagagaaacaugaacagauggcugagagagaagaccuaggccaacuugggcugucugagccccucucuccuucccuccuuccuucagguguaaaacaguguaggugguacaguacugcacuagagccagauggaaucaacaaguggguauucacugcucugcuagcuugguggccuccuggggucauguuaaccgcacgugcacuagugguucucacucaagcaggagccuccaguagacuguguguugcacuaaaauaugauuaucuugccauucauguguauuuuauuuuacuauauauauuacauauacuacacaguuuguacagucaaaggcuggguaguuaaguuuuugucaaguugggcuggagagaauguucagcuguuaaaggcuaggcucacaaccaaaaauguaaguuuuugucaagucuaaguuauauguaguucugaggugacuagcuuaugauagguauuuauuuggcauuuauaaaacucaaaacugcaaaaagaaagaaaaaacuucacugaguggcggcucacagugugcucuguuuuguguuacacucucaccagcacagaagugugugcuucucacaaguguuuaaaugacuacguguaugaguguccugccugcauguaugugcacuguguacgugcuggggucuggaagccagaagaggguuggaucuccuggcacuggaguuauagaugguugugaggcuugaugguugugguuguugggaaucaaucccuuuuccuuuuaaagauuuauuuacuuauuauguguaaguacacuguagcugucuucagacacaccagaagagggcauccaagaugguuguggaccaccaugugguuucugggauuugaacucaggacccccggaagagcagucagugcugagccaccauuaacggcugagccaucuguccugccccaaucccugguccuuuagaagaacaggcagugguuuuaacucuuagccacucaauguucugcuuuuaaacuuaacaugagaagggguuggagagauggcccaguaguuaggaguacugguuuugcuucuaggagaccuaauuugagauuccagcacuugcauggagccucauaaucaucagggaauuggauguccucuucugaacucugagggcaccaggcagacaauguggcacacacacauaggcaggcaaaacaacacauguaaaauaagccaggcagugguggcacacuugggaggcagaggcaggcagauuucugaguucaaggccagccuggucugcagagugaguuccaggacagccagggcuacacagagaaacccugucucggaaaagaaagaaagaaagaaaggaagaaaggaagaaaggaaggaaagagggagggagggagggagggggagggggaaagggaagggaagggaagggaaaagaagggaagggaaaagggaagggaaaagggaagggaaaagggaagggaaaagggaagggaaaagggaagggaaaagggaagggaagggaaaagaaaaagaaaaaaaguaaaauaagguaaagagcauuugggacgggaagcgaggcugggaacaagaguuaaccuuccccggucugaucugcgcagugugaagauuccuggaagacagucgugucacauacuuagguuccuuuuaagcagagaccuaagcagaaggagugauggaaguucaaggucagugugagcuaaauagggaguucuaggcuagcuugggauauuagcaugagucucuaucucaaaacgucaaccaaacaaaaccaaacaaaaccaaacccaguuuugugacccgcagagucagguuaagugucuuagacuuucguuuguuuacuuaucacuuugauucugaguuguguuuucugggggagggcagagugguuuuaaaauuuucauuauuaugaguguauaccugcuugucuguaggugcuuaaggccagaagaggacuuugauccucugaaauuggaguuacacguuguuugagccaccauguguccacuugggguuaaauuaaccuuuuaacccuucagccaugacucuaaacccaacuuugaguuucuuuuuucuuuaaaaaaaauucuuuuuacauauaugagaacauuguagcuguuuuuagauacacaucggaucccauuacaggauugugagccaccguguaguugaacucaggaccccuggaagagcagucagugcucuuaaaccacgagucaucucuccagccccaacuuugagguucuaauccguuuguuuucaccugcugaguccugauuuucaggucuauacagcuaugucuggauuuugucaugcuggggacugaagccaugcauggcuucccccuggcaccugagguacuucuucagagcaguuguuacuuugcuaauguuuccuuccccuuuaguauauuaauuuacuuacuuagcgugugcacgugugcauggaagcugaguggaggucagagggaaacuuggaggaauucuguacuucuaacaugcgggaucuagagaguaaacucaggucguugagcuuggcucuaaaugccuuaaccugcugagcuaucuugaugguucacaagagguuuuuguuguaugguaauuuuuuauuuuuuauuuuuuuuuaaauuuugagaacauaucuuauuguguagcagagacuggucucugaggcucuggauuugggagugcugggauugucaugugcaccaucauguugaaguuuuaauuuacauuggguaggaagaaggcagcaucuugucuaggacuaaaaaguaacacuuacuaagucagaucuucuugggcauaauucugggcuaaccaugguugugaaguuuuccugcuccagcgagacguagaguaggugugagcuucaugacuauugguuucauucauucuuuagagugccuucuuuccaaagagccucaaacaguuuuucuucuuccuccuccucucuucuuugguuuuucuagacaggguuucuuuguguggccuuggcuguacuggaacucacucugcagaccaggcuggccuugaacucaguguucugcccacuucugccuccagagugaugggaguaaaggugugcacaccacugccugguuucauauguacauauuuacacauaacuaaaaguagauuuaaaggaauguuaaauuuauucuuuacuuucagaauaaguaggagugaacucuuccucaugugugucuguguguguguguuugugucucuguguuuguguguguguuuguguauacaugauguguauauaacgcccauggagaccagagaaagagugagagucucuggaacugggauugcagacaguugugaacugcccaaucuggguuuugggaacccagcccaggauggccuucagucuagauccuccuguauccacuuugcaaguaccgggaguuagguguaugucauguuggcucucagccuggcuuaguaaaacuagaauagcacauucauguucugagagcugguguuucaguguuuaugauaaggguuugaucugauaucacugaaacaugauugcuaauugauauuauaaucauauauauauauuauauauauagucaguuugaauuaccuaaaaauuaagaauaagauaaaaaauaaauacccccugugucagucagaccucauguuuugcuuagaagggauugggggaagaauauuccuuuuaguagccuuguuaguauuuugucuuuuggucguuuugagcagcauguuugcugaugcuguauauguuuacaucagugcuucuaaaccaaacugggguuuuguguaucagcugauauucgccuuccgauuugcugcuuggcuuucugcuggcuuggcgacaggucaguuuccauagcauugcuguuucuguuuagcauugcuccugagcugagaggaugggcuugguacuguaggccucuuaccuuguuauacucggcagacuucagcaucugagcuuucauggaguuuuuaaaauuaaaauuuaaaaaguuauuaauuuuauuauuaaauauuaaauucuauaaggaauuugauuuuuguagaaaacaaagauugauauccacauuuuuuuaaaagagcauggcaagaacaaguagaaguguugaugucagucacuuuagauguaaguccuguagacuguaccugaggcaaagcuaggcacagccaucagccaucccuaaagcgcucagcuuugaccacaggggccuuagucaguuggcacacaccugacuaaguacacguguacaugcagguaaaacaccagaugcauuaaaaacaaaaacaaaaaacggugacauuuacaaguggggugaccugcugugggguuaaggcagcacacgauugggacuuuacccuccugagugucugccaucuugcuuuucacacagugacuucugcgcauguucuuagggcugacucacuaugcagggauaggacgggcuccuuacagccugcuguguacagacacugcacauuuccucugcugcagagcacuacacuugcuuccuaaauguucauacgugugcuuuguugcuaugaaaaaaauuaauaucagaaaaauagaauauuggucauguuucugucaggauuaguaacuuaaaauauuucaguuaagauuuuauaagccaggcauggugacccaauccaguggguucucaaccuaucuaaugcucuggcuuuuuaauacaguuccucauguuguggugacccucaaccauaaaacuaguugcuacuucauaacuguaauuuugcuacuguucugaauuguacugcaaacaucugaugggcagggcaucugauauuugaccccaugaaaggucauucaaccccagagggaucacagcccacaggcugaggccucugcuuuauuugcugaggaggcagguggaucucugaguuugcggagagcuugauauacagaacgaguuccaggacagucaggaacacagagaaauucugucuugaaaaacaaagacaaggaauaucugugagaguaagaguauguaugauuauguaugcuauguuagcuuaugauuuauuguaacauuuuugguauauuuaaauuuuuuucuguccuaaguuuuauaaaggugcucucucucucucucucucucucucucucucucucucucucucucucucugugugugugugugugugugugugugugugugugugguauugaucccaggguuuuguagauaugucuacauugagcuauaguaucaugucagcccuaugagguggugugugugugagugcaucacagcacauaacuuuggauauuaaauauaaucacuuaaugaguacucauuuuuucuuuaucacaaaaugccuaauuggauggaguaaacgccacggggcagugguaucucugugcuuggaaauucaggaccacggugacucuagugagaugauuucaguugagaugagaugcagaaggaagacuuuccaaagacacugcuuugcucauuuuuugguuuugagcaagagugucaguauguagaucaguguggcauugaguuucagaccuuuacuuuuaaaaccaucucucuguacuccugcuguccuggaacucacuacguagaccagacuggccucgaacucacggaauugagggcaugcgcuccuacaccugggacgguuagaaggccugacgacuggauuacaggugugugcuauugucuugguuucaggcaggugagagaagggacacucccgguugagggaguccuucauguuuuguuugaaugucauauuuuuguuugggggacagucuggccuugaacuucacugagcuccacuugccuugcuuccucagugauguauuuaaaggugucuccugugggcgugcaugugaguguguguguguguguuuuaaagaagaggcacuugucauuaagugaugggcagaagaaaggaaauguuagguggccucuguuaaacagaauggagagcacuuauggaagguauggaaggugcucugguaccuguugaugacuugaugugacaucuuggauuuucccuuucucgcagugcucgggauggacauugugcuugcugggcgagcacuccuaacaccacccuaaccccuagucuccccucaucucacucuuaggcugcauaugugcuaggaguagagugcugcgugcuugccuggcaugccuggaaccauaguccucucccagcaugaggcgugagcaggagaugugaggcccgugcagucucuuccauggugaacuuuguaagcagagggaagugaacuuuggaauaacaauaaauaaguaaauaaaauaaaaucaacaccucuaucaugacuuauaaugaugguuagauacuuugcauacuuguacgugucuuccucauccuaccuucuuuccuuauuuauuuauuuauuaaacugauaucuuuaaagguaccugugcaugcacuagagcacacaugccaugggugacugugaaggcccucccacccaccauucugggucccgggauuguacccaggccaucaggcuaacguggugagcacgcuuucuugcugagcaaucucacugacucugaccgaaccuugcauuuuagcacugcguucucuaccuuggaagaucgguguccuuuagugcuugacauuggagacauuuuagccacagggugauggagaagcugugguggggaaggacaggaugaggcgaguguguaaggacgggcucaugacauuggagggcacuguuuauuuucucuacuugcuuuuuuuaggacagagucuuaggaacugugugcucaggcagacauugaccuuggcucaaguggugugccuuagccgccauccagcuacauagcacagucacugucugauggugugggaucugcacacacaggugugcucacuaaugcaggggcuugcugagauagcuuccucaaucacuucaauaccuuauguauauauuuauguuuauguuuauauuuauauuuauuuuguaguugggugguaguggugacuaacuggcuuuaacuccagcagaucucugaguuagagguuagccuggucuacagagcaaguuucaggacagcuguaguuacacagagaaaccuuaucuagcaaaccaaaaaacaaacaaaaauugguuuauuucugcccccuguguguguguguguguguauuuguguaaguguguguguguguguguacguaaguguguguaugugguguguguggguguguguguguguguguguguguauacaugcacaugaacguguucucagggaaaccagaagagggugccaguucccuggaccuugaaucacaggcaguuuaagcugccugauuuguuacugaacagugccauguucuuaaaaugguugacccuucucuguagcuauucuagcuuauuucuuuuaguaagagucucucauugaaccugaugcucacuguuaacugacuggucaguagccacugugaucugccugucucugccucccugcacugguguuacagacucaaacuauguguaacuuucacauggugcugggcaccugaaauguucucauguuugcauggagaacacugugacagcugagucaucucccuccccaguuugguagugcagaaacuuuuaagugagcaccuuacuagaugcuaggcucuguaccauauagaacacugagcaaaauguacacccaggcccuuagagaauuaugcuuuugagagagcaugcugcuggaauacuucaagagaguguauuugaaacuuuuauccauuagaauagagaucuuuuaacucuggguaugugugugugcaugaccagaugugacaauggaggguuucauuagcccagguugacuacagauuuuggucuucugagucuaucuaugccuagcuauauacacuuuacaaauaccuuauuuagucagcuguucauuuauguauuaauuucuagauacagauaguaucuaauuuugaaugauguagaaacuggggaauuuugagcaggcuuuaaccuuuguaagccauaauggaacucgcuguguauaccgggccagcuggaacucagucuaccugccacuggcuucuaagcccuaggacuaaaggcauagaccaccacaccugggucugugacacucugugcaaacuguuaaaugcucaucuuuuuuuuuuuuuuccccucgagacaggguuucucuguguagcccuggcuauccuggaacucacuuuguagaccaggcuggcuucgaacucagaaauccaccuuccucugccucccgagugcuagaauuaaaggcgugcgccaccacgcccggcuuggcuucucauauuuuauaagccuuuugaagugacucauaaaauccuguauauuuucaguuguuuucuuagaucccccaaaguaaaauuaauuagagcucuguguguuguagugugcuuucccagcagcaguguguugcaggacaucguguauguacuuggacugggauccucuuuugugccccagucccccaaauccuguguuacagguuuguucuguccccuuguguguccugcugacaguaggagaagcucauuugcauaagucuuguuauuauguauuuuucuagguucuagagguggcagguaggguacuuuucuuuuaugauacaucuuucuguccuuuucccacuaaagagagcaccuuuggcuuucuaaccaguuugaaauacuagaucccugucauuggcugcaaauacauauucucagauuguugccuuuuaauuauuuggcuacuacauguguucagccaaauauuugaguuguuuugcuuaugguucgaauguuucuaauuucuaaauugucugcucugucccauuucuccuaaagucucuugauggaagcuaauuuaaagcaaugagauagauagauagauagauagauagaagucucuugauggacgcuaauuuaaagcaaugauagauagauagauagauagauagauagauagaagucucuugauggaagcuaauuuaaagcaaugaaauagauagauagauagauagagagagagcgggagcgcacuaaagaaacgagcuaauacuagcuguauuuuuaauuuucaaaguuuuauugaucacuauuauauguauuaaucaaugagggugugagugugagcuugugcgcuggugacaugggcucagaggcuagcucucaggauuugguuucuuccccccugcucugaguucugggguugaucucagggcaucaagcuugcuugggaaguacuuuacuugucgaaucaacuuaccaggcccaucuuucuuuuuuuccuucuuuggucuggggauggaaccagucucucugccuucuuaggguagugcccaccguagaguguaugcucugugcuuguguauauugacagcauaguguuuguuuggguagaaccauaaucugaccugaccccugaccccugaccccugacccuacagaugagcauuuucugguucuacuaaucuaaaucacaaguccuguacucacuuggguugacuuuucugcagaguggaauuguuggaucagaauucauauguaagcuccugaauucccucugccaaggcucauugugauuucugcagcgauugaaagugcuuccacuuuuagaguaaguuuaguccuucuagcucgugacuuuagcaucguuguguuuguggaucgugguuuauuucuuuucuguuugagacuuuggccuacuuuauuuauuauaaaaucugugugaauuaaugaaguugcugcgcgggggugugugugggguguggcucaugcuugcaaucccagcuauuagagcagaagcaacaauuccaggccagccuauggcauuccaggccagugagggccacacugaguaaccagcucugugacauggccugggcacaugucuuucuuuuuuuauaagguuuuuuuaagauuuauuuauuuauuuauuuauuauaucucaguacacuguagcugucuucagacacaccagaagagggcgucagaucucauuacagaugguugugagccaccaugugguugcugggauuugaacucuggaccuucggaagaacaaucgggugcucuuacccccugagccaucucaccagccccaugucuuucuuuuuugauggugagauucucugucuguguaaaaguuuuaacugaaaugauuuucuuuuuaaccaaagucucacaguauugcccaggcugccuugugggucauccuugucauuuagacuuugaacucucaacccucugaucucaaaagucucagccucucauagugaauucugagccauaucuaguucuuguuuguuugucugucaggagaaaggguuuuuauuuuuuuauuuuauggaaguacauugucacugucuucagacacaccagaaagggcgucagaucccauuauagaugguugugaaccaccaugugguugcugggaauugaacucaggaccucuggaagagcagccagugcucuuaaccacugagccaucucuccagcccagaaagguuauuuuuucaaacagauuuugcucaccaauaauuccuuuaugugauuaguauuuuuacagcuuauagaaaaguuaucuaagauguuaucuaaggugguggugcaugccuuuaaucccagcacuugggacacagaggcagagguaguggauuucugaguucgaggccagccuggucuacaggugaguuucaggacagccagggcuacacaggaaaacccugucucgaaaaaccaaaaaaaaaaaaaaaaaaaaaaaaaaaaaaagaaaagaaguuaucuugcccauguguggagagcagcacacagccugcauuaagaggcagaugcaggagaauuagaugcuugaggcugggugggccacacaggauccuaucaaauuaaaaaaaaauuuucaacaauguaaaaucccccuguucauuuguuuucuauggcugcuuuggcagaacuuugggguuuuuuuuuuugguauuuugguuuuuguuuuuuuagaguucuaaucuuuuuguuuuuguuuuuugaaacagggaacucuauagaccaggcuggccucaaacucagaaaucuaccugccucugccucuugagucuuggguucuuuuaguuaauuaauuaauuaaguaaguaaguaaauuaaccacuuggcuaguucucuuaauuuuaagcaccagaaauaaauauuuaagcuuacaguugucuuuuccaaaauuuggauuguacacuucuauuuccuuaacugucaguacuuaaaaaaaagaggaguuuacaaagccaauaagaccauuuagcuuucuuccagauuacagauuuacaauguaaagcaguuucuaccuuguuuucaaguuauuuugacaaauuugcuaggucauaaauaccaagaaaucugugaccaguucugggaguggaacacaaguagagagucugaggucagugucagugcaggcagagaugucgcugcugaagcugggcuguggcaggguuaagaaggagaucacaauggaaggguuuuuggaauuuguggguucugaugggagcacaguggacaguauuuuuaccuuuggagcguugcuuucuacccaagcugauuuaugauucucuugggauucuuuuccugauucauacagcugccccagcucuguucaugacuguuuccaugggaacagaaguaggauaacauacguuuauaaccuguugcuaggcagauguagcuugcaauauauuaaaauguucucauuaaaaagcauuugaaagucugggguaugguagagagcuugccuagcauacagcguuuggguuuuguccuuaguacugcagaaaaauaagugagugaguggauggauggauggauggguggguggguggguggauggauggauggauggauggauggauggauguguggguggauggauggauggguggauggauggauggauggauggauguguggauggauggauggauguguggauggauggauggauggauggauggauggauggauggauggauggauggauggauggauggauggauggauggauggauggauggauggauggauggauggauggauggauggauggauggauggauggauggauggauggauggauggauggauggauggauggauggauggauggauggauggauggauggguggguggauggauggauggguggaugggugguagaagaggcaaaguguuugguauuugccuuuaguaggggagguaagcaggguaguuuaaaauuacaacuccaagauuaugaacucuucugugguaaaauagcuagucuuguuuaggcucuagucuuacuugcaguaauugauuaaauguuugaaauggaaggggaauaauugaaauaauuuucugaaagccuauccccuuagauauuaaguugugguguguguagauuuaaugugacaguugccaugacccaguguguacauaggaucucaaaguggucuuucccaguucucccgucuuagaugugagugacuaguccggaggccuguggauguuaagauaccuguuucuuuauuugguuaaaucuguugaauuauaauuuuugaguggguaauaauacuauugauggagagaugacuugauuucagaaagcauacauagcguggauugugguuacugggaacugaaccuagguccucugcaagaucaagugcucuuacccacugagccaucucugcugcuccaguaacuacugguuuuuauuuggugcccacauuacuccaaaugugacccuugaagauaacguccuuuucagaaguuaugcugaacuucagguuuugcaugcgucauugcuuguuaguguauuuaucuuauguuuuccuaugcauuccugauaucaguuauuucuguaaggagcagucguuucuuuuauaguggagaugaguuacuagagaaaccaagaucugcugagugugguggcgcaugccuuuaaacccagcacucgggaggcagaggcagguggauaucugaguucgaggccagccuggucuacagagugaguuccagggcagccagggcuacaaagagaaacccugucucgaaaaacuaaaaaaaaaaaaaagaaaaaagaaaaaaaaagaaaucaagaucugagcaucagauaggaacauaugcugucaggguguugauggucuaucucucucuuagggcagagccuguaaggaguaugugcacacguccagucaucucacacacuuagaagcugggaguccccaccaugcugcugucuugauucagagccuuaguguuuaugaacugccuucucuguuuauuuguagcaccugccucugcuucucucuuuacauuaaaaauaaaaagaucuaucugugugcauugagugcagugccugcagaggucaggggucagaucccugggagcuguaagccagcugggugggugcugggaauugaacucggagccucaagaugagcaguguguucuccuagccacugagccaucucuugcccacuucuguaguucucacuagucaguuuuguugaguugguuuuuguuguaguuuuguuuguuuguuuuguuuuaaucuccuguaacaaaggcugucuucaaacucagcaaguaucuuuggccuugaacucuugauccucucucuucucuccagcucucugauggcaugacuacaggcaggagccaccaagccuggcuauuuaucccuaauagacuuacuuacuugguuacucaaaacuugcuuuggauaugggauucaggagcaggaugaaaggaaagagaauuccuaggcuaaugagagugcacuaguuaugcagacagcuaccagccacuccccaugggugagugaguaaauccagguguugaugugaauuuggggauaagaaaacaaaaaacugagcaagcaaaaaaaaaaaaaaaaaaaccaacaaaaaguaauuguaauuacagguaaaacauuuuguaagaauagacaugacaccaugguaugugguaugacucaguuacauaguauucacaggguuaaaugcacugggaacugugggcugaucagagagggguugagguuaaaaaagccaaauccucuuucucuauaacacauagaggcagauagaauugaaauuuuuguuuuuuguuuuuguuuucuuuuuaaagauuuacuuauuuauuuuauguaugugaguacacuguagcuguacagaugguugugagccuucauaugauugcugggaauugaacucaggaccucugcucacuccggccccacuugcucagccccgcucacuccaguccacagauuuauuauuauauguaaguacacuguaggagucagaucacauuaugggugguugugagccaccaugugguugcugggauuugaacucaggaccuucaaaagaacagccagugcucuuaccuguugagccaucucaccagccuauccuguuguuuuuugcuuuugcuuuugcuuuugcuguuuuuuguuuuuuuguuuuuuguuuuuuguuuuuuuuuuuugagacaggguuuuucuguauagcccuggcugucccagaacucacuuuguagaccaggcuggccucgaacugagaaauccaccugccuuuguuguuuuuuuucaaaacaggguuuauugaugcagcccuggcugucugucuuagaacucuguagaucagaauggccuccaacucagacaucugguugucucucccuucugagugcugggacugaaggcaugcaccaccaccacccagcauagcccauaugauuauuaacaaaggggacaaccacacacagccacucacaaguacauuuaggaaccuuaacauugacaauacccaccccucccaauaccucucuucucuaggacccuucccaaacuuuggggggcuucuagcauuuuuuuaaaucugaaaaccacaugaauaugcugucucaacucucugccuuuuaugcuccuauccuccugucccugugggcuguagaugaaaaucucuaggaagcugcucagucauucagguuuagaucaaaaucugcauauaacuccuuggugguaacgccucgagucacagccagcuuccccagcagcaucugugagacauccuugaugucauuguacucauggaggaaggagauugcugcucuagcucaaucacacgguagcccucugcuauuaacugagagaucuccuuguccagcacauccugcuucuccuucaguuucugaacgucagagcucaaggucuccucgcuggcaucaucacucucaucaaucacggggaauggccguugcggugaucgguaacccccaugguaaagucggcugaauucugucugacucacucuccugaacccuaagguccaggguaccuggaauggggugggcuuaaacucugaaggguccaggguugggguuaaacggcugcuucagggaacuagaaaucaacgaugacgaugaugacgacgacagagaccaccaaucgccccaccagaacugaaacuuuuaaaaaaucaguuugagcauguuguuagaagcugauagaauagaagaugauucuuugcccagaaauaauaccuggcucagaaauaauugcuggguuuggcaaggagcauuaacuuauaguagaauccagauaccuguugggcaguggugacacacgccuuugauccuagcagagucaagcagaucugaguucgaggccagccuggucuacgagugaguuccaggacagccaggaccacacaaagaaacccugucucgaacaacaaacaaacaaacaacuguuggucccuauuugagaguaggugucacuguuuuuuaggcuggccuuauucauucuguagcccaaggaaacuuuaaauuuaggauuuuacugccuuagacucagauuaggauuacagcucuguaccaccaccaagcacagcuucaggaaacagagucagguggauuucugaguuugaggccagccugaugaccuacagagugaauuacaggacagccagggcuacacagagaagccaucucaugaagaaaaaaaauaucuuuauguugaauuggccagaauaaguaggaguuaacucaaggccuuuagaacgcuagacagaaagccugccaaccuuauucugaccccucuucuuugguuuuguuuguuuguuuuuuuguuugagauaaugucuuccgaaugaccuugaacuuauaauucuccugccugcaauccaagcucugugugugugugugugugugugugugugugugagagagagagagagagagagagagagaacuuauauguagcucaagcuuaucaucucaagcacagugcucaugccucaguuucucuaguuugcugucacucugaugugguuuucuccuucguuuuauaaaccccaggacaguggacauuugugaagaugguuucugauauacuauguugagugguauauguuagacacauggcagagagagaggauguugcauguguguccaccguuggaagcuuuuaggugacuucuguucucauauuuaaggucucuugccccccuccccuauuuaguguggguguguugguguggacaugugugugaucagaguguggauguguugguggugugcacaugugugagaucagagugugaguguguugguggugugcacaugugugagaucagagugugaguguguugguggugugcacaugugugagaucagagugaguguguugguggugugcacaugugugagaucagaguguguguugguggugugcacaugugugagaucagagugugaguguguugguggugugcacaugugugagaucagagugugaguguguugguggugugcacaugugugagaucagagugugaguguguugguggugugcacaugugugugaucagaguguggauguguugguugugugcacaugugugagaucagagugugaguguguugguggugugcacaugugugugaucaaaggacaagcuucagaguccguucucuccuucuaccagguuagcccugguguugaucucagguugucagucuagauggcaagugccuuuaucuuuguucuccccccccuccccccgugagccugucugucugucugucugucuguaugucucauauauacacacaccccauacacguugccccacccccaucuuguuagguuuauuaugacccaaguggguuuuuaaaaaauuauuuauuuauuuuaugcagguguguacauuguagaugucuucagacacaccagaagaggacaucauuggaucccaucacagaugguugugagccaccaugugguugcuggacauugaacucuggaccacuggaagaauagccagugcucuuaaccacugagccaucucuccaaccccaugacccaguguuuuaaucuuaauuuaagacuaaccucaacuuggagccaaucuauaauacuuuuauuuauucucuuguguguacguguguauguaagugggguugcacauguguuacagcaugcaugcgcaugucaggggacaacauuugguagucuguucucuccuuccaucaugggcuuaaguguggaacucagaaaacaacaccuuuacccuuuaggccacauuaccuacccuccgauggaacuuucauuugagaaguagauguguuuucucugugguagugagagauugacagcauuggcucuguuccauugucagugugauguuagggagcaugcucuuuaagagauuacaggcagggggucgguaugggggacuuuugggauagcauuggaaauguaaaugaggaauauaccuaauuuaaaaaaaaaaaaaaaaaaaagaagaaagaaauagagcaacaacccccccuccaaaaaaaaagagaucacaggccauuuuauccuuuuagcuucaagucuaguauuaagaguaaaugccucuuuaauauuacacaguuugaguaaauuuaaauugcaguguuauaaguuuccccuuuuuuuuaaagauuuauuuauuauugcaucuaaguacacugucacugucuucagacacacuaggagagggcaucagaucucauuacagaugguugugagccaccaugugguugcugggauuugaacucaggaccuuuggaagagcagucaguguucuuauccguugauccaucuuuccagcccacuaaguuucccuuuuauuuuaagaggacagagggcuggauugcagcucagugauagcagguaccaggccuuggguuccauugcuaguaucccuccugccucccuaucccuaaaaagaauaaagcaauguagagacugggguguagggaggagcuaauauagugcucauaaauggauuaguuacagaaaagucauuuguuaggaugcagcgcuacacaggucugacacagggggaugcuguuuauucugauguagagagaccauuccacucuugcaucacgcaugcugucauugcuccuuaacagccuaagacucagaggaaagaaaauagauaaaaggaaacaugcaagcucgauguagccuguaacccagugugaggaaugggaagugauaggauuucacguuagaggccaguuuggccgucauaguagauagaccuggucucaaaauaaaauaaaauaauugagcaacauaauuuauuaaguguuugggaaaggcugaccacugcugcucuuucagaaguccagguucugcuuuuuaguacccacauggcaccugaguguuuuaaucuuaguuuaagacuaacuuuaaauuuacuauucucuugugugugcaguguguguguguaagugggguugggguugcacaugcaccuacaugccagagaacccacucuuagggaaucggaugucuuuuucuggucugcucaagcagcaggcccacgugguacacgaacacagucaagcagagcaccaugcacacaggauaauugaaaagaaugcuuuggggagaagcacagguuggguuggggggagcauuucuguuaucagaggggcaguguagugacagguacugagcaggcccaucuguagguaagcuggcguguuaguaauggcuguuagaccacagguccgucugcugucucccggaacaccagaccaugucucccuguaaaggcucucaggagggagcgagcugaccuugcaguuuccuuuucgcuuugcaguugcaggggaggccugcucugcuuacugcgcagacuccggguggcuuugaguuacagcuaggcucuuaccaguuccuuccugucacagggcucagagcagaggucauauguucuacuccccuacuuuuguuucuuugaucuaaagagagcugacagaacuacagggucugucucuuccucaggauccccucacacuguuugugaugggugucccucccaaugaaggaugcuugguaaugaaaggcuuauuucccacuucagauggugaugcugccugcagcucuccuuggagagcugguguggaggcuuaauuucaccucagcuuccucucuacguuaaacccaucuuguuuucaucccgucaugaaugggcaccgacuuccagcaggaccugaguuguucuugcuggggacgauucuugagcgugaagccgcgcuuugcucuucacuuagguucguuugcucugugucucugcccacagguuaggcaccuguccaauagcagucugugcuuguggucucugugcacuaugugguuccuaggacugacucucuuguuggauauuugauuucaggcauaacuguugucuuuacugacucuguaagugacacuaucuguuuuugagauuuaaaaaagagucagaaugcuggugauggucaaacugaaggaaaaguuuugucuaaacacguugaguuggaguggcuguugaauuauauggcguugagcugugcaguuaaauacuccaaagcaauuaacagaaaugguugaagaaaucucaaguguaaaugugguguggaaagaauaauugccaccagguuaaaaagaaguacccucagaaaaaacaugucuaacccuggaagcuguguccaauaaaaaaaggggcagaacaaagcaagcaaaagucaauuuaaauugucucucgugggugacugagguuucaugcagcccaggcuagccuuaaacauucuguguagcuaaggagaccuucagcuucugaccgucacugagguuaucacucaauucaugcuaugacagggacugaaccuggggaauccaugcuaccaacucagcucuaccucccuaacguuacccccuuuuccuuaaggauaaaggcucacuguaaccuuacuggcuuuggacuuagaauucccugccauagccgccugagagcuacucugaugacagaucugagcucccacacugaacuaacuagacucacucccuccuucccucccucccuccuuccuuccucccucccucccucccuccuucccucccuccuucccucucucccuccuucccucccucccuccuucccucucucccuccuucccucccucccuccuuccuuccucccucccucccucccuccuucccucccuccuucccucucucccuccuucccucucucccuccuucccucccuccuuccuuccuuccucccucccucccuccuuccuuccuuccuuccuuccuuccuuccuuccucccuccuucccucucucccuccuucccucccucccuccuucccucucucccuccuucccucccucccucccuccuuccuuccuuccuuccuuccuuccuuccucccucccucccuccuuccucccuccuucccucucucccuccuucccucccucccucccuccuucccucccucccucccuccuaccuuucugacuaacuguggcuuuauuucuuuguuuucuguuuuaauccccccuccccacaacuuuccuugccuuuuguuuuccuugguuuauauauuaagaugauuauaguuagaaaagccuugaguauguugguccaguuucuaguguggguagcagaucaggaacuggcugcauggacgcccuuaagagaaaaagcuccgucauggagcaagcugcaguucaggggcccgaguugucccugauacugcuccuccacacagugccuggacugucagugugguagaguggcagaggggaaacuuuuuacuggccagcuacccauacucauuaucaauuuaugaaacacuagccugcccgauacuagagguaccuaugucucgaggacuggaauuuaacaauggaggcagaaaaaaaauugguaucauuuaugagguugccaguaugauuucugaucaucauacaccuggauggaguuacaucaugcuuauuguucuuuguagacagcagccuuuguccuuauacaaauggcuaugauaaagucugaacugggauagggaauggcccaauguugggugaacacugaggggccauauagauuguuaggcugggcugggagggaaucagauacaaaagaaaaagaaaaggucuuucguaguaguggguggucacaaccaugggaaggaauuggcaagaagaauggauugcagugggagagacgccccgggccugaguggagauggacgggcacaguugaagggccuuguauaccuaaaugcacagggcgauggcagugagaucuccugaacuuuuuagaucuacuuaacuuuuuaguguaguuguggauuuacaguuagaaaggucguauggaaagucucugggcccacacacccaguuucccuucauaaggaagcucugggcucaguuuuuguccucuuaggaucuuguuggugaugacauuucuguagacuuuguuucuuuuagaugacaccgcugauugaggcucacugaugagaaguuucauaggguguuugggguugcugcccuuucccaucaugacuagauugcgguuauggcuuugagggaagaagccacagaagaaaagugucacucuuuuuccuuaaagacgaaauguagaaguacugugaauagauuguauuuagugugugugugucugugugucugucugucugugagugcaugagugcaaugcccaaggucagaaaaggaccucagaucuccuuuaacuggaguuagagaugguugugaaccaugugggcauugggaacuaaacucggguccucuggaaaagcagccagugcucuaacuacugagccaucucugcagcuccuauggcugcaucuugaggugacaauucagauugcagggaagcgcacucagcuaaguuacaccuuuuaggucuuuguuccuauccaguggcccuuuuuuuuuuuuuuagcaugaccccagccuauucugaggcugaagcggguuuguuuuuucccagucugcuuuuauaucauuuuaacuacaugcaaguaauaaggucaguucuaagucaaggaacaagcaagaccauaaacaaagcccuaugaucacuuuuucuaggggcuuaucaggaugaccaggauauauaagccuacuuuucuguccuagcccaaagucauguuccugccugagcuugcuuccgugcccuggcccagugucagauacccaguggcccacuucuuuuccuaggaauuuauugaccuuuuacauuuuuaaaaucaaauuuuaguauugucuuuaauuuuuauauguauguuacaguuuuucguguggcuucaguuuuccuauccacucuacuuuuucaauacuuuugaguggugguaaaaaccaucuuauggauauauguaauaagcuuuguguuuccauuugguuaauaggcauuugagaucauuuuugcuucuugccaguuggguguaauggugcuaugacuaugcacaauauuacacagacacaggggaaacgccuauccacaaaauaacaaugaaggaauuuuuuuuuagauaaauacauaguaauuugauaauuauauugugaggaaagauacuaggaaaauauugaaaguguuuucugugagaguagaaaaguuuguauauaugaugaaaaugugcaguucauacugcaguaguuuugaaucuggguggagugacugagacgcuguuugcugugaugucacagaaugcauauagcaugggcaaacacuacagaaaccccuacacuucauuauguuugaauuuuaauuguuuucugguuauuguguguucagaaaccuuuuuacguugcuaaauuuuaagaaguuggaaagugaauuuuacucuuaauauuuguaaauaauauuuguuauaguaacauacuuccuuuaacuugaguuuuguaaugaaauugguguagagcuaguuuuuauuuuauuuuauuuuuuuaaagauuuauuuauguauauguaaguacacuguagcugucuucagacacaccagaagagggagucagaucuuguuagggaugguugugagccaccaugugguugcugggauuugaacucuggaccuucagaagagcagucgggugcucuuacccacugagccaucucaccagcccccuaguuuuuauuuuuaauuccuuuaaauuugguggauuauuccauacgugacaaugagcuuuuaagauuuuucuauauuuuguaccauaucaaguucucugauuacucucauaacgagucaaggcuuccucccucccgagcuguagagggcccaccucugccucccucagaauaagggugaggaaccugcgggauggcuugagcuagggugcagggacauugucaaaauccuccaaaacucagcagcucgccccagcccugaagugcugucugggugccucggucugugcuuugaagguuaaagucuggcaguguuuauacacacaccagaugaagcuguggggguguuguacuucuacuuuucuaaaugcuaugaagaugcaugaagugguuucuauaggccugacaggcagucuggcguccuguuguguggggguugcaaggaguugcugggugccuucaucaccagggucaguuguagggcagaccuguccagccgcgcuugcugcaguccagugagcauuugcucugcuggugcagcgagggauaguugugcuuucuugugcuccuuccugucagacaugucuggguuuauuugaccccucuaacccugucgcugcugacuggaauagacugcuuuagcgaucugaaccuaggaggccucaguguccaugcuugcuucaucacgcaggucucgaugcguggaaggcaaaacagaugaacuuguguuaccugccugauccuucaagaaaugcgugugacuuuuccucuuuccugccuccgcccgcucucguucuccauagcuugaacucagcagacuaccaggccuggccucagacucgugcugcucuuccugucucagccuccccagccucccaaacucaaugcuagcuagagucugugcuuuucuuaacccuccuccaccucugucuuggaaaccacuggucucugcucuuuaucucucucuuuuuuuuuaguauaauucuuuuuuuaaagauuuauuuauuuauuuauuauauauaaguacacuguagcugucuucagacacucuggaagaaggagucagaucucauuacgggugguuuugagccaccaagugguugcugggauuugaacuucggaccuucggaagagcagucgggugcucuuacccacugagcugucugcucuuucucuuguuuuagcauuccaaaaaggucccaugaacaaaaaagacaaccuuugaccuugacuucuugucuuuucuguugcugugaagagacacaccaugauaauugggggcuugcuuacaauuucaugaccacugugaccucagacaggcauggcacugaagcaguguuguguuugauaacuuacauuugauccacaagcagugggcagagagcgagacuggaguaggcuguuggaacuccacuuccucaaccuucccaaccaguccaccauagaaccaaacagcagagauuugcuccugugguggcuacucucagucagaucaccacgcuuccuuuccucagguuuuauccuggagauagaaccuugugcaaaugcauaggcaucacuuauuguuauugcuguguauggaaacugcuguguauggaaaugcuaccacucgcuccuuucuuucucuuagauauuuguauguauccuaguucccagugguugucaaugagcugcuuuaaucuaucuaucuaucuaucuaucuaucuaucuaucuaucuaucuauuauauguaaguacacuguagcugucuucagacgcgccagaagagggcaucagaucucauuaaagauggcugugagccaccauaugguugcugggauuugaacucaggaccuuuggaauagcagucagugcucuuaaccacugagccaucucuccagcuccaguucaucuguuuugccuuccacgaaucgagaccugagugauaagcuguucugcugcugcugcugcugcugcuccuccuccuccuccuccuccuccuccuccuccuucuucuucuuuuccuauuuaaaauguuuuaauguaacuuacaaacugagcuggaguccuuuagcaugauugugucaaguucugcugugcuugcccacuuguuccauuccacugccuaaagcuaugguuuuuaguuuuguguguuuguguguaaugugcuuugaacacauauucauauuaauuuacguaacuuaccuagaacugcuuguccgcccagcaacacggcagugcagagggacaguucauuuauuugguucuuuuuuuuuuuuuuacugugaaggauuuuucuuuuuuuuuuucucaugaauuuuuuauuggauauuuucuuuauuuacauuucaaauguuaaucuccuuucucaccccccuaacccauccucccuccuccugcuucugugagagugucccuccacccaccuacccacucccaccuccccgcccucaguuccccuacacuggggcaucuaucgagccuucauaggaccaaggaccucuccucugcaacguaugcagcuagagccauguguacuccuuuguugauggcuuagucccugggagcucuuggggggacugguugguugguauugauacucuuccuaugggguugcaauccccuucaacuucuucaguccuuucucuaacuccucuauuggggacccuaugcucaguccaaugguugacugugagcauccgucucuguauuuguaaggcucuggcagggccucucaggagacagccauaucaggcuccuuucagcaagcauuucuugguauccacaauagugucuggguuaugaauaaucuuuaugccuuuuuuuuuccuacguguauaaguguuuugccugcauaugugucugugugccgcguguaugucugucgugugcccaugggggccaggagccacaucucuuaaaacuggaguuguggguuaugagcuacccugugggaguuuugcuguuguuguuguuuguuguuuguuuuuuggguuuuguuuuguuuuggguuuuuugagacaauguuuucucuguguagccuuggcuauccuggaacucacucuguagaccaagcugaccucaaacucggcaaucuuccugccccugccucccggaguggugggauuaaaggugugugacaccacuacuaggcucaguuuuuuguuuuuguuuguuuuuuuuuuaauguguuaaauuucuaaauaguuacuucaccaaaaaguacagauagcaugucauggaagcuguccaguauuacuguaucuuagagaaauuuaaaugaaagccacuguaugacuauacuaaacacagaauguuucaaauuaaaggccuagguaaaacuguaaguacugaugagugaagaagucugcuguuuuugcugaaguuagugaauuaagguuaaagccacucaaaaacaggcagucuuuuaaaaauaauuaacuauauuuacuaaaagucugacccaggaaccucacuuuucagguaaauggcauuagcacaugugcucaaugaaagcgcagcuggagaagagcaugcauuggcugcucuuccagaggguccagcccaugcgugcuacagggaaggcugcucucucuaagugcagugucacagccacuugguccacaguucuagggcuuuacaauaucuuuauuuuauuuuuauuuuuauuuuuauuuugaaagauccauucacccuccuucccuuccucuuugcuucuguuuucuuucucucacaaagacguggucucuguagcuuacauuaaugacaguucuuagucuucacuauguguccuuggcuggcuuggaacucacaguguagaccaggcuggucuaauucuaagagagcugcuccugcaggucccuucagcaagugcuggagugagcgugcgcacuauuacuaugcauuacuauguucacuuuauaaaguuccugucauuuacuuuguugcucagauuuuucuagauuuagcuauuggaagauagaacccauuguucuuuggcagccuucuuauuuucuaguauaacaaaacauucuagugucaucuuguaaucuugugagcucuagaauaagacauuucuaaaagauauauuaguuauuuuauuuggaaauguauuuagaaguccgaucugaacguuaaugugcucgguuucccucuauugagggcuuuccccgggcacaaaugggaaaugugugugcugaugugugugcccaugugcugaugugugugcccacagcugcaguugcuuugggauagagcucacgugugcugcuguuagcagcaguccuguucaccgccucggauucuuugaagccuccuccucuuuccucuauuuccgacucuucuuuagcuuacuuauuuugagguucauuauguucuuuuguauuuaugaguucauuucucuuacugcauggauaugaugggacgauucggagaaacugaugacucucccuccacagcauuagucguguuucauauugccgccagaggucagagguuucccuuuccccauccacacugucaccaggcugggcacuggcuuuguagggguggaacccaggagcuucagucuccugaucuguuggugucucuccuuguccucccgccccucuucugagaggcaggugaggguggggaagggaaaguccuugccugucuucucuugcuuuggcuuguuaggagggugauuguggugauuuugugcauuuugcuuugagguucuguugagcugagaaacuucccagccucccacacgcugggauuguaggcaagcgcggccacauacaacuccacuaaauacuuucuuuggugaaacacuguuuuuuguuugaauguuugccuauuccaaaacucagguuaaaaucucuguugccaauauauugggaggugggacuuucaagaguuuaagacaccaugagagcuucacacucaugaauugguucagugucuguauaaaagaggccugggcagugagcugaaucucuguuaauuuuuuguuggugguguuguaugcagaauuaacuuuuuuuuuaacuacugaauuauauuuaaaaggcaguuggggccaaguguggggugcacauuuuuaaucucaacacuugggaggcagaggcaaguagguuucugugaauucaagaccagucuguuuuaccuagcaaguuccaagccagucacuaauacaugagacccucaucucaacaaaaacaaaauuaaaaagguaucuucaacaauagaugguauuccaguaauaucuguagcauuccugucucucccuccuguagacccuguauccaugcccacgcaaagucaucuuaagggacuuugugaaucuccuaaaauaccauuuuaauuuuauuuauuauuauuguauggaugugagaugaacaguagugauggugaugucacagucuaagacuuagaagaucagauaguggugguauuuaaugcuuaauuauagcuacuaacuuauaauaauacaauuuuuauuuucuuucuacuaagccaaacuggcaaggcgcagucaagaacgagacaaucuuggcauguuggucuggucaccuaaucagagucuuucugaagcaaaacguaagucuuuacuguuuacugcucucucacgucuuuaaaauuuaaagauuuucaaccugugguuucauuaucuuacauuuuccuuaaaugcuuaguaaugaguguauaacuaaggacaguuaaugagcauagaaaggaaauaaugguuggagagauggcuccgcaguccagagcacucacagagaaccuguuuccaggggaucuaaugaccucuucacacacacacacacacacacacacacacacacacacacacacacacacacauuugcacauaaaauauuuuuuaaaggaagaaagaaauagcacugagcuguguaaccccuuagcuggaaauacauccauuacccaggguuucacaguccuggccagugcuuggucacuaggcagcugcagcugcagccccgcucacaguuuuaacaguguuacugcaaaugcccugaguacacugaccuguguuuuggagggggaggagaagcggcucuguuaauguuguuaauuguauuuucuaucuacucacguuacuuuuaggaguaauuuugugucugcuaccguaauuccuugguguugaaagucuuuugucaucauaacuaagaaauaaaacaauuucuuaugacacauuuucaguggaguuuauggauggauuugcuaacggaaaucacaucacagguuuuuguaguuugcacaucuggccggagcucaucuugcugcgguuaauggugugccccacuccaccuggccucagcaucucugacccugugccugcugacagaaauuucugcauaguuaggguuuguuuuggguuuuuuuguuuguuuguuuguucuucucuuugagugcacucagugacuuaaguugauucaugucauuuugaacacacauucuuacauagcaugggggaaggggucugaaaaaaaucuacguccuuauaacuagaaaagcuuuguuuucaggagcccugcugagcaauucugcauucggagagcauagacacucagcaugucucccucaguacgggaugguuugacucuggcuacuggggcuacacguaugccuauaacaccugcuuaaaagguuuaguuuuaauuuauuuauuucugcuuuuucaagacagcauuucuuuguguagcccaaacugucuuggaacucacuauguagaucagguuggccuggaacucagagaaauccgccugccucugccuccugagugcugggacuaaaggugugcacgcgccaccacagcccggaagccucugccuucugagugcugggacuaaaggugugcgcgcgccaccacagcccgggagccucugccuccugagugcugggacuaaaggugugcgugccacagccgggagguuaagaguuuuuaaacaacaauaguguggacguuuucaauuuuacuauuaaguuuuacucaauguuaguuaaaaguugaacuuuaagcugggcgcgguggcacacgccuuuaauccuagcacuugggaggcagaggcagguggauuucugaguucgaggccagccuggucuacaaagugaguuccaggacagccaaggcuacacagagaaacccugucucaaaaaaacaaaauaaaaaaacuucuaaaaguaacaauuuugucuccuauugaauauuuagaagacacaggcucccuuaggguuuuacugcuaugaacagacaccacaaccaaggcaacucuuauaaggacagcauuucauuggggcuggcuuacagguucagagguucaguccauugucaucaugacaagacaagcguccggcaggcaggugcaggaggagcagagguucuacaucuccaucugaaggcugcuagcaaaagaugugguuaggaggagggucucauugcccaucccacagugacacacuuccuccaacaagaccauacccccuaauagugccacucccugggccaagcauauucaaaccaccacacuggagggugagggggaacagaacaauuuagcuuuaccuguacaccagaacaagugcugaauguuuuagaaugucccugugcaucucuauuaugugcccccuuuuuuggugguucugagcauugaacccaaggggguuguauauacacuggacaaguguucaccaaacagagacacagauauacgcguauguauauauguauguauauauauauauacacacacacacauuauauaauauauaucacauauauauauacauucauauauauauauauauauauacacacacacacacacacucacacacaaacucuacauauacuuuugagauauaguuucauacugugacccagaaugagcugaaauucacuguagagcccagccuucucuguguuacuuggaaaauucauuuugucucaguauuuacaguaacuuuuuagcauaaccaggugugaauauauuauauuuuauacauuuaaaaagagaacaaaauaggcugagagauaacucagauguuuuccagcaguuuuggguucauuccaaaaucuauuuuuaaguugugugugcauacacacacaccauuaugcgguuuuuuguuuuguuuuguuuuguuuuuucagagccgaggaucgaacccagggccuugugcuugcuaguaggcaagcgcucuaccacugagcuaaauccccaaucccugaucaugcguuuaugugcaauguguaugugcaggucaggccacagaggccugaagaugacauggaauccuuuggaauugaaacuacagauguugguuguaagagugcagggaaccgaaccuggacccugugcaagagcacugagugcuccuggucguggaguccucucuccagcugucuuacagccacuggcagcuuaaugguguuuccaugaacacauauaucaugcaucccaaagaugugucgacuccuguugcuuagaucuuauagccaucuucguacucacacaccuguugugaugcugguauaaauguaccuacuauggugccaguuuuaugaacauguacacagauaguuacauaguuuacauggugaugauaaaagaucagugguuauuuuuaaauguaugcuuucucucugcagcuucacauagcucauggcugccaugucucucucacauuguuuccuacuaugcccaauuuaaugucaugauguuugucuuaauuggcuguaccauauaucucuuucugucauauagcccuguguguaguagguucguauaccaacuggguaugugaaaauauacucugguguuuacagaaugacaggauagauuaaugacauacuuagagucuaccucaaaaacagaagaagaaacacaugauugaguauauuuuuuucaaagauuuauuuauuuauuuauuuauuuauuuauuuaaugcaugugaguacacuguggcuaccuucagacacaccagaagggugcaucaaaucccauuacaaaugguugugagcuaccacaugguugcugggaauugaacucacgaccucuggaagaacagucauugcucuuaaucacugagccaucuuuccagcccuguauguauguauguauguguguguguguguguguauauauauauauauauauguguguguguguguguguguguguguguguguguguauguauauguauauauguguguguguauauguauauauauauauuuuuuuuuaaggcuaaauagaauccauagguuaaggagcaaauaagucauuucuauuuuaaagggggaaacgguugugagggcaaguuuuagguacacagcuacauuaagcagaaagcagagaauagccauguacacccaagagagcuugccuugcuaugaagaccuugcaccugcagaguuggugcaucuguguagggcaucaccaccuucagagcgugugggaugcagagcccacugcuuugcucugacaucuccaaguguggcuuuagucugcuaggaagcugcccugugggugauggaauguaccuacuccuggucccuaauacgugcuguaugaagagcugggcuaaaauggagugccugaagcugucuuccaugcugggcugcuuuugccugucaguguguccccccaauccacccucuacauuugcuucucggcugccucgauagaauuugcuuguccuuccugucaacagaggggaguugcuuuaaguuuuuacaacaaacauuacuacagaaacauucuuugaccuauuuuugugucucaucugcucagcuaaaagucagugccaaauaauuuucuaaaguggugagacuaguuuacuguugcuaccagaagaggauagagggauuugcucaugauccucugcguuaccgcuggauuuggauuacguacuguagacagccuagcggguguaacauccguugcucuuacccaggaguuuugcugcuuuucuuaggugugauaaugacucucuguuuacacuuaaaaaaaaaugcauauguaaggaugaaauuaacugggauguacuuuaaauuugucaacuauaaugcaauaacuagccagauuggauuguggacagagaauaaagcacuguugaagaauuuaauauacuuuuuuaugauuacauaaaggacaucucaguguuuaagagauuagaccauaauauguaaaaaguuacugucaaauggguuugggggaaguacauuacuuacagacaaguuuauuuucauuauuaaaagucauugauaauccuucagccuaccauauggauguuuuuguuuggggagauuuuggggcucacacauccugugugugcauucuguggauaccgucacauuagcucuaaaccaaguuccauccucaaauacuuauggguuuuguggguuuuguuguuaauuguuguuuucuagucuccuuccuauaaauagcacuugaguagguuaaagcaugcugaaacccucacagggaaggacuucuuucuuucugcagagcaggcugccuauauaaguaauuuaagacgauuguaauuaauuguuugaguuacuucucuuuucaacuguaaggagaauuccacaagggcccaaauagcuacagggaguagcacuagccauaaaguagaucuaagaagucuguuggaggauggauucugauacauacaauagauaauuuacuauagacuauccugcugcagccugugcugcaagcuguugaagagccuguuucuccagcaguguccacagugucugugcugaaugaagaguagcuucacacaagguugcagcauugaaagugguaggauuuguaaguccccuuggcccccuucaacauauucuuaacuuugucccccaugcccagaaggaucaggcauagagaggaagugacuugggugaagcaggucagcuuccuguaguauacagcuugcuucacugcuaggccuacaaauacaggguuagacagguaaaccacucaaggcacugggauucagagauggaaacagcuuuccgauugccacuauccugccugccuaagaccuaguugaagguggccuugaaaugagucauuuguaaggcagucucuagucauuaaaaggaaguuuggggcaugaaugaaauaaauauaucaggagccuggcaguggugguacacaccuuuaaucccaauacucugaaaagccuggucuauagagcucaguuucuggucagccaaagcuacacagagaaacccugucucgaaaagccaacaaacaaaaauacaaauauacguuaggcacugaagguguugccuagaggcagaaaauugauuuaacauaggaaaggccuagauuuguuucucaggacugagaaaagaaacauaaaagggauuguguucaguaggagagcacuugccugucauggauggaaggaacuucaggugugauuucuagcacugcaaaaaagaaauguugugacagaguugauuugauaauuguuuacacguguguaucuuaaauguuuuccuaauacucuaugaaggacugacgaagagucucauccuuguucuguagucgagcaaaggaguucagcuagcaguuucucaggagaagccaaggcugcuuucuuuccauucugcucaagaauagagagaugacgcacugucuuagucuaugccgcccucuaccccacccucccuauuaaagccaggcagaucuugagucuuugaauuauuucgugcacagccaaguacacacaguuaauaagguugcugugaguguucagcucccugcuuagggacaggucuggaagaguugaagggaugugugugugucugacuauuuugagacagggucucaccauguagcucuggcugguccggaauucacagugacguccaaacuggccgcauagagacucaccugccuccugagggcugaggguaaaggugugccuggucugcucacucuuacacugauaugcaaaugugaguucuggaaaagaggacagaauuauccaguuacagagaaguacacuuaagaccugaagagaacuuagccuccugcgcugugcgcugggauggagcagucaucucuugucucuccaugguggucuucacugguggcuggggaaugggcacgcacgcagugggaauaguaacaaacagcauaguuaucuuguuucugacuugccuucucuuguuccuucaagauagucaggguucagauguuggcuguaguaaugucuuuguccaccagguggcagaacuguuguacguaaauguuccuuuugcuucuaugugagucuuagggauaacuucuuucauaauaauaaaaggaaaugccauggucuuuuuuuuuuuaucauacuccauuguucuggggauugaacccagaaccuugugcacaccaggcauaacgcucuacugagcagcaucuccaaucuuguuauuacauucuuuagaaauguuuggcagucucaauuuuaagccaugacagaaauuacuguaguguuuccuuugcaguaccuagugccacugcaaaccguuauagucuuuuucuaagcuccauuaagaccauaagcuuuguccucagccugccuuauggucugagccuccuacucuguaaccgacucaggaugacaguuucugaaucugcagugucugggggagggaagggugaauugguuaccauagcagcuuucaucuguucuuucuuuugcaauugaauuugaaacucuugcuacucuaaggacuuuguuucauuggguuaaaaauauuaacauagaaacaaagcgcaagccaaggcauauuuuguuacuugccuuuggccucuaucacauuccuuugaucaugcuguauuuuacucuguucaagcuacaccaaauagugagugaguacugcaacccuaaaaagccauggauuaauacagucucuguuuuaugaucacaguggugcagaucugucaccaucagaguuaauaucaggugguucuccaggccuguuuggauauaauugucaaguaaacagcccugcacugcgccaugguggugaugucagcgcagacggagucugcccagugcugagucugaggcuucugaccugcaggcgggugucagugggaguagucagucagcgacaggccucuccucucccaagcgugggcaggaugcccuggggacagagccacugugcugcugcuuaagcugugugaccucuguggaccuccugccuugguccccaagagguucugcacaggaccccucagccccuuacagagacagacacggacucuccccuggagagauccucaggggacuuguguuucuccugagccauuucauuuccuuuaagcuccuguaagcuuuuguucuuaugagagcagaguugauuuucuuaggcggaaaguuuauuuucauggaagggcuuuuaaccaugagggaguuuuuagcuaaugcauaucucccauuucaucgcuuguaccaaaugcuguccugugcaaaguagggugggggguagguguccaccucucucagaaaaucagagaagugaggaccagguaguguagcagagaggccuaccaaaauuaguauuuguguaacuaacuccgaagaacauuucaagaaaagcaagaagaguggaugcccguggcugauguucccaguuaggcgaccgagcucugcuggggacaguggacacucaguguucaaaacaaauuacaguuggggucucuggguuuaagacgagccuggccuacauacauagcaaguucuaggacauccagggcuacguagagagacacugucacaaacaaauagaugaaaaaggaaaggaaaggaaaggaaaggaaaggaaaggaaaggaaaggaaaggcaaggcaaggcaaggcuagguugguggacaugagagcggagcaacucugucuucaugguagcuggcauuggcugguuugggaaacuuggcugcucucuaggcacacuaccuugaacaacugcacuuuaguuuuaauuauuuaaauuuuggguguguauauucacacuguugcagguguagaggucagagggaagcuugcugcauugacccucuccuuguuccaggguucaugugugugugaggacuggcaaugagugcuucuuuuuaccucaaagccaccuugccagaccacauuuuaauuuuuuaaagcccaguccuuugggucacagucuugaagguaaauccaaaaugauaguaaccgaaauuuuuauuaaauaguagaaaccuauaaguugcuauagcgaagcacuaaaagcauugccacaaguucaaggucagucuugacuuuuuuugcgcaguaaauagaggcagagcuuggauuggauccugacccuucaugaacauagcuggccugugcugucucuacuuuugggggcagauaccaccaucauugacuuagcaaacugucuuaccuuuguuguuuuucugucucugucuucagacacagcagaagagggcaucagaccccauuacagaugguugugagccaccaugugguugcugggaauugaacucgggaccuggaagagcugacucuuaaccucugagccuucucuccagcccuuuugaugaguuauuuuuuuagauuuauuuauuuuacuuuauguguauaaauguuuguccaccuaaguguauuugugcccuuuggacccuuagaacuggaguuagggauaauugucaguugcugugugggugcugggacuuggcccugaguccugcaggagcagccagugcucuggccugcuggacuguugcuccugccacuucuuuauuuuuugauuggaucucacuguguaggcuugaguggccuagauuucagagauccaccucccuaguacugggaccaaaguucuagcucagggaguuguguaagugcugucuucagaacaggaccucaggaaccuugggaacaguguugaguuguuugagguucucauggggccccuuugacccacaaugcgacaggacuuaauccauuccuggcaguggagacuucauuaggugacaagugauguccauccuggggucugucucccuguuauuccauguauauauuuuaaggagcuucuauuguauuaggugucuauacaaccccuuaaaugggcccuaguuuuagcuguccgucccuguauuuccuccccucuuccccaucccuccccuuuccugcuugauccucuuccaguccaucccuuauucgucugugacuguguauuccauuucccgucuuagggugacucagcacagcccgcucauccccuguucuacacagaucuucuguggcaacauggauuguagcuuacuuauaguuacuuauagcugacaccaacacaugucauauuugucuuucugggucugggguaccucacuuaggaugauuuuuuucuagcuucauacauuuaccugugaauuucaugauuucauuuuuuuauaaacaacugagugauauuccacuguguaaauauaccacguuuucuucauucauucacagacagacaucuagguuguaccuugcuauuaugaauagagcagcaaugagcacgguugagcaacuguccuuguaguaggaugaagccuucuuuggguauaucuuagagugguauaguugcgucuggagguaggucuagucuagcucgccaaggaacugcuacgcugauuuccauaguagcugcauaaguuugcaccgcacugccccccccccccaagcaauggaugaguguuccccuuacuccauagccucuccaguaugagccgucaauucuuuuauugauuggccauucugauuguucaccuuacauuuccagguagugucucucgccgagucagcaaagcuuucugcagcagucacucagggccacccugucccugccuucccacugcugggucaccagcacgcaccgcugcgcuagcaucaugugccagcaugugccucucucugaggaaugccaugcagccacaguuagauuacagauugauuucuuuuuccccuuaaaacccguucagccagcccugugauucccgacaugcuucccgugcuaacgaggcaggcauuccaggaacccuaagcccccagcccauggccuuugcccacccuggauauuucaaggauaauacacccuguuguauuucaagguuaauggcuaaaaagcugucuauugacugguacagagcagguucucucaugggugucaaggcuccacauguuaauguacuuguuacaaccuuuagauccucuguagauccaccaaaaugaaaguagccucaauaguuggcuuuaucagaggcagccugguuuauguagugagauacucucucugacaaacaaaacaguagcuguggugguggguuuuuuguuuuguuuuauuuaaaauuuacaaaauauuauguacauguguguguguuauuugugucaugugucauguauguggggauuacaguagagacuagaagagagagucaggcuccuacuuucccaaguuggaauuacaggcaguuguuagcuaucugugugccaaaaaucaaacucagguccuccuuugugguacucauaacugcugagccaucucucuugccuguccuauuuccuuuuacacuaaauaaguuucuaaauccuagaagauagaaguugaagcaggauguuuaaaguguuuauaggcucacuagguguauagccauuuggacauuucucugggggauuccgaugugcauugggguuguauucuauguuguguuuguuuauucccacgugagcaugauaggcuuugaaggagccggcucuggugcgugcagucuugcuguccucaggcugacuacuggucucuguuuuucaguggacgaguacaucgcuaucgccaaagagaagcacggguacaacauggagcagguaacaguucauuucuuguuguggaaagcagagcuugccauggacccaccgggucagugucuucugugggcugucagucuuuuuuuuuuuuuuuuuuuuuuaaagauuuauuuauuuauuauauguaaguacacuguaguugucuucagacacuccagaagagggcgucagaucuuguuacagaugguugugagccaccaugugguugcugggauuugaacuccggaccuucggaagagcagucgggugcucuuacccacugagccaucucaccagcccccgggcugucagucuuauugagugggcaaaaggcaguagcugcugacuaguuugguuuucucauuggaauguguaauugguuucuuguccuguuguggaauaccuuacagucccuuagggucucugacuguauaacgacuuaugggcguaucucagacuuguugcuuacaacacccaacugacuggcugaguugagguacaggcuuagaguucucgugugagcuuuugccuauagaugagcuucccacagcuguacucacagaguuucuuuccacugcaagcgcuucuguaugauagugaccuggagacaagcgucuagcuguucucagccauccuguuucugccuuggcuguuuggcuguccuucccuccugucauagccuuaggaacagagucagcccaccccagacaaggagccuguaaaacgccuuaagaggaacauauuugagucuaaaaugggaggaagaacggaggaaccgcacacaaacucacuucuagagcugguuucucagugaguugaaacaaauaccaaguuaacaauaaagagcacauuccaggagagucggaagcaccugugguacaacuauugaggcacaucugcucuguaaagacuugaagcuuugggucuguuggugguguccuguggcuuuaaucccagcacuuggaaagcagaagcaggcagaucugaguuugaggacagcaagggcuacacagagaaacccugucuucaaaaccaaaacaaaacacacagagaaacucgaagcuuugguuauuuccugucuacacacaggccguagcugucuuucccuuaucugcugcugcacauuuauuccuguagcagcgugcauguagcuugugggaacuagaguacacaaaaacauaccguucuccauguuggaaaucugaacacuugaucucugaccuaugacugauugcuguuaugauggaagggcaggcaaaaaauccaguggucauuguugcugccccucccuguugaguucuugucccugcuggagucacauccaggaaauaagggaccaaaacacucacccucuugcgcucucuacauuuuuucucuucugagagacagacauuacagauuaaggcaaucaaauggaacaacaugagaggagaaaauuagaaaguugcuguguauguccagggaacgaaauaggcacagaaaagaucuaaaaagucauaccucgugcugauccuugccacacagacaguucacaguuauaagaagugugagagaaggaggcugcaccucaggggaagcaagcaucugauugucaaggcuacugcaugguuaaaucuagauggccaggcuuuuuuguugucuguuuuuuuuguuuuuuuuuguuuuuuuuaauuuauuuguuauuaucucuaaguacacuguaucugucuucagucauaccagaagagggcaucagaucucauuauggaugguugugagccaccaugugguugcugggacuugaacucaggaccucgggaacagcagucagugcucuuaaccccugagccaucuuaccagcccuuuguuuuguuuuuaaagaaugauuuauuuuaaauauaugaguagcugucuucagccacaguggaagagggcaucagaucccauuacagcugauugugagucaccacgugguugcuggaaauugaacacaggaccucugaaagagcagucagugcucuuaaucacugagccaucucuucagccccuagaugcccaguuuuuagcggagaauacacaaagcuuaccucaaagccagaaaguauggacacugaaggaaaaaccuuuugagggcagccaugaacuuguuuguuugcccaguuaaagcaccaauaacagggcaaggaaacgguuucacugccuaaggcaguaagccagugagcuugcuggguuaccugcacaagcaagagcuugcuaguuucaguuuguugcugugauaaaaugcccugacauaaaacgauuuuccagcaccuugaccacucgcugucuucucucccguccuuacuguguauauaaccuggaguuggggagagcgaugcuugugaaucuuguaacuuaggaacuuccugaugcuucugaguuuuauuuaucuugaaucucaagaaggcuuccucuaggauagagcuuuuuuaauuuugagaaauugauacccaagauuaaaccaacagaaacuauuccucaaaaauaccugaugucagaucuacuaccuacacgugaccuugaacaugcuaggcaagugcuccaucacugagcugcauccccacuguuuaccccacgauuuuaauucacuuacuaaugcucaaaagggccauuuugaguaggcagaugaaugcaucugaacauaggacaauugucuuauuguuugugguacuggaggugggggaccaggauauccuauauacuccuagcccaggaaaaggcaaacuuuguguuugaagggggaggggaugaacaagaguucagaacccaggaauccugugggguguccucaaggagaagagagaaggcuuaggaagcuucaggagaagagagaagggaucgggagagaucucgaagggggaaaagaaaaguagagaaccccuaaaaucgaugccaucucaaaauagcucaacacacuucaagaugaacuuacccacaccaagauucaguaugaaauacucaaaagccaaagaugcaagaaaaaagccauucuugggcugcaagggcucacaguaaagcuagcagacuugucaucaggagcuuuagagucccaaagacagugauaggauguguuggaaugguagggaaacaaacaaaagacuuugaaccaagaguuguuuguuuggguuggagggauauucagcuuagugguagguccuggguucacuuccuaguacagagaacgagaaagggaaaaacauuccuauaccugauagaaccgguccuucaaaaaacgaggggcuggugagguggcucagugaguaaggggcagguuacucauugaaucggauggcccaaguucauuccugagucacucacgccagcugcucucugucauacacaggaguuuuuuggcuuuagugcauguauguacacacgugacugcauucaagcacacaaacacacagcuaaauaaaauuauaaacuaagacauuaacagauuuuaaaaauaauaaaggacuccuuaugcauugucugccuauuccucaaggaugcuguaggaguccugaggaagaaaaggaaaggacacuagucagugacucagaccuagaugaaggaguaagaccagagucaaggcaacaauuuaagauacaaaugcuagugggggaaauaggcugaaagcugauaguauuaccucagugucuguaagucuacauuuuccauauagccuaagugauucuuuuacagccuuagcuugcuucucuucuucugauauaugacacagcagaggucugugcugcccacagcuggaaggcuguguaagaagcuaaauguuuauauuuuguugaaacuacuuuaacauaaauuccaaucugaaucuuauaacuuuagaauguucaauauaaucccugugacaaacagaaggaauagcuaggaaccuguggucccaccccuagggaaacugaggcaggagaauugagugugaagcaagcauggacuccauagggagagcauaucuugaggggcaaaacugucuguuuucuuauuugagacccuuucucagagaagucagcauccuaggcaguugguugcugggccugaaaggaaggauuuggagggaagagcgcugcuguugaaugggcacaguguuuguuucacagagggugagucaucaugcgugugcucagcaccauugagcugggugcuaaagaguaguuagggugguagaccagaugucacacugagugcagccgucgggugccucggcucuccucaggucuccucgcccgucuguuggaagcacacaaugccuguuugcugucuucacucccgauuuaaugguucauuuauguguucuauaauguugccaauaucauuuuucuaggcucuugggaugcucuuuuggcauaagcauaauauugaaaaaucauuggccgacuugcccaacuucacccccuuuccagaugaguggacuguagaagacaaagucuuauuugagcaagccuuuaguuuucaugggaaaacuuuucauaggauccagcaaaugguaagcaggguuauguuguuguucuuguuguuuuaauuuuugcuucuuauauuuuauacucuuugugagacagaguuaucauaaacuuuaaauguuucauuuauuuguuaguuuauuugcuugcuuguuuuuuuguuuuguuuuguuuuuuccaagacaggguuucucuguguagcccuggcugucucuguagaccaggcuggccucaaacucagaaauccgccugccucugccucugccucccgagugcugggauuaaaggcgugugccaccaugccuggcugcuugcuuguuuuauguguguguuuugccagcauuuaugucuuuguuccacuugugugccuggugcuuacagagauuagaaaagagcaucaaaucucuagaacaagaauuacaaacuguugugagcugacauguagguacugggaauugagcccauggccuuuuggaaaaccagccaguucuuuuuuuuuuuuuuuuuuuuuuuuuuuuuugguuuuucaagacaggguuucucuguguagcccuggcuguccuggaacucacuuuguagaccaggcuggccuugaacucagaaauucgccugccucauccuccugagugcugggauuaaaggcaugcaccaccacgcccggcaagcagccaguucuuaaccacugaccaugucucuagccccaaguauuuccuuuugaauaaaauccccuuuagaaaaagcagcuuaauaaauugcuuuuuaaaaaacugcucuguagcuggacagugguggcacaugccuuuaaucccagcacucgggaggcagaggcagguggauuucugaguccgaggccagccuggucuacagagugaguuccaggacagccagggcuacacagagaaacccugucucagaaaaaccaaaacaaaacaaaaaccugcucuguagcucagcaauucuaguacagagugaagcugcuauuguaaauguauaagcuaaaccuccacaaagaccccacccaccccaccuggucucaaaaagugaugucaacaggcaggaucuccgaugauggcuuuugaaggaauaucacagcccugggcuguaaaucugcuuuuuuggcuggaugauucuugguauuuugauacaggguuucucuguguagcccugacuggccuacaacucacuuuguagaccaggcuggccuugaacucacagagaucuuccugccuuugccucccgagugcuagauuuaaaggugugcaccaucauacuuggcuauauuuuuuacucucuaggaagcuauugauaaacuccacauuaaaguucccuggugcuuguauuaaauguuaaaaugaauuuguaagauuaaaaccuagggauuggagagauggcucugugguaagagaguuguuuuaacucuggcagugaaaacugaauucaaauccuagaacccacauuaaugguucaggcauuucgaacacauaacuggaguuccagugguggggauaggugugauggagauggacuugccgggccugccagcuuucaggcuggcaaacaaacaaacaaaaacacaagaggugguauuugagggcagaggcagacggaucucugcguucaaggccagccugaucuacauuuugaguucuagggcagccagggcuauacaaauuuuuaaaaauuaaaaagaaaauguauuacuuuuuaaaaaugcauaaaaaguuaaucauuuuuguaguuaaaacucaugaauuuuucaauuuuggugguugauaaagugcauaagauauucaauauuugugaaaguauaaaaugcaaugugaaaguauaaaaugcagcuuugauacugaauggccucuguaacugcauagaaguucacugagguguauggucuuugagucugguuaauuuuggugugugaaauuuuuuuuuggcccaacuuuuuuauaauaaaguuaaagauaauuuuuuaaaaagaaaagugcggggcuggagagauggcuaauuggcuaagaacacugacugcucuuccaaaguccugaguucaaaucccagcaaccacaugguggcucacaaccaucuauaaugagaucggaugcccucuucuggugugucugaagucagcuacaguguacuuauauauaauaaauaaaucaaucaaucaaucaaucaaucuuuuaaaaaaaagaaaagaaaaaugcguuuuauuaggcuuuccuuuucuguacauuuuaaaauccaauggccgauccuuaugaaauguauccuaagcacauuugauugguaaacuccagcuucauauuuucaccaacuugauuucugcacuuagcuuccugauaaauccauagcaaguuuggugaaguuuuacuacucuuggaagaaaacuagaacuaaaacaagugugauggaucgccaugcucggaaacagaagcgggagcgggaggaaaggugaggcaugcaccugcggaugucaucugacugcgcgcgcccgugcgugugcgugugcgugugcgugugcgugugcgugugcgugugugugugugugugugaaagaagcaaaaagagagagagagagagagagagagagagagagagaaagagaaaguagauuuugugugagccccucaccaucuuuaaacagcucaaggaagaaaggucaggcaggcaggguggcaggacugagagcaagcugcugcucaccguaccuccugcugguuauucgucccaugacccucaccugaucuagaaaauuccuaauaagcaugucuggaagcuucucuccugggugguucuagaugcucucucucucucucucucucucucucugucucugucucugucucugucucccucccccaccccccuuacucccuuacugacccuagcaguuuacacauuucuaguacucaaccacugagccugccucccuggauauucauuuuaaagauaacucauuaaacuucaagaaggaaggauauggcuuccucggcuuacacauagcagagaucugugaacauggugauuauauccccacacucugggaggucuagggucaguugugaagguucugcuugauaccuaccccugggcagguuugcucagaaggagugacauggucggcucucagaaggcagugcucaagccugcaggcuuuuguguuagaguggcaggagugugugaccuuuaagagcuuaggcucuccagguuucuguaauacauuccaagggcucucaaaguagcucuggcuguccuggaacucacuauguagagcaggcaggccucaaacucacagacauccaucugccuauaccucuugugucucuagugcugggauuaagggcaugugccuggcuuaguacucuuuugaucaaagcuuuuauuuucuuuauaucuuaggccuaguuugauuauacauugaauuuguuguuguguguagauauguucugcuaaauaacagucaaaauuugauaaaauaggcugggauuuguuguccuugacuauggcauagaaagccagccaacacuccggcuauuccucuuugcauuacugcacuaguccugagaacugcuauguccccugcucagugugcccuucacccaguuagguuacagacuuacagcacuacagggcaugacaggagcacuaaguggucauuggccucccauacgacguucuauaugguuauuggcuaggacucugggcaaaauuucucuauauccagaacagcgguucucaaccuauaucaaaccucuguuuauauuagcauucauaacaguuaucaaaguuacacuuaugaaguagcagugaaaauaguuuuaugguuuagggucaccacaacauggagaacuuuauuaacagauuguagcauuagaguugagaaccacuggaccaaaagaacuacaaaguuggaauucuauauaaaaauguuuguucuaacagucuggugcuguauagagcaauuuuagaauguauuuauuaaguuuuuaugugaaauagaauuaauacagaauaaucuuucggccccauucuugccuuccagugaggaugaacuggaagaaacaaacggcaguaaucccguugacauugagauugacccaaacaaggaaagcaaaaaggagguaugucucuaccuacuagcccugggcaguaagugccagcacuagcucucccgguaccuccugccucccguacauuaguauauuaagucgagacuccaaacguucagauggaacauuguaaacaacaccagcuuugcuuuauagaauuuggaaugguauuucucuguaucacauggaauggaaccccaagguucugcuaucuucuguaagagaacggugguaacaagacagggcugggaagugaauggagugggccggggagcugccagcgcucgggcaggaccuugggcagcuuucgggcauggucacuuggagcacagaggcaucucagcucccuguccuguaauggcaggaauggcuaugugaagcuugggaaacugaaaggccaauuguaaaauuauagcaguacgugauuuuuauaauaggcaaugaagaggaguuaaagugauuuucagcaucgucacccguaaucacugucacaauuugguagcuuuuaagacaccuuccucuaaaacauauaugcccauauguauauauaauucagaauuuuuauuuuuaaaaguuguaaagugauaucuuaauuuguauaguuuuuuaaauguauuuuaaauauacuuauauacauagcccauguauuacuucacuauaugaguauuucagaauugaguuaacugaucuuaaacagcuuuauagcuuacuuaaguccccucugugugaacagcaaggagcuaauggucacauaucuaagucuuuuuacaaauuuucuuauuaaaauaauuucuaaaaguugaauuguugccuuaggguuucccaugugcauacuuaaggccuccuauaacccagaucggccccagucucacuguguaacugacacuggccuugaacuccugauccuccugccucugccucccaaaugcucggguuacagauacaucaccaccaugcucaacuuaaaguccuaaguuuaaaugauugccuaauaauagggcagaguccuuuugucgccaagcuuuuauauuugauauuagagaaaguacuguuaaaaauuaacccauuccgggguuauuuuauauauauauauaaucugauauuacuuauuauacuuauuauauauaauaacuuauauaugauauaauauuuuauauauaauaaguaaaccaggugugauggcgcaugccuuaaaucccagcacucgggugccagaggcagguggauuucugaguucgaggccagccuagucuacagagugaguuccaggacagccagggcuacacagagaaacccugucucgaaaagccaaaaaagaagaugaagaaaaaauuagcccaaugauuuauuuuaagaaugauagcacauuuuuacagcaaauuauguuacucuaaaaccuaaauguuuggugucuuuucaugcauguauguuugugugaggguucagauccucugaaaaagaguuucaguugguugugagcugccaugugagugcugggaacugaaccuagauccucuggaagagcagccggugcucuuaaucucugaacccucucucccguuuccaaguuuguauuuccuaguggaaaacuuuugcagaccaccucuccucuuauacacaacucgguggccacaagguucaagagggaauaccggcuguuguuucucuccuauuguuccuuuguacuuuucgccagaggccagaggagguagaaaacaauguuucuauugaagaacaaaggaauguuuucuuuguuccaugccacaauuuaucuuuaaguaguuggugcuuagauaagcauggugauuguuuuagauuguuuggggcuauguuaacgacacaugcuuacuacuguccauuugacguuuuuguuuuuguuuuuaauuuuauuuaccaaauauguauaucaugcaggugcccccuacagagacaguuccucaggucaaaaaagaaaagcacagcacacaagcuaaaaauagagcaaaaaggaaaccuccgaaaggcauguuucuuucucaagaagauguggaggcugugucugcuaaugcuacugcugcgaccacggugcugagacagcuggacauggagcuggucuccaucaaacgacagguacuucaagcccagugugagaaucagcuugcacacuagcaugaccucacagauguguggaaggggagcacgcugugguguguggaggucagaagacagcgucuggaguggauucuuugcuucugccuuuucauggaguccagggauugaacucugauugccagugaugcacagccucucacuggcaauuggauauugcccccccccccucuaaaaauuacauuuagaugugugugcauguuugugcgcuccugugugugugcauugccuuuagugcccccaccacucuccccuucaaguucugaagcuccaucgugccucucacgcuugagucgccucccaggagggggcugcuauuauucaagugcagaaucuggucuggggcuuguaauguagucagugguaggacgcuuguucaguuuguaggaagccuuggguuucuuuuccaccacuguuaaaagaacccucacagacagacucauucagucugcuuuuauuguauuaccauaagauaauguuuauuuuuaugguuuuauaagaugugcccauguuuuauaaagcugcuacuuuuguggccauuauacaaacuauuagcaugaauguuaggaaccugguaaauuuugcaugcaucucuguagagcauggcuccaucggaccccauauuauacaaacuauuagcaugaauguuaggaaucuggugaauuuugcgugcaucucuguagagcauggcuccaucggaccccauagagaaccucaggcucucccuagguucaggguuuccaguguccuuucaguuuaccuguacuuuguacuguaccagcacuucccaccuauggucuacuuuggacugacugaguuacaggcacaaccucccuacccucuacucacaggggaccacuucaccguccuacuugugacaacagaacuauccccaggcauugcugagccuccuuggggucacaugguuguguccagugguaaugguggcuguacuuguugcuaacacuugucuuuaaacuguggccucucucugguguguugugugaggcuccuuggaccucagugacacugcuuaucugccacuuauuugucagccccggggcuauccuugcuuugaggaugucuaccguugguuuucuacuggacuguguguuuagggugaguauguguuuauuuaacacugccucacaccacacagcucaggcugcccacaaacucagugcuccucuugacucuaccucuauaccuccuuauagagucuucuuuucuccaguuauaaauuguuuccugcccaucucaugauaauuuaccacuuuguccucccccacuccuguuaacaguauuuuaugaaacuuguuaaaagaaguacaguuucccaucuuuuccucuuagguugguagguuuugagugcugauaagaaccuuccaggggcacagacaugcaggcaaagcaccuagacacauaaaauaaauaaaucuuuuuuaaaagaaccuuucccaggugaugaaccuguguugaauaucaucuuaacaccguuguuccagcuuuuguauguuggucuugagccuacuaagaaguauguuucucagugugguaguguauguaggugucugagugggggcugagugugugucugagugugucucaccaacuguuuacugaaaaggcugucaggucuuuccugccgagcaucuucauagagaccuuguuuacaauaggcagguccgguuuuauguucucuguuccguugucugcccgucaccagugcacagugccccaguguguggugugcagcaaggaagccuccuggcucucaguguccucggcccguuguauuuccuuaacaauuugugcaucauuuuuucaauuuccaguaaaaacaauuuuacuaaaauuuugauuaaauuuauuuaaucuauuaaauuaauuuugauuaaauuuauuuaaucuauuaaauuaauuuugauuaaauuuauuuaaucuauuaaauuaauacccuuuguuuuauuuuauuuuaagacuguuucucuguauaucccugguuguccuggaacuugcucuguagauuaggcagccucaaacucagagaucugccaguuuguuaaaggcguguaccaccaccagcuuucaaauuacaauuuauuuuuauuuuauuuuuuuuuaguauuaauguaugaguacacuguuacuuucuucagacacaccagaagagggcaucagauaucauuacagaugguugugagccaccaugugguugcugggaacugaacucaggaccucuggaauagcagucaguauucuuaacugcugagcuaucucucucuccagccccucccauuacuaucuuuauagaguucucugaugaguggagaugcuacacuccuccacccauacagaucuuuaauuauuugcauugugucauuugugauguguaagaaugugugcacccuucaguggaauuaggauauuuguguacauuuggggucuuggggagaauguguccgugguagcaguuguaccugagagcucaugcacaccacugguuccguagccaguucuuggauauuauuguguuaucauggucagccucacagucuagaacgcaccuuccaucagucugugaucuucuucccuucccuugucuuucccucuuccguuucuccuucucccucuugguugaugagacugagugauggggagccagcugucagagguggccgggccgggagguggaacugauggcucugucuuugccuugguuuaaggaggcagcacugaagaggagcaaacauccucccagagucugccugccgccagcacagcuaggcucugaucuuaggggaaucacuuaaucuuccuagagaccucuuuucaaagagaagaugaauccuugggucugaucuguguggaucugccugggcugcugcaggcacugcuggugcugcuuauggugggggagcccugccauauugggacacaguggcgagggagcagaggcccuccuguacuaaguguagaaagaggaaacagucuuugucuuuucuuagcagggucaaggacaagaguguuuucaauuugaaauaauuacucagauuggcaguuuuaaagagggaggaaggagggcuuagagccugacauggucaugaggagacagacguuuagaugcacguggcgagucaaaacggcagccagucagugggacagugaugucaggaagccgaguuugggaguaugucaaggaaagucucauuucagaguaacagaaaacaggauuaaccaguugaagaagucccaaaguugcuauguugaaagcugcagaagccauuuagaacucuuugaaucagcguagggcuauaagaaagggagauggaaguggagccagcugccuauuucugugagcaggggaagcaaaggccgaaugcugccuguccucggcuccuggcugucaggacugagggcuggggcuggaaguguccacuuccucaguggauucacuugugacaggagguucuacgcagaggagugucucacaggacagaugcaguauggcauguuuaccuuggggguucacgggggcaggagggcagccacauggguuagguugcuugcuuuuucuuuaaaugccacacacagcuguauccugauuuuuauucaauuuccuuucagguugauaaauguguugaccacuaaccugucuauucuaacucuaaauguuggauucuagcucuccaccucucacugcugguuuuucugaagacaagaugugcucuguaccccaggcuggccuccaacuccaacucuuaguccacacuugugagucggaggcagagcuagcaugggcuacaaagugagaacuuaccucaaauaccucaaagagcagagcaggccaucccaaagcacuugacaaaauggaauuuuaaaaaaauguugugggagccagaagucgaugcacacgccuuuacucccagcacucaggaguagaggaaggcccagcucuauuagugugagaccgcccucaccuacauagugaguuuaaggucugccauggcuauauaguaagauccugucuugagaaaacagaacaggcaaaaggaaaaaaagaaaagaaaagaaaaguauauguugguauaaaaggcuguuuaagaagccagguggggccgggcggugguggcgcaccaggcuggccucgaacucagucuugcuuuuaauguuacuucacuaguaagauuucuucuuagcccugugaugauggugcagaccauuaaucccagcacuugugaggcagaggcagguggaucucugugaguucaaggccagucuggucuacaaagugaauuccaagacuaccaagaguacacagagaaucccugacuccaaaaaagaaaaaaacagaaaagaccuuuuucuuuagguuauauuugaaaguguuaaagucagccuuccaccucaucacacacugaaaguauccuccccugagagcugcaggacaaggacauaguugucuguuucuuggguauccauggaaaaugaaagaacguggcugaauuucugaccuucucucuguguuuuaugauugggcauaaauagaaaagcuagguaugcuaagucaagcaaaaaauaggaaaaaaaucacuuaugagaaaacgaaggcauuacacuuggucaguuaggcugggaggaauucugccaucgugguuuuccauuuucccaucgaagaugucuuccuagcugucauguauuuaaaacaaagcucucuucucucuuagauucagaacaucaagcagacgaacagugcucuuaaagagaagcuugauggugggauagagccuuaccgacucccagagguaggaggacauucaucuuagagucaguuaaugugcuugaaauguugcuaucugugugguacauagcuuuaauguguuggguuuuggaaagauauagauauaauuuaaggaaccaaguuuauaucaaaauccugacauguaaaaaguucauuaagcugccauaaagaugcauguaauaaguugacaauccauuuggauaucuagguuauucaaaaaugcaacgcucgcuggacaacggaagagcagcuucucgccguacaagguacgcacacgggaacuaacugugaugcaagaaagggaacugcuguguuccacuccggugucccaguccagcuucucccgggcauguauacucgaugccuguguugucacugaggagugagcccagagccgugccaggcaggugcuaugccuccgugaaacccugcaguccggguuccuaguuuuugaaacagucucaucuuuugcucuggcuggcugugaacccaaaauccuucugcuucaaacucccaagggcuggagccacaggcccuuccugucuuuuaaauuagcgugaaagccgcgguugucuaaggcugugaguguguuacaaguuagaguggcugcucauugcacucugaguaggugagcauuagcauuagaagacaggaaaugccuucagaccaggaagucugcaaaggccaagccgaguguccacagcagcagugugauaugaccugagagguuccuacuagacagcauuuuagcagccgucuacaccgucgucugucagauaccucuaaggauggcugccauguuuuuccacugcucuaacauugucugugcuuaaccccggucaugagcaagugcuucaccuacucagccaucucccagccugagcuguucuuuuucaaauggugacagcacuugcugcucuuucgugggacccaaguuuagcuccaaaggacccacauguaaucccaguucuagaagauuugacuucuccuucuagccucucuaggcagucacaugugguacacagacauacaugcggggaaaaugcacacauaaaauaaaagauaauuaaaauuuaaacuuuuuuucucuuauacuaaauuuuuuuuuaaaaaaaauauucuuuucuguucuuagccauuaggaaauaugggcgagauuuucaggcgaucucagaugugauugggaacaagucaguuguucaggugaaaaacuuuuuuguaaauuaucgacgccgcuucaacauagaugaaguuuuacaagaaugggaagcagaacaugggaaagacgagaccaauggaccugcuaaccagaaaccugucaaguccccagaaagcuccaucaagaucccggaggaggaagaugagguaaauguggaagggguggucucuucccugcaccaagcucacauucccagucacucagccguagccaugcugacguggguaggucaucacugugggcugcuuacuccuuaacuacagccuggcuuccuucuacaauuguaaaccaucagaaacugcugaugaguggcccacucaggagucucagggguugcuguuguccagggcugcuuaccuucuuucuaggugaggcugcgugccuuuaggcucucuugaggaauggccaacagcuaccguccagcuuauauugcuguccagggauggcuagcuuuagcuggugaaggcaguucuagguccuguggcugcugagacuuaugugacagugucuggcauugcgauuuuggagaugaugacacacuuuucaucagggcugucaggguggcucaggcuagaggccuguccuuccacuucccguaucaggacuuuuuaccucccaccucuccccaccccaccccuguaucaggacugcuuaccucugagaaucgggcucguggguacuuuuuuuuuuucuuuuaaagauugauuuauuuauuuuauguauaugaauacacugcagcuguccucagacacaccagaaggcugcauuggaccccaucacagaugguugugagccaccaugugguugcugggaguggcccuagcauguccuucucagugagguugugcuccucuguaaccgacucacauccccaguagcauguuagagcuucuucgugguguuggaccuucccugugucuguuuacuucagcaucucucuaaaaauacaacagcagggcagagcacagggcaucacccacauguccuuuucccuucuucccacuguacucuccucuaucuguaagcuuugggaaucaaaguuagugggucaccagaguuaguggagugaacuccuuuguccccugagcccucucgcuggcccccgucugugcuccucaggucgcagcccuucuuccagccucuguuucugcccuaagcuuaguuugcagaaggagacuuggcucgugaugauuucugcucaccaagagccuggggacuuagcugguaggacgcugcuuaauugucuggccagugcucagaacauggaaacuugguuucaccggcuuguuuauccuguuucuagcaacuggggauaucuguccucacagcauggaggacaucagaauuuucccaaaugcuacuaauaaaaaggccugucggucuuaacaguguuuuuccagcuaagaaggaagagcagcccaaggcgucugcgaucuacagagggggcuggagcagcugggccagagaucuccaccaaggucagagcagagaggaggcccgcuuuagucagcagcucuuuacggugccguuucaccacacucacauucuggauuguagcccaguugugccucaguaguaagacaccaugucucauggauaguuaguuuugaaaaacaaaagaaacaaguaaaaaaauguuuucauccuuuaaggaagaguguaauauacuccaggaucccaggaggagccgguaccaccgagucccucuggccagugccagugcaugcaugggauuauuuauuccugcaggcaaaccugagcggccugcucucccaugcugugauucaaggccccucagcuguuuuaucuaaccuugccgagggagcaccauagucucacaucuuggcuaauagggaagcugaggcuuagaaagagaaaacugguccuaccugagcagccccucccugccugggagcaugagugcuccucacggugcucacagugcuccccagagccagugagugcuggucgugccucucacugauuuccuuccuuuuucccuccuucaggcugcuucuguccucgacguaagauacgcaucugccucaugaaaacuguugguagcuuugaacacuugguauggacgacacguuauccagguaucagguauuacaagacaucaccuagccaucugcaucacaucucuguggacaagcagcuauuaccaaaaaaggcauacacuuccagucccgugcuacaucugccuuaauucuuugcucguuccuccauguuggcacgacuucccagagagcuccguugcaucucauucugccuaagggcugggggacccacggccugcacaccucccucgagucugggaccuacccuccaguuggcucccccccgagccccaacaauggcagcucucccaaucaacagcuucagaacagguagucuugaaaggcccagcucuguuccugcauggccugcaguuucuacuuugugcauaguguaauucucagaaggccuaguagaccuucuagaaaaagucuccccuucucuccuggggcagccaccuaaguaaaaucaugcuucuuuggaaaucacaagcccuucagcagaccacaucgucaccuuuaucauacaagcuuccugauacaacuccuguuucccuaagagaggacaguuauggcuguagaucagguggcuucucuccccuuucucucuccccuaacucuuucccuuuucuccuuuccaagugguaaaagcucauuugcagcaacuguccuugggcacuguagccucaugggaacguggaccucagugcuuucugccuucagccuucagcauuguaaucccaggaugagggugcacccaucucuucuugauccccagcugccaccaucauccccagcuccgagagauuugguuccuaucauuguaccuggugcuuguacauuuggaauuggugccuucuccuucuggcaaccauguuaucaaucccuuuucuguuuaagugucuuacuuaaaguuuauugcuugccaaagaugccaucauugagguguagcagauggggagggugucugcagguuugagugcagacuuuaaaugucaggucagcucaggaaaggagaagagagaagcuagggaugguuuccuagacgcugcacaccaguagcucucauccucuuggcgugccuggccauuguaugucacuccauguguccuuuugugucauuuguguacuggugugaucacacaaacacuauauccugucucuuagcagcagauaggacagauaaguaauggauguguuuguugcuuagugagaccaagaugaaaagaaacaaccuagagugguggcaaugccauuuguuuggacugggaacaagcaaggguugcuaauaaauguucugagacuucagaaucacuuuugcucucuuaccagacugugggccugaagggccugaggagcagccggcugggcuguguccuagcauccauggccacuugagacugcacuaaccauguggaaauaucuuuuguuguuguuuuaauauuuuuucugcuuucaauaccaaaaaggaaaaaaaaaaaaguagaugcuuuaagguauuuaagguaugaauggaguucugaagaauuuaaaauaugcaauuaaaauucgauguuuugacuccuaagcaccuuccccccuccccuuuuuuuaaguuagcugauuuucucuuuagaaagagguucagcuggggauaggauguauauucuucuugagaagucuggagaaaggucauuccaaggucaagugcagagggacuuuguccauccugucucacaccggcccauugaugaggaagagucauagagaugagucagaggcacggcccguggucccacccaggaacccagggacccagggacccagggaccgguaacagaguaacacuaguaacuucuuuugugcuuuuaucauaaaccugcuguguagcugaaggggaaggcaagcacaggaugaaguuagccuccgcucugcgugugacucacagggacacugaggcacaagauaaaacccugcucaccuagcguguuugcaugcccuucccuccagugagcagagcagcgcugugcuacaggguggcugcugccgugguuuucuccgucugccgguggcucugugucugucuuugugcccaggcuacuuugcuugagauguguucccccucagcaguguugagacuuggugaucaucucggaugguguggcaggcagagcggcugugccaggcaccaggcuuguucugucuuucucuugguugugagcguggcgugguaucuagccaugaagaguccggugucgggcgguaugguuaugaccagagcagcugaucuucccuuuccuccaaggaagagaggcgcgcaugccguucucacuuggcagaggggcgagagugggcucugccuggcugcugcugcugcugcuggaauagucuccauguuuuaaacuuuucaugacacaguccacagugauauaaguccaagaaacugcuuagcuuucaaagccgagggcucuggucuggacugugacuguuacagucaagaguuaggugcaucagcagguuagguuuggaacaugacaccugcuuccgauggaaugucacuuaagcuuuggguucuuaaaaauuaucaaugugaaugucauaauuauauauuuuugugggaaaaucuucuaaauauaaguuauugugcaaaauauaguaucauggacacaaauaauagucuaagguuuaguuuagagaucccuaaagauauaaacuguauugcauaugcauuaaaaguuuguuuuauuuaauuuucugugaacauguaaaguguuagguaauucuuuucccuuauccacguaagcaccuguuacuugaauauuguguugaccggccagcggcagugaucaaugcuguacucuagcucuuuccucagaggcccuggccucggccgugcuggucagaugaguguuggcacacagugggugcugugucagagguucacaacagagggucacagcacacccacugccucuuuguuuauuugucaaaacagcuuccuaaagaagguuucagagaguuuuuguaagaccuucccaauggugguuacaaaccuuaaucaaaaacacagaaggugacaaagcuuacuguggugggcucaugaagcaggaguccuguuagacaguuucccagcgcugccucugagugagcucagugacacuuuaauucagcuccgcccacuucgucuuucucacuaugagauguacuauugguauaauugcacaccaaaaauaagccaaacagugcauuacacuaacuggaucccugcuuucauggaagcaaaggaaagacacgucucacgucucuguccuguuuguacaccuagugacccaggauucaaguuuuuaguaucaaguaaacuucgccucagacugacuaaggcagcuguaggucaucugagucuaaugcucgugugcaaugcccuucccgccucucccgggucuuugcagcuucuccucacuguaguaaagcacaauugcaggagcguccgucacggcucagaaggagucaguagucuaugcauguuguaagauaaugaguguuuacagucgccuucucuaaagugagcauuuauacuggaguggguagcauuccauuauguagacuucaaacuuugcuaagugcuuuuuagauugcuuaaaaauuuuucaagauuuuaaaagauguauaagguuaaguuugcaaauauaacggaaaugcuguauaucuuuugaagugauaaaauccauguuaaaauuuuaaagaaaauauguuguaauaaugcuguuguaaguaauauuuccaugucucucugcuuguuuucuaguucagcacagucauuguggugaauguccauagcauuauaaucgcuuagccauugaauuauaauauuuguuaguggagauugggaaauuuauuugugaaauucugcagaauucauuuuucuauuuccaauauuugcugaaguuaaauaaaaauuuucaagccauugauguaauaaaauacgaaacaaaacaacguaa

SEQ ID NO: 6850 - RNA, 24644 nt, Mus musculus
agcagggcaaagggugagaaagcucaugccacaccccagggcugccucugacauuucaaggcagcuguaauuuuuguuuacaucaaccgauccugcuggccuugaguuaccaccauccuucccaccuagggaagccaggcuggucccuucugaaguaacagggcacuguuuagauucuaaguguccccagugcaggccuguggcaugguggcugcaggguccuuaccagagagggcuuccccucacagcucccaaggggcaggguggggcucaccggcauauuuccgcugugcaagaggggaaacccgggccccggagaucaagugccuuccuaagaucucacaguuacucaugagcuaacuucugcuuucucaguccugcucuagaauucuucuguuccauucuuaauuugcuucucugucacugcauuagagcccagacggaaaccacgugggagaggagacggcuuauuuagcuuccacguucccaucacagcugagggacaucaggacgggagcucaaggugggaaccuagaagcaggagugaagcagagacuguggaagaauacugcugacuuacuggcuuguccagcaacccuuagggggcuguaucccccccuccccaugucaucaggagucaagaaaauaccucagagccaugcucacaggccagucugauggaggcaauuccucaacugagacugccuuugcccaggugugucuaagcuguguccaguugacaaaaauccucucucucucucucucucucucucucucucucuccuggcaggguuucuuuguguaguucuggcuguccuagaacuccaucuguagaccaggcuggcuuggaacucggaaaucagccugccucuaccuucugaggauuaaaggcguguguuauuuuuauaaaaccacuggcuaugucugccuuuuaaagaaaacacuucacugaaauguucugggaggcuuuagcuagagaaaccuggucuuugcaaagaccuguaaucccagcacucaaguugaaggaucaggagagcaaggucagauucagcuugguaggggcagccaggaaagguacuuguggaugucagagacccaccaagccaaauguuguaaucccaucccagcaccccuuggcacgaugggaggcaggaggaagaagcacguggacacuggcauaugccauacucuccuggaguauaccaggcaaaggcagcaucauacgaaccuuccucaacaagguccaaagcaagagccgauucucgaaagcuguccuaugaccuccacgugugugcuauaacacaugccacaugccgaaggcaugaagccacugagucagaggugcaaccugggggaaagguucugagaugccagccagccuggguccugccggauggucggggcgggggguggggggagggcucgcagccaagcugaccacuguggccacugaaggugaaggccacccagccgagggccguggcgggauuguuuggcucaugggcccuguguucaggacucucagaucccgagcuauggguucuuucuccuauagcucugagguagacuccuuuuuuaagcuggcacagaggucuccauggcacuuggagucuaaacuaaaaacacaacaugcauaucuggcaugcacaaaaccuuggguuugaucucagcacccaaaccaaaacagaacagaagacaucacacaacguagguaggcgaggucugccaucagguaucuacuguggguuucagacgcccaccaggucagcuaucaaagaacagcuucauccccucuccccuggcuuauaggaagggccuaagggcuuccaguguagagaugaguucuagaugcacaguccugucaagaagaauuugccuccuuccugaaggcucuagaugcugggccauaccugugucugucugcagcuccucugccccgcaguuuccagagcugacuucuugugacauaguuagauaaugugucauuguuguuccaguuugcuguguguaucuaucgaacggaggaaaagaguguaaguugauuuuaauggacuacaagcuguuauuuaaucuuggcaguggauaccggcagggcaucccauaccagagggaaaucaaaggccgguccauaaccugcagggccuggcauccuuggcuccuccucuccucuccucuccccuggaguugcccccacuccuggcuguagucacacuggccucccugagugcucacugaccucaaggccuuugcuuuucaugccgcaguccacaugguaccuugccccuuuuccuuccgguccauauucugccuccuaaucugccuuuccccugacccuugcucaggcuuccucucccuugccuucccucggucccucaguuucccuugcuauagaucaaccugugguugauuuauuuccguuucuacccacuagaugguaagcucaacggaacgggaacauccuuggcuuugugcuagcaggacugaagggaugccaagccgcucacugcuugcucccucggcaagcaggucugggcagacguuuggaagaggaggugggcgaggguucuucccucugcauccauguggcguucaagcuuuaaagaugagggagcaugccauuucccaguguuuucaggaagauaggaugucgcauugccuaggauuagaaugauucuuacuauuucuagacacucccccccacccccacccccgggauggaguagcuccacccaccuugcuuccuuggcugcugcugugugggaggagcucugccgucuacuggacuauuccagcagccauuggcuuuuguuugcuaaggguucgggaaaaucaaaggaaccagccugugggucggggaggggacuaaccagcaucgagggaaagauggccucugggaucagaccgaaggcauagauagaucaauccguguugcccuuugucuccugggguuugcuguguggggcuugcaaauaaugccccugcuucccgugacauucacugaagagcccuuuuucuuggaagagcuguggagugggauguaucuucaggaaacguuaaagauaggggcugagucaaaacuaccagguggagaaagaccacgucaggacucucuuucccuuguacaauuucaggcaaguguuugagaaagcacagaugguaugugcaugugugcacaugugcacacaagaauccugggaugaaucccuuaaaaugagaacacuuuuguuuccugauuggccuacagagaugagaaaaaaaaaaaaaaaaaaaaaggaaaggaacuguguauguggcccauuuccaaccuccuaugucccccauuccccacugcccuccaucuccucagcaugauauagaccugggaaugugcucugucacccuuaggccucucugugucuccugugugaacuguccugaccuguagcccacuucuuugauagugugacucuucugugcaggaguccacugagggacaggacugggcaggaacgggacgcagugucaccucaaagcugggacccuucuaccaucaucagcaucuuuuagucaaaagauguuguauuggacuuguggccacgaaucuccaguaaguuuagacaucaugaucagcauuuaaaaaauaaaaauaaaaauagauaaaaauaaaauugggagcugagcuggcuuaguggugaaggcacucgauuccgauccuuuugacuugaauuugauugccaggucuuacaugguagaagaaaaggauagacucuugugaauuguucuuuaacuuccacaagugugccccaccucaaauaaaaauaacuaaaaguauaauaaaaauaaguaauagaagcuacauagugagcgugaggccagccuugguuacagaagacagagagagagagagagagagagagagagagagagagaacuccagagagacccaagcuugcuagggagcaguggaauuugccuguaauccuagcauuugggaaggugagaauuucaaguuugaggcucucuuggucuacauaguggaacccuguauuaaaauuaauagcuagauagggccagcaagcuggcucaguagguguggaugcuugcugugaagccgggcaaucugaguuugaucccagugacccacaaggcagagggagguaacugacuuuuguccucugaccgccacacuuaaucaugauguguguucccauaugcacaguguacacacacacacacacacacacacacacacacacuggauacauaaguaacuaaaaucauuuaaacauuaacaaguagaccagaauaaucagagcacauuacauguuugggauuaaguauugaugaauauguggguguguaucacauauucaacagguuugaaagcuacuugcugagaagucuuacugaaacuauaauuuugcugugugucucuccuuugcuaguauuuaauguuuuagugagcgaaaugucagcucacuucagcacacaucugcccugcaggggcagguggcuucugcuccuggagcugucauuugaggcacugggaggggccugaugacaccuguucacaggccugaagcccccgacaccaugcgacgaauacuuuuccucuuagcacaacagaugggagcggcuuucuggacaguugcauuucggugagucaucacgagaccugcaugcauccuaaaaugcagcaaacugagcaugagaggccacauaaauuccugagagaaauuucuuuguccagaaacagugucggcguguuguucagcguugccauagggaacagccagcuuugcuuuugaaaugcccagagcagagcccucugauugguucuccguacugcucaucacuucugcccagcaacuggcgcugcgguggccagaaacccgcccccaaagcccuggcucugauggggcaaacuucuuuaugcugcccucuguguuuccccaaaacagggggucuggagcugcuaaaugggagaagaagggcucggggugggggagcagcagcuggucucacccguagagagcuccacgcggcuggacucuacccacucauucugaagaaggcuuacuagugcuuuggcagagaauaaaaggagccacgcagccauaggaagccccacgcacaggucuuuguaccuucugccugguggcuuauuugaaaagaguccaaauagugcagccuagagaaggaagccuuucuggauuugggcaguuuuccuugugccgugaaaggcgugugagaaaggugcccuggacagggcuggggucgaacaguagaggucugagaacacgguuaaagaaggcaggggcacucugagcauuccgggccauuaaagacacccacgaggggaaaggggcuaauagugagcuccaggguccucauagaugggacugucguucuagcacuguugccuuggggaacccuggaucugaccugacucugaacucagaacuguggccuguggcccagaugagggcgccacuggccuagcugagccuggcuagcaaggccuaugugggcucucgaacaggcaccuguugggcuacugcauucagagauguccugucagacuauccaggcuucuagaacauuccaugagguaagcuggacagaagaugcuggacuuccugcgcagccuggucacacuggucuccguuccagccuaggauccgacaaacuuuauugagaagggaugugugagcuuccagaugacuuggaaacaaucauggccucuuugcucaagugucugaacuuuguaaggauagacccccauuugcucccaucuugccauggcaguagggacaucugguggggcccugugaccaugagacagcaagaugaagcugcuggagaaaugggugucccuggcuuagagaaguacccaggacaaauuggccacccuguccacacagggcagauccacuucggguggguauguagggagccgaggaggacucugcuaaaccccuagagcugggucagaugguaccagacccgccugugagcauacgaggggcaugugugaggguggcauggcugugugcuaauguggacugugagaccugcccgccugccugugaacucugucggugaagauguguguucuuggacaggagacacuaggaacgaacucugcacgcgugucaaugggcgcccgcgagugagugucuucuacaggugcaaggaccugagugcccgaguaggcgagacuguugggccgcccgucgagguggcaaggcgaggaaccuuccuugcuuccccuccgcucgacuggcuuuuugacccggaaagaccgggacgcgggcggggcgcgagggcgcgcgcgcgcgcgcggaggggccagggcccugagggccuggggcgcgcgccgccguugcuaaggccggcggcgagcgcggggccgagggucccuagcaacgggcgcgggcgcgcgccagccgaaggggaugagggggggggcggggaggcgcgcgcgggcggcgggggcgggcgcgcuggggcgcgcgcccaggcggcccgcggggauuuccagcgcgcgagaggaagugccagcgcgagggugcgugaggcggcgcggccggcggccgccgcgugcgcgagccggguugcagcccagcagggacuuuccagccggcggcggcggcggcggccgccggcccuuccccgccccccgacauggggcugcccggggagcuggacgcugcagaaggcggcggaggaugcgcgcggcgccccugagccggccgaacgggcgggccucgggguaaggucgcgggccgggggcggcgggcggcggggcggcgggcggcuccaucccggcggcggccccgggcccggcggguccuucgcugccaggcccggccgccucaccgucugcggugcggcccgcccgccgccccaacuuuggaaacuuugugugugcggccagcuccgggcccgaggcgccggcgcuccgggcagacggggcaggcaggccucgagcccugggugcccgccccgaggggugccgagccgucagcaucuccgaggcccggggcuuuggcgcggugcggagcggcggagacagggugcccgcauagaugagcgugcucgcccuggcugguggagguggguuuuugagccauuauuuaaaaguuuauacugagucauugcucugcagaugaaugacugauucauagucggagagcugcagagaggcuggaaggcaggcgguucugggauccagcuggggccgaaugcacaccuuccaccuucgauuaacaccaaaggucagagugggcuccccacgggcgagccauuaaaacgauccuugccgcggggcuugcagguuuuggaggcgccaggcuauggcucauguacguuucgccacguuucuacacugucaucaccaccgguuggggacccggguaucaggauuagaccuuuagagagaauucugcguggacaauucuuuaccuuuaauuuaaaacggcaacaacaugcaaaugggugaaguguuguggacgugcucugaaaucgaagaagcauucagauuaaugaucgguugaaggaacugauuuuauuuucacggcuuuuguacugagcuuugacucaguuuugagaaugaaauagaaggguguguguguguguuacguacacacauuuguaaguaugcucuuuuuuuguggagucuuaaaggguuuaucgaguguuguauugucaucuuaauuuacauucacagcauacaacugaagaggagccauaauuuuuuuuuuuuugguagcauuucugugacuagauacacaagugaaaucuuuagaaaugcuguuuuguauuguguguaaaaugcuuauauguagaaauuguucaggggaacccucagucagcucuuaaaaccuucugguguuuuucagaucuuggaaaauggccuguugaaaauacugcaucauuguaggguguuuagcaaaauaguguacagccauccuuuacuuaaaggagaggaaauguuucccuuuucgccauauugugacaucuuauauauuaagaacuagucugaaggugaaaauucuuuggccagagcaaauugaaaacugggaaauuuaucacaggagucagaaaacccuguguguagggucuggugauacauccuggcagaccuugggguccagccucacuguuugaaaucagaccuuaucagggacaagguuuaagauguaaggugucucacccagacaccaucuguuccagcugucacaaugcagaagucggggaaucaaaaaucuggccagggagaauuccagcauuuuuuaaacaagacauucaugugaauuuuucugugagggaaaagaaaaccaauuuuuuuuuuuuuggaugcuauccauucuuuuuggaauuaauaagauggccucagugaggaggcugcagagacauuccguuggaaacaggcaguagcagcagucuguuucugcugcucuugcuggugcuuugaagaaaguccuucauuuaccugggaucuaggaacggaugcuugcucucccugugucugagauuucucucuaaacacuuuugcuaggaucccuuagaaucagugugaaugaggaaggacuuucugggguauugucaggauacauaugcuaaugagcccaaggcugagcaugauuuaucauucccuuaaaauccuucuuuauuaugcugaaacuaccucaggagagaugaaacugucacugugguguugcaagccugagcuagcucaaacacacaaaggaaauugcauuaaauuugcccaucuuuguuuuuucaucuuguauaguaagacucuccagacagcaaaugagcuaaccuaucaaauauuaugcaauagcuuaauuucuucucaauagucaauuucagaauuguuagcagagaagucucauaacccaaggccauagucugauuuuguggaaucagaaccccuaucugcaucuuugcaaguauuuucagaagaaaaacuaguuguuuuugguugauauuuguguguguauauauauauauauauauauauauauauauauauauauguauauauauguguguauauauauaauguauauauauguguauauauauuauauauauauguauauauauauauuauauauauauauauguauauauuacauuucagacagagaggggggcugagaagagagcugaagugaggaaggugaggcugaaggauuuggaaggugaccagcgagaggcagccgaggccuugagagugagacugcuuaggcuuggagccagagcgagggcagccuagaggccugcagacaagaagggaguagagagguagcugggaacuggugcggucccagaggagcugacagaaagaaaaagaaaauucuauuaaaaaaaaaaaaacuaaagaaggaacauuaaauauauuuguauaauuucuaugauacuuaguuaauuaaaaugucuguugauuuuggaaggccuuuuuuguuuugccuauuccaggaaagauuugggaugacaggccaaucuaggaagaaguaggugagguuucuaucaaauauagacccuuuguuuggugagacuucuuggugcuuacagacuuggggucaccugucagggagcgggaugugaguacugcaagugacuguuggcuucuggccccuccaggagucaggcuggcaucuugcugcauucagacaagcacauuauauuaacugugacuugggagucuugcucauuuaauuaauguucaauuaacgugcccugaguucccauaaucuaguuacacuacacuagcaugaguuagucacagcaccugcuuuugaucuguagaaaucuggggcgucugggccccgguggacagugaagggcaaugccagagcucgcuuaagauuugccugagaccccagcacaggaacuucccgcaggaagagugaagaaaaaaucaagccacugucccacccucagagaguugauucucuaucaggaaaaccaaggaaaguuguccacuuuuguagggggaaaugaguuaguggguuguguauagaagucugcaaauguguguguguguguguguguuacuguaaggggaaaguuccuggcugcccagacuagucagagauauguuugggaaaggcaccccaguuggcuucagccuuaggaaaucuggcccuacuuguaaggggccugcgaauggcaguagaggaccucuaccauaugagaugagaccugugaguuugcugcccuguuccucccugcuggucuauaugaugcugguagucaguuuuucagucugugauauccugugcugcccuucugcucuugcaggcucccgugugauuuggagccgaguggucuggcugccucugacugaagggcaugguuuauggaagggauacacagugacaccagacagagccgucgcacggugcugugccuacuguuucgcuuuguauguccauaguuuucaaccuuucugaugcuguggcgguuaaaucaguuucucauguuguggugaccccaaccauaacaucucauugcuacuuuauaauugucaucuugcuacuguuauguauuauaauguaacuauaugauaugcagaauaucuaacauggcacucccaaaggggccaugagccacagguugagaaccacgguuguagguaggaaaucugaaaaggccguggugguggugguggagacagaacacaucucuccacaucuacacucugcuccuuacugaugggcugaaacauuuucauucucaagaaaugaaaugccggacccugugucucaucuuuaaaaauuauuuauuauuauuauuaucguauguguacaguguguguguacaguggguucgugccacuuugggcauguaguggucagaggacaacuuuguggagucaguuuucaaagucacauggguucugcugguagaguucaggcagguagccuaacaucuugggaggcaagugucuuuauuccaugagcugucucucaguccccaauguuucauuguaugauuucauuuuuaaaagaaaauuugcuuccuguugauuugaaccauuugaaaauuaaauagaggguagugaaauggcucaguaggcaagggggcuugccaccaagccugaugaucugagcuugguggaaggagggaggcagaguuugcagauugcccgcugaccuccacaaacaacguaaagggaaacaaugaaauggagcuauuugguaacuuuucaugaggccauuuuccugagaaaaguaucaggaacugcuauuuuuuuuuaagauuuauuuauuuauaugaauacacuauugcuggugugucugacacaccagaagagggcaucagaucccaucacagaugguugugagccaccauguguuugcugggaauugaacucaggaccucuggaagagcagucagugcucuuaaccacugagccaucucuccagcccaggaacugcuguucuaauauccuaauuucuuuuccaguucaaacacugauuauacauccagaccacuagggccauaugaaugagaagccugguaucauguaagcagugagaaagguuaagcugaaaaaccaaguggaaugauacagccuuucagacaguaggaagcagcguuccagggaaaaaguagcucuaggggucacgaagacuuuuguuuguuuuugagacaggcucucgggcugcccuggcuguucuggaacucuguagaccaggcuggugucaaacucacugagauccaccugccucugccucugccuccgccucccgagugcugggauuaaaggcgugcgccaccacugccaggcuaagucauaauaguuuugaagaggcuuuccaagguggacauaugaacucugucaggcuagugugcauuuggaggucugcaugcacaggagguagguaggugugugccacgcagagcuccuuucacaagggccaggcacauggcaagugcucggugaaugugcucagauucuccaaggugggagggaagagaagacaugacaggccucagaguuucacugggcuuugagccuguguuguagcuaaaccuagugccuccuuuggucauuuuccuggaugcuacuccuccugcagcuaugauacauuagagggacuuacacacugggaaacgacuacuuuuuauuguucuuguuuugaaacaggggcucucuacuuacuugcuguguagaccaggcuggcuucaaacucucaagagaucuaccugucucugucucugccuccagaauacuggaauuaaagguguguaccaccaaucugguagggaaacuuugcaucacuaaccugguagggaaacuucuucuauacaaacuuguaacuuucuaggaagaacagggaaaugaguucucaggagcacuuugcccauuaaugcuuagacauccuaacuuuacacuggaaauuaaauucugugcuuuuuggauuaauagugucuguuguagccuuauuaugggguaaauuaaguguauggguuucaggaggcuuuucuguaggacucuacugccauagggugggcaaggcaagcccauggaguuucaucuuacugugaagauacuuuguacucaaugaucuguucuagcaucaacauacucugcuccuaaucuuuuaguagaauugauucuccaaaagauaccuuguauuuauucauggcucuccucgaagccccagauucuaaccacucaucugaaauacuuuuguuuccagguguuuugaagaagggauuuucaaccuguauugaauuaaacuaaauauuuucuuuuuucccccccuuuuccuccucuucuacuacuucacccuccuccucuucauccuccucuucuuccuucucuuccuccuuuuuggaacaugaaccacucugguggcuuccaugccauggccaagcgaggagaauccuugggugaugacaugguaggggcuguaacaggugaacaugagugcugugggauuuggauaacaggcuaugcagggaauuuccuugcagcguaacuggaguaagacagccgagaugaagaggagugucauugaguuaagucccaugagucuaaggugauuccauggcuguccuucauaggaaagggaacaggaaaagggaacugacuaguuguugaggcuggaaccgcaccccuggcaggagaggagaggaagagcagagggcuuuucuagagguccugcuuucaccacagcuccgugcgcuuuaagcaggugguuugauggcuuuguuuucugaugcuaagucucccuauacaguucacucuggccucacgcucacuauguagcacagauugucuugggacuucuggucuuccugacucagccucuaagugcugacaggguuuacagacaugucuuacugcagcugguuccagugcagcuguagauuuuacucacuuguagauauguugguuuuguucugugaguauagauuuuauuuuguucccuauccaguguucuucaaauacaucguggauuguuagagcaguucuucaugccgccuuucucuacugacaucuucuuggcuccuccucccuagucagugcucauuccuuagcuguaacacuuguacacuuguauucauaacaagccuagcuaaggacugggguugaagcucagugguagagccuagaguaaggccuuggguuuuaucuccaucagugaaaaaaaaaaucagguacucuuuacccuagugguucagauauugaguacaucuugccguauauagcagucccuaaccagauuuacuaauguguucucuuuccucuuuaucucucuuuauuuacauuuaaaccaguagucuacuaauaaugauaguauuuagucaucauaucuuuacagaguuuuacaaacauuagcuuguuaguggugaacaagucccugaggccuggucacucuguagagagcaucaugguuauagcgcagcacccauuuaucgaaaacuuaauuauaacuacagagagcuuaugggaauauaaguuaaaagcaaagaggccuuucccccaauuagcagggaagugaugcuggcuguuucagaggaucuagcuuuucggcuagagccacugugaaguuuugauguggaaccaggaaaggcucaggucugcugggccagagguauggcgcuuauuuccuggacauguuccuacuccagggagggcuggacaccaggacucagcccaagucccuggcuugauagggggcuguuaguuuucuuuucgacaaaaguagguuacagguaugagaaccaaggacauccgugugucugagacacucuccugccuuuuccagacucaagcaaguucugcugccucucugauagagcucuagguugagaugacagacuuuuguuucuuguuuccgagacaggguuucuccguguagcccugucuguacuggaacucucucugucgaccaggcuggccuugaacugagagacccaccugagaacucugccucccaagcgcugguaucaaaggugugugccaccacugcccagcugugagaugacaaacuuuguaaggggguuguuuccuccuuuguuuuaacacaguucagccugaaauguaaauggaaaugagacacauuugaggcuggagagauagcucaguaguuaagagcacuggcuuguucuugcaguagaguuggagucaauucccaauguccaccugaugucugacagccguuauuggcuucaguuccagggauucugggcuccgugggcuccaggcauauauccagugcauagacauacaugcaggcaaaacacucauguacauagaauaagaagaucuuaaaaagugagacguucaugugugggaggacucagacauuugaguucagguucuuccuguaacugacaguggugucaagugccuugccaucucuagauucaguauucuguggaaugcagagcuguggugauggguccugcugagaguauuaugaauaauuucaugucaauaaacuauauccuuaagauggcugaaaugguacauuuuauauuacguauguuuugcaacaauaggaaaguaauugugaggaguaaugggguccuggagagauugcuuacccauucagagcucaguucccacaccugugccugcugacucacaccggcuaguaacuccagcucuuggaggaccaggcucaucugucuucccagggcaucuucacucauguauacauaccacagacagauacauuaaaaagaagugacaaguaacagaauaugagaagugagcauaucacaagcgauaauuccugcuguuacuauagcaccuauagcaaucucaguacuugugagaccaggcaggaggguaaagaaauuauauagccuaggcuacauaacuaguuugaggccagcuuggacuauuuaaagacccgucucaggaaauaaaauaauuuaaaaggagugguaauugcucuccuuuuuccuugugcauauguuaucagcaaggugaaaggcagacucucuuggaguguaugggcugggccagaagaacaccuuucacauggggucgaaggaggaccuuauugaacuaugaagaaaguucuuucccgucucuccucuuuuuagagcagggucuugcuguguagucaggacugaccuugggaacuccuugcuucauucuccugaggcuguguuguaauuauaggugugagcuaccaugcccagcuaagaaagucuuuagaucagaaggugaaauaucuggaaaucaaagucauacuauauuugcauaaaaggaacagcuauauuuagauaucccuguuuuuuuuuuuuaagaaagcauuuuuuuuugcaugugauuaaauuuugauagguuguauuuuaaucuauuauuucucucccauuauuuaucaggaauaaugcuuucugauuuauucagaucucuuuuaaaauauuugaaggaucuucucuaaacucucuuaaaauagcuuauguuucucauaaucuuacuugcuucuuuucuuucguauaaaauuuguuuaucgccgguuggugguggcgaaugccuuuaaucccagcacuugggaggcagaggcaggcggauuucugaguucgaggccagccuggucuacaaagugaguucaaggacagccagggcuacacagagaaacccugucucgaaaaaccaaaaaaaaaaaaaaaaaguuuaucaccuuaaugaagaggguuucuggcauaugguugguagucagauauuuauauaaaugaguccaugggcuggagacggcucagcgauuaagagcacugacuguucuuccagagguccugaguucaauucucagcaaccacaugguggcucacaaccaucuguaaugggaucugaugcccucuucuggugugcaugaagagagcgauaguguacccaaauacauaaaguaaauaaauaaaccuuuuaaaaauaaaacaaaugaguccauaaguuacaguucagcauuuucuuccacggagacaaaauucauaugacauauaaauuaacuauucuaaaguauacaguucagguguaucuagugcacuccaaaugucauucagcuacugggccuuuguaguuuaacauuauauugcaaacccauugaguaaucaccucccucccuccuucccaagcccugaucuaaucugcugucuguguccauggauuugcuuauucucaguauguccugugagaggagucgcacagucagugauaaccaucugugucugggugaugucccugagguguauccagggagguauuguauguuacuuuguuucuucggugacugaguaguaauccauuuuguguccugugcauauguucuucugugucuacacuuuuaucuuuucaucuguuugugagcacuuaguuuucauccuccuuacuguuaggaguaaaguugccauaaguggguguuuagaguauguguguucccuuuucuccuggaugcaucucaucucacagagcaguuguugguggcucugcacgugugaggguagcuuguucccagcagcagugucccagcuucugcacaucuucacugacuucugguacucuagucugggaauuacugugucacugucuuucuggcuuguuauuucuuaaugaccggcgauaguaaaugucucuaacgugcuugguguccauuuguaugguuuucaaaugucuaagcccuuugacucuccuuuaauugcgcugauuuuuuucuuguugcguuauaagaauucuuuauuuaguguagacaugaaacccuuuagguacacaauuugcaacuauuuucucccgcugaauagaaugcuccauaggugcuguugauagugucuuuugcauaaagauuuuaauuggaguucauuuguuuccuuccauuuguuacuugggcuuuuggugucagcucuaagaauccacuguuaaaucauuaagacuuuuuuaccacuauguuuccuaagaguuuuauaguuuuagacuuuauguuuacgucuuugguccauuuugaguucauuuuugcaucuggaucgagauaggaguuccuguuuguuuguuuauuuauuggcguuauccaguuuuuccagcaccacuuuggaagagauuauuuucuccccaucaaaaggucuuggcccucuguuuaaaauguauuggcuauagauacuugaguuuauuucuggaaucuuaguucagaucucuugaucuguaugccuauccuaaugucggcaccgcacuguuuugauuguuguagcuuuguaguaaauauuuauugaaguagcaagcuuugaaaaugagaguaucccaacuuucucauuuuuaacaucauuuugacaguuuugagccccuugauguuucacgugaauuguaaggguugcuuuucuguuuauguaaaaauggucacuggaauuuuaauagggauugcaccgaaucaguuagauugcuuuggaguuaccaacucaauaccgccuuccaguccacaaauaaggcugucuucccauucauuuccucaguucuccuccuuccuucgcuucucucaugaugcuagggauggagcuuaggugcugggaguccugggcaguccucuaugcugagaggucccccagccuccucuacacugacccccccagccuccucuaugcugaggucccccagccuccucuacacugacccccccagccuccucuaugcugagcccccccugagccuccucuacacugacccccccagccuccucuacacugaacccccccagccuccucuacacugagcccccccagccuccucuacacugagccccugagccuccucuacacugaacccccccagccuccucuacacugaacccccgagccuccucuacacugaaccccccagccuccucuacacugaacccccccagccuccucuacacugagcccccccagccuccucuacacugagccccccagccuccucuacacugagcccccccagcuccucuacacugagccccccagccuccucuacacugagcccccccagcuccucuacacugagccccccagccuccucuacacugagccccugagccuccucuacacugaacccccagagccuccucuacacugaacccccagagccuccucuaugcugagaggucccccagcuuccucuacaccgagcccccccagccuccucuacaccgagcccccugagccuccucuacacugagccccuguccccagccucuuuccauuuauuuucauuauuaccuuguaguuucguguauaaauaguuaucuucuuggguaauuuuauuccuuaauaguuuguucuuguggaaucuacuguaaauagaauuuuuuuuuuccaucuuggauuguuguucgugauguauaaaagcauuguuuuuuuuuucuuuucuauuuugauaugcuauaacuacugaauucaucuguugcugguaacagauauauauuuuauggauuguuuguuucuuugugacucuguguaacccuggauguccuggaacucgcucuguagaccuggauggcuuugaacucaagagaucuaccugcuucuuccucucaagcacugggauuaaaggugugccccaccacugucgugucuggggauugugcuuguguaucugucacugugcauaugucuagugcuugcagaggccaguagagggcgucagauuuuaguuacagaugguuggggguuccaggcauugaacccagauccacuggaagagcaaccaguguucuuaaccucugagccaucucucuaagcccuugucgaacauucuugagucauuuuacaugcaaauagauacuuugcaugcacuuuccaaccugaucuaucuacuucccucucccucccccccaacagcccccucuuccucucuaccuaaugacugcaucuucaaguauccaagauaauaugaagcucacaauggaggugaacaccccuuguauugcuucugaucuuagaggaaccugucagucucucacugguucagugcuuagccucuguagggcccuggguuugauggccagcaugaguagggguuuagugcaaagccuuaaaggcucuuuguuauaguaaagaaguuccuguucuggucuguucauguuugcugauuuuguuuuguuuucgagacagggucucucuguugaguccugguuguccuagagcuugcuuuguagaccaagcuggucuugaauucacagagauucucuugcaugcugggaucaaagguaugugccacuacuccuggccuuaguuuucuguuuuuaaucauaauagguuguugaauuuugucaaguucuuuuguaguuucugaaugagcauguauuuuuuuccuuugugcuauuagaauacuguguuagaguugugugcgugcgcgcacgcacgcguguguguaugugugugugugugugugugugugugugaaacucagguacucaugcuugcauggcaagcaguccuacuaacugaucuguuucucuagcccuaaugaguauguguacugaaucauccucgcauccccugaguaaauccugacuugucauguaugcaguccuuuuaacagauccuggguuauguguucuacugaggagguuugugcuuauguucauaagggacauugguuuguaauuuccucuuucugggauaucuuuagcauuguuaucaagauaccaaaagguacaucauguuuauauagaauaauacaucauauagaauuuugacaccuggucuccccuaucuccaaucauauagaaaauucuaggaggauuucaaagcagacauggugaugauaccacauacuuucuuauuuccaauguuucuuuuuuauguuaauuauuaagacuuauuuauuuuauguaugugaguacacuauagcuguacagaugguugugagccuucaugugguuguugggaauugaauuuuuaggaccucuguucgcuuuggucaacucuacuugcucagucccugacugcucuggcccaaagauuuauuuauuauauauaaguacacuguagcugacuucagaugcaccagaagagggcaucagaucucauugugggugguugugagccaccaugugguugcugggauuugaacucagggccuuuagaagaucagucagugcucuuacccgcugagccaucucgccagcccaucuuagcaugacuaugguauuggcuuuaaggccaagaguuccccugacaguugggaagaucauggcugucauuaccuuuaucauacaugucugccucgagacucaggaaggguccucuguccuugaugcugugacagggcaaagguguacuuuaucugguucuuccuuugcagauagcauugguggaaggcagucacugagaucugucugguggcugaucuggcuucaaggauccaagaugguuacacuccgaugccugugugguuggaacgucuagaucaggguuuccuuucucauuguggucucaggucuguuguuaccgauguuguugauggcauugcugaguauggcugcucagaacuccuagacagcaaggucucuaaagaagccuuccggaguuaaacgguggaaugcagaugggauugugcugaugugaagaguauaaaagacuugugaccacccaccagugugugugauacucaaauagcacagugcucucucagcaguagugucagcuaagccuuugaauggauucagugcuguuaaugaagacucugaguaaacucuggagggucaccauucauaccguggcagucgccaaaucaaaucugugugucauuccccgucaggagcuacuuuacucuucucuagacccggucuugcugugugacccaagcugccuuugcaguaguggcccuuccugcuucuucccuaaguggagggaucccaggugggcggagcccuggggugggcucagcagugagccucacuguuaccugugaccagagucuaagaguuugauagugguuucuaggagcagcuuuggguuuguggccucuuccugugaguuuauuuagcaagguuacucggaacucauguuaagaaauuuaagguaguauuucaguucucuuugguuuuucaagucaggguuucucuguguagccucagcuguucuggaguuaauucuguagcccaggcuggccuauagacucagauaucugucugccucugccucacaagugcugggauuaaagacaaguccaucaugccuggcuaguaguucuguuuguucuuuaaaaagcuuaguugaaaaaauaauaguggagcuggagagauagcucagugguuaagaacacugucugcccuuccagaggacccagguucaauuccuagcaacuacaugguagcucacaacugucuguaacuccaguuccaagggaucugacgcccucacauagacauacauggaggcaaacaucaaugcauauaaaauuuuuuaaaagguaaaaaauaauaauaguaagccuguauaucauaaauuuccuuuuuucaugcagaucauucuaggagauuucuucgcuuguuagaauaaacuuguggcugguuucugcauaaaagggugggacuugcaccugugugcaguuagugugcauaaaggugcacgcaucagcucugacauggaaaucucauuuucuguggcucuugccuucucagccuuucucagcugacggcugcaacaguaaaugagcaaaagaccagaugaugaugucacagaagaaugaggaggguggagaugaauaacgaaacuagaagucugccucucacaccauaguguguuagaaucaugaggaaagagucaugucugcuugcgucugccuggggagccccaacacuucugucugggaagucagugguacuguuucccaagcaggucauuucuaggugucugaccuugagugcaaaaagcacgaaugaaaaacauguucuacuuuaaguaugugauacaccagaaggacugaugggagucucaggggcccugggucuucuccuucuccucucgugacucuugaggucaaggaccucugaucuuauaugcucugaggucucuugccauagugagguuacaaauguaaguuuugaguauggugucuacuuuucuuaucuuuuuuuuuuuaaaauucauuaaauuugccaguuuuuuguaauaucacaugggacaaaaugccugcucucuguaagccucuggcuguuacuggaugccauguucuucuuugccacuguuaccuucagagucuucuguaccacaguguggugacuguggccacagugugcuaaccagugugggccaggcuuggguaguuagucucuucggaggacgguaaccgagguguaaggucagcggcuuccccacaguugaugccauguuuuucgccugccuuauucuguagucuaugcucuacccggagcuuugcccagcucagcuugccuuauuuuuggguucugguucuuacaacauggcuugccuugucuuacgcuauauuaguguagauaauguuucaauuuuuccuagaguucuuaggaacuacuucagguuuuaguuacgcuuggaaugaacccuaucagaaacgguuuaaccuccgagaagcuuucugagcagcccuccuugaaaccacaccuucauauguaaagcuuuuccuuuugguuuucuaggcaugacuuuuuuuucuuuuaauagacguugagauauggccucauuuagccuaggcuggccuuggacucaguguagccaaggaucaucgugaaguuccuccaagugccaucacacccaguugcuugguuuuggguuuuuguuuuuguuuguuuuguucuguuuuucaagacaaaguguuacuauguaguccuggcuggcauggaacuugcuauguugacaaggcuggcuucaaacucacagaucucucccugugucagccucugccccugagugcugagaccaaaggcaugcaccaugcccuguuuauuuaauggaccuguuucuggguguugagcauguauacugugcgagugagcagcggcuggaaaguugggguugaugcuuaaucuguauguuaacuuugacuggauuuagaauauaaauccagauggaccuauagcaauagccaccccuuggaaucauuguuuuucuucugacugcuuucuugcugcugugaccaaagaccagacagacaagaagcaacuuaagaaacuuuagcuaaugauuuaaggauacuguguaucaugcagggaagagaugaccacuggugcucagggcucuccucuguguuuccacuguauucacuccagagccccagguccaggugcuggugucacccgcaccagcuaaaccucuugggaaaucccaucacagacagacccagaagugcguuucuuagaguuuggaguugagggcuagagaaagccuggaguacuaucagcagggcuuagugggcccugcuggagaaacuguagaagaccagaugcgcugggaaggcggauggaaaaggugugcucaggacuuccaggaggcuguccaugcucuaaaaacucgggugcggcugaauucaaaggcaacaaguugucuggaauaggaauuuuaucuaucuaucuaucuaucuaucuaucuaucuaucuaucuauuuagagaugaggucucucuauguaguccuggcuguccuggagcucucuauguagaucaggcuggccacagagacccuccgaacuuugccugccuagugcugggauucaaggcaugccucuaugccuagggaauuuaagaagacuuaagacagcacaccaucaaggcuggcaugguuacuguuacugcucuuacuaagaucuacaguagggaagagcaaagauaauguguguaguuuggugaagacagaguuugaguaaguuucaaguugcaggggagggugguguggaagaaguaguuauaccuguuuacaagauaagcacuaucaaagaauccucaaaauccgcacuaagacaguagaggagaggugcucugagaauagaccccauccaucagaagagcgguaauuagugaaaaagaagaugcauuugaaagagagacuggauggcuaacgcugaggaaggaguuccugcuuggaaacacaccucuagagaagugacuucccagguuccgccgucaaggcacagagaagccaggauaccuguggagaaggggccagacuguauccucagcug

SEQ ID NO: 6851 - RNA, 5286 nt, Mus musculus
uggaggagaccgagggaggcgagcucccgagccagcguggaguccccgcaagcgccagcggugagugucggugagugugcaggaggcacaacgcccccuccccacccuugcccgcccgcaggguuccguccuccgaggugcaccuuggcagccaaggguagggaggagggcgagugcgguaaggaguuagugggagcaccccgaggaagggacggguguggguccccccuggcagccgaaacggggggagggggacucuggaucaagccacaacaccuggcccucugcaccccagagcggauagagguguguggggcucuccaacggaggcuucaggaaccaggcacccugcaagagcaaggcagccugugggcacuugccccaucguagcuccauccuugcugcaauccuggcuccccagauuuucccuaggacucuccugucgcucucucccucuuucuccgcucacucuucagcucugucaccucuuugcauggccuccaugaucacucucccucccucauucccgaaugucucugagacaucucuuugggucucuguucugggagguucucagaacucuggagguaugcaggaacucucucaacaucucagagucucagagccgggagccguccgcgggggaucuggcgggcucugggacaggggaccacuggaaugacauggcugccuacugccagggggugcccaucacagggugugccccccuuccagacuaccuugggacucuggaacuugagcugaccaagguggacaucugguagaagggcccucauuuuccaugaucuugugguggcccaggguccccgcaucccagcagggugucucagacauuccacccugcuggucaguacuucaccuuggcccagucuccuuucaaagcacaggccuguggcccugggcugccugacuaaaaucugccaaugccuguuagacccuacucauuucuugcucuggcaugagcuaggcuccaagaauacccccccacccccccccacaucccucuaccccaccaccaccccauacagugcuagggagugucugagggcgggccucugauuucuggcaggggcucuuuccucacccuggaggcucugauccagccuccccagccugugccuggccuggguagauggggccauaugcaggcaagaugucagcuucucuuagggcauggccugagggucugugggugaagggguguucuugggcaggaucggggcaccuuggcuucuggcuggcucagacucagugccggguuucucccagccaccugacucaaacuuguuugggccccaggucugcuguguucucugcuugcccagacugccugcucuccaucucuuagagaggccucaggccagcugaccuuccuccaggaagccuuccuggcucucaaagcugggucaaucucuucccaucuugccacauucucuauaguccugggcacuguaugucagcucuccugugcucuauaguccugggcacuguaugucagcucuccugugcucuauaguccugggcacuguaugguagcucuccugugcucuugagaucagcccugagcugugggugcugggccuggcuaggcugagguggggaggguuccugaaggaggaggaggaggaggaggaggaggcggcggcuuagcacuggcugcaguggaugucucauuuuuacucuugucuuuguguagcccaguagcaauagcaacagcaugagcaccccacagccagcagcaccagagagccccacugagggccccagaggcccagcagggaagguaagugacugaggggcaggagacaggagggagccagccucaagcucuggcccgugacuucaauaugcuucucaucucugucagccucaguuuacccucccaugucgaggagggcauugcuguuuuuguagaaauuugguggauagagcaacugaaagcaaacugcccuggcuuacuuugcacgccagcugaaccuggggacaccaaggcucauuucccaagcacaggaucgcauucugcucuuuagggugauaccauucuagggugcccucagauauuuagggggcugggauguugaugcagcaagauguuuaaauguguaguagggugcacugacacaccccuguaaucccaguagucuagagagugagucagaggaucaagaccagccuuggcuacuuaguggguuucaaacagucugggguauaagaaccuguuucagaaguaaaauaacccgagauucuaguccugcacagagcagcagagucccagaaaucugccuuaggucagcagagccagcgaaggaagaaagcagccuagacucugggcucacgggcgcagcuacccugauggucuggcuggcugacuuggccaucuuaccauaguagguacccuccagacagaacccauggcugacggaaaggacuaggguguaggaaaggagccaggauggggaagaaggccugguuuggcaaggccagcggagugucggccucagcaggguccagcuguggagcaggauggggucccccucugcugucuucugaggcccuuuaucuuucauuccgcagaugguccagccuggugacaccuguucucagacuucagggucaccugaagcacuuggcuaacaggguccuggguagaguguggaaguguguggggggaaccaguauccauugguucuaagcagccauucagaggcagugugacaguuugccugcucugugccuaccuugcuggaggacugugugcuacugugggaaggcuuauacacuaggcagccgucuuuuccagaacuucaggaaggcacagagguggaccagugcaggcaagucagggccucaggguaccgagggauggagcugugugaggcagccucggccuugaaaagccuugaaugggagguggaguugcugagggcacccagagggcgugugggcaccgaacaaugagggagagccagcucugauugccauggcaacaucuuccuagcuccuuggccugccaaguggagggaggaggccaaggacccagcagggaagccccuagaaaggaauugugcugacuuccagguacaggaagcagcuggggugcuaaguccugggcuuccuccuggggugacuagucucuaccaucuuagacucugucugggaaaugggcuucucugggucugaguccaggugaguucuaugauguuuccuggcuaccugauuccccagugguggcacaaggcagggcuguucacucugccuguucuuggccuuccuaguaggacaggacagagggcggaagaggcagagccagcaguccauggcccgguaucacccugauccuuccccacucucucuauaggcugcgguagguguccgggagaagggcccuuggcucugucagcgacugcccucuauugugguggaacccacugaagcgggugcuguggaaagcggggagcugcguuggccaccugaggguacacagagagguaccccucagauccaggcugcugcuggugagaccacagugcccauuuccugucaguguuugcaguaggugugggaccccagcguccagagcaucagcccagggccuggacucugccucaccuucacccacuccucuggugacugcccuuccucucaucuguaccuguccucuuaaugcacaccuguggcuccaggcaggccuggcacucgagagggccacaggcacgcuccuacuguccagacugcugucuguucucccugacuugagagcuuuggaaggauucacguugcccacaaggaccuagaggggccagcguacaggagcacauuugggaacagggguuccucauagcuuggcagcaggugccagggugcaagacuggagcuucaagaaaaaggugggacaggagugguuaguccuuagguuaguccucaguuaguccucauuuaguccucagguuaguccucagguuaguccucaguccucaguuaguccucagguuaguccucaguccucaguuaguccucagguuaguccucagguuaguccucaguuaguccucagguuaguccucagguuaguccucagguuaguccucaguuaguccucagguuaguccucagguuaguccucaguuaguccucagguuaguccucagguuaguccucaguuaguccucaguuaguccucaguuaguccucagguuaguccucaguuaguccucagguuaguccucaguuaguccucaguuaguccucagggccuccagaggggcucguaagccacugaaagcuauaggcacgagggcugagcuguucccugggguccuuauucucugaagccuguggagggucucucacugugaggacgugaguucagcucccaugacagaugcucagaaccacacaaaccuccuuccucuccccagaccucagccucugggcuaguccuuauaccagcccuuauccagcuuggcccuugaagggaucuauacccauggcccucaccuuuucucaaagcucccucacccugugucaggccagcagcagagacagcagcaguggcugcugucccuuagguaaccacugaggugugggcuguuaggagacccucaggcugccacauucucucugccauaccuuucccugacacacagggcagggcgguggagggcugcuucaggcuuccagagcugggcuucauucuccuucucuuugccuaaaacgagggugugaucaccccuuccuucccaaccgccccggggaaggaguggcugucccguccagaugucugccaaaggcucaccucagaucccccaggaccaauggagcuacagcugucaccaauagagaggcuuugggcuuuauguuugguuuuuguuuuucguuccuuggcuuguuuucagcuccuuccccaaguccaccagggaaggaagcagaugaugaugucauccagggugccagcuccgggcaccaggcauucccugcuccaguaacagaugcggguguggcaggcucuacucucugaccaccaagaggaccuccaucccaggaugacaggcugauucacagaaaaggcugggcccacacaggaggcccagcucgccaagcuuccugucuggcuggguguggccaggaccccagccccugccuuugcgcuccauggucuagaucuggaacauaccccucuuuguucaguggcuugaagcagaaauaaaggcauccuuccugguggcuacgggcaccuucguggguacuugagcugcugggcacaag

SEQ ID NO: 6852 - RNA, 4813 nt, Mus musculus
cagugaccuggcaaauuuuauugcuugagagucccuccuacaugaaacuagaauacugcaagcugcagaaccggugcucacgagggcucaggugccuagcaagaggcugagggcugucuaccccuucugggcaagaccaacguggugucugaggcuagggacccaggguguggggucugccuuugcuuuguuguugcuuuuaaaauguauuuaguuuuccuuuaugcacacgugucuugccugccugcaugucuguguucagcacaagcucacacucacagaggccagagagggcguuugguccucuggaacuggaguugaggacgguuguuuaucgcccugugggugcugggagcacaaccuuugaagggagagccaaggcuccuguuuugaucugcugaggcaggcaggggcuuuuccagcucaggacuggcucgguccucccauacauucaauccagcaucaccucucccaaccagcuuagcuugcccaaccuuguacacuauuuuaauucacauuuauuuuuagaauccucagcuucgcacuacaguguggaugugcugagcaguuagaaagggaagccuucccuggccugaaguccugaaaggagacuccgcagccccaaaagacucccccacaaaugcccggaaugccucaucuccuggcuccucuggcugagcagccaggcagcugagaccaaaaauuccauguccccaggcuucagugcuggggguagggccagagugacucacugggcucccaacuuggggucagucauggagagggugacagauccucggccaacgaggcuccugcucgcccuucagcccuagaugcaggugauuagcacguccacagaggugggcacuucgaucuccucgaagagcacguggugugaggggagccuggucucgugggcagcccucagcaagucuuggguguguugcaagagauucugguuccggcggcggccgagucugcguagugccagaauggccagaauguggucucgccuguagagacauagguuccccacugcagagcggugcccccugguacccuucagcucuugccccgcccccacccccgggagggcaggaacccaggcuugggaggaaguaugauucagcauuccuggagcuggauuagggaggcugaaaggcugggacuaucccaggcugcgaggggauggggcucuaaaaggaggcaaggaggcgggagugugggccuggaggugcacaguaacuggaccuagaacacacagacaugagacaggggagggggcaugcgcacagcggaaagaagcucugugcagaggcaacgcaagaacucugaucuagggaaggcuccagaaacuggcagaaugcuagggagguagaggccaggccaggccaggccaggcggcagguuggggaauguccucacagugugcaagacagagcgugguggggguguagggugacaggugaagugguggagggguggacguggguggaauagguacaaaggggcacccugagucacugcguccccacugcuuccccgcagccauccaagaccacuuuuggagccagggaggaagggccaaacaccaguuggggaacccccgaggagcgguagggaaacugaaaacuuagaaggaacuaacggggucgggucguuguuguccguauucaaaaucuaccagaacaaacaagcugcgagcagcaaggagccagagaaggggcuggaccaggggcuuucagugaucuuuccaucccggaaucuccgagagcacuggagagagccaagccgggauuuccaagggcucugaugauucacugccccacacgagccuccucauggcugccgaggccucagagagcuuccagagaggguuugagcccgagaguggagccacgccguccacagaugguggagaacacgagggaggggaugguccucuugccugcggucccugugcgccuuccucgcgggcaugcgcacacggguccgucgcgguucgcuucccgacuaagccacaguucucucggcccugacaagcucgcucuucccuccguuccacgccugcacucacuuugcuaaaggcgcgagugccagguuccagugaccccugacucuaggagggaaggaggaucugcuaaccugauguccggguagcuccguauaaguguuuccaggugccgccggaugucgucuuuguaugucucgcccaggaucucagccacagacaggauggcuugguccagccacuuggcuucagagcccuaaggaaacagggagauaugugcgugguucaucucccccaaggagucucugccuacaaaccucuccuguagugcccagaaacacccuucccgugugucugccgcggguggcuugcccauaagaagauuccacggagucagggaauaagauuccacagaccacaucugcggugacucuggagaguuuucuuccugucugcacagacgggaaauccgagcccugaccaggaaagugcugauuggaaccugucaccaguaggaggccagcagcccagauaagggguuugggcucaaagugcucccgagaggggaaagaucucccacagaccuugcccaucauaaccuucauuccuucuuugccuucacccacaaauguaugcaaauacaauguaaagugaaacccccuccugugcccgccccuuuagagucuagccccacugccauuuucccuguggagucugaagaaccgccuaguggaagcucuuuucuccugcuucacccgccgugagggcucuuuacaggaugaaaacaacagaauaggggguuccuggcuggguuugcuggccagagacugagcccgauugacagucagacgcugcuccuaccaagcccuggaagguguugcuaauggccugggcauccagguucaucuuauuagagcccuucagucgauccuggccacugaaccucucguggggccucagcaccugccccagguauucgcggaccacaaaacggugcaccuccugcagugucuccugggagagggagaugguaguggucaggaucaaagccaugggcucugcacacccaugccagccacccacuuccugguaccugugccagugguggggucacaugcucaagaugaugugcaaaguccaccacuuuguccaugaggggacgaaguguguccugugugagccagcucuugguauauagcaccuuaaauagaggcuggggacagaagggcaugggaagugagcucuguucaccguuucuaacccccuuccgugcugggcucccuggugcagcccucuuuucuaggcacagguuuuaucacuagguccuucccauaaugcuuccuccaauggguauggaaaagucuaagagucuugucaggcccugcuuagggugugugcugggugcaccuugagugucugucuggucaaggagcuuuaaggccuuauuucuuggcccaccaccccacugaacagaaggagcagcaguggguuggugagugcuucccacccacccuugcucugggagaacucacagagggcaaaagaauggugugaccuaggccuggacuuuagagcacagauggguaccgggguugcggggggcagggaggggggcgcacagaaguguccaguucaccugcaugucuugcuguacaaucuggagcaaauguuucuggaagcuauugguggcagccacuagggguuucuccaguuccuuuaugguuccugggaaccuggccagaagacugguucuggggaggagccaagacacggagugagcuggaaacagaaaaacaggcagaggagcaagaccccucccccggggcacaccccugcaggcugggcaaggcacuggucugccucccguucguucauuuuucagcgguucuuauucuucccaacgcaguuccuuguguuguggugacccccccaaccauaacaucauuuuaguugcuucuucauaauuguaaugaagcacgaugcaaauaccugauacgcaggauaucugauaccuuuguggaaggggucgggacccacagguugagaaucccugaguuagcuuguaaugucccuggaguugugcaaaguaacacccaggggcagaacugaauaaaaggacaacaucaaagcccugagaaccaaucauuaacucuggcagcagggugacaggguggcugcuuugguccugucuggcagcuuugagucagaccuccaugccucuuggugaugggacaugguagcacagccaggcccggcagaaacuuuccaaugagcuucaucccugccucugagaaugauacugucccacugggcagguacccagcugcauggguuacugguugcaccagcauccaccugcccaccugucccaggcuacccuaggcuugggaagucacacuggguggauuaagcaggcacauaguguaucacagugcucauaaagagugcucauaugagggggcaggugagauggcucaguggguaagagcacugacugcucuucuaaagguccugaguucaauucccagcaaccacaugguggcucacaaccaucugcaaugagaucugacacccucuucuggugcaucugaagacagcuacgguguacuuauuuuaauaauaaauaaaucuuugggucggagggagcaggguugacuggagcgaguggggcagaccggagcaagcgggguuggccugagcaaacagagguccuaaauucaauucccaacaaccagaugaaggcucacaaccauccgugcagcuacaguguguacuuauaugcauuaaauaaauaaauaaaua

SEQ ID NO: 6853 - RNA, 2986 nt, Mus musculus
ucagaaauagggcaggccaaacccuaguuuauuuucagugucagcaacagcuuagccaucaaaaaaauaaacucuacccagggcgacagaagucucuacagcgaggcuaagggcucagccgccaggcggcaaacaucaaggaugcauggcgggcacugcccgguuaauaaguuaggaagcggcagccugaugguggcgagggccaggcuucacuucugggccggcaugaggucaucgauugccugacccugcuccagccguugcuccaucucaaugaguaguuucacuccguccaccaccaucugcaccaguuccaccuccgagaagcccaggcggucagcguuggagacaucaaacaccccaccgacagcagcgguguccacgccaccugcggugggacaugggcaggucagcggggcugaggacaacaccugcaccuucugccccucaccugugccuucugccccucaccugugccucgcuucugaagccgcagccgcuugagcaccuccgagaacuucucgugcuuccccagguggggcagcuugaugugcacaccugcccgcaguccggugcccagguuggaugggcaugugaggauguagcccaggugaggauuccacaugaacucauaguucuuggacuugaagagaguuucgaucugaagguggagaagggagaguuaagagaaggaagccuggccggaagcccuacggacccugggagaugugggcucugaucugccccugaucccuccccagcaccaacgccccuagugaggaagcccuggggaaugcccaggccugaccugagugaggccggugcagaaucgggugaacacuuccuucauguugccccccuucugcauggagaugacucgcaggugguccuccucguuaauccacaccaggaaagucuuauugucauugugccuagaagagggguaaagucaggcuggagucccugccagaauguggccuuagaucacacccaagaaagacacuauaggugggugaccucaaacaaaaugcuuccucaacaaagugcuggaaugugagcugucaccaagacgccaaucccagcaacaguggaggaaggcagcucauauacaucucaaucaccagucaugugcuguguggcccgcaagggucuggagccuccagagcaucccaccagaggaagcacgccuccgcccgcucagucugcagggguaggagcccugcccggacgggugcggaggcuuuugcgucauuggcaccuggcacgaucccggcggaauaagggggugagaagguggagagaaaacaagaagcgccggcucccaggaggagggcggagaacagacgccaaagagacuggucaccacccuugagucccuggagacugcggccucccgcagcgcaaggaccacagucauccgcagaaccaaggucaccugggcggagggaggcacugcacaaacuaggaauucagggcaggccccaccuucuagggacugggggggggggggggcucguaccauaugccacgagcauccggccagucccgggccaugccggaggccagcagcagaggcgacacaggcuuaucgaagaggaaguggucgucaaugagcugcugcugcuccgccucagucaugcucuugagcgcguaguaccugccagacaggucgccaucuaggcuggacagagcugcggagugcagaguucaaggacagggugggcgggcgagcaagcccgccgccccgccugcagcaguguguccccgcgggcgaaggugggucuucgacccucaguccccagugggaacgcgcgcgcagagaagagcgcagcagcucuggaggcuguuacccgaccccuaccuucuacugccagcuucucgauggcgcggcgcuccccgcggcugcagugcggggggagacagaagccgcggaugcugcggccugugcgcacucgcgagcucagcacguaguugggguccaggucaucgccacccugggaauacaaggugguggcuagagugagcgccgagaccccucuccccagcacgcccggacccugauuccccgcaccugcagguugucuggguugaggucggucuugugcucaucacugggcugguagccgccgugccgcuccucaauaauggggucgaagagguccuugaauacgucguaacucuccucgucgcccgccacugcacccacagucaugauguacggguggccuggaggaggggcgcggcgacagugacgucaccgucaggcaggagcaagccgaggcucuuaaggcuaagcgcggagaggggaacaggggaccccagcccaccgaagguucagggaagagcagugggauccuugcccggggggcuucuuggggaggcggaagccugacgcuacaggggugugcauacccggauugucuacgccagucugaauggcgucguccaaaguaaagccgcucggcgugcacuuggcacggagcucggcguacagcuccggggucagcaccuuggccauaugguuguuguggcugcucagaucagggaacucauccucggccgggaagcgcagcuucugcguauuauggcuguuggagaagggcauggcggcggcagcgggcugcagggaagagcggggucagaggagauuuaaacaccggccgccagggaccugcaaaccacuugggacccccgagacuuucccuggacgccaccaaggucagcgaggucugcaucgucagaguccagcgcaucccaaguucccgggcggguccgaugagcgcucccggcagcgaggcugcgcgugaugccccggucccgcaccccacagcguagagccccgcaggacuauaccccuggcccuuggacccgcucaccgggaugccggacgaagcaggggcgauggaugccugugcuugcagcuccuggcgcagcgcagaagaacgacggcugcucgcugcucccugagcucuuaaggggcgcgucg

SEQ ID NO: 6854 - RNA, 10690 nt, Mus musculus
gggcuucaggagcgggcggagcgcgcgggagacuugcggggucgcugauccgggaggugaguuagcugaucgcgaguggccgaacaugggguggcgggagaggacagaggacacuguggguuucgagcgccccaggucgggacucaagaacgagcuuccccagcggggcaccccuucaagcccguagcgggguuugaaggaaucgaacugagcgcgggaccugcuuuccgcacuagagucccaggccagccacagcgugaccacucgcugcagauuugaucugugacuuuuguuuuucuugugguguucguaaggacgagucacauugugcguguagccuaggcuggccuuggauucagcaguccugccucagccuuccucgcacugauacaggugugagccaccgcgcgcgccucacccucuagcuucuuuggguaauuggccaaaucagcuacccaggagcuuugcucucucucugacacaauuggacacacucuagcccaguuggagggaugagcugguguaacccuacuucuccggaaggcaggcggccaaguggagcauggagcucugugcuuuugucugagacacagguucucaguguugaaguagaaguugcucaguggcacuuuguaaagcaagguuagcugccucaaggccuuggcauuugcgggugcacagauagaacccgccccugacuauguccucuguccagucuccaccaagcccugugauugcucugguucaccacuggacgcuguagcgauggcuugggggaccuuugaguucuggugccagagcuuugugucugaaagcauguucucccuucccuccugcccuguguggugugguguauguguguguguuguauguacauacguguauguccguuugcauccguacugaugugugugcguguguggaaggcagaugucugacauauauuccuccaucacuugcccuacgaacccaaaguccacagauucagccugucggccugcucugaggaacuugucucugccuucugagcccugggauuacuggcagcccaccaaaccugcccagcaccagaucucacguccucggccuccucaaacuuggcuccugagccacuccaccccauccuuagugccucuuggcacugucauuugaacccauugcaguguacuguaggacacgccuuuccucacacuggccuggugcuguccccuccgggccccuuucgggagacuuucucugugcuuucugguacgguggagcugccucuucuguuguucucugaccagguucaauuucucccaccauccuucaaaaucccaaacucacaaaaagcuggggaaugcugagcaagaccccucuaugccccaggaaguugaaggggagcagcaaggggcagcuaccuugucccaccccccccacccccacacccccacccccccgcacugacaccuucaggauguugacuacggcugaauuaguucugugccaacaucuggagugaaccuaggcuuccagacugccuaguccuccucaggguugacggugcacgcaggagcaccauccuuagcucucauggaccgggagacaccuguccucggcgcucagugggacaccuaaccacacuuuggcuucggaccgcccugugugucaccuucccacaggaagucugaguuggugugugucaccauccgucgcugugugccugucagcucugcugugugcugucaccgucagcucugcaugccccugcugagaccacuuaggaauggacuuggaucagcuggaccuaaacccccgaauuacugcugcgguuaagagggguauguguguggugagcagggcacacaggcacugugggcaaaacaagcugcacucucugcaccacccacgccuagcggcuucucuccuuuucaaagcgggguugguuggucucgcaaggggcaccuuuggcaccugaguucccagagggcuguggcugcagagggcgagcugcucagcccgcauguuccuggcagcucuuucugccacugugugaacuaguuugauauaucugcaauguauuauuuuuuucuuuuucauuuuucuuucuuuuuaauugcaacagggucucacuguguagcccuagcuggccuggaacucacuuguagaccagccuggccuugaacucacagagcuccuccugccuccaucucccagugcugggagcaauaauuucuuuugcuaacugguuugaaaguaaaaaguaaaugcaagcccagaacagaacugguuuccuccucaagcagcaagcaguaggccuuggucauuacugugugccgcccauugcuuccugccuggcccggccugcuugcauccuggcuccauccgccucuuugcuuacccuggccuggcuuggggacucagaguugauucucccuuggcccucucucuguuugccacugucagucaacuccagagcuuuguacguggucaaaaggcacucuuucaugucacacccccaacucuacauucaugcuuucuuguuuuuaaaauacagggucuugcuguguagcuuaaacuggccuugaauccugggugcaagugacccuccugucucagccuuccaaguaguugggacuguggacaaagggugggacagggcgacagucacaucuucauagcacucaggauucgcucucuggcuccuacugcugcugacaagagagucaggcccaguuacgagggugcagcagcgccagcaggacccucccucccuucccucuccauccacuagucgcauuccccaagauuuugugggcgaauccagaauuggugucccagaucuggaggcccagcuccauccccaccucccacucugacugaguggucuaucccugugacuucaggcagacugaagucagugaaggagauucugugcuacuccggaccagacuugcagcggcucaccggccugcccagccacgaugugcagugccugcugagagcugccucucuacaccuucggggaagccgcguccucucaggugagcaccugggcuggggugcuuggagcgcaggccuggguagacuuguggggaacaauuucacagcacacuaggaaccuaggauagguagcccaagugacuuguccaaagcccacaaagaagggcccacauagcagaacaguagggucucauggcuucagcuucucuacagaguccuccugaaguaccugcccucggaggagacccucacaguaaaggauaaaguuaggucccuguggcgugguaugguggcagcagcugugagagguccugacacucagaacauggcuuccacacgauggcuuuaccucacuggccucuaagcugaggcuccagcugcucagaacugucaccaucacugucacaggcugaugcucaugcugaggaaagccugcucgcuacauugcuccauucaggagcgucaguuuccuucuuccucccccacagccucccucucccugauggagucucucuaugcaguucuguguagcucaggcuggccucaaacucucggagcugcuucugccucccaagagcugggauuaaauguguagaccacuacaccugaacugcguucggguuucuucagcagcuuuguccaccagggaagggugugggcccaccugggaaaugugacagggacagacucuuacauaugcauuguacucagcugcacaaccaggcugccuaccuuagcauucugccugugugugugugugugugugugugugguggcuuugccaguccuucacccauguugcaugugccagcacuuccuugaaggccucaggaucacaggcccuagcaggcugugggcggagugcgggcugugggcggggcugugggcggggcgcgggcuagaccgcugacacagccuggcaugcucccugcagcacugcaucuguuccagcagaaggagagcuucccugagcagcaucaacgccugagccuaggcugcccuguccuggaucaguuccuggguggaggccugccccuggagggcaucacuggccuggcuggcugcagcucagcaggaaagacccagcuggcgcuacagcucugccuggcugugcaguucccaagacaauauggaggccuagaggccgguaaguggcuccccuuccugaagggaggggaggcaggaucugaggcagguagagcugaucccuggccugcucugagagcugcuuuccucucugggagccaguggcuaucucuugagugguuuccccuauaugucuuucuucuuccagaagagugagugggagguggagcugugcuaggcuggcagggggaagcagggggugcuagcugggccuacaguuacuacacaccccugcacccagacucacagaaccagacagguagggcagagcacgaggccuuucccuucuggucuggccaguaguugagcagcguguggaugguuuugguacugggagacucugccugggcccucuaagggcugauggucauagcugcaaaacaagccauggcugagccaggcgugguggcccaagccuuuaaucgcagugcucagggggcagaggcaagcagacucugaguuugaggucagccugaucuacaaagcaaguccaggacagccagggcucuauuacacagagaaacccugucucagaacacaaaacaaaauaagcuauggucuccaccauuuaagccuuggguccugugcccaagacaggaaggaagcaggucugaggagcccuaagcuucgcccagcucuucagcagcugggguuucaccacaccaccacuucagguuaauacugucacaaaagcaauguccgaaggcucuaguuucccuuguucucauugacacugccugguacaacagcugcuccugguagggaaggcagugccaguguucccagcauuccagaggucuguagugaugugcuguuagccgcugacgugccuucugucaggucaucccccggaagacccggccuuugccuagagucuuccaugccagucauaggcacacaccuguaaccccagcccucaggaugcaggugcaggaagaucaaugcaggcuggaggccaggcuggcuccacaugugucuggccugggaugugagacccuauuugagcagaaaguuuuaaauccuuauauuaagugcagaguauugucggcucuguucccccuuugugggagaucugcuuuaaccgagaccuuugagacacagacagugcuugucuuaugaagcacgcacgucuccuuacucugugguuugacgucuuuggcaaggucuuuucuccucggaggucuaggacuaaugguguagguuccagcagucgcaggcgaggcaccugccacccacacacggcuccccgauugcuguccagcucauuuggcggcaggaucaggguggccuuuggccccaaagcauaugacacaaggacuguuuauguccccggugucucaggugccuguucacccgcucuugcacuuaccacaauggcaccagcaucaucaaguagacgcacagagagaggugggagccugugaguuguccugaaucugaggaacgugucucaaagucccuuaacccuggugauccacccacccucugcccugcccaccccagugaggaacuggagagccggcaugagauagcaggguauucaggagcauagauguguguacucaguguguacucagggcuagccuguguuccuaaggagccagcacggcagccacagguaggauacccaggucuaaccugcugcccuucuggggaaaaacuuauuaagggacagaagcagacaggcaggcaugagacuccauuuggugugugcagccacggguccguuuccguuuccucacacacugggcacucuggcuuccaggggcugucuacaucugcacagaagaugccuuccccagcaagcggcuguggcagcucaucgcgcagcagcggaggcugcggacagacgcgccugaggagcugaucgagaagaucagguucagcaaccacaucuucauugaacacgcggccgacguggugagugcugcuugugcucacagauggcccagcgacucagccagggucaccugugcagagacgggugacagacucagcucaggguaaaggcaagaagaggaagugucagacucccauugggugaaggucauggaaguguucuuucuaaacacacagcaggaagccugccugcugucccugagguaccugugggccaggcauuuggggauucuggggugacgaauacacucuccagcauggggauuuaaugcaaaaacuggucaaacugggucuaauagcguacaccucugaucucagcccuugggagggaaggacaggagaaaucuuagucugaggccagccgggucuacauaaauaguuccagaccagccagggcuacacagugagacccuaugucaacaaaaaccucacuagucaggcucuugguuuuuuguuuguuuggguuuuuuguuuuuguuuuuucaagacaggguuucucuguauagcccuggcuguccuggaacucacuuuguagaccaggcuggccucaaacucagaaaucugccugccucugccucccaagugcugggauuaaaggcaugcgccaccaccgcccagauagucagcuucuuguauaaucugccuguucguccuaucuuugaaccaacauuauucuuuaccugaaacacagaccuaaucaaucaacccaggaaaaagguagggaagggaggccauagaccucaggccccucuccuggcugcuguucucuguugacgcugccagggccuggggcuuaccuguugcaggaagcagggccaagcccaggacagcuggucagugcagagaggcucucugcugcagggaugggugaaaauggaggucauuccaagcuuggagaaggggauaacccaguuccccgaauauaaauggcaggagcacccucagugugcccaucugggccgucacauggcuaggccgagaguuaagagccuagccaugagaggaccacaggcuggcucagcugacuccaguguccucugaccuccacacacucaccauggcacgcacucacucacuugcaugauaauaaaaaaauuuaauuuuuaaaaaauaguuaugaacaggcuuucauucugguagaugguauggcauauaaacuuuuaauuuuuuuuuaaaaaauguacaauaaaaauacauuaucacacacgacacagaacuaaacacaugagaagugccacaaagaggccaggcagaagcagcaagagccagacguguccugcucguaggccucccaggaaggggacaggaccaggucaccacccuugcugacugagaguggcucuccaagacccuacuagagguguaguuguuaguauacgcuccacagcacaugggcaagggaacuaaguuagcacugcgggcucccagccgagggcccucccagccccacccuggccuucacagggccagcuccggagccgugcucagcagcagcagcagcagcagcagcauggugucuaaaggaccaggcccaggucacugcaagagaaagcugcaggucaggucaccacugggagcagcuccaucuccugcccuggggucugucugcccagcaaugggagaagucagugccagccucaaggccacaggauguggacacagagccucccucccucccagcuuugugcaugagaagcaauauggaccacaccuggcccccucccucuuccugucauccccaaggugcccaagcccuggcuugugggugcagacacucacguuagugcuagcgucuucuaggcugcugcugucguuuuccacacaaagaggcucugcgggggaugcccuagaaagagguacagacugaauuucacuccuggcuggaugcgggaacugacagcuccucacagcugccagugagcugguauagggcuaccugccuggccagccaaaagugccugaagaccccaaacucaggaacaauaugaaggcccuggcugaaacuucaagccuuagcaccacccaguuguagccacgugacccucugacagcagccauccacccuccccguauaauccuacccugucaccugggccacucaaacacaucuuaagucacccaacuucagugccaaacaguacacaguggccccaagaaagccuagggcuccuggaguggguggcaggggagaugauccuggugccaucccuucucuguccccacuagcaucuucuccagggcgcagcugauguggauggggcagggucccagcuccuuuaggagugggugguaccugaugugugcagagcagacucccagaccacuacuccauccuaccacagcaggucuggccugccccaucagcacaaagaccuggaaggcaccuaccuccccauacauacacauacacacacacacacacacacacacacacacacacacacacacacacacacacccuacacacaccccacucaagugagaccaagcagagcugcucucuagacugcaguguagugaggugaucaugucagccguggagcuguagcuggguugggugaccucaguaucugcaugggacaaccuccacgggacucagggugcagguccagguaugagccuccaccccaggaggccaggaggcagccaauaagugucaaaaagcuacagucggggaguucugaccaugcagaggccaccagcaggcgugauguguguccccacaggacaccuuguuggagugugugaguaagaaaguccccauccugcugucgaggggcauggcccgccugguggugguugacuccauugcagccccauuucguugugaguuccaccuucaggccucagccaucagggcgaagcuccugcucucgcugggggccacacugcgaagacugagcagcaccuucaggagcccagugcugugcaucaaccagguaggugcagcuggcgcuggcugggaaggagggggcugcccuugaccauggggaaagcaaguggcuggguagaaggggggcagcugagguggcugugucacuaacccucacuugcuuuuuccaggugacagacaugguggaggaccagcagucuguguccaggucacuagggugagugugggcaccucagcauggcggacauggugggcuguacaagcaccaacacucauuuugugucucagggcuucagaagagcgccucucuccagcccuuggcaucaccugggcuaaccagcuccugaugcgacugaugguugaccgcacccaugaggacgauguuaccacaggcuugcccagaagcccaguucggacucuccgagugcucuucgccccccaccuaccccucuccuccugcugcuacacagucaguggggaaggcauuagggggaugccaggaacacaguccuacuaacagugagaccagugggucagccugagcaggucccaaggaacccugauucugaugacucuuuccaacaaccugucagucaguggcaccuggugaacaggcacccagugacgguuagucugucaguaucugcucucuccucccugggguucaccuacccauuagaggaugacugagcagcaggagcucuggcagcccagagggcgucuccguaggaccccaaaaugacaagacucagcucuucucucuucugcuuucugccugggacucagcagcuugguggggccuacccuccugcaggauggucuuaacuccccccaacccacuauacacacacacacacauacacacauacacacauacacacacacacacacacacacacacacacacacacacacacacacacauacacaguaacaccuaccacucaggccaagcauggcuugcagugagacacuccccgacugggcuccuccccacacauauacaccauuuuagggcagaguggagaaaacuguccgaggaagagagaugggccaggcccaacccagcugucuaggcuaaguggcuuugggcaacuuaugaaagggacacccggaaacaggugugugugcucacuaaggccuggcagguguuccuggcaacucggcugggcggugcauccaggcuggaaggcaccacaaagcacccaacaggacuguguacacacucagccagcagguaggccuccugguaacaugugcucuggacucagaaucaacaccuuguggacuugaggcucagcaguaagcaauggguguggccucuguagacagggcuguguguugacgcacagguagcacaggcucccaccagcaagugugccaaguggaccuucaccaaggaguccuguugcuccaguagugucugacuccuuaaaccaggacauacacugucacuguccccacuccaguagggaaaacaguccacuuaugguauauaccaugacaucuucagggcggcccuauccucuuaugagcucaucguuucaaaggccccuggggcuccuacccgcuguggcaauccugcagacuaaaccuagggccuccugcaugcaaguguucuacacugagcuaugacccacugacccgugccugagagcugaggaugaggggacacacagcugcuuggguggggugguucacauaaaacagcucugcagaacuggagggcuuuagacccggaaauaaaacuuuauuuuuguaacaaaguau

SEQ ID NO: 6855 - RNA, 4475 nt, Mus musculus
ucaccucgccgcgccagcgcccuuggccuuuucccgcgcccugcauuccagccacugccucccucagccuaucccucgccguuaacugcguaagucccgcccccgacgucacuccggccuaucccgcgcagcggggcccguuugaggcgagcccccagccuuucuccggccuauugggcgccgcgcccucgucggcucgggccuccgccgcgguccgagggcgccgugacgugugcucggcgcgcggcgcgcugcgcgcugcugaaggcugugucugguacccgcuaccaugcccaagcggagcugcccguucgcagacgcagccccgcuccaacucaaaguccacgugggccugaaagagcugagccacgguguguucgccgagcgcuacucacgcgaggucuucggugaguguggacuuccguggguagagcgcgcuacgccgcgcagggcagcgggagaccgcgggagcgucccgagcgcucacgguggaugcugcuucaggcggcucccggagaaauccgagucggacccgagugcugccgagcggacuagccuagcgcgggaccgacgcggggacuggguucgagugggcgugauggcguagacugcccugagcccucgcaaguggccuuuguagcggauggauguugcugagcauugccuugcagugauggcuuucuggggcagguguaacgcaguguaccguagcuuggcgcaguuugcggccguauaacuuugagcggugccgcugcgccuuuggaaugugcgggaaaacaaacucccuacgcagccccaguauuuguccuuucccucucuguacucugggaaugcaaacucaagugcugagacgcaggggcgaugcgugaagggacaggacugagcugcaaagagugugccuccccccacgccccccagucuagacauggccuggcgucguggcuuguuuuuugacgccagcacucagaagggaaaggcaugggcuuuauggugagaugucuuaaaacagcaauaacaaugcaaacacggcccagaaaaugccucagcugguuaaagugcagucuaugcaagccuggacaugagucaggucccaagaacauacaguaggagagaauuccugaaaguugucuuccgaccacacucauaguaacuaaauagccaaguaaauuaauuuuuuuuaaauguaagcaugcaguugaaaagaaggccuaaguguuaauuggaaccuaacagccuggcucuacccuucugaggacuuguguguuggagcauuugccaggccacucagagccagccagucaggaaggggugcagggcucuagcgaguuuuauaguacacacaguuuaccaaaaccccagcccacacucuggacucugcuggaccaggaggccuuaaggagaaaauugcucucauaauggaauguggguuugagccccaccuguguuaagaguaccccuccaggaacucuucccauuucuuguuuuucagacaggcuuucaccguguaucuuagccuggccuugaacuuaaguaauucugucuuaaaguaggaggcaacugagcugggaauagccacucucuuugaguuuuuguuugcuuccagugucacagagaggucccugggucgugggagugaguauuucuagaacucgcaacaguguuucccuuuagggcucccugggccugaagcccgaaaggaagcaauccacuguuauaggugugagcagccaguuacccgggguugguggguggcagggcuggaacaucugggaggucuuugucaggggguuguugucauugucccuuuaguaaaguuguucacuggccuggcaaugguuguaggugcuguucuaaacucgugucuguuuucugccuccuugggacacuugcuuuugggaaugaaugguucugagccagagcuuucucuggcacugagacaagcuuacaggaggaggacugggagugcaaagagggcaccaaccaggugaagugaauagcuguggcugcugacaauagaauaaugggaggagcaccggaguggagcacagccugguggcugggaacaggcaaagggggcuccgagccuugugggucauaggauaucugugcaaccgcuuugcgguuuggagaguuaucuuaaggaaggcucuuccuccccagaaagaaccaagcagcuccuuuuccaaggggcucgggccuauagagaucacauaucgagcgaagauuguuccgugaaccaccugcaggagucacugaagucuggugugguaggagccccucaaccugcgaggggacagauguugauuggaccugauggccgacugacacggugccaagcucaggccucagaagguggugaguggccgccaguggggcugaccugcuguuacaccuagggaagaugguggcaguguucuguucaagagccuugacuaccugggcaaacaggaucuacuuagagcagugguucucagccugugggucacaacucuucgacaaaucucugucuuuaaauauauuuauguugcgagacucaugacaguagcaaaauuaguuaugaaguagcaaugaaaaugcuuacaugguuuggggucaccacaacaugaggaacuguauauauuaaggggucacagccuuaggaagguggagaaccacugccuuagagccugguaaguggagcaaauguugcugggcagucugacccucacaggcauccagaguggacgucaacagguuccaacuggcaucucaagcucuccuggugccccaccugcaguaagaagaugccaguccguucccuguugaggggugguucucgugugacucgugaaaaacaggacucugcuucagcccagaagccucugggcugaccagugaaacaguaaaccccaucuugagacccagacagauagagaguucugauagaguacuccggccauccuagcaacaggcaggugaucuguccuggaguccugugaccaguccugggaaugaaugccucaucgugagccuuuagucuagugcuccagguggcugauagauagguugccaaaaggacucgguugcaggggaagaagggugccugucacccucguguucuuccaguguccuuccaaugcucacagccucgguguuuucuccucacaggccuucccaggacagcgcccaucgcuuguucaucgugcaugagaucuguggaugggaaggcggucugcagccagugcgagcgggcccugugugggcaguguguauacaccugcuggggcugcggugcuuuggccugugugcuguguggccuugcagagugagugcuuugaccugaucacggucccucuccgucagggcacaggugcugggugggugacucggauccuuuuggaagaaguccgugcuucccaguagucugcggccuacuuaaagcagcucccuggcuugcacagccuuguggucuggacuucugaguccuuauuagggcuccaacaguccacacuguugucuaguuucaguuucuguccagcgugcguaucauuugaggauugccucacacacgucacuggguguauguacauucaggucaugccuaccccuguguguuaacuguguauuagcagaauggaauggaugcugcuuacccauuggcugcagccagaugagucagcuccuuagaagugcucagugaguggguggacaguguagagcccugucccuuuguuccacacuguagggacuuguuccaccaaaugaguaugggaucaguacaguggauccggauaagcucagccccaacauucucuaaagcuaaugcgucagauggaaaaccacacuucauauggcaaauccucgccaacagaguacucuucagugguuuggagagaucaggagugcuugcagggguacucuggggagaagucucaggaaccuuagggcugauucaugcuaaggugggagggagaguuucccaggcugccuccaggcuuguggugacugcuauagguccucagguuugugucaguggcccucuuguugcuaugucuucaugucacuccugugugucucuuaugacaucucacccgucugguaaaccacaaaggccuggaaccaagaugcaagacccacaggauguuugcaugcuaggccuccuuccagagacagugguguccccaaacugucccugaaaugccuaucaccugagucugucuucagacaaguucccauucugaugugugaugcgauuagggccucagugagaggggaugcauucagcuacuuagguaucuucucucucucccaccaacugugcagcuaugccgacgauggugagaagacacugugcaccagcugugcuauguuugaagccugagguggccacagacagcacaagauguucacacuaaagagagagaagguggcuuuuuauauguuauguuuuauacccaguaacaagugaauaaaccucuuuauauuugcacaaggac

SEQ ID NO: 6856 - RNA, 4475 nt, Mus musculus
guccuugugcaaauauaaagagguuuauucacuuguuacuggguauaaaacauaacauauaaaaagccaccuucucucucuuuagugugaacaucuugugcugucuguggccaccucaggcuucaaacauagcacagcuggugcacagugucuucucaccaucgucggcauagcugcacaguuggugggagagagagaagauaccuaaguagcugaaugcauccccucucacugaggcccuaaucgcaucacacaucagaaugggaacuugucugaagacagacucaggugauaggcauuucagggacaguuuggggacaccacugucucuggaaggaggccuagcaugcaaacauccugugggucuugcaucuugguuccaggccuuugugguuuaccagacgggugagaugucauaagagacacacaggagugacaugaagacauagcaacaagagggccacugacacaaaccugaggaccuauagcagucaccacaagccuggaggcagccugggaaacucucccucccaccuuagcaugaaucagcccuaagguuccugagacuucuccccagaguaccccugcaagcacuccugaucucuccaaaccacugaagaguacucuguuggcgaggauuugccauaugaagugugguuuuccaucugacgcauuagcuuuagagaauguuggggcugagcuuauccggauccacuguacugaucccauacucauuugguggaacaagucccuacaguguggaacaaagggacagggcucuacacuguccacccacucacugagcacuucuaaggagcugacucaucuggcugcagccaauggguaagcagcauccauuccauucugcuaauacacaguuaacacacagggguaggcaugaccugaauguacauacacccagugacgugugugaggcaauccucaaaugauacgcacgcuggacagaaacugaaacuagacaacaguguggacuguuggagcccuaauaaggacucagaaguccagaccacaaggcugugcaagccagggagcugcuuuaaguaggccgcagacuacugggaagcacggacuucuuccaaaaggauccgagucacccacccagcaccugugcccugacggagagggaccgugaucaggucaaagcacucacucugcaaggccacacagcacacaggccaaagcaccgcagccccagcagguguauacacacugcccacacagggcccgcucgcacuggcugcagaccgccuucccauccacagaucucaugcacgaugaacaagcgaugggcgcuguccugggaaggccugugaggagaaaacaccgaggcugugagcauuggaaggacacuggaagaacacgagggugacaggcacccuucuuccccugcaaccgaguccuuuuggcaaccuaucuaucagccaccuggagcacuagacuaaaggcucacgaugaggcauucauucccaggacuggucacaggacuccaggacagaucaccugccuguugcuaggauggccggaguacucuaucagaacucucuaucugucugggucucaagaugggguuuacuguuucacuggucagcccagaggcuucugggcugaagcagaguccuguuuuucacgagucacacgagaaccaccccucaacagggaacggacuggcaucuucuuacugcagguggggcaccaggagagcuugagaugccaguuggaaccuguugacguccacucuggaugccugugagggucagacugcccagcaacauuugcuccacuuaccaggcucuaaggcagugguucuccaccuuccuaaggcugugaccccuuaauauauacaguuccucauguuguggugaccccaaaccauguaagcauuuucauugcuacuucauaacuaauuuugcuacugucaugagucucgcaacauaaauauauuuaaagacagagauuugucgaagaguugugacccacaggcugagaaccacugcucuaaguagauccuguuugcccagguagucaaggcucuugaacagaacacugccaccaucuucccuagguguaacagcaggucagccccacuggcggccacucaccaccuucugaggccugagcuuggcaccgugucagucggccaucagguccaaucaacaucuguccccucgcagguugaggggcuccuaccacaccagacuucagugacuccugcaggugguucacggaacaaucuucgcucgauaugugaucucuauaggcccgagccccuuggaaaaggagcugcuugguucuuucuggggaggaagagccuuccuuaagauaacucuccaaaccgcaaagcgguugcacagauauccuaugacccacaaggcucggagcccccuuugccuguucccagccaccaggcugugcuccacuccggugcuccucccauuauucuauugucagcagccacagcuauucacuucaccugguuggugcccucuuugcacucccaguccuccuccuguaagcuugucucagugccagagaaagcucuggcucagaaccauucauucccaaaagcaagugucccaaggaggcagaaaacagacacgaguuuagaacagcaccuacaaccauugccaggccagugaacaacuuuacuaaagggacaaugacaacaacccccugacaaagaccucccagauguuccagcccugccacccaccaaccccggguaacuggcugcucacaccuauaacaguggauugcuuccuuucgggcuucaggcccagggagcccuaaagggaaacacuguugcgaguucuagaaauacucacucccacgacccagggaccucucugugacacuggaagcaaacaaaaacucaaagagaguggcuauucccagcucaguugccuccuacuuuaagacagaauuacuuaaguucaaggccaggcuaagauacacggugaaagccugucugaaaaacaagaaaugggaagaguuccuggagggguacucuuaacacagguggggcucaaacccacauuccauuaugagagcaauuuucuccuuaaggccuccugguccagcagaguccagagugugggcugggguuuugguaaacuguguguacuauaaaacucgcuagagcccugcaccccuuccugacuggcuggcucugaguggccuggcaaaugcuccaacacacaaguccucagaaggguagagccaggcuguuagguuccaauuaacacuuaggccuucuuuucaacugcaugcuuacauuuaaaaaaaauuaauuuacuuggcuauuuaguuacuaugaguguggucggaagacaacuuucaggaauucucuccuacuguauguucuugggaccugacucauguccaggcuugcauagacugcacuuuaaccagcugaggcauuuucugggccguguuugcauuguuauugcuguuuuaagacaucucaccauaaagcccaugccuuucccuucugagugcuggcgucaaaaaacaagccacgacgccaggccaugucuagacuggggggcguggggggaggcacacucuuugcagcucaguccugucccuucacgcaucgccccugcgucucagcacuugaguuugcauucccagaguacagagagggaaaggacaaauacuggggcugcguagggaguuuguuuucccgcacauuccaaaggcgcagcggcaccgcucaaaguuauacggccgcaaacugcgccaagcuacgguacacugcguuacaccugccccagaaagccaucacugcaaggcaaugcucagcaacauccauccgcuacaaaggccacuugcgagggcucagggcagucuacgccaucacgcccacucgaacccaguccccgcgucggucccgcgcuaggcuaguccgcucggcagcacucggguccgacucggauuucuccgggagccgccugaagcagcauccaccgugagcgcucgggacgcucccgcggucucccgcugcccugcgcggcguagcgcgcucuacccacggaaguccacacucaccgaagaccucgcgugaguagcgcucggcgaacacaccguggcucagcucuuucaggcccacguggacuuugaguuggagcggggcugcgucugcgaacgggcagcuccgcuugggcaugguagcggguaccagacacagccuucagcagcgcgcagcgcgccgcgcgccgagcacacgucacggcgcccucggaccgcggcggaggcccgagccgacgagggcgcggcgcccaauaggccggagaaaggcugggggcucgccucaaacgggccccgcugcgcgggauaggccggagugacgucgggggcgggacuuacgcaguuaacggcgagggauaggcugagggaggcaguggcuggaaugcagggcgcgggaaaaggccaagggcgcuggcgcggcgagguga

SEQ ID NO: 6857 - RNA, 21066 nt, Mus musculus
acaagcuugaaaagcaauuuuuauugaauuuggagggacaguuucuuauuauaauaguaaaaaugcugaagcugaauguuguaaaaaacgacauggugcagcaauggccagcgucuggccgggaggggacaggccagggugacggacagcgggagagggaaagcaucuaaaaggacaagugcuaggagaagggcucacgugaggcaggcgcucccaggguacccgcuaagagccaccacgcgggagcgggugcgggagggcaggggcucuccugucaccaagauuaaaauccccuaaaugucucugaacagcaugggacacagcaacaaacuggauucuuguuccucugucaaccucacuugagcccuggccaucccauccagcccuagggcugaagcagcugugaccucuccccgcccagagggagagggccaguuagcauaccacaggggggugcuucuggugccuucuugcuggacuuuggcccuggacccuagagacagguggcggccaggguggacaggccaaugggggcagugacgggacccacccagacccaugagcccacauugcacauggucgcgucaguccuuaauaguuuucuacaugaaucuaauuguucugggcacugaggccacauguguggucucaaacuggaugaaauaaauuaagaaaaaccccaggauaguuuuccuccugaccuggcugggagguaggcugcugcccacaguagaaacauccuccccugguccuggaggcuggcaagguuccuccccagcgcauccgagaaacaaaacaucagguucagaugauccaugcggggcuucuggacucggcaaugcagaggagcguggagcugccagccgcugccccaggccucaggcugugccacuggcugaguaggagaacugggggaagugcggccuccgcucacuguccacacacuccaugcugucaucugugggccacaggagggcucagaccaucucuagaaacagcccgcccaccugacacaugccagaggauacaagggggcccugugagggggcagugacucuggcccucagaacacucccucccuccccgccaagcugcuaccacccuccaaaggguuuguuugauucuuuuaguuuuggggcugagagagagcuuagugguuaagagcacuggcugcucugguagaggacccggguucaguuccagugcccacguggcuacucacaaccaccuguuaacuccaguucccccccaaaaaaagcaggagugcaagccagacacugaggggccauggagugggguggccucaccuugaucaggcggcgugauggugaucaucugagcugugaacuccucaucgaaauaccuggugucagucucagaggugaccuggggcuugaaaggugggcucagcugaggagcaacagaaggccugguuacuacuggguuccaaucccuccauccucucugggcaauacugaccuuaucgggugggcacuagcacuagggaacagcucuaggagauggaacuggguagggcaguguaggcaggggagagcaagcccagagaugcccaaagugacgagaggguagugacugcccaccuccaggcagugggaacuccguucucugguugucauuucccuucugaguuuuuuuuuuuuucuucccuuuccauuuuuugaaacugggguucuguguagcccuaggaacuaccucuguaaaccaggcuggccucaaacucagagauccaccugcuccugccucccaggugcugggacuaaaggcacacaguggcaccaccacagcuguggcaggacucaaagcagucuucaggugagcucgccugccucacugacagcccaugaagaagauaagcugcagagugguguaugcacuggaggcugcuaacauccuuuugggucucacaggcaaggacccucaauugccaucccucccaaaucuggugugagggcaaugcggacuucaugggaucucuaguugagugugggcaggaaaggcaugccauccacacccccacaugcugcuggccccguguuaucuagaagguacacucaaggcaggggguaacagggcacccaacacaucaagguagaguguugagaccaccugcugugucccucaucagccugggccagggguacuuaggagcugaagagaaucacacuuaggggugaguacaaggggcucugcucucugcaguggccuacacugugccagacgggcaggggccgucccagaaugggauuaggcucgcccuagaguuggagacaccuagacauuaccccccacccucggcuagcuuucaucauagggcacaugaggcgaucuccaggcaaaggacaggagcaagcaacagguguaggcaacaggggcacaauugagggccuggagaggccaggugacugugcgagguaugcagggcagcauacuacccucuucugugcgagcgagaaggcugugcacaacccuguggcucugugggggcaugugacuacacaaggcugugggcccagcaugcgugucugagccagcaaaaacaggaguguuugcaugugugcacacaugugauccagagaugggcacaguggccagagugagaguguuuauauguaugcacacacguaugugauccagagaugggcacaguggccagaugcacaccuucuucucauacacauccugccacacgauguuggcaaagaaccggugcugcaugaucuccuuggcauccucggagcccccaccgagccuguggguaggagacagguccagggcucagacacugcgugcaaggugacaggucacggggauacucgcaggguagggauaccccuagcugccugaccaccccacccgacaugugacugagacuguggcggguacagugggcagcagcacugucuagaggcugagccugaagccccggcagcccuuaccucuguguaggguccuucuugagcagcccggagagcagggacuuggccucagggccgagugugcgcgggaagcggaucuccuccaugaggaucagcucgaacagcuucucgugguccugguuguagaagggcaggcggccacacaucaucucguacaugaccacgcccagcccccaccaguccacugcacggccguagucguuguccuccagcaccuagaugggggacucugucagcguugugucggggcgugggaggauguaagggaacacacaggaaguggcagagcaccucaggggccagguacuccggcguuccgcagaaugucuucauaguggcaccguccuugauccccuccuugcacagcccgaaguccguuaucuugaugugcccguccuuguccagcaugagguucuccagcugugugggaaggcgcucagucagugaggccagaccccccagcccccacccgcccugcuccauaagcacaccuucaggucccgguacaccacguucuucucggagugcaaguaguccagggcagacacaaucuccgcaccauagaagcgggcccgguccucggagaacacacgcucucgagacagguggaagaagagcugugggguggagcgcgcugaggaaggccugugugagggcccgccaacccuuacccacaggcagagggaagguuaggaacuagcccccaaagagaacuggagacugcgagacuccaacucagcagaaauaagacauccccaaacgagcagcuacaggcucacauggccagggcuggcagcaccagugaucuguacuacagagaggguucaaagcucucagagggacaaguucacccaucaagugcccaggucugaagcugccuguggcccuaccucgcccccguuggcauacuccaugacaaagcagaggcggucgugggucuggaaugaguacuugagggccuggaauggaagcagggcaagccuaagcacagugacacugccaccccaagauggaucagggcacaucuuggguaucaccguagcccaggcuggccuagaacucagcaggggcuacagaugcaggccacaugccaacugguagauuuuaagaugagagacacgaggucuagguucaacugcagggcaagauggcuuagaaguuaacuauaccaaguucugggguucccaagagccuccagauggggagguugacacaacagcuuaugaacuggugcacugagccaccccggcaccuuuccaucauggaccacggguggaauaagcccaagaugcugacucuggaacucaaucaagcuacuguaacugagcuucacuaacaaucaacccugagggaccagccuagaagacgggucugagaggacugcagggauggagagcuggggcaacucaaggucucagcagagugagaagacgagucucacuccugccuccugcacacuacagcuggggcaugacugcagccccgcccuccaucagccuaccugaugcccaugaagcccuugcccguccguguaugggugcaaaggcaacagugugggagugacccacucuggcccacucuucccuaucccacaggggccagacugauggccacugcuuaccguaaggaagggaugccuagaguucugcaggacacgguucucaguaagcgugugggcaaccucauccuggaaugcagaaccaagugagcaccuaucuccccugcaucccacuccucucagccucccuccaagccugcccucccugcaccuuggcgacgaugaccuccuucuugaggaucuucauggcauaguagcggccuguggccuucucuuucaccagaaucaccuucccaaaggugcccuugcccaguagcuucagguacucaaacucguucauggucugugggcaguagacagagcccgguuagagagagccuuugcucaccacaacuagccuaugguaauaaaccauaugccaccgccuucggcuugacaguguccagagugagcaagcuuccuccaaguuagccaacagcaagagagcuggccacaagccaggcccauucucacaugugcuggccugugcagucagugaagggcucugcacagucuagucagagcgcugggccuugggagucagcgggcaucuucauauuacuuacuuuuaaguacuggggucucaugucucaugcacgcuggacaagcacucugccaacugagguguccucagcccauguccagaggagccagggguacccagacccauacaggaagccaggcaggaauaccaggaccuaccaggucccuccacaaccccuggcagccccagcagaagcagagcccagacucaccacacggugcuugggcuuggccagggacaccuccaucucuucagccccugaguugucacugggugagccugaucggaaguccaucgucucuucuuccugccucuugaguccaucugccacagucugaauggcgguggcccauucuucccugcagcgggucaagugaggccucaggcaccugggggcgcuguugcauggcuuccaccaaccagcugccuggcucccugguccugaagcugcaggccaccacucagauccugggccuccauacacucaagaguaucaggagcaucaagguaccugggaugcugauauuucucccauuaugccccacucaucccacaagugcuccagucuaguucuccagaauggacucagcagaggccucaggcucucgagcaaccauacccugcccacucaccgcuccucaggcguuuccacauggaaggugcgcucaaugacugugguccacugcaggcagcggaugauaaagguguugggccuuggccgcucugucuucaucagcuggcauucuaaagaagucggggaagcaucuaucuguuucuccgugaaacucccccucguaguccucaccagacagaccucaacccugucccaggaaggugaaucucauccucacuuuaaaaguguauuugccaggugugguggugaacaccuuuaauccuagcacagguggaucucugugacuuugaggccagccuggucuacagagugaguuccaggacagccagggcuacacagagaaacccugucucgaaaagcaagcaaacacacacauugauuucaggggcuggagcgauggauggcucauugauuagaaguacaacugcucuuccagaagacuagagguucaauuccuagcacccauauggcaacucacaaccaucuguaacuccagagaucugaugcccucuuccugucucuaagagcaccagauccacacauaaaauaaacaaacacccuucuuuacacacaaaacaauaaaauguaaaaaguuuuaaaguuuuaaagcuuuuuguuuguuugauauagggucuuuugcugugcagcucuggaaaacuccacguagacuggaagucucaaacuauggcgauccuccugccucugccucucaagugcugauuuuacagguucuagccaccaccgcuagcauuucuguuuucuuccuauguaauucagacugaccuagaacucacuauguagucuacacuggucuugaacuugagguaaucaugccucagccuccugagugccaggaauacagcaugagccaccacacccugcuccauccccucuccuugcccuaguuccucucaaagaacugagacccaagaccugccacagcugagaugcucugcucugaaggugaaggaaccagucaggcuagaucaguuagcccuacaccauaacuauccugaaguuccucuguccuucaacugcugaucccuaccucaugugggggccucagggauccagcccacacccccuuccgguacagaaguaucuugcuguuuucccaacaacauacagagucucuggaaaagucacacauguacucagcacccaagccucacacugggagcacacacagaacaaggaugcccagagcaugaacaccugguggccacaccuagaauaugcacaccuuuaaggguggaucaugggagcagcccaggcccugaggauauguaugcagcaagagggcuucacggcaaagcaggcaggagggacugaggggccucccacauuccaucgucuggguccuggcaaugugaggggccuccaggcuccaaugaaugagcaaggggcagccugccaagcaaggggccaagaggggcuugaggcccagccuugggaaaggccuaugucaacauggggugggggagggguggaaaaucacccugagccuugucuccagcacaucugagacagccugucaggcaagcagaugaaaacuagcaccaaaugggggucuuaaccccucccuccagaacccaccucagauaaaaagccugaacacagccccacccugcuuuguccccagcuaggcguaaacugucuaccuccugaggcccaagaccugcuugaaggccaagcccugcccacugcccagcggcccuuggccagugcauauaccuaugugucugcucuagagaggccccuuuccuuccuccugcauaaguaagcugggaguccuuuccuauccaucuguagaggcagcaaccuguguuaagcccuaagaccuggggacuggccaagugcccagagauggaaggcccuaggaucugaggcaggucagacagagcuaccugcagggcaggagcaucucaagaaggcugugaggauaaauggagacccagcuaugcuaggcacauacucuacacuccagacugcagcccaaggaggaccccagaguccacaguuaguaaccgcccgggcuuacugcugucgcuuaacacugucaaaccuauucuuguccagcuccaaauaaaacugggcugugacaauguggcacagagaucaaagauacugcaucucagccccaagcucucagucugucacccucaccaguccuggacagggcugacucccacugacccuccggcaacaggaaccacaagacccauagggcaaagggcuuccgauggccaccuucccagggagaaucacagagacgguccuugggaugucauucacuccuagagccgggagccucuccucccgcugucuacccuagaguucccaaggaaugcccuugaguggcuguuuaauccacagggacccuggucaacccacccccuagaccagguucagucacuacaugcuggacccguccgccaucuagcaaggacucccugacccugccagagcuggccacucaccaguccuagaggaggugacucagggccaguacugcccaguacccuaggacuaacaggaggcucuccucggguuucucagugggcaguuucagccucccugcuggccugccuagccaccccauccaacccgcauggcuaagacacuuacgugccacugagaaguuguugaguggggacucucgcugauccacauccugaggccguuccuuguagccaauaaaggugccaucguucuugaggaggaaguagcguggccgccagguuuuaauauauuccccugcaggggauaggagacauaaggagcugcaugggaacuccacugugaggacccaggcacauaagauccagggagaguacagugugagguggggaagaagggaccugggacacuuccgccuucccagcaagcacuagcgccagggcacaacuggcagugccugcagcugggagcaucaucuagggcucugccugcacagcagacccaggaggugccaccgcuggaacaggggcgcuacgcccagcugagucccaccccggucacccagguacacaggaacacuguucccuccaguuuugcaacaucagccauacgcaggcaccacacucaggaaucggagcagauguccucugugaucucccagcgacugucauuuuucauacugacacccggaaaaaauguuuaauuuacauuuugccgaacaaggagucugaacaacagggaacuaacuaauuaggcaacuucuucaucugaggggacacuagguugagaauaggaggggcaaccuacagggcuggggucccuuagcucugucuaggauaaagccugccugcgccacugggcccuaaacaaggucaccugagggaugugugaugagugacugcuugucuagacccccuaccacugggugcuccugggcacagacccagucacuaggucaagcaccgugaucuugggcauaaggcggugccccagucucaguccauagccccaggggggcuggccagcuuuccuucuuuaaccucuaacggugguguguaccaaauccagguauucccagagaacacuuucgcaggugagauacagucugcucaggauaguguauccgcuuggaccuguccaugcucucaggaccugcaggggcucugggcagcaagcugcagggcucuacccacaaucuaccucccaccaucuagccccuuccaaugccugggaguccuuuccaaacagcagccuugcucugcaugacccuacacccugcacaaagugggaugagagggaacugaagugauggagggaggcuguuggcgaggccgggggaagacgugaauagaaccacuaccaggccaagacucccaccccaggggcgagcagcuccaagagcgagggaucccgucuucuugucaucgcugcagaccaccuaggucugacaaaccgaugcagacccuggccccacaauggaaagcaaagcaagaaagcccuccggauucuuggcaagugcccagauguggccggggcuccuccagggcauaggcaaguuaauucugauucucuucaagggccuacagcccgcaugcaaccucuagagcaccuguaaacccaacccaccucccaucuuuagcucccagaagcccagcucuccagcacagccaccccuuugggcaccagcccugcuucugaccagguggcacacaccugcagguauucacacacccagcagcccugugacagccccuccccuggcacagggccuagagggugccgugguaggcaggggcucugaguaauacagcagagcacugggggguacacagcccaccccccauccuguuccuucccgggccacccgccgugugugcccacccgccagcaccagucuggagcugucggccccugauggaguacccucccaucucaccagcugcugcuccccgggacacuaacugaauacggaggcugaugagcagcgcacccgcgccccagaaauccaucuugauuugccaacugcugcccaucccacugugcccagugcagaccccagcucuggccccgacacauaaaccaccagcaugacccugaaucuccuaugggcucuaagccuacaugaccagcccccaggccuggcagauuccagaauguagacccggaguuacagacagggggcacucaccaggcagaggacaagguaaggacccagccccacauacacacagagggccuaggugcccuuccccucccuggccacacaaagcacacaaaggccacauggccaaggagaacuguaaagugaaguggccucaugaggacuuucccuuucacaguaaagggggggccacagcucugacagacacacacagaucucuuucuuuaaauccugccucaaggucuagccaauuggucacuggggguaccggcugagccagcugcagccugggcuguggccugcauguuaauaaguucagaccagacagaccccaaaccucauucuacugcagaaacgggccaauaugauagacaaauacaagaggcggcuguccugguccucuggggcucuaugguaucuaggaguacuccugccuacccugcuggcgggggggggggggggggaggggcggggggcgggggggggucucuuuugggaauacaaacauuggcaggucucccucaaguccuucauaguccagcaaggagugacugagccugagccauucuggccucuguagaagugcuaggcucuggcccaucugggaucuucuuggcucccuugacccaucuggaugcuugauacccugaacucaggggaguccagcugggcagcauggcagcagccagggcccuccaccuggcuacacagcccuggggauucaggugcacacgguccacaagaugugcaggcuccuccaccugcaggugccuuaccaggcccguguuaacaaacacaugaacagaugacaaaugaccaggcgccaccuccacaaugcaguucccguggcucuugagggcagaagccugacaacagcuucucgacaagaaauaaaaaacagcagaacagaagacacccaggacuaagcccggccucacaccacaguaaacccagcucuccaccauccacaugugcaagcccauucaggaggcgucacagcugcuaugcagagaggacagccaggacccacuccacccaaggaccuguuccaccuucuagcaccaagaccagcaccuaggaagaggcaaggacuccccaacaacuucggggcucccucaggcccaccuccaccuccaggaccagauucuguccaauccuaggggaaagguacccagaggugcuacucacuggugccucaaggucuaggccuuccagcaucugugugggugagccuccgagucccuguaccaggacccccuguaccuaagucaccacacuaggaaagagggaggcaggacacaccuuuaauccuagcacucgagacucaggcucgaccgguguccucucacacuggccuggccuguguccugaucacugugaacauucucuccaaguccccgauucuuggggaaacugcuggauaaacacuuugccgcaguagcaguggcgguggcaggcggcagcuggcaaggcgccaggcggcaccgagcuguuucuccacagcaaagugagccccagcaggccuggggagcaggcgccagcugacagcagcgaccaaacguccccuaccaccaacacauccaucgcaccgacagcugccgggcggccauuuaccuucuccagcacauugagcaagcgguuugcugauggcagcccauuggggccauuagcccagcucuggcugccuucugggcaguggguggucagcagguggcaaggucaucucugaggccagccucccaggccccuuugcagauccuaggacccaugucacuugaccccaaaagacucaaugaccaagcgcugggcaaaggcagggaguggaggggugugcuguccauagcaggugaaaccccaggucugguguuccaggguacagcccaggugcagcccgucugagaggggugcucaugugggucucacagggugggguaccaauggccaguggcacuccacugggccuggguguguuuuuugccauaacccacaaauguaaaaaaucucaccuagcaagaaguaggacgcacuggagccaccagcuuccuggagaaaccgaggcuuagaaaaggggacccuagcggucacagagaggcaggaaauaaccagagcugagggacagccaggacacaaacugcacaggcaggccucagcugagaagagccaagauauagcaaccacgcgacugcaaugcgucccaaggucucucagguuccuggaacccacaguggguggcacaccucuccacugccaccuccaguccagcuuccugagccacagggaguacugguccagacuuuacccuacccacccacaucuuacacuugccuaccccuccacagcaguccccacccuccccguaccagaaaggaaggccggcccacagccccacucugccauacacaccacgcacccccaagucucccguaccauucagaucauccuguucaccuuagucccacaguuuuggggcaagccacagggccaccauccuaugcuggcuuuuagccucccuacaccagcccaaccccucucauccguccuacuuccccagacacacggcagcucacagaccccacaacauuccugugcugagucccaaaagcugugcccuccccuuacccauccucccucuccaccucacuguggcacagcccagggggcccagagagcguccugaaagauggcuuagaggguaaaggcacugcccucaggccugacgacccauguuugaucccugggauccacaugguaaaagaaaaccaacucacagguuguccaaggaacauaugcaugcuggcuacagcacaugagcguuucccccuccccugggugcgugcguacacacacacacauguacacauguacacacacacacacaccauacacacacgcacacacacgcgcacacauguguacacacacacacacacacacaccccauacacuacauuuucaaaggaggcccagacagagcagaaaggaugugccuucacccuacagauaccagagccuacaugggccagccagacccugggccaagggcagggaagccuucucuagaacaaugucuaccaccuccgaaguccuaugccaagagcccaaacaaaccaacaaagcaaaaucauaccaggaggccaggcauaguggcaccacguauauccccagcacugaaaaggccgaggaagggaacucgcuugaguucaggacaaucugggcuacaaaguaagacccuaucucaaaaaacaacuaaaugggggugaggggcgggggcugggggagggggaaccgacacaaaagccacucagaggcaaaagauagugaggcacgcagcuaccugcagacaggccaccgguacuacggggcuccuggcugcucugcccaccagcgugggcuagagucuaggucuuggcuaggcagacucuucuggggaagugcuggguguggguagaucaccagccauggugggauggcugggacagccacagcuacuguuacagggagggccuaaggguuggagcuggcucugggccuggcucgggugugacugggcagagaggauugccagaggacagaacaguucuccccacuaccccauggcacuucuaggaaucagccugaugcaagcccucaagcuacuccuagcagcgacaguaggcccugguucuggccauccacacagcaccccacccccuuccugguuucagugcacuuggcuacccugcagagcuggcaggaccaagaggcugccccagacccagcaguucaguggagucuuauguccccacacuuuuccucaccuccuggugaccuccaaguggcucagccccacugggcaacucugucuagaagauggucgucaggaagccgagaggacugcugcccacucuggggagucaccaggccgggccggacugacccccacaccccaguggaaggccgcccagcuuccucuuuuguuguuuguuuuuaagggagaacucaacacgcucacaaaacaggaaacucagucccagcaccagccaaggcucagcggcagccacacaccgcaguguacuguccccuccaugaaugggcccagagcauucagcugccaucucuguccaggucuccaggaaugccacaugcuuaccucucccucaggaucaguccccaagcauggcacuacuccggucccuagauguugacuugcccacuggguucgggacccuugacucugcccagagaccaugagcucagcacaaacagauccacacccaaagccagagagccccauacuacaugccaguuucccuccauccuuguccaaacugcguccaccugccaggcacuaacccagugagaauagcuugguuucuccuagccugcugggucucucaacuaagucugcugagugagcccaugacguggccccacacaagguggcccugcacgagguggcccugcacaaaguggcccugcacgagguggcccugcacgagguggcccuacaauugucaugugccaccuacucuuaaacacauagcccuucguucucagaccuuuccaugucucaggucuagccaccugcugggagcugggaagacacagacacagacaauggcuaaccuggccaagaaggugagaaggcucccuggcuccagucucuaccagggcagcucucacgcauacagcccggcaaacgucagagauuugagggaagaacccaaaagauuagcacagaugggccuguggccucaguacacagcucauuugcaaccugcaggcugaaaucagaggucacggacaaguucagccacaccugcaacuuaaccccaggcuggcuguuaagaagacaugguucaucgaccccaaaccucugcaucuggagaccagcacugagguucaucagaccagccaccucucaucucuaggagcucaagcccagucucccacgggucuauguuguuggaugcauagggaagcuaacgcccagccacagaucaaugcacaacuagaaugucugcuccuguacugggcacccucuggcccagagcacaaacagagcuccuaggaaguggcuuggggaacacuuccugagaaguaggcaccuaacucccagggaggaggagaaaccuggaccuggggucucuguagccauggagugaggaacauccucucuucuuugcccaaauagcccugaaggcacggucggcccacgggagcuuggggaggagccgagaaccaaugugcuccaagccccuggcuggacaugggagaccuagcaaagauggguucuguucccagucugcggggcuauaaccuacaaaagcaacagagggagggacauaagggauacccaggugucugaaggaucaugggucacuaagggucaacugcaauaaccuucccucccugccuaccccagccaagucauaauggccucagguuagaagucuaacauggcaauccaagacagggagagggcuggaaccccaaacuagugaugcacacagggcucguuguguucaagggagaaacgaggaccaccaagaccuaggcaagcagcagcaggccaagccugggucuuggcugggccagagcaaggcagaauaggaggacccaguccaggaauguggcauagaugccauugcgcgcagcagagccccuacuaccuaggcuggggcuggggcugggggaggaugaaggaccaugaggacagcacaucucucuggccugaggcugggaagaccccccaccccaaagagaggcaguccugucaguuccacggggcagacaggcaggcguugugcccccuugccaucccacagcuaacgcaugcucucacgucuuuaacccaccaccauuuccagggcaugcacggggaaaaucaaggccuaaagaacucaaugaccuucuucuccugaagagggacaaugacagcacugccaaaucagguucaagcacagccucagcguguccauaggaccuaauguccugugccaccuggccccuugagaaagcucagucauaaggagcaauaugacacucccuaggccucagaaggguuccuaccuggggagagaggcccagcaaucucgagguuggcccuaacucugacagccauacaauacacacgugcccaugaaauagacuguguagacuguguauggccuaggguuggggagaaggaggagccaaagaggcagacagcagggcaugacccaggaaugugagcuuaggaggcaggacuccuagugggccagggaaggaugcccuggagaacaaaugggaagucaggugggggcaggagccaaaggucacagccuccuggcaaagcccagcacagaaucugcccugcagccgccagauugggaccucucaacacaucugaccacaucuuccaccccugcgugagcccuccugggucccaaccauccuccccaacuucccguagcuccugugcaccacccucccaccccccaguucugccagagcuguagauacucuaauaaagccccauguccuaacaccaacuucgguccccaccucccaucuucucuaucugaguccuucuccugacacccaaaaguacaauccccucucuagagagccaggaaggagagugggaggagaggcugggacuggcaaggaucacccuagggcuuccggagggaacaggucuacaggaagaggaagucagaagggggugagaugccugcccuggggcaagagcaagugacuauccugggggaacuggcuuugaaacuuacuccuggcaggcuggaggaagaauggcggguuggcuggaggugaggggccccaggccugggaagaguccaucucagucagcuuuucaguucugagcccccugacuucaggaauccgggccugaggugggcaaagggcccagccgagcaacccugcccugcccugcccugccugcccucaggagcccuugggcagugcccaggcuacucgucugccagcccuggaacagcagccacguccuugcugccuuccaggaaagccaggcgugaggcugcugcagcuggccccacccccaagccacucauggcaggccccgcacagggccucagccucuggccaagaggccccaggaggaggccgugaccuccauacuaugggaaaagcugggccugcauacuccugaagcaggccuagagccccaugauggggaggugccccuucugucugcuaggccuagacacagcaagcacuuucugauagggccugcugggucaguaaagaccccaccaccaccaccaccacccccgccccgguuccacauugaagagcuaggcagacccaggccggccugcuucuccuguggagugcggacuuaccucguuugugcagccagcccuccuucacaauggcuacgucguucaugguauccguggcccccagagacagggguaacccagggaugaugcucagagucucuucucgguaggcugagcccagccggccuggccgcagcgucuagaagaagccgagaaagcacgugagacaaggucccacuugggacuagcuuccgugagccccagagggcccacaauuacccauguccccucaugugaucuacccaucucugguucccagguucccuccucacccuuacucccugccagccugccugacgugucuccaaagguugcuauagaagaccucccuccaguaguagaugcuacacacccagaucuaggccugguaguccggggugcaaggcuguggccaacccccaucauccuggucucugcuagaaacauucauuuccagaaggcuuuuccuguuaggcagcuuguucaauuugcuaccccagcagauuaggccaccuccuccaggcagcccugacugcuucugcucugccucgcacuagugaggggugcuuaccacugucucaccacccccuacagucugggaggccuacugcaggucgcagggucccuacggcucacguuaggaacgcgggaaggccaacacuggagagcacaaguagaacaggcacgguaugaagcugagcccaaaguccuucaggacaacacuaaaaacuccucaggcagaaccccagaccccuugggaacacagcacccugccugugaagcuguccccuucacuuggugaguacacacuaggcacauaugguucugucgagccuucacccuacgccugagacagagagacucugagacagccugcugggaacacccaaagcagugguuacgacccacaauuacaguauccgggagcccacaaacagggcagguaacacacaaggguccugcagcggccaacuagcuagccugugcaaagcaaagggugccagcucaccucgcaaagauccccccgccccccaauugcuucucuuccagagggacaccuagguauccuucaaauauccccaagucuggacauucugggaaagugcaccugaacagcccuugaccagcaagccuguguugucccuccaccuggaguucauguggacaauccccaggaaaagacuggaaggccgccguggaauagaucccaacuagggucuacuacagcugacuggcaacccccuaugucaucucucuagcccagaagacacaagcuggcacccagagucucugucacuuugccuuguaugaagcuaaauguggaacaaaagggaggccggcugcuaugugucaaaugccaaaugccaaaguaggaaagaccacaccuggcccaagaaggaaagagcccuucccucagcaagcagguggcgacuaaaagccagaacgaaaaagauaagccaagaagaaaucccagcucagugacugucagaguggguguggccuggaggcagagggcuguacugcaagaucucucucgguggauguccccuacccccacccagccccaaggucugcugaugacagucagcuguccagagccguguaaaaauaaauucauacacacggagugaagaaacacagccauguuaacgccaauguccacaucaagccgacuuaagcaugggacacucuucccaccaugccaugccguaagggcauaugguugcuauuguuaagucuuaagaguucagccccucugggacacuggcccgugagccacacgcccagcuggggccccaccaaggcgacucgcccuucacuuuagugauggcucuaggcagucaaggcuagccaccuggagcaagaccaggggccugggggaaggaggaguuuggccacacagcagaggcccaagguuccaccaccgcccaacuuagaaaccaguccucuuuagacaauuccaucagcucagccaguaucccggauccgggagaccgaguccacgccguccucaaggccccccccccccccggcaccuccagaaaccaccuaguccaggaagcagcuuccgggcccaggaggguuagcaguccuuugugggcuagccugggcacugugccaccgcgcacaacuuucuguccgugggaaaugaguucuccuucccagggcccucccaccgcacgcaggccgcggggcgagccuuucuccuacccucgcuggccgagugcccgggcagccccaggccccagggcgcaccggcccccacugcgcacaccaacagcgccccucucccgcgaccuggccccguggagcggccacccaaggucacgcagcggccgcccgcacccucgccggcgugggccuccugcgcgaccagcccggccccgcgcgcuccccgcccaggccuccgcucggccacuuccugcuccuacuccgaggcgcggcgcggccgggaacaaagcgggguggccgcggcccggaacagggcgcggcgcgggcacucaccgggccgccgcgugcgggcgacugggccuagccgggccgcggccucgggcgcccgccgcuccgcaucccgcgggcgggcgcugggcggggccggcugaaggcagcggcguccgggcgcgcgcugcuggccggaucugggccgccgcggugccggccacaggacgcugcucgguccgcuccgcuggucccggacucgcgugcgcugccgcgcugggccggccgcccgccgacucggugcugccgccgccgccgccggcccgccuucuccccgccccgcgcccgcgccgcccgcccacauccgccuccgccgccccgggcgcccccggcgcggcccgcggccagggcgaggcaccccgugagcgcgagcgcggccccgcaggcgccgcccucggguggccccgagccagggccacgcggguaacggagccccgccgcagauccagagcuccagcucuggucuggguuucccgguuugugggaccuggcccuucccugccuagcucuccagaccccaaggagggaggccagcgugggaagugaaucaguuugacucucaagaggcccaacuguccccaucuugggagccgggagagaccggucaccgguguccuaaaggccagccaacacaagaaagaaggcuauugagggcucauccaacccaguacugccugccacagcaacugauaaggacuccccaggugacagggaggacgggagcacaccuggacacccagagggggcagauucagggguaggacucagucagccaagaccuugcuguggacucagaugggugaggcuuggggggcgguuccuuauggugucccggaauugaagagucaaggugguuccugccucuuauccauccucaguccuucccccuucg

SEQ ID NO: 6858 - RNA, 2605 nt, Mus musculus
cagaaggccgggaguguucagggucgugagguggaacucuaccgcugucgccacgguguccuggcgagugcugcgccggcucuguccggcggaaguugccggucggugcgaacgagcguccuuuggucacaacuggcucuggugucagccgaggcugcucccuugauccauccaggagagacaaggacccacgucugagugccgaagggcagaggcauagggcugcgcuucgcgggugauuguuccccuauaagggcccugccuccccuggcucccgggccccagacuccuaaagcuccucuggucccaagcucccuagauccccaaguccuaacuacuuuucuagaccccaguuucucagacccuaaaacucuaagaucgcuggcugccuagaaucuuaagucuucagaguaucuggccuccagcuucccagacucucaguccuuaaggucccccaaacccccagcuucucaauaucccaagccauaaggacucaggccugcagcuuccaagccuuaagacagucgagaggacaguuccuucgagagaauaagacagugcaaaggugaaggcucccugccccccuuggaucuuugagagguccauuucggaguaccccuagaggaaggguagaacuugucgcaagggaagaaugggugucccuaagaagagucagagcaggcccccagagagccaggucugaggcccagggaugccuaugagagaggagacugaauagagugaaguaccaggaguagcugcugguuggugggaagaaaccaaggagccugagaagaguacagggagugagggagguucugcuucacugggugacagggugcugguucuggagugggucugcuggagcuugggagaagccaucuugaaguggagcagagcccagaguagcuuuacuccauguuccagacacggauaccugaggccaccuggagaauggguuggaagcagccaagagaacccaaagcaaaacggaaugaguacagccagcccugcuuguggugagcguggggcagggaaucuguuacagccacucauccacucaucauguccagccuggccacaggagggugcagaaccaggagaggacccaacacugccacagagauuugcacacaaggguuguuagaugaugugugcauucuaacacgugacauugcucaucccaauggucauagcuagggcuguaccuugaccaccuaccaucucacaccaaaggauuagaguaccuaggaagcccuuuaaaaacccaaaggacuaagaaguucuuuaaaaacucaguaagaaaguugguuguaagagcugaaccaaguugauccagacaaaauacaaaugauccgugaaccuagaaaaaagaugcucacauacugagagaaaugaccacaauggcgaacuaucauauuuagaaauuuccugauuugcuaaauguagucagggcugcagggaaacagagaaugccccuugcauaggcaguuuggcacccucugagggaauuguaagugccuucuccuuaggccagccauccuacuuuugggaguuggguacccauagugcuucagugccauuuaagaauauuuguuacaauugcuuacagucagaacuggaaguugcccagaugcccagcacugagagacgugauaacuuaauaaaugugugcuggaauaagcccacugugacaugcuacaggagugagaaaaugaaaggacuggguggagagagagcucugagguaaagugcuugccuuauaacagugauggcccagauucagucagaacuuaaagcaggcacagugacacacugugaucuagcauggaggagauaaagacaggugggucucagaguuugacagccagccuagccuacuggaagccccaggcuagagagcgcccacaucacaaacaacaguaaaacaaggagggauggcuggggggggggugucaccuugaagugacuggccuccacaugugcacacauacacagggacaagggaucguuugugugaaagaaaagcaaggugcacauaccacaucugaugaugugccaccuuuggguguggcacugagggaguucuguaagccugugcuggccagcuucaugccaaccucuacacaaaacagaggcaacuggcaagagggaaucuuuuguuuugcuuucccagacaggguuucucuguguagcccuagcugucuuggaacuuguccuguagaccagcuggccuugaacucagaaaucugcccaccucuguccuggcucccaagugcugggauuaaaguuaugcaccaccaccaugaggcaggaaagagaaucuuaacugagaaaaaugccuccuguaggcaagucuguggguuauuguuuugaucagugauuggauggcagcuuacuguggaugauagaaccccuggguccuggguggcauaaaaaaguaggaacagcaagcuaugaggagcaggccaucagcacugauccuccgugaacucugcaucagcucuugccucaaaguuucugccaugugugaguucuugccuugacuucccucagcgaugacugugaucugaagcuauaagccagaauaaaccguuucccucca

SEQ ID NO: 6859 - RNA, 3585 nt, Mus musculus
gacaacugaaugcauugcuuccuuuauugaaggugacugaaugggcugcaaucuguacaugaggugcucugggcagagcauggaaguuguacacaucugggaaaguaguagcacacuggcaggcagacagacaaacagacacacaccaaggucuaaugguaaacccgugugugaacccugcugggcaacccgcagguaccacugagugcagaccuuugugccgcgcguacacacccucacagucugcgccccaaagcuugccauuagcgaaagagucgaggaaggaucgaguaugugaguuggaaggacacaccacacacccugcuggcugaggucacuaggaacagcagcggcaaggcagagguuaccccaaaagcugcuccuacccacacaggcauggguacuucagagacaacguugcucucgugguguugggcagccucuugggacuuaccccacgaaggccaacagagcucccagaaccagacaauuuggcagccuucguugcuuccaaagcuuggaagaaaguagcggauuucgguucccuauaggagggcugugugugagacagguuaagugcuguuuauuucugcuuugguuuuaagccuguggauugacacaagaucaaucgcguguucuaggggcuaugggguugcuuucagacccuaaguuucagguucuaguuggcuggucucauccacugacucggaccucucaccucauuuggccacgggccuggggauagguuugucaccagugucucuagccuguuccaacaguacgaguucuguucucgcagaggaugccaccauugcuucagaaccaggccuggcacuuguccccucugacuuggcuuccuccuccuccucuggggaaaagcuuucucgagcaucaaaaaaggugacugucuccuccuggggcuugugcucuuccuggccuuccccgucuucaguguuccugggcuucuuagugggugaagaggagaacccuaacuugggaaaccggaaccagcccgccuucuccuguuuccugggcaguucgggguccagccgagcgguaggcugcacguggacaggggaucuuuggguugugucucuggacucagcagccaucucuuccacggaggaaaacccaauacucggaagccaggaccacaacaggcuggccuuuuuaccuucugguuucuguuuuguauccaugccagagaccuuaaccuccuggcuguccucaggaaacucaagaaucucugcgggcuccucaucagaggugcugucugcaaguuggggccccggaggcacgccaacacuggaagagauaaucucaaaugguucgccaguaucagguggggccucagcaggagcagagugucccccugcagcggcuggugagggagcuccacccacacucuccugcggcugcgaaucaggagccacuguauacacacaggccugcacagggggcucuggaauuuucacuuucagcaaagaaaauccguaagaaggaguuuggauuguagaagcagggaucucugacucccgcacaaucuggguacaaaaggcuccaggagcuaaggggucagcgcuccaccuuuccauccugcuaggaagagcgacuucuuggcuuucaccucgagaccccugaaugugcacucugaccuuagaaauuggggaugcuuccaaagauugcucaaggcuugcugguggcauucugguguccucggcgccugucuuuagaaugcuggcuucccagagcccagggcuaccuguaugcaugggaccaguaaugcuggcuucgaccucccucaccacaggaaagaacacaucagccucagagcugggagcagggaaggagaaccuggguaccuucaguuugggaaauguaacagucaauacagaauccucccagagcugacucaugcucaccacagagaccugggaugccacaucagugauggaggccuucagccucagaggcccucgcggcugggaaggcaagcuuccuguucuagccuccaucucagcagggauauuuccuccuggcccaggaugcugcugcuugccuguuucuucuggaggaagcugggguucugagacccucacaagggagacagagucuuuauauagaugggucccaaacucagggguggacagaugugugugggaaugcucaacaguggagcuaugcauccucgagccugucccguggagaucucguuuuacaacaucugcauacguugggcucucuacgggcuucacacuggucccuuccucuggggucuccagggagauaugugccucuaccuuggacucaggcacaugggacagcugcacgcaggcugcugcuuuuucuucugccuccaaggggaugcugaugaccugagucugugacuuuugaguggcuuccuguucuccaagccggucucgcuccuuggaugaggagcgucugaaaccaggaacucugaacuugggcauuuugaaccggcgcucauucgagucuguugacgucuccuuugcugugggauccaucucagggguuuccauggugcaggcguuaucucucugucuaccggauggcugcaggggaccuucuguucugggugguaccaguuccccaaagggcugacuugcagagacagucaugagacuuuugcugucaccucugacauucagaucaucuuuggaagaaggaagcucaguuuuggaccuaaccaacucugcugugguugagggggaucugacauggaguucuguggugacaucuuuugaaugaguguccccaacgugggcaucacugacagcuguuucuacgacuaccaaaucaccuccagaugugguaccacugagugaaggccucaugucuccguguggcacagaagccguccccuuagaaaccuuuaucuuggguagugccagucuuggcauggaaaagcucagcuuccggcuucuuccuuucuccacguccuuuuccagaggggcaugcuggggggauuccacuauggaaacacuacuuugaauuugagaauccauuuccauugaggacaaacuuagacugggugugggugucuccugugacugagaaucaccuguacucucugcugccuucuuuggagaccaauuaaaagaagguaacuugacgcuaggcaauuugaaggaagugucuuuugcuucuugcuuaggugccucagguggcugacugagugaaggcugacuggaggacacacccacaacacuacaagcagcagcaucggaagaaaggaccugagggacuacugaaccagacagggugugagccguaacaaaagaauggacaacagccugagacucagucucagacagaacguuuucagacucugaagguggaagagauaagguaaauuuaggucugugaaauuuggggaacaauacgcgagcaguaaaaggagggaguguacuaccuugagauucguguggagagucaacaauacucaaagauggacgaacauaugacaacaaggacugagaaggcacaaaaggaggugaaagaccagcaucaguagaaucauggcacgaacugguagaaaugucccuugaguuacccacuugauca

SEQ ID NO: 6860 - RNA, 32652 nt, Mus musculus
aaugagcgucuacugccugcagaguaggagagccacugcccugccucgugugcucacagucugggccgggucaccagccggacccaaggcggagcagggucagucuuggucauggacaggcagagacucacaggccccugcagggcccugaugaacuaaccuugccccucucccagccccagccacagaaauccuuggcccuuuccauauguccccauccugagcuucaugaagucagccuucagccugucacaucuuuauccaagucacccuagacuagcagccauuaacaaccuccccugagaaagaggugggucaggccugcaucuaaacccaacuucagccccuuccucuauacucagauuucccccuggacuucccuaggcccugcucuguccuuugcaugaauuaugcagucccucauccccugccuccucaggagaacuacuggaaaauuugauuuaaaagugacaagaugagaucauucgcugcaucuuggaccacagccuuccccauuccccugggcagacgagccuggcacuguucacugaggcuugcgggcagagagcucaggaccauggcuuggugcagcuauucccagcuuucccaguggcccgguaggauggugcagacacagucuguguuuacagacacuggcuuguuugccucacucugacccagcagguccugcucucgguccguucccaaggcuccaguuccccucaccugcugcccuugcugacuuugacgucuggggagcuggaaggacaggaaaacugaggccugggcccacagugggacacacaguggcaaaggacugggcugcagcgggucuucccaccuuuagugucuccucaugucugucucgcuuucagcucugaagcaagacuuccagaacgauuccaguucuucugaguccacguuggggugaucugugugaccacugagcugaaugaugguccccaaagauauccacgucauaaaauccagaagccaugaauaugagaccuuaaaaaagggagggguguucuguaugaaacuaaagaggugagaaagcuggguaugguggcauaggccuggcacaccagcccuggaaaagaugaggcaggaggaucaaaaguuagaggccagccuaagcuacauggugagucugagacuagccuggacuaaauggugagacccugucuagaaggagggaagacaagagagacggguggagagaggugugugaagauccuagcaguguccccaagacucagggcagcaaccaugccagcaucccggauaggcagagugagcgcaugucauucuagcccagucugugauauuuuuucauagcaaacaugguaaacugauagaccucggugcacccuggggaccuuacugaaaagaugcugcccugaauggacagaggcaaauuuaacguuggugccuaauagugacugaaggaggucagacagcccagauaggugggcaaaggaggcaguggcucuacuuggaucuguagagcagggugggccagaggguagaggggccuaaugucagggugugagcagcugggcugugaguccugaguggccgugaaggggcagagccagugugcugggggaaggagcccugaccgacuucuaaucccucacuugucccucccucucuucccccgaguucuucugccccaggguggugcugcugugcccaaagccuacagucaaccugguggcucccaggucaccugacacuaaggacugguugaagaagcuguccuagaagucacagggaucuucccgugagguggcaggggucacaucccugucucugcaccugugguuucugggccguagggccaguccggagcugcccaagugccggguuggccugcuuagucuacuccuuuaggggcagcagggcaccccaauaugccccuccaacucccuacuuccuaaucccggcuguguucugagcuacauggacacagggauaggaaggaccuaggggccaugcccagaccagacagauauucagcacuggggaagaugaagcagauggaggcagggccccuguguucagggaacugggguggugggacucugggcaagggccucccacuguggaccugcaggcuuggagccugcaggcgagggaaggacugaaguaggcagggugacuugugggaagaguggucacagaugccaccaccuccugcaugccugugggcuaggguggggcagggccaugaugauagcaaaacuauuuuugccaugcugcugcggcugcugcaggaugcaucaaucauugaugcucugggcaucacggccagcuuuucgggagaggcaguggagcaucgggucaggcaggugggugguggcagugagcgaggcagccacaaccauaucaggcccaacccccucuggaccuccagccccccccaaggguccagcuuugguggugguggaagaucaugggguauuacagagcuacauagcaccccugaguugauguuuagaaggggugguggugagaagccuuuguguacuggcuguggcugugaguugggucauuuccccacaugcugggcaggggguaucaauuccugagcuagacuuggccacaggagcuuuccccagcagggcaucugucuccagaggagaacacagggaggaggcuggggcuggaguguggugccgggaacuccuggcagcacauugcucugcagcagaagauggccaggcuuuagagugggggaagggacaguagacggaacauagcagguuccccaccacacacaccuuccucccccguuccuguucacugugaccccaggucuagguuucggucucugaauucuaccagugaugggcaagucuaacugggcccugggagcaaaggcugacucucggcugguccacccagauaggugcagccuggccucuaggacaagaucuuccaaaggcauagagagcgaagcacagcccgugaggccccaggagcacugcucaggagugagcaguagccccccuguauucuguacauaccuguauacacaugcaccugaguguauacacaggaguaugugugccugucuguguguacugggacagauccaagguguccugugguguauguaugguuuuguuuuucugucuguggcucuuccccgagguggauagcucuuuagggagaugccccaaagugucugguccucucacugucuguagucuggccucucaccuaagugggaucuuccaggagugcggcggcucgaguccccguguuagguccucaccuugccuugacagucaagcugaaguucuagugcuuggcuccuggcaggcagagaugcaucugccaacaagcccugagucugggaguaggcaagagaagggagagccccuggguuccugcccugccugcauccugggucuggggccuaagccaacucugaaaugacucucggggcugcaagugguugugguagugagcugccuuguccuuuucucaagccccguccaggcagaugcagagacucuggccacacauguccagauucugguaccuucucacugggucaagggucuacaggcccaguggaggaaguucaagaggaccucuggugucucaagggggccucauuaccaagcacaacucuccuaaguaugcuacccccuguacugacagugucaagugggaaggugcuggcacaccagguaccccuuaccuaguacaaugccccugacauuacaucauugggccuguccuguuugcaccuggguagcuuagaucacauauacuuccucacaaagcuaaugggagccaccacagccccaggcagaucaugcuagacaauccaaauaugucacagagucugggacccuaagaccacuuuacauugcccagagcaagggacacagcugggucugcacccaaaggucuuuuuggugauacaaaccuaccuuuucccaaggcccuugcucucagacucugaagcaggauucagacacacuggauuggcaggcaggcagagaccucccagccuucccagcagacacagggauguacccuggaacacagagacccauauccccagggacaaggcagugucuguccuucauccaggacauuucuccaaggagagggugagacuugugucccaccaaggcagggcuguggcccaugcaguggcaggaggaggcugccagggcucuuucccagcagugacucgcgucugucugaccuguguguggcuggcgggcugcccagcgcugcagcccggcuaacgggaacugccugccgugagugaaugauccaugcugaugcucaccggcuugccugggcccugacuucugugggcucguaccuaagacugugcacacugugugcacgugcacgugcagucauguccuguuaugcuuauuaucuguauaugcaggugugcgugcgugugugugugugugugugugugugugugugugugugugugugcgcacgcgcacacgcacuggugugagugugugauuuuguccuugugucugugaggcccuucugcugcagguuaaccucuccuggcucccgcccuauuuccccacccuaggaaaagugguaugcaugccucucuguccacccggcauggccaccacacuugccaggaacccuuucccccacucaggucugcaccauacugggcucauagaacucggcuucuguggaaacagcucuuggaccuuucccucccccaaauauguucccuugcguggauggcacccaaguagaggcugccgagaucccacccucccccaucaaggccuuacccaguccucuuagcaaccagaaugucccaggaccauugaagucucacccaaccucacgacccuaauucagcugcucuugauuuacagaacgccucccccacgcuucaacccugagcuccuugcuugauagaugcccccuuaguccuaggccaggcaggccuuuuccagccccugcucucucuuccuuguccugggaacccacguuaccucuccagugacagugacagugacuuccugcacuguuuugcucacagcucacccuaggcugccaggaaccuuucagagaccccuccuagccagaugucuaguacugcccugaaggggcccucauuuguaccuucacuguccugcagcccaggggccauggccagguccccagcugccaggcuuucuacaaaaaccauuaaaaggauaaauccugacuuggggcugcaggauggcuccagcucugguccuaccauccuggacagccuacagaggaucugcccagggccaccugucuccaaacuaguggcuucuagccuguccuuucaucugcuuccccucuuuccucuuuuggcccugaaccccaucuuuuccugaggaguucaggucgcaagucaucucccuuggaagucaucuaccuuagacucccgcaguccccugucacucccccaaacuggagguaaagaagcccuggauuccuggugcagggaucugguggccccuggaggaacuuaacuaaucuuugcucuagaaauacaaucuggaggagggcgggggagggggugggguguguguguguguguguguguguguguguguguguguguguguugaggucagcuagggguggggaggaccacaggggccuggguccuacggggcggggccgucagggggcggggccaaggcugcagcaaccaaugggcugaaugagaccggcagcgccgcucgcgucgcccuugcggaguggucagcacgggcugggcgggccagggcggggccggagccaaggucuggagguaccccaagaguuagcugcagucacaacccggcugcccgcggcagcaccgggcagcgaggccgugggagccgcccuucuccuggcgcaucagcucugggaccgcgacuggacgcgcagggccgccgcccgcccgcaccacuagccgccaagaugugcgacugcuuccacgugguguugcccaccuggcccggagcccccggcagcggugcgccucauccccgcuugcagcccgcuccccucgggcgggugggcugugcgggcgugacgggggcgcgcagugcgggacaggcugcgcgcgucagaaagggcaggagagauggcuaggggcuggagggcgggcgggucuugcgugcuuucggaccuucgcuggcucugugggucucugcaucucgcuugcacuugugccugccucgugcuuuucacccccacccuaucucuuuagcucacuuuguuucucggguuuucauuacacuguguggcucccugcacgccggacucucguugucacugucugucucuucccuuuucaucacgauccuccugccuguaaccuucuaagacgcuccugugacuaguaaggcggcuucggaggcaggugugcuucauacuagauggaacaggcccaaggcgagcaggaggcaguccugggcuaggagaccuucugcuagaucuagcuucugaucugcuuuuugagggaccauccuugaccugaccaggacuuagguuggggcuaacaggauauggcugugcuggauccaccgugcggcuacuauguauaugggugacaaacaagguguggcugggggcagggcugguuuugaggucuggggccuucuaaggggccugaguagaguccuguuauaccagucauggggaguugacacgccaccccacccccacccccaggauagucagugccccucuugcugagcauaucuguggcaaaguggcuaccuggugcuuuuuaccuggugguuugugcccuagccugggccuaccucuagugucuuggagggugggguggggugggguggggugggggaacaagaaaccauccuucagacucugggucauuaaugcagcagccuggccacgcccagggcaccuggccagccacugcccaggggauugagacagaggagcugcacugguccagacuggaccccuuucuacacugguagagacugguucccucugcagugguacaggcuagacccugcucuggggaaaacaguugaugacaguuuugacuauggggcuguucacgauuucagagugcuaugcagacggguggcccugccuggcauccucuguagccagaguagaguucccauaguccucccuggggcccguuuguccuguguggauugaggucugggacucuuccacacacagaugagagcccaagagcccugacuagcccugcuagcagugggagagugaugaccccaccccucaucuuccuccuuccccauugcuggcccugacccacaucacuacagauuggccuccccagagagagaaaggacauagggcugcuccgccuccaguuugccugaguggcuuucuucuucuuaggcucagguuagagaccgcuugacccacauccugcaccccgcucccugagcccaaaccucucccacucaaggaugcuaguucuucccgcuuuuaaccgguaguucccugcuucgucuggaacagcucuccuugaguccaccugcucuuagggagccagagcagcggccucuagugcagcucugguaggacacuuuuaagauaaggguuuggaggguucugccuaggcuguccucaguccugcacagggggcccaggaauauacacgcuucccaaggacacucccuaaggguugaggaggauuggguucaggccuuuuccagccgcagcccacucccaacaggccagaguugcccuccugugccagucucuggugcccaccccuggcauccugccaccuccuacagccccgggacagagcccugucucagucauuuugcgcagagguugcccccugguggcuguuuugggaauguaccuacacaagauugagugagggugggguggggcuguauaggguuacacccaacccuggaaugcccaaauaccuuuacccacugugagauggaccuuacacaagcccccugauggacauguuuaaccccauagaugcugggugucauaccccugagagcauguggguuccuucccugaggcagagcugaaucccagacagugacagggaaccggggucucaaagcugaggucccugugcugcaccugggugagccuggcauagccuaggcacuaaccgccaacacacuucaagaaacuacuguuggaucuggggaacccuagguggggacaucaugaggggacaucuggauguucuuucugugggguugggggccagggugugacuagguccuuucuccacagaguauaggggaaaggcaacuguuuaaccagccuuagguugggguguagguccagaucugacauuugugcccaggagugccugggcuaccaugcggggggggggagggggaggggcuguaccccagcgaggacacaugcuagcucuacucugucaucucuugggcaggguuguccacacuggugggaaucuauguucccagagaugcugagcauagugggacucucuaggcauccagccaagacacaggccauauucccugagagaugggaggugguucugaaaggugcuagcucuguccugugcuaccgggcagaacacaaaaggggcugggcucugguagccccaccucagccuggauggauccauggugggacaggcacugacugaggaggaagcaauggaggucauaaggauuuacuuccugcuugagggaagugagggcaaaagcggauguugggggcucucucucucucacucuuuugcucucucgcucgcucucucgcucucucuugugcucucagucucucacacacauucucucuugcccucucucacucucgcugucugucugucugucuauuuucaagacaaggguuucucugcauagccucggcuuuucuggaacuuauucuguagaccaggcuggccuugaguucagagauuucccccugccccugcugggaucauagaacugggauuaaaggugugcaucuccacugcccaguaaggcucuuuauuuggauggguuaggugacagaacaggcuucauucugcucucuccaagccacaggcugcaucugcuguuaucagccaagaaagcaugaguguagacaggaagacggaaccggcagauccucuagcuuccuaaccuccugggcccuggcggcugugcccaccuccaccugggaaggccuagucauugccccugcugggagcauuuuacuccagcccucuguguccucccuucugugaccuccuccacacccuauacugaagcuguuuguguuucaggugcagcuugggucggcuuggcuagggaggagagguucuagccguggcagagagagugagacgcuuaucuuaccugggcaucacuaccacccaggagcaaaacgccaagaucucaccagcuuugaucccugcccaagaggaggaggcagauccugcacucagggauggugucaggucugagugauguccacucaucccugccugcccacuuagugagagcugcuaccacuauagccaagaggucccaaaacgcuggggagagagcagacaguggccuggauacauggaggagccacggagggcucaaaauccaugaggagggagaccacagggcagcaguaacuacguucaccaggcuggaucugcguaggggacaggggcuggggaaauggaguuggacagaaggaagaauguaucugugaguuuggaccagagucauagguggaaacauugaacucccaauuuuggaccccauucuaagggaagcugcuguccugcgaagggcauuucucuuccuguucucugccucugucucuggguuucccuuuauuuuuauuuauuuuuauuuuuuuauuuuuuggaagucacaggccaagggagccaaggccugccuugcugggauaaauauuuaauagucagaagcacuuucucagacggaaaauuggauuggggcccaggaggccuggggcgggaggcuguguuccccacuccccacaccccacacauggcagaaacacuuccagccgcuccugccacgggcugugagcuccucccuggccagcacgcugcagugcacaccuggccccaaccuguacaugugagaacagaggacagagcugaggucacucuccaggguccuggcugugaacuuaguccuuuuaucccaauggugggcagaguggcuggguguugugaggcagucggaaagggaccucgagucacuuuccugacccaguaagaugcaggcagcaaggguuccacacagcucagggccucacccggacucuuccacagcuugucaucugccccuuaggggcugccccacacugagauuugcaacugcaggugacucagcccuucccaguggagucugccccccccccccgcuugcugcagaguggaggaccggaccgagcagaagcuagcaugcaggcagugcaguccaguugcccugucccuccccgugccuucuuggauccucuaguggcccuuguuuccugagagcuggacccucuguaggaggaagaaaggcagccugucacagaugccuggcugccagcccacuauuggguggcuccuucacuggcaggccuugcuagagggugggcggguggcagagcacccaggccgugcugugacgcauccccugggaaugcccucagcugagucacuagcagcugcccccagccccacccggucucgucacugucacugccaaguucccauguuguuaaagagcugggcugggggggggugggguccuggcagcuuccagcaggacuugugugugcagugggcgucgcucgacacauccagacaccugggucugugacucagcagauguccaaugcccuccacagacucaaccugaccacugggucugcuacguggaaucaaggauugaucagggugugugggcauccuuaggaucugagguaggcaaagccugcugagagucgagugagcgagccccucuggguuggauaugggcaagaggcagcucaugaggcccccuagaaucgcaguuccaacucuucuucccuacugucaaccguccccaagcccugucgucuguccccaagccauccauccgugcagcaguauggugcaccuuagcuaggagcuugggguggaggugaucauggguccucagguggguggggcaagggacagaagaggaaggggggagucagaacuguggggcucacagguagaggggcugaugggauggaugaccuggcucaggagaacccaguggcagcaggggagcuccaggacagcauucuccccccucacuccaucuccagcucccggacagcauucucuccacccccacccccccaccuccggcucccugaugacucagccagccucacuccaccuagagcugacaguuugguuugguuuggugucaggcaguaaacagaguucccaggugagagcugucuuggggguggggccguggagcgggagguggggagcuggccuggcuugugcccuguaaauagaguuguuuucuccauccaugaccguuagguuuucaggccaagguugggggaaggaagccuguccggacugaggcugucccugaagccucuuugcccaccagugaccccugccuucucccguccuuggggcucucugagguggccucacuugccucuuccaguggcucucauuucuggccuguuaugccgaucugggaucugguguguuucuaagggcugcccuuguugaccguucccuguccucgaccccuuagccuuagcugugcgugcaagccugcuguagccuguccacaggugcaggugcccagagccggcacugggaucccaaacagcgacagcuaguacacccagugguuccugccugggucugcuggccaccuagagcuagcaggggcugagaguggagcuggucugaggggagagggaacagagcugagcaaugggagccuugagggcugaagcccaaggaugcaugcaggcuucucauccaccacuaaucucuaaauaauaaggguacaagggaagcacaaaugucaguuuccaguuccagcuacaccuauuuuaugcaguaccauucacagcagcucagguucaggagacaucauuugccagaggguuagguaggaagguguuguguugguuaaaugguguguguguguguguguguguguguguguguguguguguguguguguguuuuaaagacaggaucucaccguguagcucugacuguucuaggauuugcuaugaggaccaggcaacucucaaaaucacagagaucugccugucucugucucccaggugugaaccaccacacccagcccccuucucuuucuagaacccccagccaccacaagggaaacugagacccaaggcuugagaaugggagaaccugcuucauaucugcguauccacacaaaaggcggcugcuuacacaguaacuggcugggguagugguugugagucagacagcaggcguuuccucuucaggucagcugccugagcugguggggguuggggagcugggguggggucccuggcucccagagauggaauggagcaugugaggggaaccacccacucccucugguaggguguguguguguguuugugugugugugcgcgcgcgcgcgcgugcgcucgcuggaggggggguuggacgggcucuuagccuggcugaagacaugggaggagggacagugagaggagggacuguggaggggaggaucuggugggagguagccggcccaggaucucuucuagacaaguuugggaacguguccucuucggagaaguggcugcaccccuucugcacccuguccccuccugggcucagcccugcagcaccugccccucucaccacucagcaggucagagggggcccgaugggcagccagcaagggaggccucaggggcagagcugggccgggcaucuuccugcugauguugaaggauggggggugucaguucuuuguggcuccaaguaacuugugccagggccagccaggcuggguugggaaaaacgcuaacaaggaacugucugagggcucgggacuaagaaggccuggagcaguaccucccgguuugcacugcaggcugugggcugccacagaacucccaguguccgagccgugccgcugucugguguagguaguagcuuuuguuuggaggaagccuaaguugugagggaccuuggugccaaagggaccaaauagcuauuuuaguagcaggauccagaaccgcaagguugggucuuguggcucagggagagguccccagauuuugucuacugaucugguuugauguacaaaagccugggguggccauagaaguuggcucagacaacagccaacuugcuuacuggggguauccaagaugggacuggaguuguggacuaccuacguugggucacacugucccugguguccagaauuuuguccuuuuacucaacagagugggguggcuggucuguucuugggugguugaggguguggcggcuucugcuggcuucugagucuuuggggguugaugggcuuaguauauuucuugugucucagauucuccagauacagcggcuggccugggcccaccuacugguccuuugcaucucuuucuaagugucugggcaggggugcucauugccguuuuauuuugauuuuugaggcagguucuuucucaaauagccugcacuggcucugagcucacugugcagcucugaccgaccagcccugaguuuccugucaucuuggcucugccucucgagugccgggauuaauggccacaaguugccacaggaguuuugaccacuucauuuucuuucccuuccuuagccauuucuuguacuagugcucauuguguaucaagcucccuccaaguccuugggagauguagagacaaucggcaggacugccucacugcccgcuuguuugccuggggguggggggaggggcgcagagcagccuaugaaaugucccacaugggagagggccuaggcacagggagaagcagugagcugaggcagggggagaggucuugcagaggugauuccaggaagcuuguuuuaagaaagaaaaaugugaacauuuuccugggccaggcuggucuauacggggaagaguucuggcccuggaccagguggcucagcccuucggagcuggcucucuuccuagucucggucuuaucuccagaagcacugggggauggagugggcaggcccgccacugccugggguguugcuccacaaggucugaaagucucaugacagucaucccagcuuagcacuugcuuugugaaguuccaggacugggcgaggccugaggacaugcaagguggggugcaugcgagcucaugaagaugcaaggaucccaaucugaaagcagaggccuucccagugugagccugcccugggcccuaacugccacugcuucauauugggcuguugcuguaagcucagaggggcaccccuggccagacacgucuauacaugucucgggcuacuggacagcuguggaucucucagccaguuuucucaauguccugguaacaugcaaauacgcccuccgaaacaggccccaccuggaagucaaagcagucugaaugcaaacucuaguuuuguuuaagugaaugucccacccugccuccauggcccugcugucgguccucaacagagaggugaccauggauggugggggcagcgugccuuucuguggagccccugccucccucccuuacugucccccaggcugacauguucaccucuaccauaaaacagcccaguuccuggaacuccaacuucuccaaaccgggggccuccaccauggcacccccaccguaccccuacccagccccaccaugcccugagugcagguuugugccuguaggaguggggugcuaacggcaauguuugggacugagcgaaggguuugugguguugaggagggaccagggaauuuggggggaauaucaggugacaguggccagaccugcuaggcuuggcucagguguguccccaucuccuccucuauaaaacagggcuuuggugacuaucaacaaccugugucauuaucaagguggcaguguucacagcugggcuguuuacagagcugccucugagagacauaugugggcagguacuuaaguagcuucccugucgcccaggccugggcgucggguucuaggugggcgaggcugggcucucaggcuuccguccuucccacagcuggcaggggcaggcagccuccacucugcaaccaggaggguuuccauggccucuuugugcauucuugggcaggggugggguagggacgggugggcuccugcuagccccuggaguagagccugguggcaaaguccaugccucugagcagggccauugcucucauccuuacaaggaaaagagggcugugugggugggauugugaacacgggagcuugcuaaccccaggcagcagggccagggcugguccgccucuugcuuccuucccucccucccaucuuggaccucccagcacagagugcaucuuacuuacuagaucucaacagcuucccucaggggccuuucacacccgugagacuccccugaaacagaucuggaauacaguuucucagggguaggucacuaccugccugugggggucuuccauucgaacuccaaccugacccaguucugagcuugggccucgggcaggaaacaggaagauagagguuuaccuacccuggccuggguuccaggacggggaacugacccagacgccucuuuccacauccccugccccuuccccuucucucuccaucccugaagucagugugcaccuagggcaaaguggauucugggagcaacccugggagccccagcauugguggggugcaaggacagagacugggggagggggaugugauggagcccgaugguugacuaacuucuaccaccagguuaugaggugguggcccgugggacaugcacaugggguucgggggauauuucguucuuggguguuaucuugccuaaggucgguuuuaugaauggggaaauugagacucucuggcuuugcugauguccuggaguucauaguuuagcccacagaguaguaguaaggagaagauggaagccaacaguccuucuuugggccuccccaccucuccugggaggaccaacccccaaagcuccaucccuaguccucuaagaacagcaguaaggaagguauggggaguuguaauaggcaugguccaggggacaggugugucaggacccucaggguggccuuugugcacacagugggaaacccagguucagagaggaggcagaucugcucauagucagacaguacauuggccagagcacaguagcuugcauccauaauccggcuagacccggaacuccuugucccugcgggggagucauuagggccagugcacaggucugaauuacugacagagacagucugugugacaaggacucugccccucaggacagggauggagcuguucaucuccagcacugauucccuugugggggcagucccuggagcccaggcccagccaagguacagggccugucuuugaauaguuaggaacuuuaggcuggaguucuauguggagggaaagcuuuguuuguuucgucuaaguuccaauaaaacuuuauuuacaaaggcacgcagugggagagaugaggcugcucacucacugccuuucucgucuggcacagagaaggugccuugacuuagaucauuuagaaaauuuguagggugcuggaccugguggcgcacaccuuuaaucccagcccuugggaggcagaggcaaguggaucucugugagccccaggacagccaggguacagagugaaacccugucucaaaaacaaggagcuggaaagaugacuuagcagcuaagagcacugacugcucuuccagagguccugaguucaaaucccagcagcaacaugguagcucacaaccauccguaaagggaccugaugcccucuuuuggugugucugaagacagcuauaguauacuuguauacauaaaauaaauaaaucuuaaaagacagacagaaaaugguagggcagugugaccagugauguacacauguugcugggacagcagagcaugcugggaacuauaacaacaagcuggugccuguuagccauguagcuguaauagccugggucguuaccagcagacuguuugccaaaucgguugcaccaguucagcucagccuaggaugggacaggaauuccugcuguccacagcuuccucuccuucagcacagccaggccuucucacuucagccccucuggugggaauagcaugacaccucacgugcuguugacuugacaguuguauguccuaugugcacgcccuccuugcuccuuauacucccugucccgguuggugcuugcuucucgugcucauuuaacggccaugcucacuggauggagaagcaccauuuacgcccaacuuggaaccucagcccaguucccacguacagcccaagauggagggcuuagcuagugcaguggagagagucucagauugcagucaucugggaggagggagcugccgccaggcuuucugugcacucugucaacauuugcacguggaccagcggaagguucgcuaguucccgugggucugagcauuaauacacacccacucaggacuucaucugcuccuuacacaccaggggauucugaggcuucccacacuggguauuggauucaggugcucaugcuuggaaggcaaauguuuugccaacugaagcccuuucucucucucccucucucucucucucucccucucccucucucucucucucucucucucucucucucucucucucucucucucucucucucucucucucuguguauggguuuaaugguugucuuuguaggagaacaccuuuauuuuugccaguauuugaaagauuguuuaccugguaggaaguucuugacugacacuuuuuuccuucagucuuugcaaauauuguuguauuuucuucugauuuccauaauucucuauuuuuauuuauuuauuuauuuauuuauuuauuuauuuauuuauuuauuuauuuauuuauuuauuuauuugagacaggguuucuguauaguccuaucuguccuguaacucugccugcuucucccucccaagugcuaggaacaaagguguguacuaccaccaccuggauuuuuccuucccucccucccucccucccucccucccucccucccucccucccucccucccuccuuccuuccuuccuuccuuccuuccuuccuucccccccucucuuucuuucuuucuuucuuucuuucuuucuuucuuucuuucuuucuuucacaaagucucauaauguagugcuggguagacuacaauuuacuauguagacugggcuguccuuuaacucacagagaccugucugcaucuaccucuggaucgcugggauuaaaagugugcaccacuacacucuugucuucucuuuacauuuuugcuuugagucauggccuugcuguguugccuagacuugaauuugcugucuuucucccucagccucugggguagcugggaucucaagcaugcaucugcaaaccugguuuaaaauauuuuucuuuuauauuaaaauagugagugugagcgugugagugugugugagugaguguaaguguguguaugaguguacaugaguguauugugagagugugugcgugugagaguguguaaguauaugagagauugugugugagugugugugagugaguuaugugagugugugagugugagagugugaguguguaugagugauugagauuguguguaugagagaguguguguguaugugagugugugugagcauaugaaugaauaugugugauugagucucuguaugugagugagugugugugugaguaugugagugaguguaaguguguguaugaguguacgugaguguauguaugagagugagugugugugagaguguguaaguguaugugagauugugugugaguuaugugagagugugugugaguaugagagugugagugagugauugagauuguguguaugagagaguauguguaugugaguguaugugagugugugugagcaugugaaugagugugugugauugagucucuguaugugaguguaugugagagugugaguaugugugagugagugugugagugcaugugagagugugugaaugagugugugagcauguguaugaguaugugagagagugugaguguaugugugaguaugugaaaguugugugagugugugugagugauugagauugugugugaaagagaguguguguguaugugagugugugugugagcaugugagugagucuguguguguguguacacgcagguguccaugccauacagcucauguggagguagcucucucauccaucauauggguuccaggauuugagcucaaguugucaggcaccauuaccugcugagacauuugucccacagcugucuaccagguuccuuccauugccucuucggcugccuuuuucucacaugugaagggcugcccguggguuacggaggcucugcucugcuccuuuuucuucaguguuuccucuuguguucuucaaccugcguaggagauccaguuugaagugucuacuucaggcuccuccaguccucuuccaauccuccugccuuuaccucccaagugcugggauuacaggcgugccccaccaagcugggcuuuauaauccuggagguugaacccagggcuuugugcaugguaggcaaguagucuaacaauguaacuacuacguuccuagcccucaaauguucucuuucuuuaugagaaccuuccaucagucucuuaacucuaugcauguuuccuucaguguuuuaaacagucuguaaguggccaguugccuuugagccuguguuaagugugccaucuguggacucuuggagacaccauccgccaauugccuuguucaguagcgugaaccccugccaccuccuguuucuuuucacugccuacaauuccugcguggaugcuggacuuuuaggagaacgcauuccagcaacucuggguguucauucaggcucgggguaguuguugcuugugguucuuuguuggacuagaucuacaaaucuacagacuuugagccccagacaccacucuuccgcggcccuacggcugcuccccaccucucccacccagcgucucuggaucuuaccucaggcccgugcucaccccugcacacccauguccuccugauagccuacugcccuugugcccgcuaacagcucuucucucuguagugucuggccgacagcugcagcagcgggagccagaggcugagacggaagacgacucugugaguguugcccuuagaggaaacccauccucuucagucccucuccaucuccccaccccacccuaccccaccccccaggcuggagagcugcuaguuagagguaaccucauucucuucucccaggugacugaagggccugcgggugagaucauucggccaaggccacagggguccucaccuguuuaugaauacacagcugaaggugcaggcuuuggaggccagguaagccacugggcagagcugcuggcagaaggaaggcucagcuguggccugcagacauggcuuucccugcucauuggugucuguugcagcccaccuaccccgccuggugcacgugucuacuuucccccacuccuccagugucccucccuuugguuggcugagccacuguuaaggugggaacgccuccagcucgugugugugugugugugugugugugugugugugugugugugugugagagagagagagagagagagagagagagaaacccugaaaagccauguguggcggggauauacaccuuaauggcacacgcgcgcgcgugggcgcgcgcacacacacacacacacacacacacacacacucauacugucuuggagaggagacuauaggcuuccuugugagagagccuugacaguaauggcacacacacgcgugcgcacacacacacacauacacauacacacacacacucauacugucuuggagaggagacuauaggcuuccuugugagagagccuugacaguagucagagaagaccugucuacucuaaaggacucauuuuacaguuugaaagucuuccccacccugaaauaccuccagcugcugcagggugggggugugcguuccucaguaaggaaaugggagguugagaguugcccuucccagcuaggucccuggguacucagcucuccuguauacucugcaccccuaguguuccugugcacacacauccuucugcucuucuguauggauccccccuggcacuccuggcucauuagcaguaacucccacccucuugacugcaggaaaacagucaaggcaggcacagcuccucuggcagacguagguccugguggaaacgggguucaggggacuccgcagccuucaccagcaugagccauccagagguaggugucuuggcaguguggcaucaggggaaaccaucccuuagggacuucagccccaggagauggaaggagggcauacccuuguaccccgaagcaggacagaugcagaggcuagccucuaacccgacgaacauauuuacagcuaugccccaaugugcagcggacaacacuguagaaaaugguacccaggcuguggugaggaagggcccuggccaaagaugugagggguuuaguggguacccaccaaggggcacuuuuccucugugcuuuucuggauagccuugguuugguugaucaccugaaggaucagguggauugcagagguuccuguguguugcccaguguucaugucucucuggggaugcagaacagguguuuuucaugggcuggaugcuugcauauuuguaacaaaccaaugagggaugagcagaaggaaggcaggcucuucccuggggacuuggcugccuagacaggcuguccccuguggggacagagugagaugauuccaccugaggcugccaguagcugggcuuucuccaaauuucagacauagccugccgcacaugguggcccagucagcacagagcaccauccuugggagauacuggacccgacaaugaugcccacaggagagaggcaagccgccaucaugccauugauguaccuccguuccuuucugugcaggagucaacagaggugacacugaagacugacguggagucaggagccaguggcuacagugucacagguggaggggaucaggggaucuuugucaagcaaguacugaaggacucgucggcugcaaagcuguucaaccugagagaagguaccacaacuguacucucucugggcuccauccucagcuccaggaugggagggggaagcagaaaccugcagcgggugggccucgccugaggcucaggauggccuuauggacuuugcucagccacugaagauugagaaggcacacugugccuugauuuucugccagcuguuugaggugcaguuggggagcuggacaaaugccaauaugcagcccacuuuccauguccuguggggccuggggcacuaagccuguuugcuucuguuuccuucaggagaucaacugcuuagugcgaccauauucuuugaccauaugaaauaugaagaugcucuuaaaauccuucaguacucagaaccauacaaaguucaguucagaaucaaacggaaacucucggccagcaagggagaggaaggggcuguucagcauucgcagcaaggccaggaaaaucagguaagauccaggcuagugagauccaagauggcucugguuacacuagagaucucuuuccugugcagugucucuacuaugagcuuucguucccaaacaacccacacuucccuucuguuucaggacaaggacauugcugaugggugcauggagaccccuacaaaaacucuagaagaagcuggagaccgagaaaggcuuauuucuaaguccagggacggacaccauaggcgaacccaggacagauucuccuggccaaaauuucaaaccuuaaggagcaagcagagggcaggcccccgacgcucacacaguucuucagaagccucagaacacagggaaacacgagauaugucccccacaagcacagacacagaaguccacaggacagcugacagacaggaacggaacacaggggaagggagacgaagacggagguuccugaauuugagguuuggaaugacaucaggucagagcccagauacaagugagcagaaaggcaaagaccccaaagacaggagaggagaugcuggagcgcuggaugggugcccaacacaggaggaugacacaaaggacagagagguggcaguugaaggccaaaggaaggacaagaaagagacaacuggguacaugucugaaaaaaccacgcaaaaaaacaugagagagaauuacuacagcauggaaaaagauaucccagguaaaauagauuuaaaaacagacagacaucaaaagaagaaaaagcaggauaaaaaacaggaaaagcagacaaaacuguugcaacagagaggugaacacacaacaggacugagaugggaagacaguugggaggaaguagaaagucuagaaauuggcauugcaagacugucucugaaagacacaccagaagaaaacauggaaguaaauauacaggucccuagugccaagcuggagggggagcugacccuggccgacaaggacgugguggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccugagcguucagcugccguccgccgaccuggagcucaaggccggccaggugggcgugaagcugcccgagggacagcugcccgaggcagagcugcccgccgccaaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccaggaggccucucuggaggugggugcgcccaagguggaggcggacguggccccgccccaagugcagggcgaccugaagaccccugaccugagcguucagcugcgguccgccgaccuggagcucaaggccggccaggugggcgugaagcugcccgagggacagcuccccgaggcagagcugcccgcugcccaggcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccaggaggccucucuggaggugggugcgcccaagguggaggcggacguggccccgccccaagugcagggcgaccugaagaccccugaccugagcguucagcugccguccgccgaccuggaccucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugccccgaaggacagcugccggaggcagagcugcccgccgcccaggcugcugcugcuggggccggccugaagggccaccugcccaaggugcagaugcccagccucaagaugcccaagauggaccucaagggaccccacguagaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuuuggcguguccgcgccuggcaagcccagccuggaggccucucuggaggugggugcgcccaagguggaggcagacguggucccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggggccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccgaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggcccgccaggugggcgugaagcugcccgagggacagcugccggaggcagagcugcccgccgcccaggcugcugcugcuggggccggccugaagggccaccugcccaaggugcagaugcccagccucaagaugcccaagguggaccucaagggaccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuuuggcguguccgcgccuggcaagcccagccuggaggccucucuggaggugggugcgcccaauguggaggcagacguggucccgccccaagugcagggcgaccugaagaccccugaccugagcguucagcugccguccgccgacuuggagcucaaugucggccaggugggcguuaagcugcucgagggacaccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagugcccccgaccuggaggugucccugcccggcguggagguggacauccaggcgcccggugccaagcuggagggggagcuggcccuggccgacaaggacguggcugccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugccguccgccgaccuggagcucaaggccggccaggugggcgugaagcugcccgagggacagcugcccgaggcagagcugcccgccgccaaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccaggaggccucucuggaggugggugcgcccaagguggaggcggacguggccccgccccaagugcagggcgaccugaagaccccugaccugagcguucagcugcgguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcucucccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugcgguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuuuggcguguccgcgccuggcaagcccagccuggaggccucucuggaggugggugcgcccaagguggaggcagacguggucccgccccaagugcagggcgaccugaagaccccugaccugagcguucagcugccguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcuggcccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugcgguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaagggcgccaagggcgaggugagcgcccccgaccuggaggugucccugcccggcguggagguggacauccaggcgcccggugccaagcuggagggggagcucucccuggccgacaaggacguggcggccaaagacagcaaguucaagaugcccaaguucaagaugcccuccuucggcguguccgcgccuggcaagcccagccuggaggccucucuggaggugggugcgcccaagguggaggcggacguggccccgccccaagugcagggcgaccugaagaccccugaccugagcguucagcugcgguccgccgaccuggagcucaaggccggccaggugggcgugaagcugcccgagggacagcugcccgaggcagagcugcccgccgcccaggcugcugcugcugcuggggccggccugaagggccaccugcccaaggugcagaugcccagccucaagaugcccaagguggaccucaaggggccccacguggaccugaagggccccaaaguggacgugaaguacccccaag

SEQ ID NO: 6861 - RNA, 1969 nt, Mus musculus
ggccaagcauauacaaaccaucacagcaugacacucucuuuggauucagaucuggaggcauaguggucacaaguagcuuaggcccaugcaagguaguacacacuuuuaaucccaggagaugaaggcaagcacaucucugaguucaaggacaguccgggacagagcaaauuccaaauccaggcauggugguacacaccucugggccacgucggcuggaggacgauguaaggaaguuggaaggaggaaggcucacucucccucaccugcuugcacuuacuugccagcacaucuguuagaaucugcauauucaggauuccagcuuacacagaaaaccagaugaaacaacuacccucauggacuucccauucacagaugcccauuguuggguuagcuggacugcaaacaguaagucauuacaauaaauucccucaauguagagaggcaacccauaaguucugugauucuagagaaccugacuaguacaguuuccuuuggauucuuagccuuacuaauaaaauaauuuaaaacuguuucagaaagaaggucauaaacaauuuuauuaaacuuagaggggaaaaaaaaaagacaggauaaacaagcugaaaaaccuguggccuccaagaggagaugagaaaacugucuuuuaagucgggcaaggagguaaaaaaaaaaaaaaaaaaaaaaaaaaccagaaagcacagaaccucaggaaaacugugucucagggaaacugugccuuaggcuuuuagccaguacccaaaaaggagaugaaagaaaugaaaauggagcugaggggguucagcaggaguuuagcaccaagccucgaaccuaagaucccuaggacccacauguaaaaauagcguagucaggaaccccacuacacccaaggcugcaccuggcaaccagaacccagugacaucgcucacucaagauagucagacacaguccuaguaccccauaucuacuggacaguauguaagcagagaccaagaacaaugcucuguccugcacaucuggagagaagccacccugauuugcccugcagcuggagagucucccuaggauccugaaccuuccaggaucagagacuuauguuagagccuggaccugaccuucagcuaagauaccuagacaggugagcaguguuggggagacaggcuuaggaccacauaggaauugagagugugaaugacccucagcauaaugaaacauaacuuuuguuacacuacuuguuauacuaacuacacguuagcuuacucaagacacucagggauuaagaauacuugcuguucugacaaaggaccugauaagguuguuagcacccacacugaagcccacaaucacuuguaggcucgaacaugaaauacagucauacaugcagacaaaacaaugacacacacagauaaguaaauccaaaaauaauaguaauucaaaagaaaaaccaugcuaguauccaggucaaaguuugauggcaugccuuuccaucaaauaaagggcaaguaugcccaggaaugggaaugcauuagugagcuuaggugaaccacgaagccacaaagacacgaugugauguguaugccguauacuuucucuuauggcaccgguuuuucucucgaacgcucauucauuagaagucccggucggaaggaguuuccagucuuuuccagcaaacgagcuugcucccugugcuaauguggcauccccacugaacauucugcauccacucaccuucccaccucacuccaucccccaaccaacgccguccggacuugguguccucguuaagaucuugugcacuaccaggaccuuauauuuuaauuuuucucaguuggaacucgaaccaggaccuguucagggaugccaccaccgagccucguucaacccuucuaugucucagagaagguguagacaucggccaugcccagggcuggcauuaaccgccccgcugugagucaggagggccaggauaacg

SEQ ID NO: 6862 - RNA, 2536 nt, Mus musculus
ggucuucucaguggaauugagaaagagagugccccacuuaauuccuacagucacuuaucuacauuugguucuuguucugugaaaccuuuauuacgaaaauucacuuaaauaggauggaacuauuuuaagugacuuuucagcaauuuguggcuugaaugggaggccucaacguaggcugaaaucacuuagaauccaaagggggagggaaauccaaggguccugaagcuugggugucacuggcagggaucggggacgaccuuggacccaagucuuccuuccaccuguggaaugcugucuagggucagcggacacgggcugugagaagucaaguuucagacucuggcugauagagaaagccaagccuugaaugguaucaguaaggcagcuggaaguguccugcaccuccacugcacuuacuguguggacucuauggaggaagagccugguggcaaguccacuccaaccuuacgccucaggcauagaagaugagcucuggaaucuguccacccugaacuccagucccauugguacugucugaggagcacuggaacuggaaggcuaccuucccacacugcaccucugucauuccuucuugcccaaaguagcugagcucacugccguccaggacagcacuggcaguguagaagguguccugcuccaccuggaccgggugcucaaaccagacugggaaaguguugcuggauccgucugaaacaaacuuggugagguucugagccaggaccaucccuagccgcuugaguucaaucuugacgcuguacucagccuucccagagcuggacccauacaagcccagcccagcaaugaacacccuucuguccacugcaaacuggaugcugucacagcguccacgguaccuccacugguuacuucgguaggcagaagacuggaagcgguggcaccuuuguggagcaaggcccuuccucuuggucagggggaagucaaggaggggcuuuuuggcagcaguguaccaaaggaagauguugugggucucuucuaaggucaggaugucugacugggcggcaccauuggcaaacuccucuaaggucauaguuggaauucggaccagguagagggcucuucccaaaacaugccucuuguugugaggagugacugggaggcccugucucuuacauucugccucagcccaguucaggacggccucgaagaccacagccuccuugguauugagggccucccuggucacaaugaucuccagugucugccggucaauuucacagaagccuucagaccucagggccauuucagcuugugcaucaaugacuucccagcaucucugggucaguucaggcuccucaaacagucggcucugggacagcaggacacaagcauuuuuggcuuccagacuuguuuccagaaaguugacgcaggccuuggccagggcaggcacgauguacuucuuagcagcauacagaguggcaagcacuguguccgccuccaggucgaucucaucgcuguacauguaccugcguaaggcaggggcucuccuggggagcugcaagggcuccccugcacaaccucugggguuguagcaaacagguaggggaccauuggaagguaaccaccccauccuuccagacccagcgcacagcacuuacuuuagcaagaccaagaaggcagcaggcuccacaucgggaauguggauuucugacuucacuuccgcaagauccccguagaacauggcauagaagacggagcugccgacagccaagacauacuguggaugaaagaaaaccaccugagcuacagggcaguaaacaagguccagggagacgcaccuagccaggcccaccaggggacagggcugcgcccuuacccaccuugugggcgggcacacgccuggcagcccccagagcccccacgaugaaguggacgucagccaucagcucguuguugaacaugagcgcauuccugcaaagggcagaggcacacgggcuggaacggcgcgcgcccgggcuccagagcccgggggcgggcggcggcucaccucucgcgcagcguaggauggaaggacugccaguuggggcucucgggauuguuguugucuggcaagggcggcgcgggcaagggcggcagcggggcgggugccaggcagggcgggcagcaaagcccgaccuucgugcucucggcugcgccugccgcguugcuguuggcgaugucgguggcaguagcugcagagggacuggcgggcggguacaguuccgcggccaucuucgcuacugccggggcgggcuccgcacuggucggugcugcgccgcgcgccuucgcgccgcgacggggccugggaaacggcucugcgagcaccagcagggagguuaggcacugcgccacccgcccaugcaggcaggcgagcggcagcagcauggggccacgccggcccugcccgcuacccacccgcaccccacaccccucaccgagcccgcggcucggccgcagggggcgccgucccgcccguacccacugcugcggcgccggcgucucucgucacugugcguca

SEQ ID NO: 6863 - RNA, 56812 nt, Mus musculus
caggcgcgcgugcuggggacggccgcggggcaugcugggccagcgccuucggcccguugcuaggaggcggggacgccggcccuccugggacccaagucgcagcaggccuggcuggcugguagagcugagcgacggcggguuuaucuuccuccgguggcccgcgccugcugggccgaggacacgcggcugucccggccucgaggagcgauggagccugggaaggucggugcgccgcggggcccagccugguccggcccgcgcccccauuaccccccucuuucuuggcaauggagaucggguuccuccugggccugcacuuaggagagagcuggaggcggaguuugggucgaggucucagcucugcuguugccucucacuucuuagcuccaggugcgguuuguggaggaguuucuggacucauccagaggcgaggcugagugucaacuucaggaaggcacaggacuccugaaaaaaaagugccgcaaggugaaacaugagucucguuaagguagaagguuguugacuuuaacuuugguaggucguuuauaucaaaaauccaucucuuagguuuuccgguuuggugcaauacagguuuuuaaaguauguccuuauggcccuauuaacaacucaugauaaauccuaugaauuaccuuagcgucuauuauaaaggacccuugucugcuuuaauuaauuuaggucuucucuuuccaucuuuuaguuuacuggguaaaaguuugcccauuuuguugaucuuucugaaagagucagcucuuuaguuucauugauucuucguacugguuuguguuguuacaguuucuuugauuucaguccugaguuugauuuuuuuuuuuuugugccaucuacucuuuugggguuauuauuucuucuuguuuuucuagggcuuucaggugcaucaugaaauuaccaauauaaaaccucucuaguuuuuugguggagacacuuggugcuaugaacuuucgucuuacaaacuguguucauugugcccuguagguuuggcuauguugaauuuuuauucaguuuuaaaaaguuuauuuuccucugugauuuuuguuuugacucaauuuucauucaguaguaaguuguucaguguccaugaguuuguuugguauuguugauauucagcuuuacuccaugguggucagauaggauucagggugcuauuucaguuuucuuauauguauugaggcuugccuuguguucuaauaugugaucaugagcuuuggaaaagaaagaauauucuuuagaguuugggugggauauuuguguguguguuugucugucaauuugacuuacgauauuuuuuguuuguuuuguuuuuucauuugcuuuuuuaaacuccagcaacuucucuguuuaguuuuuuuuuuuuggaugaccugucuggauggaagucagguauugaagccaugcacuaccacugugguuuuuaucuguaguaguguuucuuuuaugaacauaggcacucuugugucuggugcauaaauguuuagaacugccauuguuguguuuuauaaaaaagaaaaagaagccagggauauguuugguaggggugcgguguggugugggggaagagugucccucugcaggcccaugcugaggcaucccuucccccugagguaaagguauaguauagaauagaguuuacuuagggcauggugaggggaguuaggaaagagagggagaggggggagagggggagggggagagggagagagcagccauuaacagguggcaagagaggaaggaagggaauggggagagaagggacagaggauaagcaguuaagagggcaagaggagagaagagagugaggagggguaagccgccucuuuuacagugagucaggcacaccuggcuguugccagguaacuaugggguacaaccuagaagaaaugcuaacgcaauauuauuuuuuuccuuuugauagauuuuuucccccuugaggaguauauaauguccuuuucuaucucuucugguuaguuuuggcuugaacucuccuuugccacauacuaauauggcgacaccugcuuuuuucgugggccgauuugcuuggaauaccuuuucuagccuuuuuaaaucccuaagguaaugucugucauucauggugagguuuguuucuuggaugcagcagaaagaugggcccuguuuucuaauccagucuacuagucuaugucucuuuauuggguaauugagacuacugauguugagaguucuuaaugagcaguauuuauaauuccuguuacuuuguuucugugggaugaucuacucuaaugggauuguuuaauccuuaaauccucugguguguccucugguguaugcauagucaaccuucuccucaguauguaguuuucuuuuagugcuuucugaagagcugcauuaguggacagccauuuuuuuuuuuuguaucauguuuuuuuuucugaauggauugugauugauaguuuugcuggguagaguagucuaggcugucaucuguggucucucagaccuuguagaauaucugucuauguccuucuggcuuuuagaaucucuauuguaaagucaagauguuacucuagugggccugccuuuacaugugacuucgucuuuuucccuggccuuauuuauauucuuccuuuguucuauacauuuaguguuuugauuauuauguguuguagggaauuucuuucugguuugguauucugcauaccuguuauaacuugauagagcaugucuuucuuuagguugggaaauguuacuuccgugauuuuauuaaaaauauuuacugugccuucaaugugggucuccucuccuucucuacauggauuauucagagguuugauuuauuucauaguguucuguuuccuggguguucugcgcuccaauuuuauuuuagguuuaacauguucuuugacugagcuauccauuucuucuaccuuguauacagaccuggaauucucuuuuguguccuaacccacugggggggggggggcuuaccuugagguuuuuguuugagauccugagucuuuggauuccagauuuauuucaguuuggguuuucucuagugauucaauuucuucauguuuugaauuguuuucguuauuuauuugaacugucugguugugugugugcacgaauguauguauacguguguucacagucuucauuaaagcuuuuauucacauuccucuuuaaggaccuugaacauauuugcaauuccucuuuugaaaccccugucuugugcuucagcuaaguugcuuuucuccuugucugugacagaggguugcuggcuucuggagaaggcguauugucuugugguucauguuuauguuuuuauacugggaccuaggcaucuggaauucagauauuugaaguguuucuugguguagauaucugcucuagcuuuuauauuguggguguucuguaugguugcaguugcacacccuggguccuagccaauauugguggcuguggaguuccugguugacagugguucuaguucccagccaaacaaaguagucauggaguccuugguagagagauauccugugggucaguggggagucacagagggguggaaaugggguagaaggaaagggugagagggcaucaagaaggaacuagggggacccuuauucugucccaacaggccaagugccuaguggauagagguggacuggaaggagggccuccugugggcaggcuggagcagaacuaauaaaucuguacacgauggaauugaugacaggaagggagaaagggcuauacauaugggucucucggaccugagccccauccuagugcagucguugugggguccccaguagaaagugagucugcugguugguggggucacaaaggagagggauaggcuagcagaaaaggcuaaauggggccacagggaagaucacgggggauacugggucuguggcagaaggcugaagcccuaggggauggagggccuuuaaacaugaguucuaagaacaugggcuuaguuccucacaguuuuuuguuuuuguuuuuuuuguuuguuuuuuguuuuuuaagacagggguugucuuuguauuucuggcuguccuggaacucuguacaccacacugacuucaauucagagauucaccugccucacaugugcccucauuucaccggcuccucacacuuuugaggcaagcccuuuacugcugagcugcuucuccaguccccauuacuuuucuugacagguuuaugagaucaaauaguguauuugacucaguauagcaucugauguacguuagaugcuaaaugaaaugugucuuacuuccugguuucuauuuuauaugaaaaaaaaucaucuuaaauuuaauuguuagaacaucauugaucuuuuuauuuugcucauguauucuguggacugggaauuggagaacacauaucccucaggcugcuuaauucugcuccucugacauccggaguuucaacuaggcagauguggguuugggucuugcacauggugacucauuggguggacugccacacauucuggccacugagcuggcccugcggggccucugcucugcuuagcuggaacaucugcauguggccuuucucccacaaugcaauuuuccuucuuuacaucugagcuccuguacuagguaacccaaggaaggccaagugggagacacauucuuugguagucacacagcauucuuuuuggccugggaugggcuaaccacagcagaagcagcagaaaccccagacucagaccugugcucaguguuugggaggacauaguuuacuauggccuauauaaaaaaugcuuuccggcaguuuguuuguuuaaauaaaaaaauuauguguauggguguuuugccuguauguguguugucuguguaccgcauacuugccuuuuuucugaggaggccagauacugaagugagagcccuuggaacuggaguuauacaguuguaagcugcuguguaggugaugggacuuggacuugagcacagguugguugguuuuagaaagaagccacugcucuuaaaagcugagcuaucuuucuaguccacaucugacauguggucacagaaugcuugcccuugcucugguacuuaucugccauuguaacuuugcuuuuuuuuuaaauuugguaauaguagcuuuugaaauagccaaaugaaugggcccuguaauaauuauggauuacuuuagugaguaauuuaaacaaaucuuuauuuguaucuuuccuguuuucuuuugagacagaguaucccucugcuucuaaggaugccuucaaacucuguauucuccagcuuugucuacccaagugcugggguuaccaguuugggcuccauucuuggccuguguuuggaucagcuuucauuucaauaggaagcaaaacuagaaaauaaaaagcauuuucuaguuuauuauuuuugauauaaauaguauaaugagaaugcaaaauuuguuauuuaaaagauuucccccuaggaccuccuuauauugcccaagcuggcuuggaauuuagagucuuccugccuaagcuuucaaagugcuaggauaugggugugugcugccaugccugacuugauaauucuaucuuuguacuuugcuauuuagagaagaaccaaagaugauacuuggaaagcagaugaccucagaaagcaccugaagguaauauauuuuaaagacuuggcgugggagucacaugaaaguccgugggcuuuuggacagugaccagguucacagcccuacauagcuuugcuuacaaguucauuucagaggcaauuuugacucaaagaggaagguagguaguuacuacuucuggaaaauuuuaggguacaguccugcacgggaacugagguguccucuguguaacccagucugguagucccaucaguuugaauuuugugauugagauuuaguccuccugaagauuuuauaauaaagaucuugauuaacuaauuaguucauuaucuuuuuaaaggauuuauuuauuauuauucauaacuacacuguagcugucuucagacacgccagaagagggugucagaucucauuaugggugguugugagccaccaugugguugcugggauuugaacucaggaccuucggaagagcagucagugcucuuacccgcugagcugucucgccagcccuaguuaauuaauuuuacaacagggucucccucuguaguccaggcuggccuugaguugaagugucugauucuccugucccauucuucugagggcugggguuauucuugacacucaugcuuggcuguauuguuguugacauagggucucacuguguagcccuagcuagccuggaacuuauacaaaccagauggucucaaacucacagagauccaccugccucugcuccuugagugcuagaauuaaaggcaugagccaccaugcccagauagcucuauucucuauguaguaaccaagugguucuugccucagcaacuuuaagcuacaucuucauuacauccuucuauuauagguuauauuuuacuguuucacuuuuuugcaguacuaaguuugaacucauguuugugagcuaggcaagacugcugcugcauccugccucccauguuacacuucagguugauuugccaaucagcucguacauggguuuguaguuaccauuuguagaaauguuauguagagcugcaguuaguaugcuaagaaucuaccuuccaucuugcuggacugagagggccguugcagccagugauuuuuaaagugcuguagcugagccuuucugcccagacagugacaguaaaugcaugugugugugcuuucauagugacagagggucuucugugcuguucuaggugcagucaggcagucccaaggaggagaagaaacucagagaaaagaaggcgcacaaggacucagagucggccgcuccugaauacagagaacacaagagcagggacccagaccgagaggcccggcacaaggagaagacagcugagagagaccuguacaccuccacagaacauccucguggggagagagaccgggagaggcacaaggaaaggaggaaagaugcaaaagaccgugagaaagacaagcuaaaagagagacaucgagaccaagaagcagagaaggcucauagucgaggcaaggacagagagagagagaaagacagacgggccaggaaagaagagaucaggcaguccauggccuaccaugaccucuugagucgagauaugcguggccggcagauggcagagaaaguggaaaagaaaggugugucucugcaucauggacuuuaucuauaguguaacccaagcugcuuguuaguuugcuagcucuguuuccuuuguuguugacugauugcucaguugauugacuaaugugcgugcgugugugugugugugugugugugugugugugcgcgcuccugugugaaugucugugcaugugugucugugugucugcuccugugugaauguguguucaugugugaguguguguguuugugcgcauguguguacauguuugugccacacucuggagauuagaggauaacuuucaggaguugguucuugccuuccccacugagauggggucucuuucuaccacauuaugcccuuuaggcuagcuggcugauucuccucuccuuaccccacccccccuccugcuguaggaauucugggauuauaaaugugugcagcugcauccagcuuacauggguucugggcuugucaagcuugacuggcugaugcuuuuaugcgcugagccauuuucuuggcuguauuuuguuuaaaaguucucacuguuugaagcauuuucccuuguagcucaucauuuauuuucugagguuuucguggauacuuuaccuuuggauuuaggaaacagaaagcuacaguuuccuauuauccacacuuguuacuaugaacuuuaaaaaaaaauucagucaacaaaggaaacuaguauuuauuaguguuuuuaacuuuugaaauucuuuuuaaaaaauuucucaguagauguuaagucccugugaauaaacaaaaauaaagcacuuuaauaaaaguauucuaccaaaguauuaguuuuauugcaguauuggggauuuggggauaaacucagugcuguuguacauggugggcaaagacuaccucugagugagagcccugcccuugggguuccuuaagugugagcuaaugaggugucaguggaagcuggugugucuguacucggcaguccuuuggaugugacucacccucucagcagccacugcauaaucggcuuccguuuccucucagacguuaucugugaggcccaucucuacuuccagggguacauagacauuuacccgcucgucucaguaacaaacagggagaggggaagaaccguaucugguucugagccugccguauuccccuucuacuuuaaguuuagauccugacacuuguugcccuugaguuuugagaauguguuuuaguugaagaagguuuuacgauacaaauuaaugaacauacgugcaauaacaguaaagccugcagcaaguuauuaggugguccucuugguaagauauaauuugugaauauuaaaaauaugcuguugugcuuuuuuuuuagcaaguaaaauacgaacugaggaaagagaaaggagagaugaagacucugaaagaauagaugaagauagagaaagaagauaccgagaaagaaagguaaggcuugcaggcccaauucagcagagcacuugggaacugaagaaggaaaugaagcgucuggauaguuucuuuuuuuuuuuuuuuaaauucauuuuuaacuuauuauugacauguaauaauuauacauacuucuagggcacagugugacacuucaguguauacaucuaguguuuaaccuccacaauaggaugauugguguguguaucauuuugucuuagguggggucacuauugcugugacaaaaccccaugaccaaaaaacaaucuggggaggaaaggguuuauuuggcuuacauuuccacauuguaguccaucaucuaaaggagucaggaggaaacucaagcagggcaggaaccuggaggcaggagcugaggcagaagccauggagaggugcugcuuacuggcuugcucagccaaugggcugggcccuuccccaucaaucacuaagaaaauacccuacagcuggaucuuuguuuuuuuuucuuuuuucuuuuuuuaaggcauuuuuuaauuggauauuuuuuucauuuacauuucaaaugcuacucucaaagcccccuauacccuccccccgcccugcuccccaacccauucacuccugcuuccuggcccuggcauuccccuguacuggggcauaugaucuucgcaauaccaaggccucuccucccacugauggccgacuaggccauccucugcuacauaugcagcuagagacacaguucugggggguacugguuaguucauauuguuguuccuccuagaggguugcagaccccuuuagcuccuuggguccuuucucuagcuccuccauugggggccuccuacagcuggaucuuauugaggcauuuaaucaauugagauucccuccuuuuaggugacuccaccuugugucaaguugacacagacuagccaggacaccauccugggcuaaagaacauuagaauggauucuuccuguacccuauguggguguuuacuucuucuucuucgucuuuuuuuuuuuuuuuuuuuuugguuuuuuugaggcaggguuucucuguauagcccuugcuguccugaaacucacucuguagaccaggcuggccucaaauucagaauuccgccugccucugccucccaaaugcuggguuuaaaggcgugcgccaccaugcccggugcauggguguuuacuuauggaaauuaaccacuguucacuaauuacuacuuguguaacacuuaccuucuaguggcuagucuucaguuuacuuuaaaaaauuaacuccuugucaggcauuuauguugcuuuuuuuuaauuugaggagucuuuuauuuuuauaaguaaagggcaaauaaugacauagauuaagucuguccuuuggugcacagaaugcuuaacaagcccucuuucuacuucauguaauaguugugauguaauaguuguuugggcuuuguuaugggucuuuaaaggaaagguccuuuagccuuagcuuuuaaauucucauaguuuauuuggcaagugacuuuagguagugaucugccuauaaaacugaggaccucaguuaaacauauuucuccagaaauaaaggaaaccaguuacaaagucucugcagcagggacuacagggacuacggggacaaauuaaauugaggggacaaauuaagaaugugguggagaaacaaagaagucaaaugcuguuuguuuugcuguguguauuagauuucugucacuauaauagaauauccaaggaauucaauauauauauaaaaaaagguugacuuugauucacagaauuggaaccuucagcccaugacuggucggcccuguuguagagagguagcacguuguagggaugcacagaggagcaaagcuacucacaccccauucagggacuagaaagcagagggaggaauaggaaaacaaagcccagaguccccucagccuuucacauggcugcacuuccugcagguagguucacaguaccucccacagugacacccuggagaccaagccuuaacccaggaccauccagacccucauccagaggaauuuagacaauuuuuaagucagauagaggacaucuagguuuagaugaucuugcuuuguagugcuugguguuggugugaaugaggauuauucuucuucuggaucaaggauuuuagggagacagagguguacccacugugauuuucuuucacuguaauauaccucgauagcaucaugccaguguaauauacagaagcagcacaugucacuauaauacacacaggcagcacgugucacuguauacacacaggcagcucaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacaagcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacagaggcagcacaugucacuguaauacacacaggcagcacaugucacucuaauacacacaggcagcacaugucacuguaauacacaauggcagcacaugucacuguaauacacacaagcagcacgugucacuguauuacacacaggcagcacaugucacuguaauacacacaggcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacaagcagcacaugucacuauaaugcacacaggcagcacaugucacuguauuacacacaggcagcacaugucacuguaauacacacaggcaacacaugucacuguauuauacacaaggagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacagaggcagcucaugucacuauaaugcacacaggcagcacaugucacuguaauacacaauggcagcacaugucacuguaauacacacaagcagcacaugucacuguauuacacacaggcagcacaugucacuguaauacacacaggcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacaagcagcacaugucacuauaaugcacacaggcagcacaugucacuguauuacacacaggcagcacaugucacuguaauacacacaggcaacacaugucacuguauuauacacaaggagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacagaggcagcucaugucacuauaaugcacacaggcagcacaugucacuguaauacacaauggcagcacaugucacuguaauacacacaagcagcacaugucacuguauuacacauaggcagcacaugucacuguaauacacacaggcagcacaugucacuauaaugcacacaggcagcacaugucacuguauuacacacaggcagcacaugucacuguaauacacacaagcagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacaagcagcacaugucacuauaaugcacacaggcagcacaugucacuguauuacacacaggcagcacaugucacuguaauacacacaggcagcacaugucacuguauuauacacaagcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuauaaugcacacaagcagcacaugucacuauaaugcacacaggcagcacaugucacuguauuacacacaggcagcacaugucacuguaauacacacaggcagcacaugucacuguaauacacacaggcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacuguauuacacaagcagcacaugucauuguaaacacacaggcaguacaugucacuguauuacacacaagcagcacaugucacuauaaugcacacaggcagcacaugucacuguauuacacacaggcagcacaugucacuguaauacacacaggcagcacaugucacuguauuauacacaagcagcacaugucacuauaaugcacacaggcagcacaugucacuguauuacacacaggcagcacaugucacuguaauacacacaagcagcacaugucacuauaaugcacacaggcagcacaugucacuguaaugcacacaggcagcacaugucacuguaauacaggcagcacgugucacgugucacuguauuacacaagcaguacaugucauuguaaacacacaggcaguacaugucacuguauuacacagaggcagcucaugucacuauaaugcacacaggcagcacaugucacucuaauacacacaggcagcacaugucacuguaauacacaauggcagcacaugucacuguaauacacaauggcagcacgugucacuguaauacacauaggcagcacgugucacuuuaauacacacaggcagcacaugucacuguaauacacacaugcagcacaugucacuguaauacacacaggcagcacaugucacuguauuacacaagcagcacaugucauuguaaacacacaggcaguacaugucacuguauuacacagaggcagcucaugucacuauaaugcacacaggcagugcaugucacuguaauacacacaggcagcacaugucacuguaauacacacaggcagcacaugucacuguaauacacacaggcagcacaugucacuguauugcacgcaggcagcagcguguguugugacccucagcucacguagcuuucuuguugguuaaagcugcaguauggagacaguaaggagcacccccucagcuacuggcuguacaaggaggacggcgagaagaagcacaggaaagccaaagacgcagaucgggagaagaggcugagagagaagagcagcaugagggagaaaagggagaggcacgcaagggagaaggggagcucgcucuccgacagggaaguggaggacagacacagagagaagcggcacaaagaaggacugcacuaugaugacgagaggcgccgaagucaugcagauaaaaaagagagaucuucgaaagaagagcacaagaaaagggaauugaagguauugcuccacgggauugucuuuaugcucagccugaagucaacagguagcgcuuguguugcucagaguagccaguaaugcucagucuuacucucugcuacccugagcgcuuuugguugccaugacgaagcaucagccuuaagucaagggaggaaggacuuauuuggcccauguucucagagguuucaguucauuaugucagggagggagagcacaggccugugcugcaggcuucugaggcccuagcacaugccacugugcugcccucauuuagggcugccucuccccuaguugaccuccacucuuuggacacaucuucaugaucgucugaugugcuuuauaaauauugucaaugcuucuccgucuaaugaaguuaacauuaaccaucacaaugaggguggcauaugaaaagaugaccuaaaucaauauuuuguaacuaauagagggagaguaguaauuguagucaugugguucauguacugccccuccccucuuugagaugaggucuaacuaugcugugcaggcugaucuauagcuuuggcuuccagugacccugcuaccuccaucuuccaaucagccuagauuacuggugcuugcuaucacacccagcuguuaaaauauauuuaacagaaaauugaaaaucuuuuauuaaaauuugaaauuuaacauuaaaaagguaggugcuacuuugaaaggagaaauuaagugauccaauuacaaaguaguuugaaucagaauugguaaagagguuuagaaaaaaugaaaaaaaauguacagcuacuuauugccaagguuuuauuuucuuccuguguauacuugacuucaucaguccaguugcuuaauguuuucagagaccacuguggugacuuuuguucucauacaugcacuuugaacugcugcuuuuauagaaccugaaacaguuguccuguaucagucacauguauauuguauaauguuuguuauagaguaaacaccucucaaacauuuaucauuguuuauggugaaagcuuaaagacuuuuuagcuuuuugaaaguguaguguguucuuacaagggcaucucuuaaaauaauccuaaauuuuuauguuuuacaaauaauuuuaaaucagcaucacaugaauccuagaaaacacauauuuccaacuucucugcaauauuuaugauugacuuuuuuuguuuguuuguuuguuuuguuucauguucaacuuuuguuucuaggaacuugaaaaagaagacaacgauuuagaggcuacugggccugaugaauaucugcccaacuuagaagaugauuuugugguauguauaaaauuuaaauuuuucucaguuuaacgauuuggucuuaaaaauuagugcagauguaguaauuauuuucucucuuguucgugucugguaagauuugauauagaucugguaguuaccugugcaaaguuugcuauauucccaccaggguuacaguuuaaccccauuuuaagugcacuguauucaaacauuuauauguguguaacuauaaguacauauaacacuucacaaucuuagcacaaaguuuguacauuaauacuuaugaguauacaugguucuauauccugcgguucauuuucagaaaaacaaagguagcaguauauuauagauuuacaguccagcaacauuaaaaucauugaauuauaauuagcuauaagaguuuugcugauuuuacauuauaaauuguaauguuuuguuguauaugagcaucaacucacuugccuuaagccaccccacaccuuccuauugcuuguaggauuaugaagaugacuuugagguuugcgauggagacgaugacagcaauaaugagcaugaagcuagagaaaaggccgaagaacuuccucuggcccagaaaagggaaauacaggaaauucaaaaggcgaucagugcagagaaugaaaggguuggcgaguuaucuuugaaaauguuucagaagcaagguuggacggaguauacaaaggagcccuggacagguaugcauggggacacuuguaacugggaacguguucugugagcucugguaacagugguuacgagcugacacgagcuauccuccauguacaaccaugcauauuguuuugcacugcuaccagccucuuguacagccuguaggcauguguucuuguucccuuugguaauguccucgaauuuucaccaaguaagaauuuuaauuucauaaaggaaaucccuugagaaaggguucaauagccaguaugcuucccaacaugcugugagugccaucucaggccuauuggccaccucacagggcugcucucuguuuuguacagugccuugggcuucuguggagcuagcaaggccuaucaccugcccuguggaacaggucugcucacacauagcccaaaccuccugccaguaagaucuuguaguccacaaugaaucaaguuaauagcaguuacuuacuagugcaguguaauaaugcaccuggaagucuggaagaguaaucggcagucacgcugugugcugcugcagaaguagccagcuauugggcgguauggaucguugguguucuauaaguugauagcuagaaguacucguuugaugccugggcuaauggaccuggcagaaggaaggacccagucuuuuuacuguguggauuguacuaugugguacuguaccaugguacccagguacugguacuauggccucagaguggcaaggcaguguauuuaucuuaggucuguauaauauauccaugaacaaccuuuucauuuccuucauuuauguuuggcaugauaucuuccuuuacucaguuggcaagaugaauuggccacucccacgcacauugcucccuagaaaggaagaacuaugauuuuggccccucaguauuaagcuauugcagggggacaugagagaaggguguguacagagacaaagucauguucucuacugucgguaguaccucagaaguuguuuaauggugcucauggaguuuuagaucucaacuuuuagcauuggcuagcagugugaccuuucuguugcugugauaaaauagugagacuauaauauaagugccuuagggcaggagauaauuuauuugcuguacauuaacaggcuacaguccaucacagaccauacaagucaaggcaggaacaagcaggagauuggagcagaaacccuggcagaaugcugcuugccagcuugcugucugacucaucaccaggcccaugcuuaacuagcuuccuuagcuagcccaggacuacuagcuugggaaugaugccaucuguagugggcugagcucuucuacaucaguuaagauagucaagccacgccuucacagacauguccaccaauaaaccugauacacacaauuauucaguugugacuuuuuaaaggugauuauaggcugugucaaggauacacacaauuauucaguugugacuuuuuaaaggugauuauaaggaugugucaaguugacaguaaaugcuaacuaggauagauaguuacuuaaccuuucuacuuuucugcuucuguaaggguaagaccucccuggauuguuaauuacauaaguuaauauguauaaugaacccacaagcaugagugcuaggcgguguuggccaugaccacuguuuaaucaccacauuuguagcgaacuguauccugcuuggcuaaccagggcugucauagaauacucugcugcauccuggggucuauuugauaauaagcuggucauuuuacccuuuucugcgacuauaggaaacugauaaauaccuuuugcaaugcgucagagucauccguagugcuugaaaaaguuuuuacaacuccagaaggcauaucuccaucuguuggugaguuagugccaaaugaugaccagaggugucagcugugccccaguaucuauaucugugacuguaaagaccaagauggguuugcucauuuuaaaaucugaguaauucucucaaggucuguuuggagcuuuguaguuggcauacugauguccauggcauggauucuuaguagugccagaacuuaaacuuuggucuggacauggucuccuccaaaaucauauucucuccaucacuggucuucugcuuugagggucagugcaguuaugugcacaggccucugaagguuuagaagaaucacagauggcaggucugugucuuagacucuuguuaaacucaaacacauguccaacaguauugaggaggcagauuaauacauaauuaaauguguugacaaguaaaaccaggaagcuuacaggaacuuuuagaggaacgugguggaucgagggaugauuguuuccaccaagaaggauagccuaagaugcuguuuuucucccagcccaauaauaaggccagcauaucuuuggaaaucuugguauucugaugagacacauaccuacacauugauuuguuuguuccucuuuuacauuuuaagugguucaucucaucuucauuuauagucauuucugccuuuuaacuauuuuguauuuaugcacuacuuuucuuauucuaguguaucauucuugucuguggucacacaccaccuaccucguuucccccaaaacacuggacuccuguagguguagguaauacucagcccaguagauaaacuauaauuucucuccuauuugcauccuuaagauuaaguuuagcuuguaaguccggcacagggagaggguaguggagaacaaucacagcagucgguuguaaccaaagcuggcugggcggggacuuggcucaguuaaaauaguuuacgguccucugauuaugcauccuguguugaagagagaugauggagugaugaucuaaacugagaugagugacaugggcacugggauauacuagacuacuccugcaucuucauggccuugugaauggagcuucuaccuggaaucuuucagaagaguccgacuucauugcaguugaagauuugcuucagguguugcccuuccuccguagugagcuucuuccccugcucaagccugcguggccuaaguguuaucugaacaguuaauuuuuauuuuauguccaugaguauccugcguauauacuuaaguaccauaaguaccauauguguacuugguacuuucagaggucagaagaggucaucagauucccuggaguuacagacaguugugagcugccacaugaguguugggaaccaaaccagguccucugcaugaucucuucuagucccagaagugcuuucugaugcaacacugugcagucaguuugagcacauuuucuguucuugucccccacacaagcauagugccuucucccaucaugcaacagugcggaaacuuuugcagguuaugaugcugcagcaaauguagcaugaauuucuuauuuuuaccauuggucuuagcagccucaggauuuuuucuuuacuuaaauugaggacauucaccuuuuuauuucaaggaaacuccuuuaaauuuuuauuguguauauaugugugcauguauguauguauguauguauguaugugugugcacaugugugagggagugugugcuuguaaugguguucauguuagggucaaagggcaaccuucugaaguugcuucuuucuuuccaucuuguggguucuaggaaucaaucagguuguccggcuuguaggcaaguuucuuauuugcucugccaucuggugguccuagaagaagguacuaaggguuccucuuuggcacauucauauuguuuuccuguccuuuuagggcuaauuaaggguuucuugaguacuagcagugugacaccaagaaagcugauaugacaaugugucuguaggggcgagugacugaauugguggcagggagcacauacagccugccuauaccaaacuaugggaugguucauguucuagacaaaacguugugagauuuucaagcuacucagaacagaauguacuucaauucuuaucaacuguugacuuugacuuuggaauuacucauuaauaacuuugaggucacaauagacuuuagguaaauggagucuuagaaaugagaccacaggugagguuuugcuuuuucccccccccagaguaaguaggauaaugauaggaaccuauauuuuaugcauauauucauaaauaugucuaaaguucuuacuggugugauuuaucaauuucaauaaaaauuguccagugugauuguuaucuaugucuacaauuguggguuuuuuuccuugaaggaauuauuuaauugucacaaaauggcuuuuauuuuucuuaugcagaugcaaaugauuccccuucuagaaccccuguuuguggaauuuuuguggauuuugcaacagccucacaucgucagaagagucggagucaggcccucaagcaaaaguagguauauaaagaauuugucacaggguuguauguguguguuuguggaugaaacucagggccuuguguacuguaggcaaauguucucccauuuagccaaucuuaguuguagcuuuguguaaaugcauauuaauguacucuucaucaacauaaucuuaaaacuagaguuuuguauuuucauuguugaugguuuagggauugaacccaauauuuugaguauuaggcaagcaaucuccugcugagcuguauuccuauccuggucaauuccuuuacuacuacuacaguucuuucuggucauugguuagucugauuaguucacacccuuuuguguacaaggugcuugcuagcuaaugacuacaguacguucauggcugaccauuuuggacuaagccguggagcccucggucuguuuugacugcggcagaaucauaaccauacauuuagaugucugguggccagaaucuugcuagcacugucgcucugugguacugaucucuuaaaauauagguagaagcguccauaacccaacaauucuuguauuauguacaccugcaaaacuaucaucauguaagugauaaccaagguuugcuaccugcucaagcguuaauuagacuccuuuggucugccaccugcucagacauuaauuaggcucccuugaacuccuuucaacuauggcucuagccaugaguuccugcccugagugccuggauggcugaguguggggaaaugcuaaugcgggcagcccuauguaguggagaacccuggagcacucaccucauagcaggcuuucaaaugauuaaaguggauucugcaguggcugggggccauaacuuuuaaauucguccucccacaaaggcugugaccagggaugcuuaaccguaguggcuggagccacagagaaauguuacaagcaggguaacgagagaggcaaggaagaagagggcuuuuugucuugcuuucuuucccuugagaaaugacucggaaugaccagugauucaauaggaaaaaaaaguuaugcugucaguacaaagaugaaauguauuuuguuacuaagucagaagcaugcauucacacgcaaaggccaauacuucccuuauugaacagaugaaaugcuaaaacaacuacaguguuccaggguccauugagagcauuaacauaacaucuugcuuuuaucaacuugacaggcagaggcagcuuucuaugaugugucaaauacagcuacccaaugacagacacuauugagcagcauauaauuaucagagcaacauucuuuuuugacuagugaguuucaaaggauugggacagaacuucgaccauuuucuaugaugaacaguuuguauugaagaaacaaacaaacaaaaaaaaaccaaaaaaccaaaagcucuucagcuaaaaacaacuaggaaagcugaaucuaaagcaacaguaguaaccacaaauccugagauggcugcacaaaaaacuaguagcuuagaccaccaggacgcaaagggucaagcuccacaagagaaguguagugugccaauccuguguugccucuauuuuccuauucuagggacucuuuggguuuguuucucaagguggccaggucaggcagaaagcaagaguagggaacugggacauucaucuacgguggggcgauggaaaaugaaguuuaggacuuugaaguaggagaauccuugguaaacaccccugacuuugguugaaguuccuaaggccuaugugcuaggaagaaaggcagguuugaaagaaucuaacaucacagaacaugacacugagccucucaucaucccaguaggaccuguugagugugcccuauuuggauucugauugccaggaagaaacuaaaaagaaaauacccaaaauuucuacaaaauuuucuauacaaugucuaauauacaguaaauuacuagacauaucaggaauuggaaucauauaacucaaaccaagaguguagcacauucauguaugauccugagagcaaaucauuaguucuggauuuuagaaauaagaucuuaauagcaugugauuaauguguguuuaagcaaauuaacaagcaaugaauuugaucagaacaagaaauuuuaggacucuacugcaaaauauaauaauugaaauuaaaacugaauagaugaguuaguucaauaacaaauuaucagaggugguaggaucagugaguuggagagaagacagugggaacuucacaauuuaaugugaagauaaggacgugggggcagauuugaaagugacccagacacagagugaggaccuucugcucugcucuguauaaaggaaucguacccucccagaaggaaagggagaggagaaaggaccagggcagauuuucaaaaacugaugaauguaaauaauuuaaagccuuacaagguucaagaagcauaaauguagauaaaaggacaaaaccaggugugguggugcaugcauuuaaucucagcacucgagaggcagaggcagaggcagguggauuucugaguuugaggccaacguggucuacaaagugaguuucaggacagccagggcuacacagagaaacccugucucgaaaaacuaaaaaaaaaaaaaaaaaaguaaauaaggacaaacaaaaguacagugagagagcaccagacagcagggcucuuaaaaacagcuagagaggugggagccugcaguuugaaaguuggagcagacgacagcuaagugggagggauucaaaggaaaauauaggccacagugacagagugcuccaagugcugaaacuaaauaaugucuuuaaaaauuaaaguaaaagaugcacauuuucagaccuacaaaaccaugagaauucucugcuuacagaccuauaauaaaacaaacaggaaauuuucaggcagaaacaauugaugccagauaaaaacauggacuccuaaaggagagaaugacuaaaaaauaaaguaaguuuaugaaccaauagaaaucaguacugacugauuaaaugacugcaguaucuuauggaauuagacauuagauagaauaaauaucuucuuuacuacuuagcccaagacuuggagaaguaaauggcacaauaagucauugucagguccuugcagcuagauaagagguuauauuauaguagauaagagguuauaguauaguagauaagagguuauauuauaguagggcaagggucuauguugaaauguuuagggugcccauucaaagauaauugaaagaguauuauaagugaauaaauaggaucauuaaaacacaagaucaauccaauguuaggcaagaagagaaaaaacaaaagaauagaggauguaaaaaaaaugaaaaacagaugguaaagcaacccagaguaugucaguaaugucucuaaaugcuuguagccuuuaaauucuauuuaagacacagauuuuacaacuggaaaaauaaguauauuuuaggaaagaaacuuuucaugccagacacagaaagguugaaaauacaugggugggggaagcugugucaaguaaacauaccuuuaccaaaacaauaccuaugucagacaaacguagaaugagaaggcuaugucauguuaugucguagugauaagagggcaagcuuaaccgagccugacacuucucaccuguguauccaacaggagugcgacaugguuugcaagcaucacagaucaagccgaacccaaagcaaaaauacuguccacaaaugcaauaaaagaugugauaagauaaucuucuuagauuaauguauuuuguuuuuuauguguguuaguguauugcucauauauauauacauacauauauauauauauauacacacacacacacacacacacacacauauauauauauauauauauauauauaugauguggauguguguauauauauauaugcuccucaugcaugccuggcauccauggaagucagaagagggcguuuguguuauggauaguuguaaacuaccauguugguacugggaauugaaucugggucuggguccuuugcaagaaaaacaaauuuucauaaucacugagccaucucuccagcccacagucagagauuuuuuuuucuuuuuuguuuuuuuguuuuuuuuuuuuuugagacaggguuucucuguguugcccuggcuguccuggaacucacucuguagaccaggcuggccucgaacucagaaauccaccugccucugccucccaagugcugggauuaaaggcgugcaccaccacugcccagcugauuuuuuuuuuuuuaacacacuuauuuuuuggugauagaaauuuaguacagacaaaaauguaguagacuuuuauaacauuuaaacagucuuuuaucaaugggccaaagugaaguagacuaucuuuaaccauaauggaauuaagcuccaaaucaagaaaaggucaauuagaaaauugccagaaguugcgaaauuaaacauuauacuucuuggugaaccauaagaaaaaagaagaaauuaggagagaaucaacgucuacaaucucugucucucucuuuuucucucucuccccuucucucccuucuucccccucuuucuuuagagauuuauuuauuuuauguauaugaggguucuaucugcauuaugccuacaugcuagaagagggcaucagaucccagucuagaugguugugagccacuauguagccgcugggaauugaccuuggguccucugcaagaacuggauaguucucuuaacugcugagguaucucuccagcuugagaauuuaaauuuuucaucuugggugcugcuaguuggacucagggcccugaguguacuaggccugcaugcugagccacacccaggcccacguguugcuuuuaauagcaacagugaaaggcagcauuugcagaccuucuucaguguggugugcuggaucuacaacagcagaaacacauugggaaagugaaaggcuguaucucagagguccaaguaggcgccaggagccuuggagaggcagaaacuaauuagaaauuauaaaggaaugaaauaaaaggcaagaacaaaacuguguaaaauugaaaauauuuccaauaaauucaacaaagccaaaauuauucuuggaacaaauuuauaaacucuaugguaggucuuggucaaguacaaugaagaaaacaaagacacaguaaaaauggaaaagagcauugcugcagagcuaacaaacuuuaaaugagacucugugaauaauugccaauaaagaucuaggugagaugagcaaaccuuagaaaggcacagcucagcacagcagaugcaaaucccagaaguuuuaggcuguuaaaacuucuuuguuaaguuuguuuaguauguaaauuacuuuuucucucaaguuaacauacagacauaguuggucuguacucgaggaaauaucuccuguuuucacagauuccagagaacagaaaaaugggucccauuuucaacuuguguuuuuuuuuuccccugagguuuagccagacuuugacucaaaauuuuaugacuaugaaaaugaaaaguugugugcacguguguguguguguguaugaauguaugaauguguguauguauguauguauguauacagaguggcagguagggacauaauuuauuaggggguuugucucacuucauugcaugggucaagaaguaccuuaaaggcuauccaaauuaauaaaaaacaaaacaaaaacaaaaacaaaaacagaaaaauccauaguauggcuccauuuagguccgaaagccugauaucaaaggaaaugggugguguaauucuguuuuuuuuuuuguuguuguuguuguuguuuuguuuuuuucuuuuuucuuuuuguuuguuuuucgagacaggguuucucuauauagucuugguuguccuggaacuuaacuuuguagaccaggcuggccucgaacucagaaauccaccugccucugucucccgagugcugggauuaaaggcaugcgccaccacgcccagcugggugguguaauucuuacaccagauacagugugagagcugguggacucuugacccuuagaucugggguccaaaugcucuagagucuggaguucugauguucaaaggcagaagaggaugcugacuccugaauggaaaguaagaauccagacuuuguaugcccuuugucuuaccugaaccaccagucuuuuggguuauacugccucacugugggcagaaagacugcagucaucucaguaacaaaggugucagugcuccagacaucaucacagacacugccgggcagcccagacagcccaaugaaaugauaaguuguuuggaugucuagcucagcagagacgcagacucauguuuccugacaugucaagaaugacaaggcugcauuggcuaccuuaguauuccuauauauagucauccauuacacaaugacacccaaaauggguaacaccuaagaauuagggauacaaggcuggguuaacauuaauuuaugccauccaucaccuuaccagaacaacaaagacauauaacaacaauaacauaguuaacacuuaguguaguaaaucuuagcaaauuagaacugaguggaauuucaccuaguaagaauauuuuuauaaaaaauucaacaaguaguuucauauguucuggugaagcuuuucagcucuaaagguggguguggaaucuaccaccuuuacuucagucuaauuagaugaaaaugaauaaauaaaauuauauguauuggaaaaaauauuuuacuagcuacaugauuauauagauagaauuuuaaaaucuacauguaaaacuaagauauauuaagagugugaauaaugaaugcauuuagcaaagauguugcauaaaaacuuauggcagucaguuguuuuucucuguacuagccauuaaauuuucaccuauuaauaggcgccagauaaacaugauugcauuaggccuccacagagaaauguagaacauauuauugagucuuaggaaacaaaaaaagugccuuucuauuauaaaucccauaaggguaugugugaauucauaccuuucagaaagcugauucugaaaauuacauagaaauacuaagauucaaaaguaguggagacauuauugaaggagagaaaaaauuagaggcuuucuaacccagaugccaaaguuaguuaaggaacccaguuaucaugcuguauucuuagcacaagaacucaagcugacuaaguacaggguggggaacaucggccuugacacacugacacuggcuguguuguaguuguugugcgguagggaaaggaugauuuucuguggcuaaugcuggagcagcuggagaaagguguggaaaccgaaagcugagcccuguccugagccaccuacacagggagacgaugugcacagccaggaaguguggaauguucuucuguggcaggaaaucucgaggcuggauuguagggagugaggagaaaguuguaggaugguggccagagaaucagaugauguaagagugacagugguugugaggccucugagugaguggaggaggacaggagaugagccaugugagaacaagugacuuguuaacacugugauucugggaagaucuuucacccauccauauguacugaacaccagccaugugggaguacugguaaguggaagaaauaaagaacacuuuucuugcucagcuugcauuagacucaggggaggugacugggauacuuacauugaauccagugccaucgccuuuagggugaaaccauuauaaauaguugggaaagaagacugugaggcaagaggacaccuagggucugggguuacuggugucugucaggagcuuguuuccugugggaauaggccgauguagcuaggagaauguaggcagaaaaccugguugucauaguagcugauaguacaaaaaugucauccugacauucauccuauagccaacaugaaaacagugcuggccauggaaauucuaguauacauguauuguaacugucagccucaguguacugcagugggccagucacacacuggcucaugauauacucccaccacuacuugcugacuguuuuuauuugugcuugcuuuuuccuuuucuccuaggccucuaaugugggguccuguguaaguuaagaaagcauuuggccacugaguuacauccucaacuccuguuuaauuauuuaaaauaauuuuugaauacuuuagacucacucuuaauuacuuacaugugacccuaaaauauacccuccugcaagucccugaguuuuguuauucaauugaauuuuuguuuccaaucuguuuuaaaggacacgaaguucaaaacugcuccggcuuauugacuuagacuuuucguucacauuuucucuccuggaucuaccaccaguaaaugaguaugacauguacauuaggaacuuugggaaaaaaaauaccaagcagguuagugcuaccuaacugauaaaaugaaaguacaguauaaaugcaugugccuugugucuacucugcaauauuagaauuggaaauggccucugaaggcaguagucaggagaaagcgugugcuucacaacuugguacucauaaacucaaagaaugcaaagucuaacauagccucuuggggcaugauaaauaauugguacagaugacagguccuuaguuucuuuuauguugaauuuuugcucacaagcccgucuuagcaggcaaaucuuagcagcaggagccugauagaaguaguagucaugcuacauccgcagucagaagagcagaguaauagcugcgugcauagucauacuaaguucauuuucuccaauuucuauacaguucaggacccaagcccagggauugugucagcugcuuuuaggcaggauuucccacaucaauuaauauuugaaagucccccacaggcuaaccuuaucccaaccccaaguauacuuuacuuuuuaaaaaaaguguauuaggucuuuuaaaaaugucguuacuuuuauuuuaaguaauggcaaauugaucugaaauugaaacuagauguuaauucuaagcuacuuuugccucuaaggcguauguucaguacaaugaagauaauguugagagagacauucagacugaagauauagaaaccagggaaguauggacccaacacccaggagaaggcacggcuguaucuggagguaacugguuggaugucuacucucuucacaguauguuuugauuuguuuuguuuuuauguaacuccuuuuaucccaguguuguuuuugaugagguuuuaaguauaugacuguggaaguaaccuuuuaauauuccuuugaaaaaacaaauuagcucaugaaugagaucagagcuguugaaucacagggaaucauuaaauuggccugaacccuagucugaucccugagaggauuuguagugccauggggaagauacuguccuccaaauacucacgauauaacuucaccccacaccugcaggacagacucugcucugagaacaacacaguuuauucucaucaguguguugucauuuugaagugcaguuucaagauguguuccaucagugcaguuuagcagucucuaagauacaggcaucugcagcuguucacauagaauuuacuuuacucauugaccuuuuuuuuaaaaaaaaaauuuuuuuaaaaggaauuuucuauauggcuucaccauaagaaagcuccaggguugguuucucuuacugccggugcccugcacccuagguguugcagauuucucaucuuuagaugcuugaucuguaaccuaaaacucacaccaaacacacugguucuuuuuagugcauuccucguggccguugacgaggauucagucucugaacuuccuguaaagcagugugaaguugggagacaguguugacuuuucuccagguucuccguaucuguggcacugcuucaauacugugauuugaaaagcuucacuguuuuggagucaacuuuauugacuuaaaaaaccuguauuuuagguagcgaagaaaaagacuucucugaugucacaguuguaccgaagaucgacacuccgagguuggcuaacuuucuccgggcagcgugccagguacuuucugugcugcguguccucuucugggaauuagcgcucaggguucacuguguuguccuuguggcuuaaaaucaguucuuuguccucaaguauuauuuucuuacagauuaucaguaaaacauucauauaaguccaugcacaacaacacuagguaaauauaggucacugaaaauucuguuaguuuuggguucuauacuauaauuuccuacaguugaaaauaacaacaaacucuuaagccaaguauguuaaacugguaaagcaaguauaaaccugcacaguauuuguaaauaauaaacaacuggccaugggaagcuuucaaguacauaaccauguaccacagcagaccucccucaucugacuuguuauucacucuccuuuucauuauuuaccugguuauuuugcaacugacucuaaucaucauauuucaguauaaauuucuaaaagaaaaagaucuuuuguugauguaaaaaggcacagugucucaaagggaauaugaaaguuuacguugcagccaaauaccagagauauagguuacccuaaauaccauguuucaacauggugaacauuuccgcuaaguuucuaguuacagaucaagagugaaucuuaaaccaaagcacuuuucagauauguuguaagaacaauggguaggagggauacaacagcaugaggaagucugugcuggaggccccagacacugucugaugacagucuuagucauaaagacaagcauaaaggugggcaaugcaaggcucucaggaggccuaaagauagauagcauaagaggauuuguuugugacuuguaauauuacagcucuccacaaucacaaaguucuuuaacacaggugugaccuacuaacauugguaauuucuaauauauuaagauacgaaguugauguucuaaucucuauguugucucaaacuuuuuauauaaacuuagaauuuaaauguggagcagacauaaacagccuaauaauguuaagccuggacaggcugauuuggaauaagccuguuuaucagacuguuauguuagaaauaggauuaggcuugacauauuuguuauuauuauuagauucuguuuuaguauaaaguucuugcaacuauaagaagagaguccucagugcagcgcagugaagagggagaggagcuguaacuaggcagugacagggauggguacaggagccugcugcagcccugcuugcuuggcuucuacggcagugacagguuagggagccugcucccauggugucugugcucccaugguaucugugcauggcacaucucuguccaaccuacaugcaauccugccaguccuugagucaugucuuuugcuuccuuuccccauuucugcuaauucuuaagucuuuucacguucuagagaugaccuaguuggagccacugcaggcauuuaaugcugacuuagagucagugagugaugguugccugugcuucuccuuagcacuuuguuugcuugaggguguuagauguccaggcugccuccuccucugaaguuuuaauuauauuuaaugaaggaaacaacauguaauaugaaauaauggcauacugugacauuauauuaguuugcuguuauuauuauacaaaaagauacuuuuauuuuuaaaguuauaguaugguggagccaaacauuuauuuguagaaaugaaaucuacaaaagguaauuuuuaaccaaaggauagcaugcuguuaguguuuuaagaaguauggcuuaccuugggggugguuuuucuuuuuaaaaauauauuuuuuauuuuauguguauggauauugccugcuuauacaucugugaaccauaugugugcauucuggucuugcagaggccagaggagacccuggauugggguuacagccaguugugugcuaccauguaggagcugggaauugaacccaggucuccuggaagggagugcucuucaguacugaaccaucucuccaggcucugcuuacuugucuuucaaaggugguugcuguauugcuugaagaggaccguuuggcagcuggacccagcuggauuccccgggcucaagacaaagcucucaacaucagugacagcucaucucaacugaacacaagccuaccguuucuucagaguaagagguuuuuuuucugauauugguuuauagcuaaacacaaacauuuuuauuagaacacugaucauuaauguaauguuauauaguuuaaaugugaugggauuuauuuucuauaaaauagaaacacucaaugccugcagaauugcaaauacaugggguguauucuuuucuuaaauauguuuaugauuuaugauuuucuuaacuagaagagaccugacagcaauuuagauuagugaacuuauuuaguaaguggaaacugagauuguccauguuuguuuuaaguccuauaauuucucucagguagucacucagguaaugcccagcuauggaaaugguaaacaaagaaagccuggagucagaguauuuaaauuaguuuaaacaaacuucauuugcagagucaaauuugaauuuuuaucucauuuaucuaucuaucuaucuaucuaucuaucuaucuaucuaucuaucuaucuaucuaucuaucuaucuauuuaugguuuuucaagacacacucucucaguauagcacugacuauccugguacuagcuccauagacccaugcuggccucaaauguguggagaucugcuggucucuugucuuucaagugcuaggaucaaaggcuugugccaccacagccugacuguuuugagucacugugucaguuguuaggcuggcugugaacucuugagcauccugccuuggucuccccagagauguaugcucacauaccuauguccauuuaauaaaucuuuaucuaagggcaacuuugucuuuaaagaaugugaccagugagguagcugagcugucaugguucuggcugugaagacuuggcaggagugaguggugcccagcagugaugcuuccuucaggagacagagugaaaacauacuuugguaccuguaaagccagagaguugcugucugccucuugcucuacacauuucuuuugcuugccugcuguuuugagguugauuuaaguacuuuucugucuuuuaagcauuaaauacauuguuauguuuuucacauucuucagagucuuuuuguucauccuuuagaaaaccguaaauccaaugggccucucuuuccagugauggccgaguaggccaucuuuugauauauaugcagcuagcgucaagagcuccgggguacugguuaguucauaaaaaaaaaaaaaaaaaaagaaaaccguaaauuauuguacuugcaucguucauuguaaacacucaggaggcagaaggaaagaacugguugucucaggagcuggugcacugggaaugguggcagaauggaauaaugugaauuaugcauguaccuagaggcuuucgcuaucuaaugcauaucuguucuuggaagauuugugcauguaaaaagagaggagguguuuuguucacuuccugcugugccucaguaagaugaauauugagauaaaagaaggagagugagucugagaaagagagauucaacauaggaggcagauagccucacagugcacaguuagaauuucauuuguaauaugucccaaucucuggucagauacagugauacuuucauccuucaugggaugugcccacugcuauugucacuguugaaaugugcugagaugagaugccagcaucggccuguuuauucauucauuugugauaucuguaguaugcuggcagucauuggaggaguugggauugagcaaguagguaagacagaaauccuucacuuugggaacuucuuagaaucccaauagacuacaaacuagcuaagcauggaaacaugggcuguaguagaaaggguuacauuccaaguaacaguuaaagacagaaggcaucucaucaugagugugaucaugaggagacagaugaaaaagugaccaaggaaacauugggaaguuuccuaugaaaguaccagcccuagguauaucuugaaccucacagagucaaggugaccaagggggacaaaguuggguaguaaugauggucagaucuccuguugaccaugaguuucuaaaaauuacuacuuucaaaaugggaucagaauacagcaguuacaaacuuuugucaguaccaggcuggugagaugccucauuugguaaagguagugucugccaagacuggcuacccaaauucaacccuggaacauaccugggggaaggagagaacugacuccugcaucuuguccccugacaccuacaaauggcacaugagcacaugcacacagacacagguccaaagaacacaaagggagggacagagggagggacagggggagggaggaggaaaauaagcauugaggagagguuggggggcggagagagagagagagagagagagagagagagagagagagagagagagagagagagagagagagagagagagagagagaagagagaggaaccuuauugguguuacugaaaacuagaaaccaggccuaugaggugacuuagugggccaucacuuugauauguaugacugguaaucugaguucaauucauguaaagacuggaagaaaagagccaacuccauaagguuguccucugacuuggacauaugugcuugcuucuucuuagcaugaacacaagcauacacacacagucacagcagaaacccaguaacacuggugucagaguuuugcccaugagcggugaaggagcacaucuaacuaugucauugcuuuucuggaggagcacugcaggcuguuagaggaggcagugaggguguggcugugaguggguggggcgaugcggaaggacaacucugauccgcaggaacuagucagcagauguaguuuuacuucccagccauauuaacccugucuuuguugacuacaaaauucucaccagaccaugagcugccauauacuguuucuucaguuucucaacaguucugcuaaugagaaccguauggaaagcagcucugccaaagaagucuuacucauucuuagaaugcuacaccuggcuuuggauuaguuuucugcaugaaguucugagggccauuguaaagagaacuaagguuccuaagaauaguguccuaguagcaugucaugucaagaaggccccuccagucauuucugacucucacacacauggugugcggagcugcuagaugagaggaagugugcuguccuggccuagacugccccauagucaaaggauuucccuuuguucaagccacauggucuccguggacacagaauuuagguuuaggcuguaggcguggaggaagacuggcguuuggggauugaggaccuagcucauuggguauaaugcuuuccuagcgugcauaacaccugggauaaaguccuuaguacugaauaacuuguuucagaaugguucaggucugauaucugcucagcuuugaacaacccaugugcucuuccucauugaguuagauuuuauguggguauugugaaguauuuuaaaugcuaaagcgaaauauguuuucuccuaucuccaggucggaaaguauccugcuugcaugcaucucgaguucagaggcagaccguggucucuguucaugaccuaccugaaaaggcuuuugccccaucgcuggauagcaggcaccuccucugugugugggauauuuggcagccuucagggccccagaagguucugauaugugagucaaagguacacugaggaggagucugugcuugcuucuaggagggucccacaaggaggggcagagauaacagauugagaguaugaguagggcccuguuucuagugccgugucucuagacaaaacccauuuguucugaucuagaaauucuagaaauuaacagguuauuucagcccgaaaaacccaggauuaucaugcaggaggcucucuaucaccuguaaacuagcaaaugaacauagcuauaggcuuaauaaaagcauggucaggauggccauaaggccaggauauuugaaucaugcuauuuagggcuugauacuuugagaugucuuaauauucuugugauuucuucuucuucuuuuccucuuccuuuuuuuuuucccccucugacaggaagcauguaacccagccuggccuugaauucucuaugcaguugaggauggccuugaacuucggcucuccugccucuaccuuaccucucgagugcagggcuuacagaagugccccccaccaugccuuuuacaauaucuuaaaauggcuuguagugagugccuuugucacuuacucagauucuucugccuuccaugugacucugguccuguuacugucugggccacuggcaucuucccuuucauaucacuucauuuuugguuggagggacuaugccuugaugguguguaccuguguacauggauaguagaugccuuaacaugaucauauuccuacagaauggauuuucuuauucuacugucugugugaagaaacucacacuugggcaguugacauuuauuuauauguacaagucuguguucuacuuaauuguauccugugaguaccuucaggugucaguccauacuuuagucaguuauucugugaaugugccuacuauagaauguagacauuaacuuccugugauugauuuuucaggucacaugcugcugcuuuagcccuuuaaaagcauuuuugcuguuugcgggaacaguacauggcucugugguuguaugggacuuaagagaagacuccaggauccaccauuaugugagacugagcaauuguuucugggcuuucaggaccccgacauucuccacugguuaguguugucuaucugcccucuagaaaagccuugacagacugaagguuuaucuuuaucagcauuuauucauucagauuauccagaggaagagaucagacucuggacaaaagaggcauuuguaguacacaccugugaucuaaugggaucagaaaggcucacuggcuagcuaguagguugugaccacuuuggggauugacuaacucuuucacaggggucacauaucagagagccuacauaucagauauuuacaguaugagucauaacaguaucaaaauuccacuuaugaaguagcaacaaaaauaaauuuacgaucagaggucacuacaacaugaggagcuguauuaaagggccacagcauuaggaagguugagaaccacugcucuaggcccagcaagagaccuugucucaaaaaacaagagaaaagaaaauaaacccaaacaaacaaaccaacagcagcaaaacaaaacaaaacacaacacggagaaugaucaaggaagacaccugaugucugccucugguuuccauaaguacauuccugcauguguauguguaugcauguacaaacacaugaacacacacauacacauacacaaagagcaagcauuucacacccguacaacuucuucuaaguguuuuauauccaugacugucauacuagccuauuccugaugcugagaaaggugaacuguuugucuaagccacgcugacugcacggguaggcccuguacucagagccgucugccuauagcaaggccuuggugccauggucuucauugacuggccuuuuccuuuaggagcugaagucccgcuggcugagagaucaggcauggaccuugucugacacucuuuccccagucuugucccuguccuguucaaccugaagagcucacaccaccacucuggcagcaaucuguuuucugucauuauucuguccccagucugcucuguccagauucgggaagaugagaaucacacaugucauuuggggcuuuucacugcugagaguugcagaaugcacucccucagcggcuugcuguucuauugcacacugugccaacuguugcucuguaccucaccagcacugagccggcagguguuguuaaccagccauuucaguaagcauuugguuuuaauuuugugguuucaacuuguacucagaagaacuaaugaucccaagauuaucuucaugugcuuauuuauaaacuaaauauucuuguugauuaugccuguuuaaauguuugcccguuuuuaaaaaaaaaagauuuacuuauuuacuuauggauguguuguauguguguccacugccacucuucucagucauacaagaagagggcacuggaucauuacagaugauugugagcuaccaugugguugcugggaauugaacucugaaagagcauucagugcucuuaaccacugagccaucucuccagcccauauuugcucauuuuuuauuggauuguuuuaaguuuguuugggagagaaggucuaauuauggacucuggcugucuuaagcuuauagcagugcucugaccucagccucucaaguggugaaauuacaggcaugcuuugugccuggccaaguuuauuuuauuuuauugucauggugcuagggauuggauccagggguuugcauuugccaggccugcgcauuacacacugagauacaucuccagccccuuagguuuugacguuuuauauacucuggguauacuuuacauuuuuauuuuaaaaaaucagacucuguauuccuuuuuguaaaauuccucuucaaugagagaaaguuuuaaaucagauggaauuugauuuaucaauauuuucucuuaugaucaugcuuuugaugucauggugaacaguuuuuauucaacuaaaagucacagagguugggcugcuucuuguguuuuccugaccuguuguuauuuuaggguuuacuuuuuuuuucuuuuuagauuuauuuauuauuucuuaaguacacuguagcugacuucagacacuccauaagagggcaucagaucucguuauggaugguugugagccaccaugugguugcugggaauugaacucuggaccgugagaggaacagucagugcucuuaacugcugagccaucucgccagcuaggguuuacuuuuaggucaguguacauaauaagaggccuuaguccacagguuuaauuuuuauauguaaaugccccauugaaauucacacauaagugugcuugggaugggucucagcaugcaccugguuucuguccuccuuacuucugaccaucacugaacuuuccauugucccuguaguuuguaucuuuuuuagaaaguucuguauuuggaauaaaguggaauaagccuuuucagauuggguaaggaaaaauguuuauguuuucaucaugguuuuuaguggccuaacagccaaauaauuuuuucuuuuaaauucuuaaaauaaaaaauauauaaaaaauaaaaacaaauguuauggauaaacuuaucaguuuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuccuucuccuccuccuccuccuccuccucuuccuccuccuccuccuccuccuccuccuccuccuccuccuccuccuccuucuuuuucaagacaggguuucucuguauagcccuggcugucugggaacucacucuguagaccaggcuggccuugaacucagaaaugugccugccucugcuuccugaguccugggauuaaggcaugcaccaucacugcccaguuuaucaguuuacuucuugaaugaguaauuuuauaauuuguguauagguuuuuguaugaacuuguuuuuaucuccucuggguaaauagcaaauauaauggcuaauacugauuuugaacuugacaggaucuagaauuacuucugagauaauccuggaugcaugcuaaauggggauuaccagauuagguuagccucugggccugucugugagagauugucuuguugguugagaugggaagacuguagaugguaucaucuguuguauuguguauaugagagaacagugcucucucucugcacccugacugcacauguaauccaauagccaucacaggccccaugugcaggaacccaugcugccugccaccgcuuccugaagccaugaugugauggacucacaucagggaaugugugccaaacuagcccuuucuuucuuagguuacauuuaucaguuauuuuguuagaacaaaaugcaaagccacuaagucaacuaaaguaccagauuccuggauugcucagugaaaaauuguggacuguuuuagaaaauggccgcaccaucugcauuccuaccgucagucaguggccgcaccaucugcauuccuaccgucagucaguggccgcaccaucugcauuccuaccgucagucaguggcaccugcugcuacucaguauccucagcagccuucagcaugaccagugauguagggcugggucauuguaguugguugaaguggcuccuuauggugacacuggagcaggcuugucuuucuguaugcucagaugccauuugugugucuucuuugguaaagcaccuguuaaggucuuugucccaucuuaaaauucuuguuuucugguagcugaguuauugauaugagguaaggguuugugaguguuucuccuauccuguguucuuuucuuuuaacuaaguguuuuuaaaaguaccucuccaagcacuuuuaccaucacagacauguuucuucucucuguacuauauuuauaucugugcuuuacacauuaaaaagagcaagucacuuuuuauuucuguacuaaccaauuuuugcccuuuuggggagauacugcugcuauggagaguauuugcaauggcagguaccauauggauuuugaugcuauuauaaaagcuaucuucuuucaaacagagaaaagaacauauaaaauuuguuaaaugacuugggcucuaaguuuucuuuacucuugcuguaguaaaaugccccaagaaauacauauuaaagaagaaaguucuuauuuggcucacaauccagguuuuaggucaccguagcagggaagcuauaguggccagaacugguuacacaaugucuacagucagaagagagcaacagaugcaugccgcaacucagcccuaucucgccuaaaguguagggcucaucccagcaaauggcaccuacuuucuucaggcuggguguucaggcuggugaucaugacagucccccacaggccagccugaccuaggucauccucauugagccucuccagugauuguagauuguguugacaguuaacacuaaccaucacauggcccagaggauaccuuuuaaaacauggcauuuuccaacugcuaauucacaugaaucuagcauuguuuucaaagcucuaaauuccuaagccauacaugauuuuggcaggagacugguguggccuccucucacuucuuuccuauaaagugauacagcacuugcuguagcucagguguguucucuuuguaguugacaucauuucuagaagacugcguaugacgugugaguagcuagugugcugcccuugacauaacucaggcaugcugcuuuuguaggugauguccucucuagaugacugcguaugacgugugaguagcuguuaugcucaggguugagggaacaacaggaaaagucuguucaugcguagcacaggacaguuguucuuucccauauuucuagucauggcuguuggauccaccaaugaguacagggggcugacugaguguacauaaagugcucuaugaaaauacuccccguguucccuuuugcuaucuaaauaucacgagcagaacgcaggagugugaaacugugaagccucugcaaggagagggggacugacucuacauguggauccuucaugucccgaggggaauccccuugaggagcucuguaacgucucuccauuguguguucauucgcuuuuuccuaaguucaauacaacucuuuuuuuuuuuuuuuucaauuucuaugugggguuugauuucagguauuuuucguuuguuguuuaaguacauuucuaaaaguggucuaaaagagauuucauccuauuggaccacugucuugugcuuugugcuuuucucggggaugggguugggcagugggagaauagucacaccugagagugcuuugguuucuuuaauuucuucuggcuacagcuguauaugggauuugaaucuccaacuccaagacauucuguaggcagcucuuucuauccaucugugggcggcaguacuucugauaguggcuguccuguugaagagagcuuggucucaugaucuggcuggcacuguuguguucccaggccuugcuauucuuuacccuuaucaguugcccgugagcagcacuuuccgaagucccucuuguaugccccuuuuccaagccuuuuuggaggauucuggccccagaaucauguccucucuuucuggagugccugcuuaaguuucucauugucacuguccuuggucauggaauauuuugacuuucuuccuaacccuguacauguauuuccucagugaugcaauaguuuuguaaugacacaagccuugguauucauuucuuguuuuuccucuuacaaguguuuugagguuguagucucuguuugcuagagaugcugaaaaucacggucauggaucuagauauguggucuacauuagucucgugacuuaaggagagagguauauagagagucaggucuuuagaccuggaagcaucccuauaucuuucuagguauaaugcugauuucauugcuaagaugugagacuuacaguaggugcuguggaucuuucuucccuagauggaauccucacaucagugaaccaccgaagcccucuucaagccauagagccaguugcuacuucugccuacaaaaaacagagcuucgugcuuucacccuuuucuacucaagaagguacgagaucccucacacccauaaaaucccuucugcauuagugaugcaaagcacuguacuuauuaaagccacuguucuucacuuuguuucugcuuucguuagaaauggcaggcuugucauuucauauugcuucccuggacgagacugggguucucaauguguggguaaguaggaagugcacagccauccauacagccauccauacagcagagugaacccacgggggaggagaaugcaccugcccuggggaaugggucagagacagaacacaaucacaaggcaguaagccuaagcccucuguucugagaagagguaugaaguucccuggccuuuggccuuugggaauuuguaaggaagauuauaacaagacaucagugcuagaugauauguuaggacuuguacagacagcuaccaaugagguuacugagaggggagaaugcuaagauaaaagaaugaauacauuugucacuaguucuaaagcagaugauuagucuuuuuuuaugaagcaguuauauuuuuuaggaucuaauauagcauguuauuuuauuaaagcuaugccuuguguagauuguuucauggugauaaaauguaucaguauucauuuuuuucaauauucuguuuuuaggugguuguugaauuaccaaaagcagauaucucagguucaaugagugauuuagguaacuauugaaguaaaaauuaauauugauuauuguuugcuaaaaugaauagagauuaaagauauaaacaccugcuuugaaaaauaauuaauugacaaccugaaaaaaaauggaagucagaguuguauauuguauaauuuaucagcuauuggauaaacaucucauuagcuggagcaguugaaugauaucuaacuccauguuccuuucuguaggugucauaagcucugcucauagcuggcauuacuucugccgugugucauaccucaaggcgacugucuucuuucuuuuccaguauacuuuagguuuccauggcagaaguccuccugcauuuggagcuuucgucuguggcuuuggauuuacucagugcacaugagugcgcuaaguguggcuguccucaggccacaacagugggaaugggaauggggaugcucccauguagagcaagagagauguggaaacauacuagggucucccgugguuuucuguuuucagaccacuuaauauggcuuucaguucuaagaggccucagacgauucagucccauuagauccuauggucuaguuugucugcauuuuaaagucagcuuucuuacucugaauuccuaauccuuacucuaauucucuaauggcaaaguauccucuuucuuauucauguccccaagauuuacacggccuugcuccaggucuccagauucagaagaaggcuccucaccaagcaaaugcuggucacuucuuacugaaguuccauucaaaccagguuuacuguguccgugguugagaccaugcuagccugaucuguagaugugucaccucugugauagcaucaguacugugugacaguuauaagacacaggucuugcaguacguuugaagcugcccuuucuuuguagcagugaguugaauauauuccuacaugcuuuuaauucaacugcacucaagguucuggauaguaucuugccuaggauuuggguuucaacauauauaaaucccuaauucuucccucuguaguaauauaucaaagggagaauagcauuaggacagacauuuagcccggaauuugagaagagcaagggaagggaugggaaguaaagccaggccugggagcuggagugcuaugauguuggagcagaaguuagagaagcugaugaagacaaacugagacuggaggaguuugggacacuaguggccauucagcaaaaccuggaauguuuccaaggauggcuuugaaugacaggugccuuggguaucuacagcacuggauuuggcauuuuaacuuauuauucaguacauauguuaccugcuguccucaccagucugaaaauguggggguaucuggaucaugccccgacggacuucugauaauaaccuacaaauucuugacacucuucuuuagccaagucaccucaacuagacuuacagggaguucugcuugucauuuauauuuuggcauuccuucugguuauagauacuuaaauaaagaagaaugaauccagacaacuguggauagguuuugauuuagcuuacauugagagaugugcauguuucugguuugucugauucuaggucugauaccuggaggaaggaucaaguugguacacaguacuguaauccaguuggguaacaggugagacucccacugggguuaaacaccucucucaucccagagggacuuuacuuccuguuaaaugcauguucuguuuuugcaaugaggacccacuuucuuucuuucguucuuuuuuuguuuuguuuuuuuucaagacaggguuucucuguauaguccuggcuguccuggaacucacucuguagaccaggcuggccucgaacucagaaauccaccugucucugccucccaagugcugggauuaaaggugugugccaccacugccuggcucuuuuuuuuuuuuuauuagauauuuucuuuauuuacauuuuaaauguuaccccuuuccuaguuuccccucugaaaauucccuauccccuccccucucccucugcucuucaacccacucacucccauuucugguccuggcauuccccuauauuggugcauagagccuucacacgaacaagggacucuccucccauugaugaccaacuaggccauccuuaucuacauauacagcuaguugcugcuauucuaaugccuucaugugugucacacaucugcugggcuucuguaagacucuucucucuacuguagacuucucucuucauaucaugcauuguauuuauuuuuuaauuguaauuuccuccaggaauuaacaguauacucuugcaggacuuauauacucuucaaagugaaauagcuaauguauuugaugccauguuuucucucaaaacucauagcuguguuugugcaagaucugugggaaaggaguagaggcagacuggauuauaagaagaguccuaacuuaguagccuccccucucugggguaaauaggggugguagcccagacugacauaccaggucuuugucuucucuucugccaguuguggacuauggauguccugggcaguagccauuuuguccucagugaucccagcaagcaugccagugaagaagaacaucccuucuguguguagugaugagaaugauguguugguaguauggccauacacaugugggagccugaagaaggggauuaguugggucuagaaugaaaugggaacuuuuuugagaaagugauaugugguagauggaauaagaauagcuccuucauaggcucauuuacuugaauguguagucacuaugguugggcucugacauuauagaagcccaugccaggcccaguugucuuucucucuaccuugcugucuaugaaucaggauguaaagaucugaguuacugcuucaccaucaugucugucugcuuccuuccaugaugaucaugcacuaauauuuuaaaacuguaagugagccuccaauuaaaagcucccuuuaauaagaguugccauggucaugauuucuccuuacagcaauagaacauugacuaagacguaauaacugggcuugguccuuaaaagguuaaagcuuggucuugguaaaguagucaugguucuaaggcaaaaugugcuuauauuuugagauaccugccagugugauguugagaaaaaugggaguuggggcuggucuugccaugucugcuucugugaugacagucuagacaauggcuuggagggggcagggucuuacucuggagaaguggaauguuauuuuugugauaauaggauuaucaaccuggagaaaugugaguuuggaauacaguaagggagauuggagucaaggaaaucaauuuagagaccacuguagcagccuguaugaaaaacagcauggguauggagaaucagaugugaauugaagcguagaaguggaaacuugguguugagccagauuaugaggccuuuacaguaaccuguggcucaaggccuguacaaucuuagaugcauugagcuugccccaguuguagaccuaaaacugagaccccugaacaggacucuagaauucacugccccuuugugugaggaaaauuuagaaaguuucaccccuaguugaaggaaaauggauacuuggaagaacuugaaaccucaagcuagaugugggcucaggaaccuacaaguuugggaugugaacaucagagucccagggaccuugagacauaagagcaacugccuggugggaagcuggggguuauggaauuucaacaagacaucugcaaaagaugaguucacaugcucaccugccagcagcauggggaaauggugcaccuuguaagaacugucaucccaguggaacucacuggucaauacagacucaccuugucucaguaucagaccuguuggcaauugcacaaucuaaaaaacauguuuagaagcaauauuguaauuuuguaauuuccaaaauuucuaccaaugagugguuagauaauagauucaacaugguugauagaagaaucaguaacaaaaugguggaucugcagaaccgaucaaguaugugauaccagagaaaggaauaggaagcagaauagcugaaaccauggaggcagccugauaggaguggcuccuuauuggcggcagccugauaggagcggcuccucauuggaggcagccugauaggagcggcuccucauuggaggcagccugauaggagcggcuccucauuggaggcagccugauaggagcggcuccucauuggaggcagccugauaggagcggcuccucauuggagggagccugauaggagcggcuccucauuggagggagcugauaggaguggcuugucacuuuguaaaggccauguguucaucucugcuauuuauuuuucagucuuucucauaaagauagugaacugugggggucgacacaaacacugagugucaaauuccugccuucagauccuaaucacuuuguugucggcaccgacaugguuaguaguagcuuacauuucauccuuucuaccuagaguuaccugauaaauaacuuuauaucagauuaauuuacuguuugcuuuuguuauaauaucugaaacguauuucuugaauauuguguuguccagucuugugucuaaucuuuggcuauuuuugguguucuuguaauaauuagggacuuauaagccacaguaccaggcaagauuggagaguaucucccaggguguucaaaccugagcaacacggugucagacccauaaaaguuaaugugauugacuuuucaccauuugaagaaacaguauucuugguaagaaaaucacuuuuugguuaaauuauuuaccuuuuggggcaauauaacauuguaauucaguagaaaauuuagaaaguuauggucucuuaguagucuacaaacuaaucauuaguuggaccucagugauguaaaaaugagacacaggguauuauuaacaaaaaaaaaaacuaaauuaaauugacucagaaauugaacucucuuuagaaauacuuuguuuaguugcaggauacuugggauuugaaaggaagauaacccauggucaacuggcucucauggcaacuaacccaguccacaaaacaaucaccauuccuuccugagaccacaagccccugaccuaauuaccuuucacuugauucaccccuuaaaugucacacugccucucaacacuguuauguugaggacuaagucucuagcacaugagucaguggggacaaacucgauucagaccauagccaugguuuaccaguuccuaagugugcaaucucagcauguauagagcuuuagccccuugugcagaugcagagaagccaguuuucaguauccaagacgcuuuuugugucugaguuaauugcacacccagacauuguguucagagauuauucagcuccacucuugcuucacuccaguaugauuuuguuauuuauaugaaauuagcguuuaaaaugugucucuguugguauuuugcuuuagaauuugauucuaguugaauauauauuauuuauuguuuauuauuuauuguaucuuuuuugaguauggaagggauuaaagagcgaggaagaauuaaucuucucuuucuauguuaauaauuugaucuuucacuaaaccgccuaaguuuuguuuuaugacaugcugucgcuagagauacaacuguuuaagaaggugacacugcaccuguggagccagccuugcaccugugcagcagucaguggcacucaacucuuaaacauguguuuacaguuuccauugggugcacugacggcugcugucugguccacgguggugauugcucauggucgcucaccucacuguuugugaggacaagggggcuggugucuguuucuagggugagcaagcacucucugugaggaggauagguuuuuaaaaauuaaaaaaaaauuuuuuuuuuacuuacucacuuuacaucccguucacugucucucuccuauucauccucuucuaccauccuucccccauccucucuccccuucuccucuuagcugguggggguauccuggguagcuccccacccuggcauuucaagugugaggauagguuuaaugauaugucuuuauguucagaaaacaagagcaagccaaaauguuauuguacaaacaaggaaagcuagugcucugaaaacuucuccuggguguuaggauggaaaugaaaagaaagaacaauaggguuucuacaucccaacugcaggcuggcuguucagauggaagcaucaggcugcaccagcugacgucugagaggcccaucaugcagugggacaacagcaccaguggccaugcuguuacuagucugcagugguccccaacaaggccugcaguguuccugguccaggacgaugcgucuaggaucuaugucugggaucuucuugagaaugaccuggguccuguggcccagcagcccaucucuccagauaagugaguacaggccagucacccucauccuugcucuucuuaaauuacagguucaaauguacauuuaacaccacauuuguguguacuauauagucaaaaauguuucuaacaguaguuuuaguuuguagucaaaucaaacauacacagagguccuauauguacuuggacccccuccccccaguugugcaacccccuugcugccaagaucuccauccaugugugcucugcugcaguugucccauacugacaugucaugcacauucuauuccauuuuacauuggcuucauccuugcugaucauuaagcaauaccgugaaaaccacuuuaaaauucagucguuuuagaucuagcaucagaugacacaguagauaggagaguaguagucuucaucacuauuauucugguagaaacaauuucugugaugacucacagauucaacaugagcgaucuauagcguauuccuucagguuucucaaagauagcaggacaugugaggcauaagccauggagucaccaguccccacguacccuucccacuguguacgaaugaaaccugcuaugcaaaguucaaagcauguaaauugccauugauccuugauuaaaagcuuaacauuuauuuauuuauuuaugugugugcacaauuguaugugcuguggugcccauguggaggugagaugacagccugugggauuccauucucugcuuuccauggacuagaacuugugucaucaguuuugauagcaagugcuguuacuggcugaaccaucuugcuggccuguugcaaauacuuugaaauaauucuuugccuuuauucuuuuauuuauaaaagauuucauuuggaaggguucucaagagagaaccauauauauagucaccuauauuuuguucuugguauuuuauaaccauauuagguggauaugugugccagggacuuggggucuuuuuuuuaaauuaaaaauaguuuuuuuacaaucuauucugauuacagccccccccccaauuucucccugacucgaucuaccuccugauccaucugaauccacacccauuaaaauacaaacaggaaauaauaauaauaauaauaauaauaauaauaauaguaauauaaaaagaaacaaaccagaauaagacaaaaacaaacaaauggaaagagccaaagaaaagacaaaagaaacauacagauacugaaacacauauucucacacacagaaaacacauaagacauaauagguggacaaaagaucuguaaggguaaaaaaaaaaaaaaaagagugaagcccugauaaaguauugugaaaccaaaacaaaagacaaaaaaaaaaacaaaacaguccauuggguuuguugugugucuuccauaucugcuucugggcauggggcugacuuuaagugugguuuauguaccuuguaggacuuuguuggagaaaacuaauuccuccuguggauggauaugaacuggagauagcuucuggcugugugguuuugugucugcuuccucuccuagaccuagaaccucuucuggcuuagacugugcagucgugugggugcugucacagucucugaguucacacaugcgucaggccuguugugcccaaaaggcuguguguguuucuuugguauccuccauccccucuggcucuuagaacuuuucuuuuucugccuccucuuccacaggcuucccugagcccugaggggagggauuugauggagacaucucacuuaggacugaguguuccagugucuuuaaaucucugcacauuguguugugggucucuguauuuguuccaaccuacugcaggagggagcuucucugaugauggcugagcaagacacugaucuaucgguauaacagaaugacauuaggaaguuuuuuucuugcuauguuccuuuggaagaaugguagguaguauguggguuuuccauggauuucuagccuaucuaguuucaggucuugguuaccuaggcagugucagggacaggcuccaaucauagagugaguccuaauugcaguuguaaugugguuacuccaacaacauuuaugccacuauuacaucaguauaucuugcagcuaggucuccauuauggauugcaagguuuauagcgaggcuaguguuuauauuucccuucucauagaguucaaaguaccuuccaauacugugaacacugagucaauaggggugaagucucuagauggcaccagcuugacuucuacaaguuuagugaguuauauagguguugucuucagcaauagggccuugccaucagcuuguggagagcaacuaaaagcuuugacaaaagucuggauuguuuggggguuucuauggagccccuuuggccaacaacuugauuagauguaacccaucccugguacuagagguuuuauuuggugucaagacaugucuaguugagcuuugucucccuuuuuauuugaugacuacaguucauauuucuuuuacauauguacauguuuuuuuuuuuaaaguuuucacuauauuagguuuccacaugauuucucaaauggaccuuagcuuucacuaucucccauauccccgccuuuauaccuucuucucuccuugguugaucaguucaaaugaaguuuaagaagaaauguuugauagauuguaaagguuauauuaagaucugaaauaaauaaggauaacauuuauuuaguucuagugguagguaaauugguauuauucuaacuaaauauccaucaauagaacugucuaugguggcauguauguaauccuagcacuugagaaucugagacagggggauuacaacuuugaggccagcuugggcuuauaggggauuccugaucaacuugggcuacaaaaccagaccucaucacaaaagaaaaggaaacaaaaacuauaucaacaucugagcauggcggcucaugcccaucaccccaguacaugggagacugaagcgggaggaggaucaggcagcccuccucuagucagccagggauuacagagcagucugugcagcauaggaacucugaaaagccagccacucacucacucuagcugcuggucacauaugaacacauuuuacauguggaaagucucucaagaguccuggggaggccauggcagaagggucagacacuuccugauggucugggaaggaucugagagggggcaagcuucccuucggauuguauuucugagacuuguuacuggaggaggcaaggguggaguuggugacacugcucagcuugguagggcaauggcaugcagagggcacacaggggucagcacauggugggaugggcugcucacaggacgguaaugcuguggagggccuggagcucagggcagaccucagcuggagaguggacuugugggcuuuggcauuuauucaucugugguugagauugguggccugagauacugggaaacccucacacuagggauccucccacugccuguguggcugggaggcgugcugagcaguuugaaggucccauuguuggagguauugauucccaugggcagggaggagcaucagauaggaaugucacacuugugugaagugguggaaguugucaucuggagcuacacaguuugugagcugcugccuuucauggaucugcccagacccugagauguagaaaauuguguucaacagacuuucauauacuuuuuuuuuuuuuuuuuuuuuuuuuugguuuuuuugagacaggguuucucuguguagcccuggcuguccuggaacucacucuguacaccaggcuggccuugaacucagaaaucugccugccccugccacccaagugcugggauuaaaggcgugcgccaccacugcccagcuuguuuuaacuuuuuuuagccaccucuucuuuuucauaugucucuugaauauagauauuuacucugguaauggaaagucacacacuuguauacugccuucccaguucauguucucucuugccuacaggcuuguggcuaugacuaucgugggggaaccggagaagaccagugguaguuuuguggcccugguguuggccaggaccucuggcacagucgacguccagaaccugaagaggcgguggaccaccccagcaguagacgagcauagccagcugcgccugcuucuucagaaaugaagacuuggugucgggagaaugauggguacaugagacuugauuacagauggaucccuuaacucuguguucaugugauucuguguacauagaauauguauauucuguacauaauuuguuuuagaagaacauuacuuugguauuccuaggaaauaaaucacuauuuuuaauggaaacagugaacauuuuaguguauacuaaaacuucaaagggaauaucaagugauguccagaaagcucuuccaagaguguuuccaguuauuuuuggaacuauuuaaaaauacugucacauuuauuacugaauuuuaaacaguccaccaugaaaaagcacuuuaauggacuauuuuuuaagccaugcauaaaaugauguacauauaucugaaguaagagaaauugcucacuuuggagguggccuccaucagccuucuguuuuuacgguuuucuugaacagcuuuugguaugcuuucaaugacacucauagaauugagucagacacauucacugugugacuuagugugaaaaccaucuucauguagaaauaauacaaguaaauacauuuuuugagaauggaauaauaggggcuuacuaauugauuuaugcuguuguaacaguuugcaagcacugguucacaauuuucauuuuguuuacacaguuuuguuucuuacagcuggagacacuagaaguucaaggcugggacucuagggcuaugagucgagggcuaggaguacagggcuaggacuccaaggcugggacuccagggcuaggaguugagggcuaggaguacagggcuaggacuccaaggcugggacuccagggcuaggagucgagggcuaggaguccaagguucugcuuaggcuacugucagccuccaagauggcacugcagccauguccuuacuuggcaaaggugaaggacagacagagggugcuagugugcucccucacccucucuaaccaaucugcucgugauggcucagcaccuccuaauaccauugccuuguggcucaagggccaguuugcgaauuagaaggccacacacaucaagccacacaggagggucugagggugagcucgugggaaaacugccuggguccugccaggagaucaguagggaacacaagcaguguauuuaaagcucuuucugcccuuucccagcgagaacugcaaucucuugggccuggauagugccuggaaaacucugcugucugccucugauccauggggacauauccuuauuucccaaagacuauaugccugacauucucuuuuaguucuuguguaacuacccccuagcaucucauccuuguguaacuaccccuccagcaacucauccuguauaaaacuacccccggcaucuca

SEQ ID NO: 6864 - RNA, 748 nt, Mus musculus
ugguuuggugacgcaaucagcaugcgcccgacucuuccucacugggauccacuguucagagacagccgacccugaaagaaucuagggcggggcgacgugucagucgccaaccggaucccgcucccucguccgcgcccucaggaaagaucccccggcggcgaauggucugugccuggugucaucgcgcggucggacccgccucugcgcugggguugcugugcugcuacucuccggucguuacaccaagaaggggcugcaggcgaagccaucacgccaggcaggccccgccccuaaccugugagggcgguucggucugcgcccucggagggugggcgccgcgccagggggacacacccggacuuggcucgcagggacggccggagagggagguguggcuuccgcggguguuggaagggagcaauggcccugacuagugggaaggcuagcgggcugaguccuuuccagcuuagcggagagcucggcguucgucagccaaccucuugccuguccuagcucccuggcggagaacuugaacuugcagguuccuagggugagaggauggcuccugggccugccucuguggaaugagaacuuugcgccugcugcaguaaaauuuaccuugaggccuuacugugugguggcgccucugggucuaguacuccuucaggucugacuucccaaacaaaauggccccagugagcuuaggaaagcacaguugucaugaagauuuaaaaaaaaaaaaaaaaaa

SEQ ID NO: 6865 - RNA, 2442 nt, Mus musculus
ggagaggugcgcggcuucuugcuccucaggagggcuggcaaaguucaccggguuauaaaggaagauggaggcugagaguggagguggguuugagaaaacugggaaaggcgugggugggagacugagggaaagcauaugaauuugaguugcauaaacucuagcuaagaagguaagaagcuaguaaguagcguuuggaaagagcccugccagcugccacacugccuggcgcccaucgguauacagacgggggucacuaaaagaccacaucacugucaauuguuacaagaacugcauaauucgaggagugccugacagcuagugugagggaguccguggcacuagagugaacauaguggaaacggcgcccucgguccucacuuguuucaucugaagagucaccaucuggaaugagacuugcggugcgcucuagacauaccugcuguuugacccccuugcuaucaaauggaaaauccccugaacucugaccacuugaucuugggaucuguggcucuaugaggagaauguguuucuucuauauucggcacagucaaggaugcuggaagagccacuggaaacuuccaaagugaugugggaaacaccauugaugguauauauggaagacauuaucagagcaacugacagccaugagcugugugaaagccaccaccagagccacugaaaccugagaagccacaugagggacaccucugggguuacaggaacccucaaagcugucagugcuuggucaguagagaaugugagccuugccacaccuaugucuggacucaagccagggucuucugaaauaagagcuagugcucuuaacagcuaagcuaagcucucucuggcucccaaaccuugcuuuugaaggccucauuuuauuuuauuuuauuagccuuuaaaaaggguccuugucacagcaguugccacgcaguccccaacuuuuugauggagccaugguuagauguacagcauuuagucaccuacauuguucucuagaaaguaugacuacucacaaugcaacaguggacuccaagccacugagaccagcauagagcucucaaacaucacacacaucacucuugccuuuagcuugagggugguccgcugacauaugacaacuacaggcacacuucuggugacaguaucucugccaggugaagagaaugccaccucgcuuugcauuccuucauuuucuucacagcacacgcccuccagaguagcaugcuggcugcuggggcucuggggaugcggcacugaucuagaaagaagaguucaugauuuucucugugucugcccagauccugagugaacaccaucccgccuuugugcugccuucacagccacacgaagaugaaagugucuuaggauauacccuggagcuaugccaaacugcuggauugaagguuaucagugcccuggaaagcucccagugcaaauggaaaacugugauacccugcaaucccuccucccgcuguaccccuaaagccaagagggguucugagcagcacaaugcucagaccagaccaguguaggagagauuccucccaucaacauccucaaaacuaucucagcugaaacucuagugggauuuuuuuuuucuguuugaaaugaugguuucccugaggucaaguggaaaagccaucuucagaaacaggucuauuuagauccacucauauucuacagaauucauguggucucuucaaagcaucccaggcucagugcacaaacacugcugugaccacuacugaccccuguggcggcggcugcuggcugcugcugcugcugcguaaucagggacaucagcaaagugagagagcagggugaacugugaccuuguauuaaaaugacccaauggcuccucauguggauguggugacacuuugccuugaagaguggacagguggccacaucugcaauauuuccuuugcugacaccuccucugaaauccccacuaaccagccccugguugcucagaagucacuaacaccacagauccgcucagugccugcugucugccugguuugaugaaaagucuauagcgagagucaaaauagaccugcuguuuuuaaagugaugcauaauccuguacaccaugauguguguuucccuaagauggaaaccacaaagcggcaggggcacagcccacagccaagccaccugucaaggucacccuggcagagauaacuccgacacccuucuuuuagaaugagauacagaaacuauaacuauacaaagacaacuagggacaauggauacuuaaacugcucaugguccagcaagaugguucucagcaggguacagaggucacuugcucuaugagcccaaagucaugaguucaauuccuugaacccacaguagaaggagagaaccaacucacaaaaguaaucuucucacccacccccagcacacacaauaguaaauaaagucauaaaaaccguu

SEQ ID NO: 6866 - RNA, 2972 nt, Mus musculus
agagacuugcaugucucacaaaaaccuuacugcuaacgagaauccauuacaguaugacuugaauggacauacuucuaagagugcagagacagcagagcuguaggggagaccugcgggauguuaggcagagggaagugagcugcccacaagcuuccaacuaauauuuaaacauggaguagguagggugguauacugucugggcacauagcuuguauagcauagaguaagggcaugguuacaucacauacauaacagugaucaaaacaagaggcaguuacauuuaugcuccucuaccaaguaacaacuuugucgaaagcuuucaugucaaaaguaaagguacccaucgugaccaggauugcuuaacuaugccugauucuuauuccccugaguucuuauucuuaagcccaaagcucauauugcuaccccaaagauaaacuuggaguagggagugggagguggcgacuuuaccucuuuaacuauuccucuuaccagugagcaccaauuacauuucuccuuuuuaauccuucuuaaaaacacguauguguuucaauuuccugaaagauuaacauauguacuuaucaggauaacacugcaugaaaagauaaugaaauuuaaaaccugaaacuuucucguuaaguccaguaacgguccgguuucuaagcuagagauucaaccacaugaaaaagacugaaaaguaaaguaggaucggucacaaucagacugcugacaugaaaccguuuaguguggagcuaaagcagugguuagagccacuguuguaauagcuguaguugacagugucuuguuaaagaugaccuugaagucagaaaacucacauaugacacagcuuuucuauauuuaaaguuuagguguaaguuauagggguacugagacuucagaugccaguaagaagugugggauucuuugauuccucugaugguugucugugcugugauguguauaauauguaauuguguugcaggauuuuaaaggcauuuucuaagauuugcugguuggcauagccuuggguuuugcuucucuuaguugcagguugcagugaaauuauuuauuuucagauaccugagcaagaucucagguggaaggaagcaaggaaagaagggggaaaggaaagagcacaaaggacuguugguaaugcagaauuaucuuuccauggugauaguacuuggaaaaaaggagcugguguucaguuaccuccugauuuaguuguugcugaacuauuaaaucuuacugcauuguguccuuauuugcacaguugugguugacauuguaguaagugcacccagcaccugguaagcagaagcauucacaguagcuaacccagaaaggguuacuuuauucaugauacugugucagcauaagcuggauggcuuauagacacaauaggcauaagcccaaagucacaguucaguguccccugacaacacauguucccuucacauaguaggaggaugagauggcuuucugagagccuuuuuuucuuggaauacuaauaccauuucaagaggaugccauuuuuaugaucuuaccacuucuuagaggccccaccuccucugcuguguugguaauuggauuucaacguggggaucuggagagacaaaccaucagacccagcaggaggcauugaguaguucccaaagagcuuaauggaaaugcauggaaggcucaucacguugcaaagcuggcucucuacauuacaucaaaggaacuucagugagaauuucccaucucaagcauguuuuggucaagcugagcuagucugagguaugguaccucagaauuacacaauagcacccucucccucuggaguggcaggacucacugggaacaagacugaagauacuaaagcacauggagauugugccuccugggaagagcuaaagcagggcaaguaaggaugcccagguuucaagacagccgagaaagcucauccgguugcagugaucagacaccagcaagggaugggagacacaaagagauaaaccugcacaggugccucaagcaacaguucaucuuugcauccuaccuuucuagguaguuggcuugauuuaaaguguguuauuuauuguccugcuaugaaaugcagucuaauaaauauuuuauuuauaguauuuuugugauguggaagcuauaauaaaguuauauuuucugcugauaaaauuguuucuagcuuguauaauuuuaugucggaauuaaagguaugaguaauucgugguacuauguaaauggcaucaugauuucuaauuauuugaucaccuaacaaguucaaaaaccacuacugaggaaaauaccauaaaaguaagcaagcuaacaaaagaaaaaaaaauagcaauucaauaaccagguuauaccuuuagaguaaccauauuauaccuuuacaguagcuuuugcuuuguguauguguuugguggaguguuauaucucuaaugaugcucuuuaagacugguguuuauaaguuacuguauuccuuucuaauuucauggacaggaaaauauuguugaaaaaucaaacugauuuugauggucauauauuaguuuaucuaaagaaccugagguggugguuguguucguuguucauguuguuuauuugucuuuguuuuucauaauguagauggcaguugguauuaaaaggcuauguaaauugguccacaacuucuguaaguaacuggaaguacuuuccguuuacaucccauuugugaacaaaacguauuuaagaaaaagugaaaaaauaagcaaaccuaccagauuucuuggaguuaaucauuuugcagacuugggcauuuuuuucuguauuuuuaggaaaagaauuaucuuccugauaaaagugaauuuuaaauauuaauuaaacuuauuugaaucuaugaucuugguaguucuugaaagcauuaacauuaugagguaagaauccuuuccccuugaaaauaaauacaaauaaauacuucugcuuauauacuuuau

SEQ ID NO: 6867 - RNA, 2661 nt, Mus musculus
uagaguggccuccagcagcucuauccgcgcgucuucucuuggaacauuuuuaauaggcaugcuuuguccuuugaaugagucacacaccucuguuuugauuaacuuuuuaucagauuuggggauuuuguuucucucauagcuagauagagcauuggccauuuuagauagcacugaacgaauuuuuaaugaaugaaauaacauguagaguuuccuuggcaauccucagggagaaaaaugaguccaucauagaguuuaacuagggaucuagaaaaguuuucaguauuucccaaggugaccuuacuaaagggcagaaaacugcccaccgaggcauuccaccugacggucaugaaagauccagacauauuuuacccucuacaauacaagcaauacaaauaauuguugcauaaagcaguuaaacaauagaguagggaaacuaaacaaagaaaacaaaaugaaaacauggugguugccuaguaaaaaaguugagaaaucaguaagaauggauuaaacacuguugccuuuauugcuauuaccugacauuuaugugacugagaguucccgcaguucagcagcauuucauuuagaagacauaauccuugcuguuaagguaguacuuuaaauuuaauuuuauggcacaguaaguuaaaugguugcuauuccucagccaucuccuccuuggccuggggaccuagacaaguuuguauauuguuucagaccacugaugggccaguuaauguaucaaagggcacacuguggcuuacagacagggcaaugguuccugaccuuacaacugaauuagaauuaucuagagggcuguuaaccacagaucgcugggccccaccugcagacuuucuccuuggguuauagagggugagcucuuggaucucuggacaagcuaacuugaucaugaugauacugucccaggaucuacacuuugcaaaccacuaagaggguaaugugaaaguagcuggggugugagacagacagggagauuuccauguagaaaaaagucucucuguauuggagagaucaaaggaaaauaaaucuccaacuggcucccuuuaauauuucuucccuuuucccuuuuuauauagguaauacccaacuucaguucccaggauauaucuuucaaguguucauugaaauuuagacacaauuuuuaacaugguaguauaugauuucuaggccguaagggcacauuaauaaauaguuguaaaguauguauacaucucaggaugaauuaaggaacauagaucacagaaggcuccuagugcucaagacuguguugcagcuggugaaggguugcaccccaaagugucauuuccauuacucugugggacacaccugggcuucugauggguucuuauacaacacucgcagaucauaggaacucuacaggagauaggaagaaguugugaagaaaaguccuagguaucaggcguuuuaauuaccacuugcuacccuuccagcagcaaguaaaagccuuauuacuugccaggugcuauggguggagaugaggaaggacgcaaagugaaggacagugagaagggcuccuuacuuugagaggaacacagucuuauuugcucucugaaccugcauagauuaaaugagaaguaacccuggauaagagccucugcacuuagcacuuggugugcuuguaucacucaccaaaccucacugggaaugacuguucucaccuacaaagacuauuguacaguuuuucagacuuuagauauugacaauuauaccaugaccuaccauagcacaaucuuaagauucaaaugcccagcaauguggucagcguucccauuuuacaucuucagauguuccuucaaauuaguuaugccugugcuucagagauaccucaggcaguaaagacgauuuauggguucaggcuuugugaacuauagcauguuauuugaauguggcagauaauugauuacuguuuguacaaggguccuucuuuaaguuaguucucagcugguguuccuaagagagguaaaacauuugcuuaggaguccagagaaugaggacuuccacuucccuucucuugucuuguuacauucagguguuuuauaaauugagugacacuuuaacaggauguugaguucuguugaaagagagcagucagggcucuuucagaagauaccauugcuuauagagacagcauggcuagaagcugcagcagauagaaguaaaggugaugguaagcacucagccucuaccaggaccuuacuagccauuggauuucuugggggaggggggagaggggggagggggaggagcguuaaacaggaguuaggcauucuugaauuggaauguugccuuggugacuuccacuagugugguuuuuggaagagcacucuggcuucucauugauaacaugaaaacaaaaacaaaaccauugcuaucucuuacugucuuaguuauuguucuacugcugugaagagacaauugugaucaagguaacuuaacaaaagaaagcauuuaauuggaagcuugcuugcaguaccagaggguuaguccaugaccaucauggaaggaaacaaggcagcagcagccaggcaugguguuggagaaguaguugagccuauaucugauaaacaagcaaguggcagagagaggaaaagauuggaccuagagugggcuuuuuaaaucuca

SEQ ID NO: 6868 - RNA, 1229 nt, Mus musculus
ggcgaaccgcaggauguuggaggugaggcugccacugcugagcacccuagaugacuuuguccuggggucugcgcgucugucggcuccugauccaggcgauccacaaugauggugucacugcgucuucaacaaccuccucuacuaccaaaccaauuaccuucucugcuuuggcaucagucuugcgcuggccggguacauucgucugcugcacacccuccugagcgcacugguaguggugguggcccucggggugcuggugugggcugcugaaacccgugcagcugugcgccgcugccguagccagccacccugcugccugccuggcugcaguacuugccauuagccucuucauucucugggcuguggguggcgccuucaccuuccugcucugcaucacagcgccugugcuuuugauccugcugcaugcuucacugcgucugagaaaccuuaaaaacaagauugagaacaagaucgagagcaucggucuaaagcggacaccaaugggauugcuucuagaggcucugggacaggagcaggaagcuggauccuaggaccuuggcaucuacacccugaacguagaggacccccaccccauacccaagaccaacccuuuuccuagccauuaaaauaggugccuagaguccucuggccuggccaaaaagagacaccugugauugaucacugcagccccaaacuagucgucucuuagccuccagccccuguuaccuagggaccaaagucuuccucgguccugaauuugagacucagucaccuacuuccagucuugaaacuggauuuuuaagccagagcaucuguggcuaaucucaaaacuggaccccaagauacuccucugacccaaaugugggucucacuagucuuccauacgucaaagcuaggcccuaaggcaggacauucucaaaucuugagcucuaaagauuuuucagaccccacacagcuuggaauauagguuauaagaccuggccaaaucuugagccuaaugaguccacacugagcccuuaaccucagacgacccuagcccucagcagucccaauagccucccuccaaccguuaagagggucuuuuccucccucacaauguucucaguaucaaggaccaacauguggggcuggcuagggauagccccaacugggaaagggacacauauaauaguguugcuacaacaauaaagccuuugaaucucaaaaaaaaaaaaaaaaaaaaagaaaga

SEQ ID NO: 6869 - RNA, 2026 nt, Mus musculus
ggcugcuauuccugcgccucugcuccguuccccgcaguucucuuccgugugccauggacggcaucgucccagacauagcagucgguacaaagcagggauccgacgagcucuucuccacgugugucagcaacggccccuucaucaugagcagcucugccucagcagccaauggaaacgauagcaagaaguucaaaggugacaacaggagcgcaggagucccuuccagagucauccacgucagaaagcugcccagcgaugucacugagggcgaggucaucucccuagggcugcccuuuggaaagguuaccaaccuucuuaugcugaaggggaagaaccaggccuucacugaaaugaacacagaggagacugccaacacuaugguuaacuacuauacaucgguagcgccagugcuucguggacagcccaucuacauccaguucuccaaccacaaagagcucgagaccgacagcucgcccaaccaggcacgugcccaggcagcccugcaggcuguaaacucuguccauucuggaaaccuggccuuggcagcgucugcugcugccguagacgcaggaauggcaauggcagggcagaguccagcgcucaggaucauugucgaaaaccuuuucuacccagugacccuggacauggugcaccagaucuucucuaaguuuggcaccguccugaagaucaucacauucaccaagaacaaccaguuccaggcgcugcugcaguaugcugacccugugagugcccagcaugccaagcugucccuggauggcuagaacaucuacaacgccugcugcacgcuacgcauugacuucuccaagcucaccagucucaacaucaaauacaacaaugauaagagcagagacuacacucgaccugaccugccaucuggagacagccagccuucacuagaccagaccauggcagcagccuuuggugcgcccggcauaaugucagccucuccauaugcaggagcccgguucaucccaccucaggccgcaggccucucugucccuaauguccauggagccuuggcuccccuggccaucucgucugcugcugcugcugcugcggccagcugcauugccaucccaggguuggcaggugcugggaauuccguccuuuuggucagcaaccugaacccugagauagucacaccccaaagccucuuuauucucuucggcgucuacggugaugugcagcgggugaagauccuguucaauaaggagaagcgcuugugcagauggcagacggcagccaggcccagcuggccaugagccacaugaacgggcacaagcacgggaagucagugcgcaucacacuguccaagcaucagagugugcagcugccucgggagggucaggaggaccaggaccgcugcucccugcugcaccgcuucaagaaaccaggcuccaagaacuuccagaacaucuuuccacccucagcuacccugcaccucuccaacaucccgcccuuugugucagaggacgaccucaagagccucuucuccagcaauggugguguggucaaaggcuucaaguucuuccagaaggaccgcaagaugguacugauccagaugggcucuguggaggaggcuguguaggcgcugauugaacugcacaaccaugaccugggcgagaaccaccaccugugaguguccuuuuccaaguccaccaucuaggugucugugggccugcgucagcuuccaccauuccagaaaagccacuuuaaaaagcagcugaagugaccuuauagaccagagauuuuauuuuuuuaaaaagagaucaguuuaccuguuuuuaaaaaaauuaaaucuagcccacucugcaguggcaggaaauggcuuggaccacagaggcccagucaaucccagcaccaugccuugaggggcucaggcaugaggccacagcggugccccaaacauagccucuuucugugccuuacaaaccaacgugccucauggccguacaccuacccucuaaggccaccaguugucucuagaccugcaggugagccaggu

SEQ ID NO: 6870 - RNA, 977 nt, Mus musculus
agaaaauaaaagacccguuccuagcgcagccauggcucguggucccaagaaacaccugaagcguguagcugcuccaaaacauuggaugcuggauaaguugacuggcguguuugcuccucguccauccacugguccucacaagcugagggaaugccugccucucaucauuuuccuaaggaacagacuuaaguaugcccugacuggagaugaaguaaaagagauuugcaugcagcgauucauuaagauugaugggaaaaucaggaccgguauaaucuacccugcuggguuuauggaugucaucagcauugacaagaccggagagaacuuccgucugaucuaugacaccaagggucgcuuugcuguucaucguauuacaccggaggaggccaaguacaaguugugcaaagugagaaagaucuuugugggcacaaaaggaaucccgcaccuggugacccaugaugcucuuacuauucgguacccugauccccucaucaaggugaacgacaccauucagauugauuuggagacaggcaaaauaacugacuucaucaaguuugacacugggaaccugugacuggaggugcuaacuugggaagaauugguguaaucaccaacagagagagacaucccggcucuuuugaugugguucaugugaaagaugccaauggcaacagcauugccacgcggcuguccaacauuuuuguuauuggcaaggguaacaaaccauggaucucucuucccagaggaaaaggaauccgccucaccauugcugaagagagagacaagaggcuugcggccaaacagagcagugggugaaauggucucuaggggacaugcuggaaaaguguuuguacaagccuuucuaggcaacauacaugcuagauuaaacagcauggugaaaguaaaaaaaaaaaaaaaagaaaaagaaaagaaaagaaaagaaaagaaaagaaaagaaaagaaaagaaaagacaaag

SEQ ID NO: 6871 - RNA, 977 nt, Mus musculus
cuuugucuuuucuuuucuuuucuuuucuuuucuuuucuuuucuuuucuuuucuuuuucuuuuuuuuuuuuuuuuacuuucaccaugcuguuuaaucuagcauguauguugccuagaaaggcuuguacaaacacuuuuccagcauguccccuagagaccauuucacccacugcucuguuuggccgcaagccucuugucucucucuucagcaauggugaggcggauuccuuuuccucugggaagagagauccaugguuuguuacccuugccaauaacaaaaauguuggacagccgcguggcaaugcuguugccauuggcaucuuucacaugaaccacaucaaaagagccgggaugucucucucuguuggugauuacaccaauucuucccaaguuagcaccuccagucacagguucccagugucaaacuugaugaagucaguuauuuugccugucuccaaaucaaucugaauggugucguucaccuugaugaggggaucaggguaccgaauaguaagagcaucaugggucaccaggugcgggauuccuuuugugcccacaaagaucuuucucacuuugcacaacuuguacuuggccuccuccgguguaauacgaugaacagcaaagcgacccuuggugucauagaucagacggaaguucucuccggucuugucaaugcugaugacauccauaaacccagcaggguagauuauaccgguccugauuuucccaucaaucuuaaugaaucgcugcaugcaaaucucuuuuacuucaucuccagucagggcauacuuaagucuguuccuuaggaaaaugaugagaggcaggcauucccucagcuugugaggaccaguggauggacgaggagcaaacacgccagucaacuuauccagcauccaauguuuuggagcagcuacacgcuucagguguuucuugggaccacgagccauggcugcgcuaggaacgggucuuuuauuuucu

SEQ ID NO: 6872 - RNA, 1605 nt, Mus musculus
cauggcgaccguuccggacacgcggcugugguggaacaagguccagcccagacuaaggccgccgugggacaggaaggcuggcucggucauccuuaaacaacagaacugggagggggcgcccgaccgcgcgugggaccuagccaccagccuuuggagaacagagcgacugucuuggcuaccaacauucagccgcccaggauuccgggcgggaguucggaagucgcgacacaagggagaccuaacccuucucacacccgggagaccuacguuuacugccccccacccccaccgucguaagggcgguugcuuuugcacggguugaaaacuuaaggaccagucccgguuagcuagcaaagucccgaaguuacuuuuucaggacagaacgagagaaagugugacggaccugccuuuucuacauccuugggaucuuugggggguggggagaaggggccacgacacuucuccccuuccagggucccucgcucucccaccucuaguagccccagcccuccccuaccagauggucuguccucccugaguuuuuacccgggagguccuccgagucagaggcagaauuucgucucccacuaagcuugccuuaccccaaagaccauuugugagagcgagucccuuucaaauaucucccuguagaaaaacugaaaguagaaagaaaggaagcaaucuccgagcagaugucugaccaccccuacucgcauacacgcagcaucggguuacaagguccuaggaaccccaaccccguucugcgaccccacacgggugaacccccggugcuuucaugccagcuuccgaacucccccaggucgccccguacccagcacgaccaggcccccggagucagggagggcagcggagaauaacgaaauagguauaaauauuaagccgugacauugacacgcccggcgccuccccucccccgcgcucuggacacacucugggcugcucggcacgcccccucucgucccgcugcgucccgcgcagcgcucauccccaggggacccagcaaccucuuccuagcgaagaccgguuucuauccgagaaacccggccggauuaggcagccagggcgaguagagggggggaggaggggagcuggugaaaccggguggaagucucccgggcagucacacuuucuccuuguccuccggucuccuccuccuaggugcagagauugugggcagacagcguaaucucugcugagggggaagagcggaguuucgcggcggcugcgcccggcuugcgcccgcgggcgaagaggucgguccgucuagcccggguguccccgaggcguguaaggcagcgagugcgcaccccgguuccacugugccgcgucggcagccugaagccagcauggagaaggacagccugagucgcgccgaucagcaguaugagugcguggcggagaucggcgaaggcgccuacgggaagguguucaaggcccacgaccugaagaacggcggccgcuucuuggcucugaagcgcgagcacucgcagaccagugaggagggcaugccgcucuccaccauccacgagguggcggugcugaggcaccuggagaccuucgagcaacccaacguggucaggugag

SEQ ID NO: 6873 - RNA, 2944 nt, Mus musculus
ggcucugggacuggagccuucuaagccuuccugccccuuccccuagauagcugagcuuuuucuguacgaacuaaacggaaugcuggacauuggaagugaguuucuucucuuccgaucaggcaugaaaacugauuccuggucauaggacucagauuuaagggggacacugcugccucugaagagcuuugcuucuuuugggaggagauucugggaaugugaauggaggccccuugcagcccauuucaagcgugcccaucucaggaguacucgguggagguuuguggagaagagucugcacgugaaaaaugauaauaaccuauccaccaccaccaccaccaccaccgcaccccccgccuccagucuguacaaguaguaaacugaaggcaauauucacucguuaaacaguucuucguucucaacuguucucugaggggcgggggaaggcaguaaaaugaagucgacucggucugggccuggggcugugcguaacuccagugugagaucauucuccugucacaaugcuggcucucccagacccuucucacuccuccgcccuccuaggaagcaguucacuccuuguggguccacccuccuucaccagccaccaucuugucaccacacaagccaaccuguggucuguguggugacauaucccugaacgcagcgaggucgcccucccuggcacuccggggcuauuuucucagccaccggccaccuccacgcuggucuccacuuuuguucugucucuucucaggcuuccaggcugggcagcucuguuucucccugugaaguucccuuugcugcaugcagugcagcgaaaacaauggcuuacaaguagaugauuguaauuagauggggcuuucagcuuagagaucauagaugggaauauagguucugauuuucuuguucuucuagaaaauucaaaaggucaaagguaacugcaacacucccuccuaacucuauuggcagugaauauucucuggauuggucaagaagccaguuuuguuuguccggggcaucauuaacaauauaucaccucucccacagaggauuaauuaauauuucauuugauuguuuucuugagcuguucacuaaaauaucuuuuuuuuuuuuuacaaagcauuugugagacguugcauggugcucugagcuaaaaugauccucuucaucuacuaucucauuugcagauaauucuacucaaaagcaugaguugccuuuucucauuguauuugccucucagaagguaaugaauuucccauugaaaaauuaaaaacaaaaguucaauuacuauaugaugugucagguaaaguuucacaauugucuuauuuguugaaauuuaaaccuucacucuucaaaauaaaugcuagcacuuaggcagcuagugaaggauuuguuuguuugugugccuuacuugugacuacuagcuaaugaauuagguaagcuaauaaagaauuugcuuguguguguuggguuuguuugugcaccuugcuagugguuuugguuuaacuuaauuucucaucagaugaaugugcuaugcccagugauugcaauaguuguguuggcagaggaguguguuuguguguguguguguauauuuaugucuaguguguguguuuauguauauaugcauauguguguguauaggucuauuuguguguaugugauuauauguguguauaucugcauguauguguaaguauacauauaugcuuauacuuauauauguguggguauacauauauguguagguauguauguguaaguauacauauguguguguguauguauauauauauauauauauauauuuguuuuaguagucuucuuuguaaaaccaacaggaugagacauuuaaaugacuaauucuauaagagacucuugacucuggcuaccuaugcuacuagggguccugggugccugggcuuaucuguguuuccuuuccaguguauaucuagcucacauuccccaauucccgcauaccucuuguggcuggaggcaagguggaaagcagaaaagaaagcaggguccuaggggcaggaggguaugcuuuuagagcugccuuucagucaucucugugcaugugggcuuugggccuggagcuucuugaacuaacguuccuaccucucccaccuugaauacuagguuuucuuguagauggauuuauggaagugacuuucuucucuggcccggcgagagaacugcuuucugguuuacagaacuuggguguagugagaauccucccuuccaccagcacugaagaagcacuuccucugaaagaagauucuggaaauguaguggaagaccuugcuaccucacaucuaccaccuugucuaccucguaccuccucgggagugccugguggagacauguggaaaagagcuggaaagugagaauagaaucccauuuauccacaguagcucaacuauaguuauuaaggaguuauaauacuguucacugcuucugccuguggugucuauuucuucccucuuugucaaagccacuuucaggugccuuagccucuuccagauccaagcuuucugacugacguguuuaagaaagugaaauaaaaguuuguagacuacccuacauugucugguuaucugggugggaauuacuuuccuuuuauacuuucuucgguuaagaguaaagcuccagcaaucugacaggggaggaaaguccucaagggaugaugguuaaacuccuaagaauacauaccagguuacaaaaacaacagacaacauaaaagaggcaggaaaagggagaagaagagauguacccugucucauaccauagacacauugaagaucacuacagaaugauggaaaaugaucaaaccauaaucuucccaaaguggugccaaacagaaauaaucaccauaauuuggagaauaagcaauaccucuguggguggaaacagaaaguaauagcacaaagauuacuaauuu

SEQ ID NO: 6874 - RNA, 880 nt, Mus musculus
aggagucggcgcugggagguguacagcccaacguugcagaagugcggccggagcggccggagcugggggagccuagccgggcaaccgggcaccuguccccgccgcccggcugcccgguugcaccuucugauccggucacacggaccggcaccccccaaaaagaccaaagauagcagacauauucccgaucccccucauuuccucccgcuggguucccguguucccggauccuucccugacccuccauucuccuuggucccuugauuucucucuuuguucggaguccccuccauacucagagaugcagaggugccccggggugggcgcaaacgugcccgcagguuucccuguggcgaugggacaauaagaccgaacagcagggggacuugguacuccagagucacugugugguaguuucugucuaggacggaggaugacaggagccugagaccaaaauacccccacuucuuacgcaggcagagagggggaaacgguagagcaucucaaaagcccccuaccugaccagugugucaaaaacacucaguucucaggaaugaauuuuacccacucaaaaguugaaaaugcagcuuuuaagaucgcauccgugaccuggcgccauggccacacuguacuuggagaccuggacauucacagcuuaaaacuccccuuuuucuuguugcacaguuuuaauucaaagaagaugcagauuuugcugcuaaugggguuuaaaucuguuuaucucguagaaggcagucucggagaugucucaccaagguuaacaggcuuucccauggauguguaaacaauucaaauuagguugaagaugacaauuuuuuucauacaaauuaucuaccaaagcacaccaugauaucuaaaaaaa

SEQ ID NO: 6875 - RNA, 69130 nt, Mus musculus
gauaccuuggcaucgggaagagcacacacggccuggcuauccucggaccagagaacucaaaaauugccaaagacccaucauggaucauaaaauaaugagugccacauaucuuugaguauguguaagaaaccagaggcucuuaacagcugagccucugagcuaaauuuaaugcggaugaucacaagaguuacuaguuucuuuguucggaaaaucaguuagccauauaaaaaccaaccaaagguguuuauugacuggcaaaaacucugaaggaaauucugagaccaugaagaaaucauuaaucaugcauuaaaugacagcagugagcaaauuaagccucugaaacauuacuaagccuagaauauguauuuuaaauauaaaagccaacuccaaccugucugaguuuuacucauuauuuucaaacaauaauuuacgacaauaauguuuagaccuucacuuaagaaaaauggcuaaaucaaaucaaaaucuaaaucaaaaaaauaaaaaaaaaaauaaaaugcuaaaucaaaaaagcacuugcugcucuugcaagagaccagguuuggguuguuagcuuccaacuagcagcagcucacagccaucuguaacugcagguuccagggaucugauguccucuucaggacucuauggccacugcaugcauuuggugcacagacaugcauguaggcaaaacauucauacacauaaaaacuaagaacaaauagaucguuuagaauaaauacaaggaguggagagagagaggagagagagagagaguguguguguguguguggucacaccacaggccugaaggagaguguaaaugcagaguuuagcagagcugcccagugagcauccaugagugcuuguuaagugguuguuaccucaggcuuuuguccuguguuuacugagacagggagaaaacugagcgucuguuucuuuuauuuauccucaagcucuagugaccuuuaggcaucccugucucugcaaacauuuccucaucccugcuguguggaugcuagaggacgcucaggcagagugggagcacacggacuccuuacaagaggcagggaugcuuugccugcagacggcucaucagucuggggcggaggagggcggaguggaugggcuuuugccaaggacccaaucauuaacccuaaacagugagucaaaaucuuccagagggugaaaacccagcacccuggcugcuuuugaagaagaggccgguaccagcuucuccuucuaagccuuggcagcugugcuguauacgacuaagggggaauugagaaucacuaauucauaguuguccuuuuagcauuuguaugcgaucugauuggaaaagaucauaagccuagcuugcaguagugaaguaggcggggccccuaucuacaugucccuggugucccuggaguaucuguggagacuuugcuaaucuccacaagacugcugaggaaggaaaccuuugguggcauggaaaaaaaucaucuuguuucagacuccuacuuaaaacaauaaaccaaguaccaugggaguuguaaccaaauguuuaaucccacaagacauacacaugguaaagcacaagacaguaucccauacaguagaaaacugacaccugaucaauagcgugaggcuggguuucaugucuuagggucugcugcaucaguggugauggcaaguggugcucucugauuauuacugcugacuccgucaacaaugcuugcuuccauaaagugcugauaaauaacuauguuacaaaaaaggauggucccuggagaacauuccaggucaggugauggcagacuugaugagauggcucauaguucuucauggugcugcaaggacuccagcuugccugaaucagacaugucauagcucgccucauacuuggccaagaucuucaugaugggccgcaguuucagccaccacugcuccuuggggauccugugccugucaggaagacaagucagccgucaaauauuauuacaucugcuggaagaugacuucugacugcuacauacugcuggccacugucugaauaggcucgccagaaaaaugggcuuuggugcagccaccuaaauaaauaugggauaaggcaacuguuuuucauuucaagaccaaguagcccaggguggccuuaaaccaguaagcuuucagcuggucaagcaacugcugggaugacagcuauggaccgccauauccaguguauuauguguguaugugugugagugucuauaugugugugccuguguauguaugccuguguguauguauguauaucacuagagauuaaaccuagggcccaauaauacuagcccaaacuacauaagugcucuaccaucaagcuuauucugaggccuuuguauguuuuguguuuugaaacaaggacucacaaucuuguccagucugaccuugaauuuaagacacuucuaaacgaugcugugauuguaggccuguuccaccauacuccgguucauagagcaauuuccauaggucagaugaaaccauuacuucuguuuuuuuuuuuuuaaaucuguccuacauguguucucugucucucucugucucucucucucucucuuguguguuguguguauuuaacuagcuucagaaaagcuccuauguuuaccuaagacagcucaauagugaguuccuuauaguacuuaggacaguacuggugauggugaucuguccucaaagcuccuauuucucauccucccuagugaugagauucagauaaauaccauggcauugacuuacucaaagucagugacuuucuucagcucugccacugguugaaacaggagaucucucuugcaaauucccaggacacaaauggaaucaucgcuaacaaauuuuuucccugugaaaguaaaaaaagagaaaagaaagaaaucuaagaacuauugagcauauugaaaagcagauaaaaguguaggcggaccaggacagugaagggagagaagccaucagaaaacaaauuuauguauugugggaagaccuguaacuccucagaguccugagguguccuagcucugcaaagcccagucaggaugugaauuaugccugagaaacccacuuucccaucuauugcucagaucuuuaacugugaccagggccuuuccuagacuggcagcacucuuuccuuagagcuguaucucaggcacccucaagucuccuccaggaugggauacaaagaggccuggacucuguaggagccuaccuucugucacacacucaaggaggaacccuuucccuaccaccacacacaguaugccuacaggauaauggccacugggggagagguuccaggaaagcagaaagugcuccucaaguauuucacuaaauggugcaaugagaaaaugugauuuaaguggcagaaagaguucacuuuaauauuuaaagcucaaggacaaacugggaaaggaaaucuaggcagaagaaaagaauacaacagcaucaagugauguagacaaauuaucaagaggggaaaaaaaaacccagaguuaggacucugaaaauacuacaggucaguucgaacuauuuauaucuguucuguaggaugccacuuuuaucagccucauaguggacaucguauaggucgauccuaagggaaucacacccaguaugacugagaaagaagcccgacauagggagagggugccaaaaagccuggcccaaguaaccaaugggaagaggcagugugauuagaaaugcaggccuccagagggaacagcaugaaaagcuucaugcaaaguuuuugaaaauguaaaugaauuuaaacuauucuagaaaucauaacuuacggaagugauccugggggguggggggagauaagcguguaguuucauuaagcaugaauggguucauuuagcagucaacaucuuuccacaaaggaaacuggagguuuggacaggugcuugcacaggaagggucuaccaaacauccugaaggcuaaacucccaucuuagacugaaggaagucccccgcuucaauuucaaccuugacccacugucugacaaaaaacaauaccaguagggaaacagcuggcagauguuugccaucacugaaacagauggccuggcccuaaggaacugcaacaucugagaggucuggguggucagccaugggccagguggacagcaugccuaagagugagcacaggaccgccaagacuggcucagugccucugcugagcauccaucugugguggguauugggugggggagacccaggccccacagcauguguugagucagcaaacuuggaaacacaugaggguuaacugguuaucacacuccucgucaaggugugaacaagacaucacacaacuucagcaguuugccaugaccuuuccuucauacaaccuagaaagcugaacuaaacuauacgucugaggauguauuuauuugcucaugauauucuaggagaaaucaagggaaugacugucaucaaauccuaagguuacuucuggaggagagaagaaauugaaaaagggacaauaugcaggauuugaagaaggaagauagggcacagcuccuccccaucagugugcguaucuccuagcccuggguaaccugccuaugaguccaauggacaaguguuagucuaaguguaaggaccuucaauguguuucaugacaccacagaaagcaaugcuccaucuuacagucuugcuaauggcaaacagugugccaggcaaucuccuagcuaacaagaaugcuaccaaacaacuuggcacccaucacuagcaguauaaauaaaauaguuuuaugaauuauguuuaauuauaaccucuggaaaucacaggugguagucaguauucacagucaaggagagagugcggugucccagacauggcaauggcagauuuaaagaaggagaaacaccauagcuguuauaacagcguucucagugaggcacugaggcacauuucccauucucccuguccccucauaccugugcccugggaccccuucaguuuggccgagauccacuccauugcuuuggcagaaaucuugguuccaaaguuccuaucgaauggagacggugcuccccccuguggguggcaaguuauaugauuucacaagucacacagcaaauucuccugauuuuuuuuuuuuuuuuaagaaaccaaugaaaaauaccaaaacuuaacaacaugcaugugguguucagccugcuacauagccuugugguguccccaacuaaacaaguaagcuguuguucuuuguguugcugucucuauuugugucucugugugugguacagacguguguguguguguguguguguguguguguguguagaugugcucuccuacccguguggagggcagagcaccacaucagauauuacggcuuuccaacaacuggcuucagacagggucucucacaacuagaaacuccccguuuagaccaggcugccagcccagcuaguuuucuagaucugucucaccccaguaaugguguuagaggcaugggcagccaugccuggcuuaguauguuggugcuggagauucaaauccuggcccuauuucuugcagaguaugggcuguauaccuacugagccauuuucccagcccauuuccgaggccagggaugaaucacaacuucuuuuaaugauaaaaaucuguggagucacaaaaaugagaauauacauauucucauauacauaucauauacauaacucacauuaacuucaggaauucaugaaccccucggaaagaaguuaguggcuccuaguuuaaguuucuggaaguuggcaucuuuacugacuagcaaaauagcaguuaucagugagcucugagcuugagcaaguaugggugauuccacaugucaauucugggccuccguauguauacacacacacacacacacacacacacauuuuaaaagggcauauguaaacaugagcagcacacacaugugcacauacagagacacacaaguggaugaagauuaaaaaguucccuacauugcacaaaggccaacaaauacgcaacaagaccacuggcucccaagcugaucuccagccuugugaccugggcaugcucacuucacagaaaggugaguauaaagaaaaacaaugaagacaaaagaaaggcccguauucugcagguagagaagcaguucuaucuuuccagauaaucucgauuuguugaaagugucaaauaaauacuacuguacuggucccaaacuccaccugaaaucuuauuagaagcugauacuuaacucagcaaaguuauuggaguguuuccaaugaccaguguucuuucucggcuauaugaaagcugauagguuuucccuuaaaaguacugcugugguuugaggguggacugucuccuccauagacucaugucuuaaaauacuuaguccccaacuuaggguggagcuugagguagaugaccuggagcaagcaggucaccgucaccacggaagcucauucguagucucuuagcccagccccaccucaugaucgcccucuaccuccagacuguggauucaaagcaagcaucugccucccacucccucccugaugucuuuccugccacugcuggcgcuauccccuuaaauuguuggccaccauaaauccuuccucuguuauauugcuuuuugucagcuguuuggucacaagcaagagcaaagcaucuaaguacuucccauaaacccggaugucacauauuacacagaguccuaaaagggauggcguuccauaugucugaaaacuccgcauacuuacaagagcuuucgaauucaucugugcucacgucccacagaauggcaccauucugagggggaugccuggggcucagggaucacagaagaccuuggccuaccugcugcauauggcccagcacguuuuuccugcagucaaacacuccuuugcccuccucugaguagagcugguagaugaagucagugguauaauuuacacugcagcuuucguuucugaaacggaugugaagauggcaaguuuacuccgggcuguggagggguugagugugggcuuucugaagaacugcuccagccagccaggcuggcucaaggcucaaggcacccagucauuugccaugucagccuccuucaucucugccccuacccugacucuguacauuucccuuugcucauaaaggcuguuugggaggggggcucaaggaaaugaggggcaagugucuagaaaauaauaaccaauaggcuauagagcaagaauaaaauguaaaagguuguccuuuguuuagaugaagaccugauuuuuuuuaaacaacucagguuucuaaagaaaccugugcuucuuuagcauccacagaaccaguggcaaaggaaaaaucccacugggguuugaaucccaugacaacuucuguccaagaaccuacaccuaaaauggaagaccagaaacccucuccauuaccugaguacgaggccccucuggaugcuggucuucauuuucucugucaagugcacgacguuggacuagaaaagauuguuugaucagacagugcacuuauuugucaccuaccauaagaccauguaugcuagaauguagcaccauguacaagcacaaucagcugcuucuaaagguuuugggaggugucacaguauggaagaaugcaguggaugaaaaacauggcaguaucauuagcaaaucagauaagcacagaauguguaagagguguggcuaugcuacuggguauguuuauuagaaaaugaauacugacccgccuccaauuaaaauacuuacuuuauacauuugccuaacccacacauuuuuuuuuaauguucaugacugugaugguuaguguucauugucaaccugguacaacccuaaacaccuaagagagucucugcgcuaucuagauuaggcugggucuaugggcauauguauggggaauuaucuugauuauguuaaccauggugggaagaggcgcucauugucgauggcacuauuccccaggaaggggauucugaacuauaagcaggagauacuaagcugagcugaacacacaugcauguguucuccuucuguucuugacuacaugaggcaugcagcuucaaguuccagcuauacugacaucuauacagaccaugaccuggaacuaucggugaaauaaacccuuucucccuuaaguugcuuuggccuggauauuuuacuauaacaaugggaaacaaaaguaggagaauggcaauauuucagaaggccaaagggaugcuguuuaaaacaccaggucccauuacauaagucucuuuaagugacuuaggccaaauacugggaaagcguuucuuguuucucaaaauaaugaaucauuuacaaauacauacacauacagaaacagaguguguguugugaguguguguauuuguguaugagagagagacuggaugugagauaaagagaaagagaggcugugugcgugugugcaugugcgugugugcgugcgugugugugugugugugugaagcccccuaagagcacuuuucuggucuugcagaagaccuagccucuuuucucagcacccauaugaugguucacaaccauccuuaauuccaguucuggccccgagggugugaacauacacacauacucacgaaauauucacauguacaaaauaaaaauaaauggauuaaucaacacacauggucaccuagccaaagagguccuaagacuuaaguacaagcagcuggauuugaagauggcaacugaaaaaugagaagcuugcaauauuuuacaacaccaaucuccagccuucaaaaaaacaauggggaguugguaaagaagguucuuuacgcagcacugcugcacgaagugcucugggggccaagcaugcauggcaugcaaccacugacguaccugcaaaucuccgauaucaaauggcucuucaaagauguaggcagcaucagcuccugcugcaagggcccccauguuggccagguagccacaguauccacccauggucucaaugaugaacacccggcgcuuggucccacuggcugacuguuuaaugcggucgcacgucuaguuacagacauagagaguugucauuugaauccaggaccuuggcuagugccacaugugcaccggcccaggaccuguucuccccacaagcugcagcaugucccuccaccaaacccaagcgugugcgcagaagcaagcauuggcuacagagaggcucaauggcaaaacugcucaugugcagccugucaguaucucugugaucauccgagguggagcccuggcuaggccauuacccuggagacuagucacucaacucagcucacuuccugaacuguuugacuauaucuuugcuggaaguauauuuuuuuuugcaagucaauauuuagcugaugugaauuaauauuucucuaggaauguugguuauccaacuaccuauuuuuucuuuuuacuuugcugauguuucacugugaaaagcucuuugugauguuggauguuuuguuugccuuggaucuuucguaaaggguaccuauguccaaagagaacagcuuccuggacaaaggcacccagagauaucuuccaggcacucucauauugaaacccacugccaaccauucuacaaaaggacccagguucaggacggaggauagcugaaaaccacucagggccucacacccacggcagcaaugcaagugucaaucuuuuccucagaaaucagugguagccuucuaccucauucucagcaugcguucuguuccaaggaaauggagauccacacaugcaauccaaaccugaugguguccuuggauucuucaacccccucagcacucucuuguaaguacuccucaaggcuuuucuaugggaugcauagcccugccaauccccagcacccuguccagcucccagguccaggugcuguccuagcucagagacgcuacucucuugagccucucuggaccuucagacagcagucuccaggcacagugaagaaguaaacauagaggccccuaaagguauuccauacacacucccuggaacuccucuuauacaucuugaggugggguuugucuggaucaucuaagagguugucauagugucacuguaaaggagucaagagaagccagggcacaauaacuacacaaagcuacuacacaaaggagugagaggguuugugccaucuaagaggaugcaacagagguuaggguucauggaaugccagggucacaguuugcgaaagcagaagauauagggacagccucucccugagagcucacaccuugacuucaguucccugacuucugccccucacugcuaugagcaaauggcuauuagguuaacagcaaguauacagccauuuauuacaauuguaagaaauccacucaggcucuuuccuguucucuuaucugcacccugugacccacuuagaaagucauuuccucaggaagacacuaugugaccuccaggagugacagucccucuguguccucccuucaucccaguaugcuuuccuaaaaagugucuuauuagauuuggauauuuccucuccagauugaagucccuggaggacaggagcccugggcggggcugauggaggacagguaugacagaaccugucccagccagcugugccuccaacacaggagaugcuuaacacugaaaagaaaagugcccauuaacagucaggagggaagaggagagagacgucacgagggugaagggguacuuggacugcaacagucacagucacagaucuuuagggaaugugcaaagucaaaagagccauuuggagauuuucacaugaucccucugaguuauacuuaacacaucaucaugcuuaugaacaaacauggguuuuaagaaaaacauuccaaucuguaauuucucuagugaaucccccugcaugugcuuuggugggugggaagcccuggauucucuagaaacagagauggaacaaaggaagaggggguucauguugugcuggauaucucucugugauacucaagcgcugaaagggucaccguguggucuuuguuacagagcccuccuacaaguaaaggaagacugcagaucagaacagaaggcucugcugagguagguacccaguccccugcggggaacaaagccacacagguuaauguccuacuuuaaucuuucccaaaugcccacuaauccagaacacuauguugcagucacuuaaugauucaagaagaugacaaagaaagaacacuuuguuccccaggucugugaauacggaucucuaagcucugauccaaacaggcuguugaugagacagacauaaacaaacugauuagacuaaaccugcuuaccccuggcuggaaaaccaccaccaccaacagguguuuggaaugaucugccucugcuucuggacaccccuccucaaugcucucucguuacccagacugcaccuggagauuucaaacaguuccuucuaaaaauaguaagccacccuugccuugccucacucaauuacuaaaggcagcaccggcauugaaagagccaguauaucaaggccaucugacaugugcuggugacacacggaggggcuucccugacuucuggccaagagggggaaccauuuagggcuccugccucuuaugcuacaacaacuggcucauaggcaaguucaucacugcccaagggcauagagccguuuuucucugggggaggccucugugaggagugcugcuggaggaagaaugucaagcuacaguuccaacaucauggccaguccgcuacacacacuucucuuuucaguaacauacuugaaacgugaggcgguaaggcagagucugucgcagaacuagaucuuccuuuaaggguuauauuaauuagugugggggcaaucaugucuuauuaacaagauaagagguuuccuucucucuuugccccugaucccauaacugguauucuuucagaguacuuacugaagaacucaggagggaagccagaaagggaaggggcuaggcagucuaggcagagagaaucuugucauacuagguaccggcagagaaaacugacugauccucacuucccugucagucagggucuaagccagaaggcugaagcauguuggcccaucuaggacuucuaccuaugauaucacugucaaccaaguuguuagaggggaaagcucuggacucucuuggcccuaagucauccaaugacuaggguucagucuacaggcuucugugugauucuauuuaacaugcaaaguuauuaaacuccaaggaagauaaguaggcgucaggggagcuuucacauuguuuaagagcuccaccaacagacagguuagaagggacauaccuagaguauugcaauccauuuaauagucccaugccaagaucuuaauggaagauucggaugcuugguccaaaugggcaccuucccauuuuuccugccaaguaauuuaacuuaguagagagaacuugggauauaaggaaucgcucuaauguuuaaaacucacuguaagcucuaaggcaguaguucucaacauuccuaacuccgugaugcguagauggaguuccucguguucuggugacccccaaacauaaaauuauuuccuuacuacuuuauaacugugauuuugcuaguguuaugaaugguaauauaaauauuugauauacaggguaucugauaugugacacccccuuggggucacgacauacaggguuaugcaccaggucagaugugaacaugucaaguaagagaucagcuuguugccuuuggaaggaacugagcaugguaagaugccacccuacaugcuugaccaccguccauucuacuguuguauaacugcugacugcacaaaggacucugggagcuagcagacagccuccugccucagaagcaccuaguacauucaguucauuaccuguguuaccaauguagacaccaguaccacauggagcaccugcagcaggugaagucgccuuccucucagagagugacuuugucuccuggaaugccucucaucucaccgggaagccuguguaagccuuggguuccuuaguuucuggauuuauacugaccaugcuuacucuggguaaccaggcgcaauccucugugcucacuccugacacuugugcuguaaccuucccccaacaucacaacucuaacaaugggacuuuggacagaagcagcugaccuuaagagaugugauguccacagcucuccugcucaggugguacagagacacuacagagaggcccgcauagagcauuucauguugaguuaaaacagcaaggacucucaccaugauaauaggaucaccaucuuauuaucaaagguauggccaagugguaaagauaaguuuuggcuuauucccucugaaaaccaugaaaggguaucuuuuuucaauuucuaguuaaggucggacaggugaagguuaaagacuacaaguugagaauuugagcugucaggagggcuaaauggaggagaacaaccccguucaggcaaagcaaaguaaaaauugaagcagaaggucucuuaccucgacaaucacauucagggcaguaucacaaccgauacugaugucugagccagggauaucguugcuaauaguggcaggcaaaacacauauugggauacaaaacuccucaugguuguuucgagccucagauagcaugauggcaccaugauaacccugaagcagcagggccauagcaguuagcaaagugcugguacaucacuugccaaguuacugagcgugggcaguaacuccagggaugugacagggagggaaccaaguaaccagcgggaaguugguccacaugggccagcagagcccacgagaggccagaauuggcaucugggcaggcgaagggcaugcuucaacuauucacaggccacuggguauaucccucagcccucaccuugucccacaggaagaagacacaaguggcuaagguggggcaaagcagacagcaaagcagguagcaggccgaggggacagaggugcaucgaggguuagucauuagauggaacugcugcuccuuucucagcauugaagaggagguggggaaagagagugagguugggggccuuucggcgcaaagcccaucccaacacuucuuuagguggaguggagaauggggaggagcacggggcucauggagaacaucaaaugacugagaucaccaaugcagcugguucacugcaccaccgccaaaggcugacaggaaaagaggcaugcauuuuacauuaccugcaggucuaccccaagacccacaccaucaucacugugccccucugcuccccacuggaaaaucugucucccuccuggaggaagcauucuuccuagaccuuuggcagugcuuacaggaagcaagagaaaucauuuggaaucucaggcacugcuuugaagcgauaauuaaaacugucugacucuauuguaaagaaggcuacuaguuaguaugcagagguuuccagcaccugccucagauauuagagcuggguuagugguagcguacaggucuacucacccacaguuccuaaauccaggcagcucccaacaguauguaggguauuuuuuagaccauugcggauggcaagucugacccaugaaucuuauuuaucuuucuuaaaauaauauaaucaucagguugcugcaggauuauuguucaaauacagcacggacgcugccgccccacaaggcagcugugauaaauguuguacggucuagaccaucuuccugcaaccgaaucguccugagauguaaaaccugugugcuccaaggauucuggacagugggucauggaccugggauacguuaguccuugguaugaucagucaauaggucagacaggguagcugacacuggccagugacaggguuucuucucuuuccaacacaaccagaccuccaccuucaccuccacccacaguuggcgcuaagucuuuuggcugcccuccauguccuugggcguuuugugcuaagguuaugguuguuacaauugauugcauucaaaauggugcccaaugugaaaacccucugagugcccccgcuggucaaugcacugggcuccucggaacuuuccaaaaaaaaauuucuauuuuuuugaggaccauuuuugcuagguauccauuaagaauaaauuguacagaaagaaguugugucuuugagaggccuuccacuggaagucauaggggaguaggcaagaugccugacagaccagagccuuuccugugggcugggagagaaugggggccagggguguaggaggagggcagguagggaauagagggguuagugccuuaaugucauucggacauuguuggugauggcgauaucguugcaagagcuuucuucccucucuaagcaacuaaaagagaagcuccaggagggaaaccauacccaggagaaguagcaaacucugaagaagccauccagaaagucuugcuucuagauccuacagggggcaucagcaacuuugaaaacaccaauaaagccaccuuagacauuuugacugcgcaugcugcaacaaggguugauucaaaguuaucaggacccauguucaaucuccuaguguucacaauuugggacgcccucagaacuguagucaugucaccaguccuggcauucaguggcagcucccaguuagcaugccuugguuguguuuuuugacugggacaaagcucaaugcugaugguaaggaauaaaaccaagucccguugaaaagccucacucaauauuccaacaccagauuucugacaugcccauuuugacaugcaguccagagaacucauccauuacccuugcagcuacugagaugcaggcaagggacacgcuuauaucugagcuucguugcuggugaaggggaaaggauuugugaaggcaauggucaacacucaagggcaaugguguuugaucagacuggacaagcucaggcuuucucaccucaagacaguagauacucugagacugagucaucucugugguagggacuguccccaacacuguaaggcagugaacagcauuccugauaucuacucagaauacuugagggacuccucucuccuaccucugaugacgcaaaauguccaucaucacagcuguccacuagaggucaacuucccacuauuaaaauuaacgcuuuucuuccaugcucuagucguuuuacccuuggggaugugccaagggccucugaacuguauucucauccccacacagcuaucagcuccagagcaguggcaaccuucaccaagguuaucucagcuggccuggcuucagccacccaccuugagaucacaaaaccgugaagacccaggucccagguacaucagaaacaaagagcagccaaaaaaaaaaaaaacaaacaaaaacaaaaaaacccacaaaaacaacaacaacaaagugcaggugcacaccaacuuacccugcaugagugagccugaagcccucaggaacggcuaccuaccuaccauucagcuuucauucucucauauuaccacuggcuuugagaaaugcaaauaauaagaaaaagagauuaaacaaaaaagaaaaaauagcacaaaaucccucuaaagggaguaauaggaagagggaguagauaaccuuuccccucuucucuuuuuugagcuucaauuuuucagcaauauguauauauccuauauuuauaucugggacaaaauaauuacuaguauugcagcuaaaaaucauaaauuauaauuauggggacauuauaagaugaaagaaagaaucuuccuucaugucugacagugaacacugaauauccacaggagauaaaugauccagcuuggcugguaucugcagaggcccccacuaaacuccaagugacaguaugcaggcguguccaaccacucaguguuuugaugggaugcugucaucauuuacaaaggucacguucaaagccacagaacacaguuucaaaacugacuugcaaaaauaagucucauacuauuuuaaaugaguuuaugguuguuuuguuuguuuguuuguuuguuuuuugucuaggccacauugauagcuacucuuugacacaugcaguccacaaacuacugcucagauacaccuguagggaagugucugcuucgaugucaaagagcuugugaaaaagacacuuugcuuccccuauaaauuccuccauguaaacugcagacuguaacucagcaucugggaugcacaaggcucuggaucccaauuuauuuugugacagacacccuucuuuccauugacaaagggcgaaagauccaccaagagccggaacccaucaaccacaacagcagaagcaauaauggcaguugucaaauagcacaugcaacagccgggagacguuagagauugggaauagacaaagcugacaccaggcacuuagguuucaguaagccgagggaagaauaguuccgccauucagaaaagcaagaaaucagcgcuaagcguuacuuaccacugugagcuuuuuuguaaaagcguuggggcuuuuauuuaccguacuagaaaugaguuuggugucaggagcuuaagacaaaacaaaauccuaacaaaauuauguauaagaauuaugucuuccagggaaaauaacucaaggguuacugaaaaacuuuagaauucugacuuaguaaucuuaaacuccauaagaauuaacaaguauaauuuacaaauguaacacuaaaauguauguguauauuuuguuacuacuuuuuuuggaaaaagaaaaauaauaagaaagcaucaauauuuuugacacaauuuaagauuaccgauuuauaaaaaggaaaaauaaugguaacaaccauagccaaaaaccuagugaagugcccauaguuuguucacggaauaucauuauuaaauauucaguucaauaucuauagucaacaucaaguagaugauguuggacaaaggauuuaagugcgauaagaggcaauaggcugaaggaaaauuacauccggccaaaacuuaaaaacccugcaauuagcugaggaucugaucagaaaacaccgugguccagcacugcuugagcuaggaugggcugucacuccacaggucuugguaauggagucaagucaugcgagcagcaacacagaagaacccaugagaaaaacuggggugggggcaauuaaauuaagcauuuucagaauccaaaaggaaguuuuaaaauguacuuucuugaaauaaaaauauuuagguauccaauugguaaaaggcuauuucuaguacacugguagauaaaaggaucccggccucggguuagcgucaguggcaccugcuuugcuggcacacccacacuuacgucugugauaguguucagagcugugucugccccgaugcugaaaucggaacccggcacauuguuggagacaguagcaggaaccauaaccauggggacacagaacgccucauguuucucccgggcagcugccagcucuaggaguccuagguaggccugucagauaagucugugugauugcaaggcuaggggagggagagagggacgugaacagcguguggccaggagcgagcaagcacggggaguacacagugcacgggguacacggugaggagagcagguaccacuagaagaaccaacacagaauuguuacgagcagagacaaggacaagcagcuuucugggagucaaggggagaagugguauuagcauacaggacuacgauuaacucucucuuaauuuugaaucugguuuugugaaguucuuaucuuucuuuugguaaauucucuacgauuucuaugacuuucguccccaucgaguaggauguaauuaaggacuacauaaauccaauauaauauaugacguuuaaaaaaaaaaaguccgaagagaaacauuaaccauauaaccuccuuccuuucaaaaucagcaguauaucucaaauggcaaauauuggauuauaucuacagauugauaacaaaugagaaaacaucaaaaggaguuucagcagaauagacaauuuacugguuuaauuuaucagaauugagcuagucuugugcuacaucuugcuacccugcuauucuguguuucaggacaauggguuuguguauuaaaaccccacuuccugaggaguagacauuaaaaugggguauaugugaugcaaacauagggcuaccaaucacaccuccagaacgaacaagcagggagacagacacacaauaacguaccucaaauccuccaaugaucagaagggcauugauacuaugggaaugcaucugcucugcgaucuucuccaaguacuuuccagguagggugcugaagacagacagacagacagaacaagaggugagaguacacccacaagcugccaaacuucuuggaauucauucuucccaccacuggggucucuucucccaccuuccacccauaucucaguucuguagcaugaaaagugcuguuggcaguggggcuacuuuuuugugccuccauggcugacagcaccaguagaguccuggaaaaugauugcuuaaggaagcacuggcaagguaugaugucccaaaagagcauuucucaaagguagguggacagggaaccuagcucaaugguugcucuaaguucaauccauagcacuguaauagauuaaaaugagcagggacacaaacagaaacagagccauccagaagaaugacguggccguggacaccugaaauuccaacguccacugaguugaagagcagccugggcuacagaauguccuuucucauaaaggccaaaaagaauugugcuggcucaugagaaaaagaaaauacguauuagcuuacaguuacucaguguaaucauuuacucuuagaaauuuccauuuuccuaauuacaugccuuuggauauaugcacauguauauauguguguauguauauguuuuacaauguauuuaauauauuuauguguguauaaguaauauauauauuaaauaauacaauauuaaguauauagaaauuauaugcaauacacacacauuccacacugcucagagcaaugcccagguugccuuccauaaagcauacaugggccugcagcugggcugacucucugcagaggcuagggagucugucugucuacauaaucaccagucuacagaggcuuugccaccaaagcaccaacaccauggcacagagaagcaaucuagaagccuggggaagccacccuggggaauccccaucugucuaucuggcacuacaagccaugauacugaaacaagcagaaaaguugauuugauucuucucagacauuagccacagugacauaagagcccaaaacccuaaaaauugcuucccuuccauaugacagaugcaagguacaguaguggcugguguugauucuugcauccuggaaaucaccaaaccucugaaacgguaaaccagccccaauuaaauguccacuuuuauaaaaguugcugugguaaccgugucuuuccaaggaaauggaaaccuuuguaaccaucguucauucuuacggccagagagacaaaagcuuuucacauauuguuuugcucuucaaacagauagaaauggggaauuaauggggagaaagggccacaaaguacugaacuucuguuuaagugugggggacuaaaccugaggccucagggcugcuaggcaaauacucuaaccacugagcuacauguccacacuacucuccccucgcuuuccuagcacugagguucauucucagcucccucaaauacagcugagguuccugggacaauggcaggcagcugucccugcuacauuaggaauucauuacagaaaaaacagaauauaucuacaugcagccacucucucucgaauguuccucucccucuuuguuaagagcuguaggaucacuaaggagugaggggcacuugcugcucuugcaggggaccagguuuugguucccagaacccacauggcagcucacaaccaccuuuuaguuccagccccaggugauccaauuaccucucauguaguguacagacauacauacaggcaaaacacccauacacauaaaaugaaaauaaaauaaaaggaguuaaaauuuuaaauuuaccguuuugucccaagaauggacccuccuuguccaguccagccuccgacaucugcccagccgauuucuuugaucuaacguucaagcacacagucagacagcugcacugcggaaggaaagacucugaaaacagcuuagggcucucucuguaugcucacaggcugcgcgcccacagagacggguaaggcugcaagucggguuccacacuagugcugacucagccaagcuaugacaugcccuuccaagguuaagcaaaauacuagccucaggaagagugcuccuucccugucugcaggggacacccacccccuaacucuagacauguguccuggguagacacuuuagcuggccagaaucucucucuaguaaagaaaauaaaaaagaauaccauguuuuaaaacuuggcaaugguuaaaauaauuuuugcaaaaaaagacaaagaagagaauaaagggagaaacacaaauacagcuuugcuaaguagaugaaguuuaaucaacuggagggcgauucccacgcuaggucagguguggcuuaguuacagagcagaacaugcugggccagaaauccaggucacaagcuucuggucaugugaaguuuggugaacuucuuacuaucuauggauccugguggcaucuuuaggaaaguuauagacaucccccaaccuggcaucuccaacuucagcucccuagaguucccggagaacuggcacaggcuccauauuuuugacucuauaaauuccauuucuagaccuuucauuuggucaacugaaacacaauagacuaugccuagcuuuugugucaucagcacauacaucgugaacaaacuauauugucuuuauugccucagaauggagccugauccuugaaggcaugucauuguccccacagcugccucugacacuucuugcuguaaaauguuuggacaguccaccuacucugccugcuuccugccuccacuaggcacuggaaagaagauguaccagcaugugcuagccccuccuuaagagccuucccucuuacuuagucagagaaucaaaucccuacagauaaccuggcucuugcuuuguucuccccuucugauuccuuccuauauuccucccuacccuggcucuuauuauccuaaaacaugggcagauccaaccccaaagucuuuguauuauaucaucugccuggaaugaaccaauguccucucuugguccccacuuacccuauuagugggagaucggcuucccaugagcaccuguuacaugcaacucaugcagagcccccagggccuguggccucuuguaaaaauugucccagcuuguuucacuuucuuauaaauaagcaacauggcuuguuaguacagucuuacucuugucaccuccaaaauauaaagucagcagagguggggcuuuuagucuguuuugcucacauguguaauuccacaggguuacaaacugaccaagguacuggccagauauaguagaaaguacggcagcucuggguuccaaguacagacacauccuguuucaaaugcgccaucauaagaacugucacaagugagccaauauuucuacuccucacgucucucguaagaaaaagauggugauaagaccuuagacguagugugaggucaaacggauuaauauauccgaaucaaaggauuaauauaugcgaaucacaugcgacaaaaggaaaacagugacugcugcagaccucuguuggccaauugcugcucuucucucagugcuggggcuaggacccagagcauuauaguacuuuuuuuuuuuaagaauuagaguugcuuuuuuuaagguuuuauuucgcugguuuguaugacaugcacuuugucaucugaacuuaacacaauagccugugaggggagcaucauuggcuuacugugccuuugggccuuuugagaaaaucugaaaauacaggacacccugagcuguauguaauggcuaagaacuuaacuuagggcaggguuccuaaguggaagguaacccuuaacacucaaaucaguauuugguauagucccaccaccaagaaucgugauuuaguaggugcugugaggggaggguggccuccccaaauacaauaacauuuuaacaucccuaggacuccugggagacucacuuggccauuggcgaauccuucaaagccgucauagauugcaaacaucuuguggccgucugcaaucccgacucgaacagcagagcgcacggcugcauucauuccggcagcaggugccccuacauugaugacggcuacauugcaguugcucugaaaagagaacaggguagugccaagucaucagaugggcacaagcccccaucuguugcacauuuauaagaggucauacuaugccauguuuugcaggcggugaccaugucaggaucacaaaggagaggugaagauaauuuccagggacccacacuggggggggggggguuaccuaggccacucaggagacugggucauugauggaagcuggcuaccuaccuugacaaucuucucaucaggcaguuuaauggcaagacgcuuauagguguucagguuucccucaaaacgccuaaagaaaagauggcauugugguuuuaguuaugugcgguuugugagaugccucuaggggccagaagagggccuccgaguccagcaauucugaggucaggcauauggguucugggaacugaacuuggguugugcuuguaacuguugagcuucagcucuggacucuuaaauuuguauauuaagacuaagucucaaugagcaaacaaggaccuaaauuucuaguaauuagaguuuuauuccugauaacucaccuuccucggaguuucacggcuuccuuaaaucuucuuucauccauugccuucuguacauccugggucuuagaaaaaaaacaaaaaccaagaaugaaugaagccuucagugcucugcagcuggaccuucaaucugaccccacuggguugucaguggccgccaaguugacagcuaacucggcugugagguuagagcccccaaagaagaggaggugacuccugcugcucguggauggccacaagaucauaaagaugacuuccacaaaggcaaaguucauggcaaugggucucuuaagaaaguaucugauuauuccacagucuagcucagguaaggaaaacauagcuaaguagcucaucaccucacugaagacugcagaacuuaaggaugcuucaugguggcugagaggaacagggauuaaaggcagccucuguggcugguuauuaaugaaaccucugugugaugguuugaauauccaggcaagauaacagcacaaguuguuguuauccagacaaaccuacuuuuccgcaguaaacucacaagggaugagcaggaagcuccaaggaaaagaaacacacgugguucaggguucuaaccgucuuaagccuaucaccucucauacaguuuuggacacgucccuuguccuucucuccccaaggauacacaggaacacacauucaucuuuguacacacagccacacauagccacacauauguauguauacugacuguacuccuauuggcuucugggaauuaagguauuuucagcaagucccuagucugucugucucuaucucugucucugucucugucucgcucucucucugucugucucucucugugugugugugugugugugugcgcguguguguguguguguguguguguuauuaaaagaauaugugacagggucauucaauagccuaaauauuacaacuuuucaugaaaaaauaacucagggaaauaaaaguuaauagcauuuucuaaugaagcaaaccccacugucaccucaucuacucaaaaacugaguggaaaaguagaauccauuuuucuuucaucucucaguagacacuuccgucuacugaguggggcuaucucaaccuuauuggaaucuguuccccaauacccucacggaucagaauguccucggggacaaaagggcaggaaguaacacuggaggaugguaggccugucaugccuacagcaccaguucuaggcaggaccauuuuccugcacuuggucuugcugcuucuggugugcaggcacugcacgggccaucugugacgauaggugucaacagucagagauucuuaaggguuuuccaguucuuagcggagaaggcucaugaccuacaggcaagccacagggaagcuuucacacacuguccgaggacacaggaagucugcugccauuguccaguggguaucauucuguccuccaaaaggccacuuuaacccagugcucacugagucugaagcaguccacacaaaguggagcaaccacccacuuguucccacaggugguccauccaauguccguggugacccagcaccugagcucaccauuugcacacacuccaucaguggcaggcgcacugcuugguuuccucuuagugacacgacacaggcuggggucucggggguagcuuccagcaaggcaaugacagccuccacucccauacggcuggccugcaaaugauaauugcaaccacuaagagauagccaacuccucauucuaugcacaagagacaccaugugcauagccggagaccaccccagauuucacacucugccugcuuucuaugcuguaaagcaaugauucaguaaggggcuauccuguucugccauggauauccccacucaucucuguaacagcaagauuauaacucuaguaagaacugccaggcaauaugagaauuuaggguuuggacucaggaugccugcuguccucuuggguuaguuucuggaagcuugcacuugggauaccacguuccuacauccuggguuuuacucuccuggcacccaugucuuccacaucaguagccaaacuggcuucccacaucagcugugaccucagcccaggaaaucaaucuacgucagaaagucucaaaggacguuuaaauaaggacaugggccacuagcaucuccagagaugagcccucuggucagcuuccacaauaaacgagugcuucuaaacaucuuuugaaggggccgaaugucuaguaauuucaaucaccacuuaccaaaauccugucaaaugcagauggggucccuccucguuggacaugcccaaggauggugacccgggugucaaaucccaaauucuucacuacaagcuauggagaaaauguccaucagaaaacauacaucugaacaggccucacugaggcuauaccagccucauaaggcccugauacugagcagagggcccuccagucugccuucagagcuauaccagccucauaagguccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaagguccugauacugagcagagggcccuccagucugccuucagagcuauaccagccucauaaggccccgauacugagcagagggcccuccagucugccuucagagcuauaccagucucauaaggcccugauacugagcagagggcccuccagucugccuucagagcuauaccagccucauaaggcccuuauacugagcagagggcccuccagucugccuucagagcuauaccagccucauaaggcccugauacugagcagagggcccuccagucugccuucagagcuauaccacccucauaagguccugauacugagcagagggcccuccagucugccuucagagcuauaccagccucauaaggccccgauacugagcagagggcccuccagucugccuucagagcuauaccagccucauaaggucccgauauugagcagagggcccuccagucugccuucagagcuauaccagcuucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuacaccagccucauaaggccccgauacugagcagagggcccuccagucugccuucagagcuauaccagccucauaagguccugauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccagccucauaagguccugauacugagcagaggacccuccagucugccuucagagcuauaccaggcucauaaggcccugauacugagcagagggcccuccagucugccuucagagcuauaccacccucauaagguccugauacugagcagagggcccuccagucugccuucagagcuauaccagccucauaaggcccugauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuacaccagccucauaaggccccgauacugagcagagggcccuccagucugccuucagagcuauaccagccucauaagguccugauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaagguccugauacugagcagagggcccuccagucugccuucagagcuauaccagccucauaagguccugauacugagcagagggcccuccagucugccuucagagcuauaccagccucauaagguccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggcccugauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauacuagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccacccucauaagguccugauacugagcagagggcccuccagucugccuucagagcuauaccagccucauaaggcccugauacugagcagagggcccuccagucugccuucagagcuauaccagccucauaaggccccgauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccacccucauaagguccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuacaccagccucauaagguccugauagugagcagagggcccuccagucugccuucagagcuauaccagccucauaaggccccgauacugagcagagggcccuccagucugccuucagagcuauaccagccucauaagguccugauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggcccugauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauacuagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauacuagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccagccucauaagguccugauacugagcagaggacccuccagucugccuucagagcuauaccagccucauaaggcccugauacugagcagagggcccuccagucugccuucagagcuauaccacccucauaagguccugauacugagcagagggcccuccagucugccuucagagcuauaccagccucauaaggcccugauacugagcagagggcccuccagucugccuucagagcuauaccagccucauaaggccccgauacugagcagagggcccuccagucugccuucagagcuauaccagccucauaaggucccgauauugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauacugagcagagggcccuccagucugccuucagagcuauaccagccucauaaggcccugauagugagcagagggcccuccagucugccuucagagcuauaccagccucauaagguccugauacugagcagaggacccuccagucugccuucagagcuauaccagccucauaaggcccugauacugagcagagggcccuccagucugccuucagagcuacaccagccucauaagguccugauagugagcagagggcccuccagucugccuucagagcuauaccagccucauaaggccccgauacugagcagagggcccuccagucugccuucagagcuauaccagccucauaaggccccgauacugagcagagggcccuccagucugccuucagagcuauaccagccucauaaggcccugauacugagcagagggcccuccagucugccuucagagcuauaccagccucauaaggcccugauagugagcagagggcccuccagucugccuucagagcuauaccagccucauaagguccugauacugagcagaggacccuccagucugccuucagagcuauaccagccucauaaggcccugauacugagcagagggcccuccagucugccuucagagcuacaccagccucauaagguccugauagugagcagagggcccuccagucugccuucagagcuauaccagccucauaaggcccugauacugagcagagggccguccagucugccuucagagcuauaccagccucauaagguccugauacugagcagagggcccuccagucugccuucagagcuauaccagucucauaaggcccugauacugagcagagggcccuccagucugccuucagagcuauaccagccucauaagguccugauacugagcagagggcccuccaggcugccuucagagcuauaccagccucauaaggcccugauacugagcagagggcccuccagucugccuucagagcuauaccacccucauaagguccugauacugagcagagggcccuccagucugccuucagagcuauaccagccucauaagguccugauacugagcagagggcccuccagucugccuucagagcuauaaacguuaaaacugaucgggacuucauuucuccugugggaauagcuaccuucaaaccuaaaaucuauuuuuccaaaaaaaaaaaaaaaaaaugcuuucauugucaaguagaagcuuuuugguauugcugcuauuuguuuugauuuggcuuuagguuacuggaaacaguguaacauagaccagguuggucuugaauuuauaauccuccugugucagcauccugaguuuggagguuauacacaggaaccaccacacccucagacuacuaaagauaaaaucuuuaucgucuuguuuuguuuuguuuuguuuuguuuuguuuuguuuuguuuuguuuuguuucaagacaggguuucucuguauagcccuggcuguccuagaacucacucuguagaccaggcuggcaucgaacucagaaauccaccagccucugccuccugagugcugggauuaaaggcgugcgccaccaggcccggugaucucuaucuucuagcaagcagauaaaaguaaguaacacugacuuugcuacagaaaugcuauuucaaguaguuguauuauuuauauuaccauuaucucccuucaugaugcacagcucugcucugaagagaagaacccagaaaacccagcccuaugccaacagcaaugcuggcuggugaucuacagagucucugaaucuccuugggacuaccugauccccgguauauauaauagugucacuuauacccauccgugcacauuucuugguccaauguugguagaguucaucugaauuuuauuuuacagagaaagaaaaccucugcccugcuuuuauaaagacauaucaguaacuacuguuaauuaucuuucacuggcuccgguugaugaauucaugcugaggugcagaucuggugcuggagucauuaauaaguaaacuuggcucauuaaauaaccauaacuaaacaaugauaaggaaaucagcuuguagagcuauggguguggcucaaugguaaagcacuugccaggcacaugggcuccuggguucuaauccucagcacugcaagagacgaugaacaaggcauuguacgauuguaugguaguuacacuuuaaauacuaacaauuuugaggaggggcaagacaauggccaguuugaggcgagcacaggcuacuuagcaagaagaagaaaaaaagucaaaaaauaaaccuuguaaaacuaaauuaguaaugucuguggguccugacucagggcugaaaccacacagccuagcugcugcuuugugauuuccucagccauucugcaauccuggugaacacagcagaguccuguagagacuggucaguguaagucagaaggaguagcagaguagccugccagacccugcccuaccucagggcugugaggaggcagugacucauugccaaguaggcaguuuuauuggugagaaugucauucaguugauguuccagguuagaaggaaggcagaggggaaacugggcauccaucgccuugucuauuguuccaaauagagaggcccucagaaugugcuggcugccaaguagucaacauuccuuaccuucugugcagagcuugcuuaacagacgguccuuucuaacacaagaacauccuuauccccccaacugucucacgucuauugguagucacagcacuguaaggaccauuaaaggcaagacauaagaaaugcuggcuguaagaugcugcuaagcuucagauucccagugcuuugaaacucuaaguucaauuccugucagccaugcugacaacucauacguccaucuuggcuuaccuccuugauuuucucagaggugauuggcuuauuuugcaugucgauugcuccuucagacacaaugaugauauucagccucuuuuuucgggcucgguucuaaggagacagaaaauuaagaugccuaaaauugguaaucguuuuuuuuaaugacagcaaauccaggggaauguguccuaaccauugccuaacuugggaauaugucucaguaaccacaaaggcaggugaaaggugccuuugcaagauuucagaggguuuguaggcuaggugacauuacaagcacauaugagcccuugguuccaguuagccugggcuaaaguaugguguauagacauguggauuauagugagccccacaacagcaagcgaacacaggcuggacucucccaguuuagccuacagaaccacguugccuguucccuuugugcuagagcucuuuccagucucacauggaccucccuugacuccuacgcauaaggucaacaacccaccccaccucauguuagauaauacugcacacaggccuggguagcaggcagguaggcaauggauaagaauucgagaaaagauacaggaaaggccuaugcauagauggcuuuucaccagcccauagaaccauugguugaguauaugagagauggagcccagugaaagaagaugagguaccuggcaaaguagauauuaugaccccauccccucucuucauuucccccauuguuuuucuauuucuggccccuaugagguaaauagacauccucuguacuguaacccugucaugauucauggugucaucacagguuugacuaaccgugggccaagaccucuaagaucaugagccaaaaaucaauguuuccuugaccuuagcucagauguuuaccacagaaaucgaaaagacauacagcccaugcaaaggaucugaaaugaacacaguuaccuugauuugccaauucacacacuggcacccugucuuauguacuuauacccugguacaaacugccuuauauaaacuacaacagucacucaaggauacgauuagccuaagggugccuggcaaccauauuaugguguagguuagcuccauggauuuucuuccuauaaaaucccaaacaaaauacuguccauuggaaaaaggucaguaugauggucugaauaauaauggcccucaauguauuugaauucuuggccccuagggaguggcacuugcuggaaguauggccuugcuggaggaagggugucacuguggggggugggcuuugaggucuuacauaugcucaagcuacauccaguacagcucacggucuccuucugcugccuggagaucaagauguagaacucucaguuucuucucuagcaccaugucuaccuauaugcuaccauguuucccaccaucuuaauggacuaaaccucugaaacuguaagccagcccuaacuagauauuuuuucuuuguaaggguugccaugaucauggaaugccuucacaggaauagaaacccuacgacagucagugauauguguggggcccuggccaugccugaagggauagcaagaaguaauaugcugauauagaucagagguacacagauaaucagggucauaaagauuuguucuugguuaugacagcuaggaaacgugcuuugaaaaauguguacaaugugaagaaugaagaauuugaagaauaagaaacacugucuuacaagcauaaggguaugagaaguacuggguaauuaccuuagcauuccuugauugaguacuagaaauacaguauccauaaauaugggguggcuaaaucggugugcuucagccacaaagcacaguauucugaagggguuaaaagacaauggaaucuguggccaauaguaacggccuuugcugcuuguaaaguacuugcccuuacaaacacaagaagcugaauuugauugccagaacuaugcuuuuuaagaaaggauauaaaggcaucaugggcaagugaaagcuuaaagcuggguaagucaagauaggagguggugcccugagacucaccgaucagaaauugucuccaaaggagaaaaaagguagacagugccuaaagaaaaacacccaaaggcguucccuuccuugcuaauugagguaagauggcuaugccuacugugggcagugauaccccugugcagguugguuggccuggccugcaugagaaagguaacugaacacaauccaaaccaucccucagugguuuuugucucaauuccuggcuccggcuucccgccuuagccuuuagcccuagguucucuaggugauggacuauaagcuaaaauaaacccuucucuccccaaguucauuuuggucagggauuuauuacagcaacagagaaacaaacuacaauuccuucauacgcauguguauguauacacacaugaacauagaugcauggacgcaugcacauauaaacaguagaauccucagugcauuuaaaaaggaagauauguaccauggcccuaccacuuaaugggugccucaaguuuacugucuagacugaauuaauugaucuacuaaccuucacaaaaucacuaaggaauauaauuuucccauguaagagaggacagagaaaggugacauuaugugaucaaagucguuuucauggugguacagccaaugucuaccuucaaggaauucuguaaccuugcaacagauuuuuucuuuuucuuuuuuuuuuaagauucauuuauuuauuucauguaugugaguauacugucgcugucuucagacacaccagaagagggcaucagauccccauuacagaugguugugagccaccauaugguuucugggaauugaacucaagaccucuggaagagcaguaauugcucuuaacugcugagcugucucuccagccccgauuuuuuuuuuucuuaagcuaguuagucuuccaaaauauugggggaacuucuuacagcacuguauugguggccaguaaaaaacaacaacaacaacaacaaaaaaacagaaacaaagguugcaaaacguucuguccuaacucagccaaauccuggaggcuaggaaggcaugugucguagucuuguccuaccucacagcacaguguacaaaguguagaaucuuagaaugguuuuuagaugggauuacacgaagaaguagccuuuaaucaaucuaaagugaguaucuagacaccgaaugaccauaaagacugacaguacacuucccgucagccaagccuaacaguuaucccuauccuugaaucauuguccauggauguguggucugugacaaugugacugugccaucaggcugcaggcaagucagcaagaagacauaagagcacuacacaugacuucccacugaagugacauccuguguggugguaaucucgucuucugggucauacacaaguccuaggaaaugggacuacuacauaucaucucaaggggucagguguagacagccugucuuaauuagacaccugaggauauugcuaaugucccacaggucagcaccaaagcuaaggaaacucccucccagagggagggccauuuuggucauccaccacuaucacuagcuuaugucaaguuaagauguugagccuccaaaggaagcuaggauuuucucacuguuauauaacuuuaaccacuagccuauuugguucaugaugugaauguuuuuccuacuuugagauggugacuugaaagcaacauuucauugcccacacauaugcagccuuuuuuuuuuuuuuuuuuuuuuucuggcucuaaauaaaauuggucugggauauaaugguuacauaauuuucuuguagaucaguuauaaagauugcuucaaaaauaaaggagagaaaaguaaccuacgcaugaagaucuuugcccgaaagcuaagcccagucuuaaagaggccaauccauacugccuuaugccuucacaggggaauauccgccccgcccuaacaagcaacuaugcuuucaaagacaacauauaacaaacuccugacagaggaagagaggaacauggaucgaaauaauuagggaacaaaagagccuaaaguccccacacaaugaggaaaggaaugucauaacaccucacaccuuauuugggggcuggggcggggggaggcaagauuuaaaaacaaaaggccgacacaugucugucugaguccugugaugacucaaauagcaaccaagaguuuucucuguaauccugacuucauuuaaccaccaugaucucaucucauggcacacaagccauuuagaagcagaacuacuguuuugggugggaggcaucagugguuccagcugucucugcauggcaacaucagccuacacuggcagauccuugccaacaggcuuggccuuguuuguuuuuucuuuuguuuuguuugauuugguuuucuauaagcaaguuaucgaguauuuaaaggagccauccugcuggcccacccccaaaaggccuuguggauccuuacucuagcaacauagccaaauugccaguuaccucugagaguuugaggcacauauuuuccucccaaucuuccucagguggagacuccggaaggaacacccagucggcaccgcaagucaaggcgcucaccaaggccaaguaacuguagggacaaaaaguaauaaauacacaggaaggaaggaaggaaccugcuugcaaggcuccacuuauguaccacuuaugaccagagacaaccuuugacagcuauagcucuugauaucccacaggggcucuucuggguccuuugagacugcccccuguugcaacauaaggugcagagcacucauguggacuccacuaagguucauuccuaccaggacggugucagcagauaccuacccacagugucuccccaucaccuccaggacgaagguccucugguggcuggaaaagggguaaaagggcacauguuaccacucacagcgagaaaaguaugcucgcagcccagagacagaaagccugcuucucagcucuggcugacaccaagcugccaaaaguugcuaagcugacucguuuucuacaaaaagcaagcucuacucucuggaaggguuucagaacuaaggaauaauggggcuucaauaguaacugcauuuggcggggugcugauuuuugaaacaugcucucauaugccccacggcugaccuugaacucuguguagccaaggguauguaaccuggaacuucugguucuucugccucugcauccaguugcuaggacuacaggcaucugucaccaucucccacuuauaggguacuggaaauugaaccugggcuuccugcaugcuaggcgagcacuaugcagcuaaacuauacccucgguauugcuucuaccugcauauuuuacaacacccuucacuuguuuccuaagacuacacuauacuuuuaaggugcuuuccugggccccuuucuaaaaggcaucuacucugaacucaguugaauacgucuucugaaagcuaaggguuagccgggaucacauccaagaccugagaacuugagaggccacaaacuugggagucuagaaacagccagucucaucuccagaggggaaaauaaagccccucagccuggcugugcccaguaagcacacaagugugacugcuacaaaacagcuccaucaacacacaaugacugucauuccuugcaguugaaagagucaaaugcucugagcugaccuuccagagucacagagcucaauggacacaggcagcuaaaaacuaggcaugauacacaaaagggacccacgaaggcccagcugcccucaaaaacaccuguuccaaugcuucaagcuucaagcuaaccacugacacagugaaaggugccugucaggcuuacuauuucacuugauuuucagggaaaggcuuuugggaauucugugguacucuagaaaguugucggccaugcauccuugugggccuaaaucacugcagauaaacuguuaacguucuacucacagucuacucacugagaccuuggaaucucaauggugacacuaggaugucucacuccacuaacaacuaugcuacuaagucacucucucuuugucauuccaugagauaaccuuugggggacucuagauaauuauuuuguuuccuuguguuuucuaguuuuucucccauaagcacauuuagaauacuacuaacaugggaucugcugaguguuucuggaaccagcaguaauagccuguugguguccuuaaguccuuuuaccucugagcaguggucaugauggcaucaacaacuucaauaauucggugcagggcugaaucuguaccaauggucaugucugugccacagaagucauugucaauggagcccaccauacccaccacguugagguaggaauacuucugcacugugucguuaucgauaucaccuguaugggagacaagaagcacaccucggauccaggaggagacauggcaaggucucuugcugaugacauuugauacagaauuggaauuauaaucaaaagagcuuuaaagagacagggccaagaguucacauagaauccucagacauccuaaauaauaccaaaagaaauuuaaauuaagagagagagaaugcagaucagcaacuuuuaauuaaacucuuauaacauauagauuuagagacauccuagcuuaucagcagaaauacaacaugauggcuagaaauauggaugcuggcauccaaggaccaguaugcccaaagaugacgguuacagcagccuggcuuccccuacgaccugggacucuucucuuagauggggguguacaugauuacugucaugaggguuuuacaggccucucuaggaaagggggcauuuccuagcacacaguagggcuuacugucauuucuguucuuauuuaaacugugugguaccagaugauaggaggcaaaacaacagccacaauuuggcuaugacuaaaaaugaagcuggaacuggugauacacacuuugaaggccaaacuggcaggaggcagguacagguagaucuaugaguucacaugccaggcuggucaguacagugagaccacaucucagaaacuaaaacgaaauuuuaaaaaauggcucaaaaguauguauguccaugucagcuauaaauaaaauaacugucgucccccccucccccuuaaagaaggcacaauguguuacuuccgaagcucuuaaaaagcaccaacagagaaaccugaggccgacuacucagagcaaggcacuaacaaggguggaaacagaaagagaaaccuaccauuccgagccagcucuuccagaaguccgcuccacuccuuucggaagagguuggcucccgugagacuuccguccccgccgaucacgcacagauugguuaugcccaagcgcgccaaguuacaggcagcuuucaggcgcccuucacggcuucgaaaggcuuugcagcgcgcacuaccgaugauggucccacccuggaaaggacauaaaucacgcucacugacaguaagucagguggaucggcacaggcagugaaccaugauaccuguagaacuuuccacgggguuuccucauuuucaucucaguuuccuaccuuuaguggaagucccuaaaggaacacacuagccugauacccgugaaagauggaugguagcauccacugaauggaaagaacaaguguguacagggucacugcagccucccagcuucuuggggucaaaacuguccugacaagagaugaacuggcacuccacugggcaucagccaugaccuguagcacaaacuuguccugccuucagaugauggccuggcucucccaugagucagaucuuugaacaaucugaaagguguguaauuuuggugacuucacuuaaaagcauagucccaguguaguuguccucaugaaggguccagacuauaucaaagaaugagaguucaccugugccucucgguaaaccugucauuucuguugugucacacaagggacggcaucagcuacaagucaccacuaguuccucuagcauuuuaugaaagcugcaucuuaagaaagcuuaaguuccauacccaagcuuccaggagagagaaagaagugauuuucuauacagcuuuucaaauaguuaagaucuuagcccagugccgguggcgcacgccuuuaauuccagcgcuugggaggcagaugcaggaggauuucugaauugaaggccagccuggucuacagagugaguuucaggacagccagggcuacacagaggaacccugucuugaaccuuccuuccuaccccuuccccaaaaguuaagauuuuagaacaaugagguuccuuuaaacaaacaacgaaucaguuuagaagaguugaguccauucccgagacaacugcuucugacucgugcgguuuccaggcugaaccaugcuacaggcagagucucaaugcagauggcucacuagaaacccauucuccuccuugcaugcuagaauucauaugucuaaagcucauuuauaaagcugucaaaauuuacaguuuuccaugaaaauuaccaccauguuauugagugaaaccuuaguuagaaauuacuaauaaagaugaagucaacgcaacaccuacacugaugcuggguuagugccauugcuaagugggaugggccacaugcaacuggacaugacagaggcgggccagggguggcaagagccaaguccagagcagagcugagccuguucucugaaccaucugauaaagaccagucagaagagcaugguacuguuacaacugggaguggaagggaaacccacggacuccagaguugaauagauacagugggcagccucaggaugaaaacuauggacaaccaacuuacagaugccauucauagauuuacacacacacacacacacacacacacacacacacacacacccucucaaccgagcaguguuuccuauuuuccuaucucaaucacaacagcaggauggggauguucuguguuuaacagagugcuugucuugaaagcauuacucugccuaacuuugaacuucccaagccguucuucacucucuagguacgcagcaaagcuaagacauucccaggugccaucuccgagucuucgacauuugcuaaagugcauaugcccuuagcaccuucagaaugaauuugcuaauuuuacuuauauuaaaaaguacuccagaugagucaaagauuaaugcuuagguuuuaaagccucaagcaacaaauaaauagcuuuguaugaagucuuuucuuucuaugccuucucuuuacuucucaauuaauuuguucccucauuaagccaaaagguuccagggauguaagcagcauaaguucccuggacagauuuuuuuuuuaaucaaagcaggcaaccauuuacaauuaccucuuccuugugcacaauacagaaauuagcugugucugcuucaagcuagaacagggaugaagugucccaguuaaauccaccgcccuaggggcugccagucagaauuuuucccaggcuuuguuuuacucugugccaagggauauauaaaaacccagagggcacagagauuuaccgaugagcacacaguaccagcaaaccaaauuaaccucuacuacacucauuugcucugaaaaaaaaaaaaaucuuccagaaauaccacaaugaacaguagcugaggcugagacacccaagcuuguauugcaaagauacuuccugaguugaggucauguugguauuuuuaagauggaauaaaagggcuugaaggaugacucagugguuaagacugcuugcuauauaaucguggggaccagauccucagauucgagcucccacauaucaggcuagguacuccacaaacgguuguaauugcagcuccaagagacccaacaucaucuuuugaccuuucugugcauaggggcacacauacgcccauauacucacauaggcaugcacauacauaccuaaaguaaaaauuaauuaaaugacacaucuuguagauugaaugugaacccuugguccucaaguagggacacuauguaggaggacuguagcugcuuugagaccaggugaauuccacauggcuugcugggggagagccuugaaggugccaaccaucccagcuucugguccaguccucugauucugaucugccaaggcacugagaagccacuugacaaucucccucgaccacaagcuuggccacaagccacuaccugucaugugccgaacugcucagccucucaagccacccugcucuccugacuagaaggacuauaccuacugaaccaugagcccaguaaauccucccuuggguuccuucagucagauaucugucccagagaaaggaaaauaaggagcaugguaagaaaugaguguccucuggccuuauaacuaguuuaaaacaguaaacuaauuauaguuuauuaugagcuagcagggaugggaaggcguguuagagcuuacucaagcauccaguguuuuaaaugaaaacagagacauuaauauagagaaacagagaacagcauggcaccuaccacuugcagaaugcuggagacacagucccauuuggcuuccacaauauuggagccuccauccaccaagccuugguaacccuggaugaggaaaaaaaacaaacaucuauuuaaagagaggcuaggcuuuacuguacauuaauuaauaaacccacaaauuauaaaacagaaacacgaugacaaugaaccuaguuuuuaaacugacuguuagaagacaaugcaagcaagugcuagauaaaaguauuuagccauagucaucaaucaaccaauuaaucaaucaaaaccaaaaagcaaacauuucuacaaugagcuuaggaaaggaagggaaggaacagguagaacggaagccucagugcacccuggguccaugugucagguccugcuccccacuaugaugaaacagauucuaccuagggugcagugucuucauccaaacucauaagcugcugagccagagagaacacagugagggaugcggcagccagggccucagccaugacuccacagcucuccgagaagagcaggacaaagaguugcacucaccaaagggcuuuggcauaagauaacaugaagacaugucaagcucccucccaaaggcccacugugauaaggucugcauucaguaguaggguaacuaaaaggcccaaagcaaggauguagccccaacuugcacacuggagaagaggaccagccggaaggccacaagcauccugagauugucucggggcuggaacagguaaaccuuuccuggcaucaauguccagcagcauccacacucauagaacugcuccccacaaagccaccacaggccgcuugacuacuuaacuaugccacacagugaacagaaauggugccuuuccucuuauucuuuuaacuuaaaugcuggguucugucuguuuguugagacaagaucucacauaccccagacgggcccugaauuuacugugcagcugaaggugaccuugaacucuguuuccucuaccucuaccuccuacgagcuaguuacaggugugcacugcacuggcacacccaguuuuauuuggugcuagggauuaaagucaggacuuccuaggugucaggcaagcauucuaccaaguauccuccauacagccucagauacugacuugacacucuaaaaauuguuuguguuuuuacaaaaguugugcuaguuagaaagcaaggaaaaaccauucugcaaacuuuaacacauucuaaaggcgcuuagcaacaauaaucggaauuauuuaaguaaauaagaaaagaauggcuggauuacuauuguguuuaaagcuuccaccccacugcgcccauggaagcuugcuaggaaaugacuuggucuuuaacugugaagucuuuguguucgcaccacuuaggaaagauaccugccccccacagcuuuaaaccgccuuugacuaaaaggaagaaauuaccaaguuaggagaacuaauuuugcccuaucucauuaucaugcagaaagugagaucaguuucuuucucuagugaagcaaaagacuaaacauguaauguagccaacacauuuuuucuaaaauuccauuuuauagucuugccuucaaagccaguuggaugacucaccuaagaaaaacauaccgcugagccuuugaaaagcauacuuuuuuuuuaaccgaagaaagauuacuacagguuuuguuuacagcacuucagaggcuauggaacccugaguggcccuaucacacccaucuuccaccagaaguucuccuguuagaccuuucacucccauggaaacgugggcugcaggcucuggaauauacugagcagggccagguugggcaucaguggcucccaacugacucugcuagagcuguauuuaaagguccugguggcuacuaugcuuagucauguguugacaccacuauaaacaaaguaagaccuagcccacucaaagggaguguucaaaaugaucuccccccacccccaagugaaaggagcaaguggaagauuaccaucucauguuaaaucaggccuuuuccuuccuguguuuugucgaauagaucuaugaccaguuuauucucaucuuugggaugcugucucaauguaaauuccugauuauuuuugugcuagagaaaacacuugaggccaggcaugagagauucugaaggguuaucuaguuuuauagucauguauuuauauuagcaaaaaaaaacaaaaaacaaaaaacaaaaaacaaccaaaaaaccaaaaaccaaaaaaacaaacaaacaaacaaacaaaaccaaaaaaaaaaaacauuauucaaaacuagcugcucacaaagaaaaauaaagacaaaaacagcauaaguucucuaugucagugguuuugguuuuggucuuacuuuauuuugaagauuuuguuuuauuuucaauuguguggguaucggugcccuuagaagccagaagagggcaucacaugcccagcaguaggaaguuauaagcaguugugaaccuacugaauuaguacuagaaacugaacuacagaccuuucuaaaagcuguaagcauuuuuuuuuuacucuaaacauauauuaaauuauuaucucaagccaggugugguggcacaugucuuuaguccccgcacuugggaggcauagauggccgaucuccaugaguuuggggcaagcuggucuacaaagcaagcucaaggauagccagggcuguuauauagagaaauccugacaacuaucaaaaagaaauucaucauuuuccuccuuccugacuucucuacaacccuuccuuccuauugcucucucucucucaaauucauaaccucuaaguguguguguguguguguguguguguguaaauacaugcuccuaaauauaaauauauccuacucagccucugcauugcucguguguaugugauuucaauggacaugcaaacauaaaagagagaaaccaauaggaccucaacccuauacacagaacuauaagcuacuaagaaauucugagauuagaagacauagucguccccaaauugguuauccaaaaccgugugaucagcccugaagucauguucauacaagcaaauacugggccaucucuccagccucauccccuuuuauuuccaagacacaaucucacucuauacccagacuugucucgaggccagguuagccuugcauucacuggaauccuccugcuucagcuuccugacugacggaauuguaugcaugaaucaucacauggguuaccagugguuuuucaaauucaggaucuuggcuugauuuuacccacaggaaaggcucauauagaaccugaguauauaguguuuccuucucgaccuggagggcucuggucaccucucccccaagggcucugaacuaaaguaaaaaaugucacagccacccauaaaaaauguacuccguggauucaacugcuuaauggaaaauuccuauaaagaagccauagaauuuguccuugguaaagcugggacagcucuaaaauagacuagaacauggcaagguccuguacuuggagcuugagcaaaccacuagcacacuaacuucauuuauuuaguccuuuggcauuauuagauuuccuuaagucaaagcuaacagugcacaacuucaggaaagcuauaaaccuaacagccacagcaggaagaagacgggucagccuucuaccaagauaaccaucaaaucuacagccaauggcugauugugacaccaaaauucucaacgggaacucacucagccucacugggagugacaauggagauggccaaaucagggagagaacccauccucuuuugcaauuugacaauauuaaaugucuagacagucugaaaccaaagccagccuuggguagggccuggcuguagggccaucagucaggucagaaauggcacauggcauaugaguuuaguauguaagagccagcauaguuuaagcauacgaaacgaaacaaaaaaacccagcacucaccccugugguuaauuaucauuacucuagacacauccuagccaguguuccaguagaaagggcaggcauucauuauaugaauuggccuuuuguaaaucagugaaaguuaaccauuguagcuaagagucaugcgugccagugcgagggcuggaccugacagggugcgugcaggugaacagucccucgggagaaaccauguggugauguaauacagcucccccuucagacaccacugcuacucguuuuagguagauauagagguuagauaguuuagguauuaaggaaguuacaauguacaaauaguuaaguuaaaacucccagaggccagccugaaugaguuguggguaacgcugcuuuaauguugaagcacugacgggggugguggaagucagcacgaagacaggaguggcauuugaugacaaagaugaaccaagagauguguucaaaacucagcccugacacggugaguuauuuucaauucaaggacuccuacccacuggcuuugucugugcaugucaagaauuucccagauugcagcacaaaaucaccucugugcucauuucuccagguuuggguucccggcuagcgagacaaggacacuuuggaauaaaaagccuaggcuagaaaaggguuugcggauuuuacugucacaaccuuagcaaugcucacuugaaauggcaggagcuguaaguccauucuacaggagaauaagaauuccagcaaagugaggguuggggagggagcuccauuagaaggggggaaaaugguaccaauccacgaguuagcauaaaacuuucuuucauuucauuucuucgacguugguuuuucuauuuuauuuauucaacuggggacccucucaugcagccuggaauagccucaaacuuagaagaugcccuuaaaacuccuguucucccugccugcaccuccagaguguggggaucacuugguagugcuggcacauccaaguuuccaccacuaugcuaggaucaaagacaaagcagcaagcaugcgaagcaagcagucucccaccugugccacauuucccagaccucacuaggauaauaacucaggcaggcuacggugcucugagccugaaacaagagacgcuagagugacaagcuaaucauuucaagaugagaaaccaggcugguauaaaccagaaauagacgugucaacuggaggacacaaggacagcagagacccucagggcucuggagcuacagggaagacgauguagguuccauuuugagagaucugugaggucaugucaguaucagaauuugggauuaaaauuuaguauaguaauaagauuaaauuuuguucacaaaaguuaacuguauauagcugccaauauaaaauaucgaacuuaaacuuaacuaaacguagguuacccuuucuguaacgucucuaagaacggcucuuuuaaaaucugcagagaacuuucaacaauaggacauuaaacccacgcaauaaacuaaaggcagugagaaucucgccuucuccagcuagguuagguucacuuuuuccuauccuggguuggauccaccuuacugguuuugucuuaacacuacuacggagcuauggcuugcugugagcuauuaaggcaaaaaucaaaaaccaaacaaaauaaaaaaaaaaagauuaagagcaauuaagacaaacaggaagggaagaaaguaaugaacaaucagcucacuacauaagaaaaacuagguuaacccaccaacccaucccaucucucugggaauggagcccaagggcuccacacgcaccacacguacgccugacccaguuccacgggccugcaaaacagcugccagucggaacagcucagcccaagcaggugccagacuuuugucagaaaugccaggcuuuucagguucauacauuuucuaugcacuuucagaagagaagaaaggggaaagggggagcaagaagauaagcuugaagagaggaacaggagaaggaagaaaaguaacagggaaaggggguaaaggagcagagagaagaacccacuauuuaaccaauacuaaucuguuuaacuguuccaaucaucuggugaucuugaaaguucuggguagacugagaaacuggaacauacauucaacaauguguuuuauaaaaaagaagaggaaggccagugauaugcuugguaggguaagguauggugcgguggaagggggugccucugcuggcccaugcugaggcaucccuucccccugagguaccagccacaugaaggguauauauagaauagaguuuauuuagggcguggggagggaagaugagcagaguaguagagacagacacagagagagagagagagagagagagagagagagagagagagagagagagagagaugaggcuggcuaugaacggaggggguagggggaauggggagagacgagacagagggggaagagaauuaaagagcaagagagugaagagggggcaagcagccccuuuuauagugagucaggcauaccuggcuguugucagguaacuguggacuggagccuagaagaaaugcuaacauacaugaaacaacacguugcgaugaaucacuaaaugaugcuuaaaaacaauccugggcaccuuuugcauucaaaucaaauagauugggacuagaaguccccagugagagggacugugccuccagggaacauggccaucuccgaaggaucuaacuauugggaggaggugcuucuggcaacaacaagguagaggaaggaugcucccuaacacccugcggugcacaguacuuccauugcccacccuaaaagaucugucccaucucagccgccacacagugcugacucagugcuaggucagcucaugauucccagaagguccgggaguacaucaguucggucacaugccuccguucugggccuggccgcagaccaauggagucaaaggcaagcaagucuuugugcccugcaaccagccggcagccagccccuuuggagcuagugcucaaaaccauuccgcauguuucuaccagugagggggagagaaagaucaccuuuguuuucuuccugcccuuucuucacuauuuucccuccccucaccuccccaccaccccgauucuuuuccugagguuuggaggcaaggucuuaucugagacuggccugggacucacuagguaaccaaggaugccuuugaacuccugaagcuuuccugccuucaucauauccaacacagcuauugcucccaaggguugaaugaagacgcagggucaaaggguuaaugccuuccuucccaggcccugacggggcugcuugcuguggcugcacaggcuccuacuuuauccuuggaagaggugugcuaggauucuaaagcuuuggauugcaaaaggcagcauggcugcgacugcaugugugacucaguggaggccaucccuggaggugucaaguucuguacagaaagguacagccagccccucacaccagguaagcugagccagaauaauuuccagccuuauuccaggucaccagggcuuugcugucaagcacguggguaaaagcuaacagaucuggggguggggggcuuuuuuguguuuuaaaauuagagaagugaaaguuuuacaucuacacuggaugaugacgcuccacauuacucaggcacugcuuauugccacugaaggaaagaaucucauacaugugccgaguccuccggcaucaucgccucccucucacaacgaacaaggcuuccagagucucagacugaacauuuacucgcuucccccagcucagcagcuagcggguucaaagagugcauaagccaauccaauaaacccugccuuacagucauauauuguuaguucuguuucucuaaagagcucagaaaacaauacuguagaggauaaauccaguuagccucaaaagaaagauuaaaugucuucuguuguaggcugacaagauguucucccucucaacucuuuaauuugugaaaucuguagagucuagucgccccaggucuggaguuauguaaauaccaucagaacucagacagauaagacagacagauaagacaggauucgacagagcaaaguacagacacacaagacgcaagaauuacagacacagggcaacugaggaacugagaguuuaccagguagcaaaguuagaccccacacacagacaucagcuuguagucucuuccccaacuaacacucaaaccagaguggacucuuuauggaacagugggcuucucauaauuguuagaaugggaccaaccgauucuucaaaguugaggguuaucguauccauuuuaaaagguguuagacagaguucugcugcuaccaccuggcugccagguacaauaaucucucuaacaaaacugucuucaagcaauggcaaauguccuucuguauaagucagcccuaagguaaacuugggggcgggagaggggucacaaggcagagcuccuucugucccugcaaaggacugaacaguaacuuggggaaggacaacuguuuggggagcauucgguuugacuaugaaauaacagaaauaacuuccuuccuucccucauaugcccuacugagcccccagcaagaucaaagcagugacucacgugggacucucuacuuuccacuaggugcucggcugcacgcagcaagagcagaggacaccagggcuauggccugaguagaaaucacaugggcuccugagagaacguucuguagacucuaagucauagugaauuugaaagugcugcuaauuuuaacaggaaaccucaucuggcgcugcuccaaccccaaagagcucaugaaagccacauuuacuuauuaagaacugcucugcucucggccagaaugcacaguuuuaucacaaggcucaaggcaaaagagagugagagagagagagagagagagagagagagagagagagagagagugagagagguggggcgcguuggggguggggggaguguuggaggaggugagaguagcuaccucuguucacaggcaagcucugaaacagaagcagaaggaacaaugucgagauccaacugaaacguggggcugacacuugaagcccagugguccuaauggauaagucagccguccccccauagccccugccacacucucggggcaggcggcagaggaggaagagagcuuauggucuguguggcuuggauccuaaucuaugauuauaccucacggagcagagcaagggauggcagcagucaggaccagagcccaggaauggaaauucacaaggcaaauuugaccuucacguguuccaaacaguaagcgccaaugcggucagaauggacuaggggcuagaaccaccgcaaacugcccaaauguaagaaacaaauugcacgcagccacagagucugaaaagcaaauuaaaacacaagggucgaggaaaccucuaccaagcaaaugauaaacacacggugcagucguuuuacaaaagagaagucgcaugaguauaccagcaaugagacaccugccugcaggcaucugaugucaucacucgggagccaugggguucagaguuaggguuggaggggcuuucaaaaaaugcuucugcagcuagagguaucuaucacaauggucauggcuuuuagccgauugaugccaucaucuguggaccaaggcacagaucuaaaacagaauuuuaaguaguaacguagaccugaaaguguuuagacaguuuuuaaguagugaggaguaaccuaaauggacgagugacauaggaaucuuacacaucaauuugauggggcacuaccccuuuugcuucuagggcaauuccccugucucucugcccuccuaccuugucacaguacuaaagggauuauagaugggugugaccacaguggcuucuacaagacuucugugaaaucacauuuggguccuguuacuuguguggcaagcucuuaccccacagagccaucuccccggccuugaacugauuguuuaaaaaaaaauaguucucuuccuuuuugggcuccaguuuacagauauaaaaauaaaauccugcuccuuauauauaguucuggagauagagcgacucgguacacguugguuccuucucgggugcuccguauuuccuaagcagccaggaccacaagcccaggagacauggagcaguucaggguggccaguaacuguuacuuaguuucaguguguguuaguacuagagauaauggauucauuguggcacuucccuacauauuucuccucauucauucccuuccucuccccagaguccucuuaaccccucuugcuaccaccccucccccaacauaucucugcgguccucaugucacagacauuuugucaccuucucccuuuccuguucuaugccuuuagaugucuuucuaguuucauaucacacgcacacacuuaaaaucuaagaucugcaggagaacaaauuuguucaucuuucugaggcuaguuuauuucacuuaacaugaggauuuccaguugcaguuguauccacuuccaggcaaacucaugacaucauuuauuugugcacuaauaaaauuccauuaacccagauucuucacugugaagccaagacaugagcaggugcuaggguguggugucagcuucacauuaaugacagaaagcacaaaagggacgucuuuccguuucuggcacuagucuuugaaauccacucacaagcugacauccucagaaucauugacccgggaaucaagaccaggaaguugaucccagccugacuuuugugcugucuuaucuccuucucccugucacuucugaggcucagccaaaggaggaggcagcaagagagagaccagggcugugagcaaguggguggugcaaauuccugaguuagagaaaacgccaaaugggaagcaagcacugaccucauauauaaaguacacuuuggcccccguguagauucccaugcgcaccacagcgcggacagcagcauucaugccuguggaaggaacagaagcaguugucaguagagcuugaggcccuaguucaccuaguccuagguaaacugcggaacugccuaugcucccuguuuccucguggccugugacuaugacacauaccucaaggauuaguagagugaauacaaaccuggaaaccaaguuacccagcauauugggguucaucggaggguggggcucacauugaaaaagagccugggauauuuuaaguucagaauaucacucaucaacuuucuugagacuagcuggaggcugaauaaagcuugcagcuccuuugucuccugagugcuaggauggcggaugccugcucugcaguacagaauguuaagcaacuccagacagacacuaaggaaaacagagggcagauauugacggccagauucaaagaaguuaauaacgaagggggcaauggggcuguggcuugaggagaagcugaauaacuauguauuucaucccuggccaucggugugacuuuacaaaaaaguccuaaguacaaaacaagucauaccauuuuuauuagaagagaaaguaagacaagccaaccuccugcaaaucuccguccauccucaggagagaccaggguuccacacuuuaaagagcagcaguggacaauguguuagcaugaaaaggccggaagcucacaucuacuuuccacugagguaacaguuuuuggaaacugagaacuggcuuucguggccugccccgugguguaacaguugaaggcucuugcaucaucuuagcucagggucaaaggcccagcaggagagaaggaacaaguaauauaauaagagccacgcccagcacggauggagccuuuagccucaggauggaaagcaaaacugggcucucagccaaguuccucugagcccaccauucucuccaauucucccacccuaugucuugacauuuggggagacaaaucucagacauagacaugcuagacuacagaaagaugacaaagggaguguuuaacugaauuacguacacaaacaaaaugggagcugggacaacagcuccauccagaaguggcugcuucacaaacaugagggccugagcucugagcccugccauccauguaaagagcugagcaccacagagugacuguacuucugaugacaaggugaagacaggaggauuccuggaacucgggagcuagcuacucuauccaugucagagaguuagagacuuauuaacagacuucgcuucaaaagcuaagaccuuaaggcaggcaccagaccucuggcccccacaguaaaugggugaaugcccacacauacauacacacauagucuccucauuuucacuucugcaaaucauguaggaauacccacaucgcacaugccuuuaucauguaaacccacagucucaauuuugcuuuccacugaaaucauauuuuggaagcuuaagacuuaauuugaguagucccuuuuggccuaagauauccuguauugccgggcagugguggcacauucccuuaaccccagcccucagaaggcagauacaggugaucucuguaaguucgaggccagccuggccuacagagugaguuccaggauagccaaggcuacacagaaaaacccuuguggcggggggggggggggggggagauauucuguaucaucgauuuuggcuuugucacacauggugacagcccugaaggcaccugacucagcaauauguuugaagaguuuucucccaagagaaugacugcuuuuccagaggucuacauacaugugccaaacuccugcucugcaaggguccacgggaaggaaacccaaacuggagugggggagggaggacuacugugacaucuacaagaacuucagcaucaucuugaccugcacucucccccuugcgucccucccuccauuaacuuccuaguucugcuucuccaguaacucccagcccugcacccgcaaacagaacuaccuggcccucugcagucacagaugucuguuaaugauacaggcaucccucugggggaagggugagcugugugauuguguguuagaccuuacauucuaggugcauggauagaagcauuacuugauagcuccugcagaauggcugugguucuagcgcuuucuacuccauggcaaucaccuaauggaccacuaggugccugagcuguggaaacucugguaaaugggugauagauacacuguccuggaaaaugguauccgagacucuuucgcucuucuucgaaaacuugauuuccacaagauuuuuugcagaaacacguuucuuugagaaaccuuggggguuucaaaaauaugucccaaaagaaggcagaaggaacaagauggcugaaagcugagagugaaaaagaaaaguaggaagcugagugugauggagaagaugacucgauuccuucuagacucccaggggaagaacagaaagaaacaugcaaccacuucaaacaguggagauuuuccugaugaccuccaacucaccaggaaagagcuuguuuauacuccagcaggugaccucaggcccgaggcaggcuuccuaagacuggggcuauauaagcugcaucccucaggggagccugagaguuucucccugguucuaggcugucuccagaauccuuugagaggcacaacuccagguccuagaagcauccauuuacuugcaaauuagucuuagguuaaacaccagggauccaccacccugguccuucuacugugauucucucaacugcuucaaaaggcagcacuugacccagaucccccaccccaaauaguaaaagagcccaggaaggauuuugcccuuccaaggaagccuggagcucuguaagguacugaggagcagcagauaacaacaucaaucaaauaagaagcugcuuuucccugugcuucugcuuuauuuccauauuucccaaucaccaaaggcaaguuucggagaagaaagccuaccggggccagagcagaguccuaauaagacuaacuuaacuaacugcugaugagauuuacacccaccccccaacacaaacacacuuuggaaggaauacagucaguggggcagaggacugcaucaaggugggcucccuuggguggaaaagagugaagaaauaaaccaauauguagacaggaauccuuaaaauuugggucuguguuuagucauuuggcuuacagcuguccugguccuccgacaccuggucauuugggacaaagagcagauucaagaguuuccacucauacucaccuacugguuuuuuccagaacaguuacaacacagucuucauucacucauuuguuuagguuuuauauucugaacagggaaucaaaacaaccuuccugacuguuucuaugggggaaaaugucaucuuccuccacagcaauaaacuucguguuucgaaagaagucuaaaucccagccccguccucccagguuugaaaccuucuuggcaggaauaaagauaaucugaagagacuuuggugucccuucccuagucuaucagauuauuaacacacggacccuaaggaauugguauuucccccuggaaucucuugcauaaggagaaaggcuggagcucggugccagccagagaggaguuuucucucagaaagauuucaacauccuuuugcuaaauugucagaacacaucgcaaguagcaggguguggggcacaugccuuuaaucgcagcacuaggaaggcagagacauuuggaucucuaugaguucaaggccagccuagguuaacaaaacaaguuaaaagacagccaggguuguauacagagaagccuguuucucagaaaaaaacagaaagaaaaagcaaacaucuugcaggagggacuguagccuggacagaguuacgucaccaaggggcguggccacacuagacagagacugcuuaauuuggcacaauuuaagccuaaaccuggaagauuuucuagaccuggaagacagacuugggguagggugggguggucuaugaauaucuuuguuucuccucucagguauggucacuuugaauaaaucuucaucuguuuuucacuuaguguguuuaauuagcuuagugaggacuaggagcaagagcccagugaggcacugccucuaacaacuccaggaacagguacaaucuucuuauagaacuaaaacuaaauaaaugugaaggcaacgauggugcuaucaggugggguguguguaugugagugugugugugaguguguguguaugccuguggguguauguguauauguguauguauauguaugugucuguguguauguauaagcauuuguguguauauguauauuugugugugcauauauauguguaugucuguguauaaguaugugcauauguauguguaugucuguguaugucucuguguauguguguauaucuauguauguaguguaugucuguguauauauguauguaguaugcgugugugcaugugugcauguguguaugucuguguguaugucuguguauaucuguguguaugucuguguauaauugugcauaucuguguauguguguauaugucuguguauauguguguaugucuguguaugugagugcauaucuguguuuguguguguauaucuguguauguguguguguauaucuguguauauguguguauaucuauguguguguaugcauaucuguguauguguguaugucuauguaugugugugcauaucuuugucuguguguguauauguguauauaugugugugucuguguauguauauguauguguguguguguguguguguguguguguguguguguguaacugaacagaggugcaauggaaagguaugaaacagcuucucccuaaagcacaguggaggagaagcggcggcagccucacuccuuuccuugagucuggagucuuucauucaaagcacaugcaaagauaccuuaaguaagucuguacuaaggggguacugccaggcaaacauccaccagugcaaaggcuugcuuugaauuucugcucugauacacuuaaagcuguaggcuugugaaagagguuguuugacaugaaaaggcuaaucacccuccucauccaaccccugcacaugaccugcagauaccuaguuaccauccuugguccguaaaguaguacaaauauuaaauaccaucuaauaaaaugaauuaaggacaggaaagacagucuaauaaaauccuauuauaauuuagguuuauccuuucuccaucuuuggaacuggaagaauaauaucuauucuuaacccuuuggcagugcaaguguauauuacacaguacuuaaacagccauucacuucgugauuuccauuauuuaaguuucuuuucgaaaaagaaagucaaggcucaaaggggcuacuaguauguuaaagaaaugguugugaggagcucugagagaugacacagagguuaagaaccugccauaucucuccagaagaccugaguuugguuccgagcacccacguauugugcuccacaaccaucuccagcucucuggaucuuacacccucuucuggccccugcagcaacccacacauuuguggcauucaugcacauagacacacauauacauaaauaaaucagaaaggucuuuuuaauagaugggcauaaaacauucuugcuacuauaguuacucauuaagcucugucacuauaugauauugauauggaugggguguguauggagggaaagaguccaggaaaagcccgacucccuugugguuaucaaguugggagccacccuggcucuagguccaagagucaacaucagaucuauaaggaugucuucaucugccuggccaucacaugcaccucccauauauguagauugagagucuauucuuugcuagggacuaucaggugacuucccugacuuaagagggggagacccuggcccucugaagcuuaguagugucaggagaggacaaacagcauuaguguaagcaugucaaucaaacaugcccaccaauucagcaucuuguccagauuuaaauguucuacuauaaugguucuugcacacagguuccagucuuaaugugggaaagaaaacaucaauagucggugcaauauaaaguacugacuuacacaaaacacaauuucccuuuaccucauucuguuacuuucauuaauguggcuacucugucacuuauaguuaccuauaaaauacaggcuaccaaugcaaaccuuaagguaaauagacagaaaggcucuugaaucuauauucaauaauaugaaaaguauuauacauagcuugcccguauauccauccuuauuaaacacuggugaaugcucuauaucaggagcugaugggaucuaguuccuacggaauuuuucacugacuuguuuuuuguuuuuuguuuuguuuuguuuuuucauuuuucaaucuauuuguugcuauuguaaguaccacugauaaggauguauuccuauaccuacuucuuucauacucugucauuauugcuucuguagaugaguucuugucucucugguacccccaucuacucaaaagcccuuccguucaguccuaggcugugugucuagaguagcaagcauccuguccgucacaugccccaccccaccuccucaagccucaaucgguaacuuccuguuccuccugagucacuaaacuccaguucucugccacuccauuccacaaagugaccuuuaucagaggcagccaggaaccucagcauggcuuccccaguucaccagagguaaauccaaagucuacagcuuguucuggcugggaccucacccaagaccacuuccgcccaucccccaugagggcucuggcuccagggccuugggcuauuuccugcuggcucauuccaggcuuuucaagguugugguggccucugcaaaaugguagcuuaccgcacuccugacuccugguaaaggaucuuucuuaguucccagcagccucugagauacacaguccuuugcuucaugucauaacagugacuccaagaggacuccaugguuucacacauuccacaaaccuaugggacuuauggcuucacacauuccacaaacuguuccuggguggaauggugacacaggagcauaagcaaucgcaauaauaguaaaccagacugaaaaaauacaaaggcugaaugucuauuugggauaacuacacucccaacccuuucaaugguuuccaaucagaaaacgaacagggucacacauuuagauaaugaacacuacaguacagaauccucucacucaagaugcuggccaaggucacaaagcagagggcaacuggguugauguauuagggaagccucccaggaaagccugggcuugcaagcaaucaccuuguugauuccugaaucuuguguccuccguaacccaccuggggauggagugaauaguggggacuccaaguacacauuuccagccuuucccagacauaugcuaucucaugucgaauuucauggcaucuuuugggcucuccugggacagcacuguuagcagcccagaacagacuagccuuuccucuuugaccucguaaccuacuuuugccugaagaccuucggugauaagggauugggggcuacaggcucgugguggggaaagaaaacggagaaaggcagagaugggauauucugagugcuucaccuugaaaauaagaaagaaaaccccguagccauaacaauacacagaagacagggccuauaaaauaagucuuagucuagcaagacuguucuguucucuuuuaaaguugcaaucgucuagaugggcacaauuccuauaauucuaaacaaaauacaaggugucaaaggucuacaaaugcagaugcugcagggaggaacucagcuuccauggagagauuugguaaccagucaaaagaccagucaaagcuuauugaagaguguaacucaaaaagugacucagcuacuugcugaauucagccaucugcucuucugccugaauacucuaacauaaucacguagugacugucauagguggaugcagcuuuguguccugaagucugucuucaccuauggcaaccuuaucuucuuaucucuaauccugauggcuuuugauagcaaaucaauagaucaaaacuuaaacagccugugauucccugauaaaagacuuccucacaaccaagagcuugcuacucaccaauggaaagcgugccuagggguuuaucuuacuuacuuacuccggaaagccgacaaaauaucaucuagcuugcacuggucauagcaacacaugccacaaaaagauacuugucuucagagaagaaugacgcaccagggcuuggggagcagcccgauuguaaagcacuugccuguauuggacaaagcucuggguuugacccucagcaccaggacauaaacaaacacugugugcuguuguacaaagcaccuacucugugauggacucugcccuguaguuuugcucaaauaauuauauuuuaacuuggaaaaaugcacucaaagagcagacagaaagaauguuaggauaguaagcaucucugugauuuuaaggccacucuagucuacagagugaguuccaggacagccacagcuacacaaagacacaaaaacaaacaaaaaugacaaaaguguuuauguaaccuugugcauccucccauaugccuugaagcaucucugaauuauuuaucacugcuaguacaaugcaaauggcaugugcagguuauuuauuaugcuguauuggucaggagugaugguagcaaaaugaguugguauuuuaguacaugcuacauuuagaaauauauauucaaccaaugccugucaucagucgcaaaugugagggcagaguaaauguauaaaauagaggaaccaacgcagcaccugggucaagucuguaggcaucucccacuucugcaauuguuagaauugucuuuagaauuguuagugguuuguaccuacugcucaaaggcuaaaggaguaauuauaauuaaugaggguuuaauuuaccugaagauaauacaaauguucucccuguugauuugaauugaugauucuagggagacaguaaacaaauaucacaaugcuugcugccuggcaugccagauguugugacuacaguugcacugagaacucuacagucaauagcacauuguaucuguaccccagucaacaacacauuguaacuguauucaguggacagccacaaguucuugcccugacacucaguucuugugaacuucagaaagccaguucaucuuaaacuucacugacucacccuucagauggggauaacuuggcauccauauaaauggucuuuaauccuagcuauuuccacagagccccaagagauucauguagagucuaaguagguguuuuguaaauauuguauuaaucuuguugucuccauaaacaguaagacaacugagccugcccauggauuuugacuaaccagaacacugacauacaccagaacugguaagacgacaaucugauuuuuaaaauuauuacauuaauuaguugauguauuuguguggcgaggaggggguaugugcaugccauggugugcaggagucgauuuccccuuccaccguguggagcagcuuagacauugaacucaucacgcuugucaacacgaucucgccacuaagccaucaucacagaaaccugccacggucuacccaaaagcauucauuauuuuuguacaggacuuaauacuaccugaagguugguacuucgucauaauaaacuugccuaucuagcaauguggaguuaauuugaggcuaaugugagguuaauggugaauuuccaguuucauuuucuaaugguacaauauaaauuucuuuggaaaauggaagccuucuguugcuuuuauaucggguguuagguuacaugguuuuaguccccucacuguugcuaauacuuaaaaaaaaaaaaggcauuuaucugcucugcuaauaaagagagauccaugguucaguuaacagaauuuggggaugagauuucauaaaucauuauuuaagugcugcuaccacuagguaugaaccucauggccuuccagaguuacuuaucucuuugccaaucucucuucccaccucuuaaaugaagaacccuguaucccagaucauccccguaucauguaaugaggcacagagaugagccuuguaaggcuuuagcauauaagauguauagaauacauacugcaccagcgauggccauuucaauacaauauuaugcuaucauuuugucaguauaagacuugaguuugcugcucccccauccccaccuccagcuaugaacaaacuccucccucaagaaaacucaggcagucaagaggaaauggugaaaaaauaaggagacuauaagcaucuuucaucccaggaauagugcugcucaggucagguccacugcauauaucucaagaguauuucccagaauaaacaaaaagaaauaugcagguccaguauaguaccacaauaaaacaugacuguuuucucaaguucuuagaaugcccaggcuugggaagugagucagagccgguugugagggugcucugccagagcucagguuugacaagggacagugggcaaugccaccaguuaagcugagcagccuucuuccacgggucugauacucuacuaucccagcaaugauccaauguaauuuuuguucucagagacuccauuuccacagaagaggccaaauggauuuaaaauccagauuccaguucucaccugaggcagauccaagauaagcagaaaagaaaccggaguuccucuucaauccccuagaaucucucauguuugcacauaggcuaaauauuucagaaauaauuuuggacagggauuccaaaaugauaagccauuaauauugguuuucuaacugacccaggauguuaauucugaaauaaaaccuuuauugcuuaagcuugcagcucuaguggucaaaagccccuuccuguagugggagugucuuauuaucuugccuuagcaggguucugugugaggaugcuauuuuuccaaccuccgguguaucaaagcauucucuaucucugggaaaacagcccuacuaccugaggaaacauuuauacagaguaucuccuuacuaaaauccuaguauuacuccaacccugcuuucuggggaggaaggcgggccuagugcccuauggugacuaacguugccauugguuccuuuaagauaaugggagggagaacacuggggacccccucacuuuuucgacccagcuuccgguuguuugugagccugaugcucugcaccucgaugcugcgcuaacgugagugaggcggugugggagaccuagaucugagcacaccggaggugacgggccuggcaucacguaggcucccacgccgggcggggcggugcccuaagcagcuccccaaccugcggcacuggcgccagccccgccccgcucaagggcgaagggaaggucauccguggggugggcggaaggcaaggacuccaacccuaaaccucccggauugagcuggcuuagaacgagggaaaauauaacauggcauuuggaugcauccaggguagaggaaagaacugaaaagcaaaagcaaaaccuggcucaggaacugucugcagccggcacagaccucaagacuuggagggcacauacucuaugaaaauguaggucuugcuucuagcgcguguccucaucaagaaauuagcaugaacucggaaagcccacuguuugggaaccccagcgcccccacguguacccaggauuagaggcuggggcacgguacagucaccccauugcucuuacauuuuaaguauucucaguuuaucaaauccaagcguacagaaaucgagucccuucagcucugaaaucaaucccgucauugggagaaaagggaagcccggagcugguaagugagggcugaugacgucccggagucccugcuuccuggucuuucccguccuggggaggcuggccccggagggccuagugacccauuuuaguuuucacuuuugucacaagcaggaagagacauugccuggcagucaaugccacacccugagagaccccugcacgcccccccccccccagcugcgcaucccgcaaugcagcagcagagaaggcugcuagcaccgcuugggaggcaggacugggauggaggcgcuguggguaccccgcuguuuuuccuacgagucccagggauuaggguggggcggugcuguggcauccuuaucgucgcccuguaccuaauuccaggaaagaacgccuggcucauaugacccagacaguagacgaccccauuggcuagcucaauuaauaaauuuggggauggaaaacugguucaucuugggaaugaagaauccuacacaaauauccuuuaucuucugccccucaccacguaauggaacucuauggucgcuccucaggcacccuaguuguuccuagauuaggguuuucccuacuccugagccaccgguucuccucggcucucauagguaauuuucaccaagcccuuuccucauccuuucucccagauccaggucacccaacguuucuccccagcucucccucuguucccaacccgauuacccuccucugcagcccucuccagccgcccucgcccccugcccggcccuuggagaccagcgagagagcugguaggcacgcaccuugggcauccccgccgcuggucaggacaccgauagcuuugccauccccagagaggugcuccagguacuucggauaggcgcuggagcucgaagaauccaagucacucaugaugaggagguagagacgccagacacucccguacucagcaagcacugaagcccuggcccacgcgcgccagccuuggaaccgcugccccgccugcacccg

SEQ ID NO: 6876 - RNA, 496 nt, Mus musculus
auuggcggaggugaggggguuccugcugcugagcuuuggggcccgauugcuggggccugcugggaacaggacuucuaacagcaaguaugucuggaaggcuguggugcaaggccauuuuugcuggcuacaagcgaggucuccggaaccaaagagagcacacggcucuucuuaaaauugaaggcguuuaugcccgagaugaaacggaguucuacuuaggcaagagaugugcuuauguguauaaagcaaaaaacaauacagugacuccuggaggaaaaccaaacaaaaccagagugaucuggggaaagguaacucgggcccacggaaacaguggcaugguuauugccaaauuccgaagcaaccuuccugcaaaggccauuggacacagaauccgugcgaugcuguacccaucccggauuuaaacuaauggagaguaaauaaauaaaaguagauuugugcucuuguaaaaaaaaaaaaagaaaaaaaaaaagaaauacau

SEQ ID NO: 6877 - RNA, 69142 nt, Mus musculus
ccaaauacgauaaauuuauuucuucuccagcaaacaucuugcauuacugcuucuugaaucugaaccuucaguuuuaucuuauaggaagaauguugacccauauagaaggaaaauacuaucaugcuuuuacuguaggugaguuuuaaacaucuaguucaaguugcucgcagagacaaggcuguuuauguaacagcuccauucugcuauguaggucuucccaacccugauuaacggggaaaagcggcucaagucccaccuuuugcagugaacagcugauucuauuuuccccucuuagccaauggugaucagauauuucagaaggaaacugggugagucaucuucugcagauaagcugaaauauuaauaguucuaucucuaccaggcucuccugcagccagcuagcaagacucccacugagcccugccugaggagccauuccuagcagaucagccuguaaagcaguuggauuugagagauucugaaagcgauuacguuaaauaguacacucgacuuugcauuuuaauagauuauuuuucuuaccaguuuuugggcugugcgaguguuuaggacagauggacuuaaaaccugccugaccguggaccccucaccggaaucccugcagugguaaguacccacgguccgggaggcugugugugcuucucccuguuaccgacgcuacagggucucggggagcaauucgugcaaggaucgcguguaccguuaguguguggugcagaauuuggggucuagcagugccuguaagcaccuugggaaagcuccuaacagggaaagcgcugagccuacuugcgccaccaggggacgccauacucguucugcagucacucgcugggucuuggcucagcgcgcugcuaggccauaguuuaggucuccaggacccggcgucaaagccgaaagccaaaacaggagacuaucccgcggaacaagccugugggacugagcgaaggagaccaggaaagaacuuccgcagccguugggcauggggcggagcuuccggucuguuuuuuuuuuuuuaaggaccaucucugagggcgggacuuccgcaguuaccggaaguacgggcgcgccaguucgggucgccggguugugucagugcgggaaucggccgguuuuuuuuccugcucugggucugccucgggagccucgucgcggggggaucuacgaauugagugcgacguaggcugguuccaggcggacgcgagugcugcugcugugacaggugacgccaucuucucagcugucuggcuuggcauccuucucgggcgcucgggggaugucagguguccggguggcgguggggacgaggcuucgagguggaugaaggauacaguccuaauccugcgcacucucucuggcucccuguguacucaaguggcgucuaccuggcugucugugucccgugggaagcccagaguuuucgaagaugguggccuucgaucccgcaaagacgggguauggccucugggaaggaggaaggguggggggcggagaugggguaagcagaugcugaagugguaaaaccccgccacgccuuuguuucucuuucugaagacuuccuuuucuuccccguacacuucuauuuccuaaguuuuaaggcaucauaaugggccaguuuuaccaaaaaguugcauaaauaugccauuucacuucgcgagcagacauaaccgaacgauugaucagguucuuagagguuuuaucaucuaacuugaacucuucgauguuucuugugcuugaagacgaggaccguuagcucuacaccacucacucucuugcccggauguagauugcuaggcaguuucuuugaaguucagauggguuuucuuuacauugcuuauuguggccuacaaaguaugccaucaaagcgguacugaaaccuuuuuaccucuaagcaguacaccuggugauaauaagccuccaggauacuucucccuuuucuaagaaaucuucuauuaugcuaccuuccuugcuguuuugguuacuuugccgaucacauuuucaaguguuuguaaauucucuuugacaccuaagccacauacuugagcauaguauauauaaauauaaccugaccaaaguaaguagaggccuucuauuaguguugcccauaggagacgcagagcaguggccaguggccacaugaaauaacagugugaccuugauguuuaugacagcuacguuuuugcaguguauaucaagccuucuugcauaaauuucuggacacaggaccuaaguaugcuuccuuugguuuucuuacucugagauguuacuuccuuuaguauagguacguuggucuguuaucuuacuuugcccuugauuugagguaaaauccuugggguuggguauuucccccagcagugauacuaagaguuuuguuaguuguccuguccugauuuauucaaagaaagauaugcuuucuagauuugaauuucuuuuuugguuauugagaaaaaaauucuuggugguagcuuauuuaauuacugaugccugucagcucagugccauccuuagacucgauaagugugcaucauuugccuucaucucaucagugacagaacauuuuaaguaacuuaauucuggugacagauuuccaagguugcguguagagaccauucucuuuucuguuacugguuagauauugcauugauucagcccucuagaaguuaauuuuaaaaguacuauuacaaucaacacuuaaaauauuaauauuauuaauaccuuuauugaacuuuuggagguucagugacauuuuauaguuuauacuaccaucugcaaauuauauaaccaucuuuuuaauguauaacuaacauuuuugggauaaaccggguauuuauuuugaaauaaaucaguuuuuucuuguugaaagaaaauuaaaauucuuccuccaaaguaugaaauagagaguaauguuuuauauuaucucaaauaaaagcauacauuguuuguuguauugcuuauaaaacuacuucagcaggcuuccuguuugguuguauguacuuaauaaaaaucugauacuguagguaguaacaccuuacuguggaacauacauacuaaaaagagccuugaaaagagagagagcuaaguguucauuggugcgguuuaauguuauaccauuuaccaagguagugaauuugguauauuaacaguguguguagagauuuuauucauuuguuaaauauguugcacuaaagcuggacauguauuguucugccuuguuuauaaacagcagagaagaggauaugcccaugacagcauggaauaaggacagaugaguuuggcaggccaaccaguuaggagugcaggagaaacuauauugcagcuuuacauuuaauguacugaucugucuuacugaacugggugaauugaugugaguguuugaaagaaaguaauuaccuuuuggagcuuuagauucuuucuuuuuaaaaacauauauaggugaauuagugcauaguaaaaguaacuuuauaaaauaauuuguuuggugugaugcuggugaugaaacccaaggucucagcuaugccuagcaaucagccuccuucccauugagcuacaucccaccccagauguauuuucucuuuuuuuaugagacaguuccucucugugaagccuuggcuguccugucuugggauucucuauuuagaccagauuagacuggccuugaacucagagaucugccugcuucuacacccccccuccccccccccagugcucggauuaaaggcaugcaccauuaugcccagguagaccuauuuuauuuucagagugaaagaguuuucuuucucuuuugagcuaccuuuuguuuugcuuuuuuuuguuuuguuuuguuuuguuuuucgagacaggguuucucuguguagcccuggcuguccuagagcucacucuguagaccaggcuagccucgaacacagaaauccgccugccucugccucccuagugcuaggauuaaaggcaugccaccacgcccggcuucaguuaccuuuuuaauacugucuaguuuguaaaauaccaucagacuacaaauugaaguugaaaauucucccucacagugguuuugugugaggaucagugccucuguauuuguggaucaauuucagucucauaagcgacagucugugguaguuuuucaaccucaggucgacccacaauugacuuucuccccuuugcuuuccauucuuucuguuuucacuuggcuagcuugugcucuguguauaccgcuugaguauuucuuguacaagugacuacugucuuguguaccuucuugcuaggaucacaaaccccaaaccucugaauuuuuuuaguaauucaaauauuuaauuaauuguauccgcaugagggccaugugagugcaguggccacagaagccagagaggaaaucagauucuuuagagcagagauucuuaauuuguggguugugaccuucacagggguugccuaagacuauuggaaaacaaagauaauuacauuaugauucauaacaguagcaaacuuacaguuaugagguagcagugaacguaauuuuauggcuaggggucacgacaacaugaagaacuguauuaaagggauguaacaguaggaaggucaagauuacucuagaguugcacgugguggugaguugccugaccguuccugcagugaacuuguuuccucugguagagcagcauagguucuuagccucugagucauccuuuuauuuuuuugagacaggguuucagguaaccuaggauggccuugaacucccuuuucaagcaaggcuggauuugaguuuugauccuccugccacuuucucucuaauuacuuuuuguuaauacaugguuaguucauguuaguaccugguuuggcagcugucuuagugaggguuuccauugcugugaagaggcaccaugaccaaggcaacucuaauaaaggaccacauuuaauuggggcugucuuacagguucagagauucaguccauuuucaucaaggugggaagcauggcagcauccauggcacuaaagaaugagcugagacuucuacauuuuuguucugaagucaaacaggagaagacugucucuaggcaucuaggaggagggcuucaaagcccaccugcacagugacacacuuccucuagcaaggacacguccacuccaacaggccacacuuccuaauagugccacucccucaaccaagccuauuuaaaccagcacagaagccgucacguacuuccauuuuuuugauguagugugaauggaaggaaaugauacuaggaacuggaguaguuacuuuucuuauuaccgagggaggccggggccaacuuucugacucaaaacaacuuaagcaagggagguuuguuuugguucacaguugagaggaaugcagcccauagagaccuguuguugggaguguuccaguccauggcgccagugaggaagcacagaauuggugcucugcuagcuuucuucuucccucucauugagucccggaccccagcccaagagagguggcagugaacagagcuaagaugugugucuucuucuccacucucuaauuuucucucacagauacaaucaaaugugugucucauuaauguccucuguauuuuuaguucaguuaagucagcaagcauaggaccaguacagauuucuggggggaaagauagagguuggagguuguaaauauagaggcagaaguaaagaugaagauaaugucacagagaaagacugaugacagauuacagcuaccgggaggagcugguguuccuaguguaggagcuacagguacagagacagaaguuguggaccuaccagacaugucuggagguccagugcugguuuugcuuccacauuaccauuuuguuuaaccugggggcuagcuuugcuagguauagucugcuuuucaggcuaaccuuaacaucaggggcuguuagaagaaaagaugcuaguaaauuucauauggauaaaaagcaccugacaaguuacuggguuccaacugugacucauuuguucaaaacaacuagaugcuugugaugcuugaggugacagcugacaacauauccuaguuacagaaaauaugaggcaguaauugaaauacacuguccauacuguacagaagagcugcacacagaaugcuaagaugagaggacuuugaugucuccuuuaauuggaauagaugaagaguaggcuuucagauaaugagcggggucuugcacauucugacuauggaucuaaagcuacugcauagcaguuacagaaacagagucagccaguuuuccugaagaauaaauaagaacuuuaauuggaugucugacuccauguuggaaacugcauuuucuuuccugccuacuguucugucaguuguuuccaaaccuucagaaggagaaauuggaggugaaaauccuaaauccaggauucuuauggaagcaaagguugguugacaccuuuacucuucuagagagagacuaaauauugucauuaguuuaccaaacccagcauguugcaugccuguguguuuacuaauaacauaccagcuuagaggccccuggaaugauaaaagaucuuuccuacuuucuuaccacugaugagguuagaacucuggaaauaaaaacacugcuuuugggaaaaaagggguugggaaaaacuaaaaaaaaaaaauuucccauagaggaaaaaugaaguacaguuaggagcacuggacauuauacauaaaaugaauggaagauugaaagauggagaaggaaagguaaauagacuaacuggcuaagucccugggaucugaaacaugaaguacaauuuaauuuccuuuuccguuacauguuccuacuuugauguuguagaaguaugcaaccuagggacagcaaagggcucaggcaaagaacaauauaaaacagaagaaagaaagcaaucaacucgauuucuggccauggcaaaaagugaugacucagcaguucagagcgcauguugcucuuccagaggauggugcuuugauuucuagcagcuaccugguggcucacaaccaucuauaacuccagcuccagggaauuaaaugcccucuuuugaccucugugggcacuaggcauacauguugcacacaggcauacacacaggcaaaacacucauaaaaucaaaaggggcuaucccucuguaguggcaaggaaauugcggggaccgguaagaucauccucagccauggcaaucugagugaaagccaaagaggaggauggacuauugugccaccacucagaaguaaccaggagucuuccucaugugacagaacagggagggagccuuaauucacuuucugccuucuguauuauucuggcagcaguaagcaauacuucuguuugucaaagcaguucuaagaaaggccugcuguaacaguucccaaggcugauagcauuauguccaaaaggucagaguuucaauuaagcaucagcuggugaaugaagaaccaggaaaaucucaaacucaaaugagggguggggggagggggggggagagagagagagagagagagagagagagagagagagagagagagagagagagauuuaaagaaaaugcuagcacaaauauggcacugauuagaauuauugacaggaauuuaaaauuuaccaucuuaaaacuuuuaagaucuagauauaaaaucaugcagcuauagacauccgauuuuugacaggugucgaaaacauauauuuauggugggaaaacuauguauccacauguagauugaaauuagaaccuucuaccuugucacaauauacucaaaugaauuagagaucuucauggaagauggaaauuugaaacugcuagaggaaaacagucgaagauauagucaagagcugucccaucaggacucuucagguguuucggaaauaacagcaaggauugacagauggggcuucaguacuuaaagggugcuucauagcaaaagaaguagagugaagagacaccaucuagaaugucagugaauaccuauucaucuaacaaaacaauaccuauucagaacauagagaauuagauaccaaaaaaccaacccaaucaguacaguuacuaagugggaaaacaaguugaacaaauaccuuuuuuuuuuuuuuuuugguguuucgagacaggguuucucuguguagcccuggcuguccuggaacucacuuuguagaccaggcuggccucgaauucgccugccucugcugggauuaaaggcaugagccaccaugcccggcagaacaaauacuuuuuaagguaauuuuuacucugucuuuuaaaaauuuuaugugcauugguguuuugcuuacaugugugucugugugagagugucaguuauccuggaacuggaguuacaggaguuguaagcugccauguugcugggaauugaacccugguccucuggaagagcagccagugcucuuacuuguugaaccaucucuccagcccuaaacaaauacuuuucaaaugaagaacuacagauggcuaauguucaacaucuuuauccaucaguaaacugcaaauccaaacuagauugagauuuuguuucucccaguuagaaugccuauuguuggcuuucuucuuucuuuuaauuucuccuucauucuucuuuuuuguuuuuguuuuuuuuuuuuuugaaacuguguagcucuggcuguccugcaacuugaucuguagacuaggcuagccuccaacugggagauccuccugucucgucuuccaaguguugguguuaaaggugugugcuaccaccaccuggcucuuaguuggcuuucuguugcugugauaaacaucaagacuaagagcaacucugggagaaaaggguauauuugacguagaguccguuccaaagcagagacucaagguaagaaucuggagacaggacuaaagcagagaguauggaggagugcaauuuacuggcuuauuccccuuggauugcuuauacaacccaggggugcuaccucccacaguggccugggcccuacuacaucaaucuguggaggcuuacucucaauuaagaguucucuuucccagacaugucuagauuugugucaaguucuaucaaccaguccaucuaucuucaagaaaaaacaaaacaaaacaaaaacaacaacaaaacaacucaaccaacccaccaaauguuguuuaggauguagagaaaagaggaauucuguauacuguugguggaaauauaaaccaguucauucacuaucuaaaucagugggagaguccucaaaaagcuaaauauguuuuauaaauaguauuguaugguccaacucuacagcucuuggguaaauauuacagauuugggccacagggucacagcauucugucucucgucuuuuuuuuuaaaugugaauucaagggaaugagcuugaguugucagccuuagcaucucccuucccagugucaaagucugaacaugcuuagguaaucuccaggaaaguagagauaggagagggaauguccauggguaucaguauugaucuguauuugaaaauaaucaauguaauuaaacccuguguaggucaacaaugaaaaucuauggccucauagaaauugguacagaagccgggcagugguggcacacaccuuuaaucccagcacuugggaggcagaggcaggcggauuucugaguucgaggccagccuggucuacagagugaguuccaggacaguuagggcuacacagagagacccugucucgaaaaaccaaaaaaaaaaaaaaaaaaaaaaauugguacagaaaaagcaugguaauucaggacuuacuugugaaauaagcucauagaaaacauaugagaaagaaauaucaauggguaaauaacuauagaaaacccacagcuagcuucauucucaggggugaaggcauucuuaccucgaaauagugaaaugucuagccaaaaguagaaggaaaauaagacuugcaaaugaaaaagaaagaaauguccucauucuuucagguggaacaguaauuuacauuaaaaacaugaccaaauaaucuacagaauauuuuuuucuaaaauuuauaaagaaauucaguaagaaugugagauauaagcuuaauacacaguaaucuuuuauauuuuuguaguuaacauaugaaaacaaaggaaaauaguguuuaaaauguuuaaaaacuauuaaaaaagauuuguagugaauuggguuuuucauuuagcacuaaacuggaaacugaugaaagauuaaauauuuuaucgguuugaagccccaaaucaacagauuuaucaaaaauuauuuuuaagguuacagcaagaauuaaaaaaaaguuucuuguauggguggcuugcuuucaugucugucuguacaauaugugugcuugguguggguggaggcggaaggccucagauccucuggagcugugagccaccucauggguguagggaaauguaaucucagguucuguuuuguuuuguuuuuuuucgagacagggauucucuguguagcccuggcuguccuggaacucacucuguagaccaggcuggccucgaacucagaaaucugccugccucugccucccaagugcugggauuaaaggcaugugccaccacgcccggcgaacucucagguucuuaaccacuaaguaagugaucucucuaacccacaaagcagcaauuuuugagauugaaaaaaaaaaucccacugguuuagauagacuuuugaaaauuaaagguuagauuaacacuuuugagagagauuuaaacaacaagaaucacuguagcugaccauaacacuugaguucuguauuguuucgugagcucucacuugaguaagaaauccuuaccuuguuugcugauuauuugaauuugcuguaucagaaaugaaguacuuguuuucccugcuguuauuuagcuuauugcaggagugaccaggacacuaccuucuagaaguaaugcccacagaaagcggaaguuguucaacugcucgccaagcaaaacaaaagcgcaagucucauagccuuucuauacgaagaacuaacagcucagaacaagagaggacuggacugccaagagaaauguuagaaggacaaguaagucagccucggucagcucccauuguguaaagaugacgucaugcuugaagugugauugaaauaagcuaaugcaugugggucucgaaagccaaagaaaggcucacacugacagacaaagcacaggaucucuauguaauccugucuuggaacuuggcauguagaccaggcuggccucgaacucauagagguccaccugccccccgccucccaagugcuguaauuaaaggcaugugccaccaugcuuggcuaagguauaucuauauaauauauaagguauaucuauauaauauauauaagguauaucuauauaauauauaagguauaucuauauaauauaucuauaacaaaaagauauggugugacaauuacaauaaggacuugguuaacucuuuguacagguuaguugucuagauuuuccagccagguuuuuguuccugaugcucuaaagaaaaggggagaauuaaaaauuuggugcucuuucugcuucugaagugacuugccuuuguccuugucucugcuguauauagugaguauaccguccuuugaugaauguaaugauacauggcuaagaauguuaaguuuugcucauacuuuucuagugucuuuauagaugucaaaaaaggugggaauuuugaagaguauuauugugaaaucuagauaaaguaggcuuuauuaaaaucaucauauauagugauaccuauauaggaauacauuaauacuuuuguaagcauuuuuuuuucacaauuagacuguaucagccauauugcuaugggauagagagaauugaauaugaggaauuggccuuauuggccuuuaugaauguuggaucuuuuuuauuuuuauuuuuauuuuauuuuguuuuuuuuuuuuuaacuuuuuaauuuuuuuuuuggacacaguguuucucuguguagcccugguuguccuggaacucacuuuguagaccagacuggccuggaacucagaaaucugccugccucugcuucccaagugcugggauucaaggcgugcgccaccacugccccagaacguuggauauuauuagaaccacauaagaacuuccugcaugugacuuuuuguauauaaauccuauauucaauacuuuaauaccauuggcaguagugcuuaucuaaaaaaaccaaaaggauuaugggcugccguggaguugaugcaguguggaugcugggaauauaacccugucuuuaggaaauaauggggaaagggcgcucgcugcugcucguucagugcagcugcuuuuuacagguucuuuuuuuuuuuucuuagucacaguauggacacacacacacacacacacacacacacacacacuaucauuucuuuagucacaguauggacacacacacacauauacuaucauuuuuuuuuccuguuguuuugagaaagggucuuguuauacguaggucagucugacuuugaacuugggcuuggaauccuuugucacaguugcucaugccuugggauugcaggcaugcuguguguuaucuugcuuuugccuaaauguuucucaccuacaguugguugacucuacaguuguagaacuuugaauuuagaagcucaacucugcccugucuacuuuauacaaaaaguuauauuuuaacuagugauggauauaaagaacauaaaaauagcuuuaacaguauuuaccuuugcuagguuguagcagaguacuauaagcuaguuaguguagacaacauaaauuuuugcauaauucuggaggauaaaauccaaggugaagggccucccaaggccucacuuguagcuuaugacugccaccucuugcauccucauggucuuuccucuuugaggguuuuucuuaacucguauaagaacaccagcagucauaaucaguuaggaucaccauuaugacugcauuuuacuggucacuccaguaaagaucuugauucuuaauauacuuacauucaggggaauucagguuuggggcacaauccauuucagagaguaaaacuacaacugugugguaggauuucugugaugguagaaguauugucccuuuugauaaaggcugguggcuacuaaguggacaguauagagaaacaaucuaagaugguucuuaaaagcuuuugauuuacuuauauuuauaccggugacaauuguacuuuguuugcuggcauauucaagacuuacuucucacaugaagugacuuuguguuuaguguugucuuccauugugauguaguaugaggggauaaguguagcucacaguaacugcuacagggugauucacaacucuuuccaccugagcgaggcagaccugugugcugcucuugugguucugaacuucccauguuagcuagauaguacuucuuguuuacugaguauagcuauuugaacuggagccaacagcgugaucugugaguggccgaggugaaccuccccuuuacaggagggaagagagugauaguguuugacgaugcggcuggcauggugggucuaaguggacugcugugggagagcagaggugcugaaaugucaggagucuugcuuuacacaguagucggcuagucacaguggagcagugcucuccugccuaauugggaacaguaucaaaaagaaggugaagguuaaucuccaugguacuauauuagguuaauguucuguaucuuuaaguaaaugugaaguuuuuuagagggauguuaagauugccauuucuaccagauucauuguuuaagcuagcauguauauauuuuaagugguucaugaaauuuaugugagaauacauaauuauugaaaaacucaaauuguggaaauguuuaauuuuuccugaaauuuauauuucuaagaagugaacauggcccaaauggguaccuacuuuguauguugacuaaacugcuagacauuuuguucuauuaugggcaagauuccaccccccccccccucggcuuuauaaugucuuaguuacagaguuauaggaagucucucuaguuuguuuuagguggugagguacauguccaguauagauaguccauugacauaccugguguuguuuguuuuuaauagcaugucuaaaggcuauuuguaacauagcuucauuuuugggaauagccuuauuucucuacaaauuugaauaaagucaacucauguucccucuaugucagugcaaaauagaguaaacuuuuuccguugaagaaaaaguucugagucuagaauauauaugaccaaggcccaagaacacaggucauguuccccuguauaacacauucuguuguagaagaggguagaggccuuuuguagucaaagaacagaaggaugucauacgucacugcacuaaccugcaugcauucuuuggauaucugguagaccggcugcagcaaagcaggagucuuugcuguagguuuuggauguucuuacagucuuagcuauagguuuggugaaugcuugaggugugugcacuuuaacagugcacucuagaaggauuaccuagcagucaggauguuagaggaagacacagagguugauaguaaauagcuguaaaaaaggauggaaggcagcuccagaucauuuggguucucagucugaaacauuccauuuccacaguuaagauguuuggucucgccgagcaugguggcgcacgccuuuaaucccagcacucaggaggcagaggcagguggauuucugaguucgaggccagccuggucuacacagugagcuccaggacagccagggcuacacagagaaacccugucucgaaaaaccaaagggaaaaaacaaaaacgauguuuggucuuucaguuagucuuuaagaucugcagcccguauauggcuucuuaagagagcuauguucacauguguaaaaggaaacuuguuauuuugugcucuuaaaucuuuuauuuuucuaggaauacauuuugauaauuguuuccuuuguagagacuugaaucuuaaauuuuuuugagucuuggggauugaaccccuguuaauaaguacaugcucucacugagcuacaucccuagcuaaauuuuaaacucuagaaacauucauauguauaagaaauauaauauauuauauuauaaagaguuuaagauaaaugaugauucacuuugaaaaaaauauauuguugccugguguuaaauugauugauuuauuuauuuuaaacaaaaaauauuucucuuguacaggauucuaaacugccguccucaguucgcaguacacugcuggaauuguuuggccagauagaaagagaauuugaaaaucuuuacaucgaaaacuuagaaugugaguaucuccuaucuuauuguauuuuuaaaaaauuauuauuuauccauagaagucuuggagaacaauauuuguggguugagagucaucacucuauucauuucuguucuguuguuaaaccugcugacuuaaccauauuauuggguuggagcaguggcucagcuguuaagaacauuggcugcucuucagaaguccuggguucaguucuuaguuagcaucuaccugacugcucacacuguaauuuccauuucaggagauccaaugcccucuucugaccucagaggauagcagacguuuguguaguauauggacauacaugcaggaagaacacccauacaaauaaaguaauauaaaaaaacccuuacaguucugugggccuaguaugauucuugccagagugauguugaauccuggcagaguuguguuccuuucugcacccuccaggaacaaacauuuccugcuucuuuuguguggugacagaaugcauuaauugugcuuuuaggacuggccccuuugcuguuucuuuggcucaugugcccaucuccuuuggugaugcaaugguuccuuuuguuuccucucugauuugccuuucugucuguuguaguccugagaauaugugauuugauugagccccgagauauuccaggguaacccccucuaccugcagaacccccgaacuuagaggguaacccccguguuaacaggcaucauagggcugggcccugagaaucuuugagggcuugucagaucaaacaaccagaacugaaguuuuauacaaaaugaauacauuccauuuuuuuuauauaccaagcauaccauaaauuauauaaaccuuaauauauccuuucuugaaaauuuccaaaaacauguugauguauuagagguaaaucaaaagaauuuuaaaauagcuucacuuuagguuuuuuuuuuuuuuuuuuuuuuaaauacauuccuauaugugcuuuuuaaaaaggaaauuuauuuaacccuuuggcccaucauacuauuuaaaggaaaacauuuucuguauuuuuuuauucugcuuugaauucuucugguuauuauuuuucuuagcaugaguagucuucuaguuuuacaugagaccagauguguuaaugcuucaccacuaggaaguuaaugucuuuuguuccuuauucuguuauuggguaguuuucacggggaguguuuagaacaugucuaccauuucagugaacucucauggaacuuugugcuuucuuuacccuaagaauugcaugcauacuaauaagcagcaguuaaauuguaagcuguuugcacuuuuuaauuucuaugguuggaucagucaugaaguaaaaugcaaucuuaucucauucacaauuugcucuuggaaaauguaauguuuuaauauuggguucuccacaugaccuuuaucuugagaacuuagaacaacaaagauccaauuuuguuacaaaguaaguaccaugaauagcaucagauuucagggagguuuuucuaaguaucagaguuuuaacaacugaaauauuuuugguguuuucauugugauuuaagauauucuugucacaaagcacuaaccccccccucccccaguuaaaaugaaaucuuuaaaaauuacuaauguuggcaggugcuuugacuucauguugucuaguauuuaggaguuuuguagcuucuugguacccauaagauaaaguccuuguugcuuggucuguguguuggauagagccuuuguccuuagccuacuccugaccuugacuuguuuuaaacuuuggucacaaguauccuacugucccaggaggcaaagcauguaggcccuagcgcuggguggacacguguuuaaaucagguccuaguugugccagguuaggacuuggggcuuugagagcaguuacuugccugggcaggcaagucuuuucucaguuucauggugaggaugccugagguuacucccuagguccucugguagcaaggaggaccauaguuuucuguaucuucagguacuguguucuuuuuaauggcucauuuuuaugguucucuccccugacacucccaaucuugaauuuccuauuaauuuuucauuuuaaaauguuaaaaucuuuguuauacauaauccucaugugaagguuuuucuggagucauguaccaguagguuacguauuguuacuauguuuuuuccucaguugcaguauccacagguaagcuauauauauuuuacuaaaucuuaggcaguaucagacuguuuuuaaaugcauggaacuagcaaaaaggaagcuguguugaauaagaauuuggauguaugcaaguggugugguuaagacccugagaguaacaucuugacagggucacaagaguggauuuucauuuauuuauuuuuaaaaauuggaucucauguagcacagaguggccuugaauuugaaauguagccgaggauaacccugaacuucugaucuucugguguccaccuucuaagugcugagauuguagguauccacagccaguguguaugguguguaaugaagccaggucuucaugcgugcugggugagcacuccagcaacugagcugcaugcccagcccuggcuuugcucguggaaugauggcuugggaaguauaaauuaucaccuugcuuuuuagaauauucuucucaucuuugucuugacagucccgauucaacauucauauguauuuuaguuuacaaguggugaauacauauuuacauuuagaaauguuuuuauuucuagugcgcagagaaauugauacucuuaaugaacguuuagcuggugaaggacaagcgaucgauggggcagaauugaguaagggccaacucaaaacaaaagguaagauauuuauaauguauugcaugucgauuacuuacgaagaaaacugggauuucacgagggacacugauucuugcucucugcuagcagccagacuuggaauacauaauucaggucuaggucagaugagaaauggcucccuguuagugcugcuguugucccaggucuugguguuucccugucuuccuaagacacagcugcacggcgcagcgcugugcuccuggaguuugagguugucugacuguugauucucugucuuccacagccagucacaguaccagucagcuuucucagaagcuuaagaccaccuacaaggcuuccaccagcaagguaugcaaggcacuggcucuggaaccagucauguggugcuugcggugugcagauguguacuuuaauuugcacauuuuccaguuagaaauguguaauaggaaaaugucugguuucuagaaacaaccauugccaaauggcuauaguauauagaugcuuaaauacuaacuuagauucuaacuucagugagaucuauguauugugcauuagcaauauuuugucauuagaagaacagcauauuuuguauugauuauugucuugauaaaaaaguauauggauugagagagauaaauaauggcuaaauaugugggcucaaaguucuaucuggcuaaaguuacguuuucauuauuauuuuucuauuuucuaagugugagaaggaagugagggugugcuugugaggcggguaggguggucaaggaguuuuccuuuacagugccuaggacugacuugaagugacaaggaguuaauugcuuggaaagcuauuguauaauaguauuuugagguaauauuauacuuaccuaauuuugaguauuuugaauauguaaaagauaaaucaauuaccuaacuggagaauguauauuccuuugguuacaugugagaggaaaaauugaaauuuauacuauuauuacauaaauauuaucagcuuuucauuuuuacaauucauuaucuuggacugacagucauuuauuuggcagguccacugagguaaacuucaguuaagagggcaagucuagccuuucugccugcucuccuuauuuaaaaauucuuggugauuuuuauuuuggagagugcaugaguauuguugacauuugcuacugugugcuuugauaacaucuggaguguaaauugcuguuucauuggauuuuuguuuguuguaaugucuaguucaucuuacuuuugaaauuuguaauuaacuaguuuuucuucaaaaugaaguacaaaauuauguucuucaucuuuuauuacauuaucuugaauuaaauagauuauucugauguuuacaauucuguguauacaguguguggucuuaugauuuaaaacucugguuauuucugaaguagaggaagauauacuuauauauaacagucuuuuaccaugagcaauaaaaaacaagguuuggacaaagguaagggcaugcacaauaguauuuugcuuuaaaauauauuagagcucuacaaucuuuaauggccgacauuuuaggauuagaauaugucagaagcaaauucuaugaacuuuacagcaauuuguacacuguauguacucaucuuagaaaauaaugaaacacagacauccacauugaagagauaauuugguaacgauauauucugauuuguaccacagcauggauucuugguauuaaagcuaagcacgaaugcaacaagaacaugcuacaaucuagauucauuacuugcccuccuugugacucagagccaugaaaggcaaguagcauguuuggugagacagugggagcacagaaguguaugaagucaaccuacagagauucccuuccccugggcagcuccugacugauugcuaaugcuuauggggagggaugggggagacacucuacucugaaaaggacuuuaaagcaacuuguggaaauguuugcaaauauucuuuagaaaguauuuuuuuuuuuuuuuuuguaguagaaaagggccuuucugauuuguuuuuaaagugcuuuaggcuguguucuaguuaaaaugauuuaggauuaugggaaaacaucauaucauuguuuagucugcuguuguucuguucaaauguuccuucuaguaauucaguuguguuguugggucucuuaguaaucuugaccaagucaguguuuauuuguuugucuauuuuuuauugagacagggucucuucacguaguccugacuguccuggaacuuccuauguagacaaggcugucugauaacucagagauucuccugccucugccucauaacuguuagaauuaaaggugugcuccaucaugcccugcuuaagucagucaguggucuuucuuucuuucuuucuuucuuccuuucuuccuuucuuuccuuucuuuccuuucuuuccuuucuuuccuuucuuuccuuucuuuccuuucuuuccuuucuuuccuuucuuccuuucuuccuuucuuccuuucuuccuuucuuccuuucuuccucucucucucucucucucucucucucccccucucucucuaaagcauaaugagcauauggaaguagcaugagaugauaugccacaguaucaugggcaucauguuauccuguaucuaaauagugcucuuccauucuauccugugagugggauagguaagguaggaaagaaacgggccucaauaguuccuuauacuagcauucuuuauauuagaaaugucgagagacuuggaaaauguuauuuaccauaacuugugaugguggcaaguuuuauguggucucugacuccuccuccuaagaugucauaguguugggcaucucuguguuuucuguaagcugaagcucuuauagauuauagagggauacuuuaguugauuuuaggagggacacuagcuuucagaaagguaagaugacaaugauggguuugagguuugagcaaguccuuuucuguuuucuauaaaguuucaagcaaguuaaauagaauugacuuauacuuguaaaaugucagucucuucauugagcuuucuauuuuugucuuuacuguguuggggauaaucugaaagcacauuccuaauugauguaacagauuguaucugcauauauuuauguaagaguaaauuuauauacauguccugggcucugcaaaauuauuguuaaaagcaagcuguaugaauucauuaaauucugauuuugcuuuuuugcuugauuucauagacucaucauucuuuauauuuuuuugaguuacuuaacaguugaaacuuucucauuuaucugagagcagcuucacaacuaaaaaguuuaaagaaaauuuugcauuuaauuucuuccucacuuuauauucuucauuauaagggaaaugagaauuguuuguuauaugucauuaaaugggacaguaucuuacuauguguuccucaucuguaucaccacaugucuguuuccauuagaauaugagcuucuaaaaggccuuuguaccucuuagcugucucuaguuuggccuguggcuucaagcagguguucaauaaacgcucuuugacaaaccuccucaucuguuacaaguguggucuuucgacuccucuuacagcaugggauuuuuuuuuugguuguuuuuuguuuuuuauuuuuucaagacaggguuucucuguagcccuggcuguccuggaacccacucuguagaccaggcuguccuugaacucagaaaucugccugccucugccucccaagugcugggauuaaagugccaccacugcccggcagcaugggcuuuuuuuguuuugauaugugguugguguaaaaugaucaaauucaggaaaaaaaaaaguucuuuugugagcacacaucuaacaucuucagugucaguagguuggccugucugucucugucugucuggucuuugucucucugucucucuaugacucucccucuuugacuaucucucuuggucucuaugacccugucucccugacucucucucugacugucucuuuuucuuuguguguguuuaaagguggggaaguguuuggugacugagauuuggggauguaugucuugcaaggcccacugugccuuucuucugcaguaagaugcuagcuaccugacuucuguccacuaguagaguggggaaauguuccugaagccucugauagcaagcugagggaaaccagucuuacuguuugaggcaucucaguucugcucaugcuuguauuauauucuuucuggugguguuuacaauauucuauuaagugacuuacacauuuugcaagaugucuuuuugcuguuugccuuuuuuaacuuaaagaaauuuaauuuaauuuaguaaguguuuaaaaguacuucuuuucuucucaauuuagauuguuuccagcuuuaagacuaccacauccagggccaucugucagcuugugaaggaguauauuggccacagggauggcaucugggaugucaguguuacaaggacacagccuauuguucuugggacagcaucugcuggugagccagacacugcugcagcuggcuuauuaagauaugacuuugacugauaacugauggaagugacuuucaguuggcaguagcacagcaguuccuggaaacaacggugugcuggaagaguuacuaaaacuaaagcuuuuggauccacuuggagcaagauaagccagauuccuaacacucaugguggaggcaggaggaccucaaguuguaggccagcauggccugcgauauaaaaucuugucacacugucucucaaauaacaagaugaagaggaaggaaggagaaaggaaaggaaaagcuuuuuucuuuuuuguuuuuguuuuuguuuuuuugagacaggguuucucuguguagcccuggcuguccuagaacauacucuguagaccaggcuggccucgaacucagaaauccgccugccucugccucccgagugcugggauuaaaggcuugcgccaccaugacuggcaaagcuuuuguuuugacuugggagcacccauuuuuuuuucugagaccuguagucuuccuuuguaacagucuuauggguggaugucacagccaaggcuggacuccuguuuuuugaggaaggggauacuuggcuuuagcuaaguauguauuaugugagguuaucaguauuuggaugguaggaacgacauggcgggauacuuuuuacacauuagaauuuuuguuguuguuguuuuuggauucuuuguuuuuucgagcccaaggugcuucugauuugggggcagguuuucugucaauuuucuuccaccacugaaagcauuguguaugcaacugaauaugcuuauucuccauccgguuguguugucagaggcguuugcucuucaugggucacaggucucaccaucagcacgauaguuuaugaaagcucagacuagucuaacuaacauacuaccucuucagauaaaauugcuaaaauuaaaauugaugguuggcuguugaaaauuacuuuuagcuugugagaaauuacuuucucacuagauucuggcuuuuaaaaguaaaagagcccaagaaaucuaguuagagaguuucuuuuccuguuugaaauuguucuuguacuuuaaacaucuuggaugguuuguaaguauuaguuuaaaacaaaagagggggugacuuuuauaauauuucugaaauuucauuuggauaacuggcaacuauuucuucucagaauuuucuuccccgccuuagugccugugcaaggauaaaguccaaaggaacugccauuacuucacacaauugagcugaauuuggaaacuaauugauuuugagaauuacaagauguucuggaaagcucuaaaacuuggauaaaauaguggaacugugauaugaauggcuucugugugccaguugcacacaugauggccuccguguaauggucuaguaggaaaccaagucccuuuguccuuuguccauuuccaguucuguggcuucaaagacaagccacagccucgugccuuucugguguuggagacuuuucuuaggucgggugaauuguacaaaguaguagaaucaaaguugcaggaacuauuugggggcuggagagaugacucagugguuaggaacacuggcuguuccuccagagguccagcacccacucagaagcacacagcugucuuuuaaguccagccccaauggauccagugcccucuucuguauuucaaggguacugcauacaaaggcauacaugcaggcaaaaugcccauccacauaaaauaaaaauaaaaauaacuauuaggagugcugugacuugccaauuuuagagcauuacuguauuucuuaagugacuauaauauuaaugauggcuaaguuauggcuucuucaucuuguagaucacacggcuuuguuguggagcauagagacuggcaaaugucuugucaaguacgcuggccaugugggcucagguaagcauugaccucagcgagcgcaggaaccgggagcugugccucaccuggcgcuugguuuacaaaugauuccuggcaguaaacuguagugauaggaaguuuuacauuugauguaagucaggguacaggguagucagagccuagaguaaagugcuuuacucuauaugaguaauaaagagaugaagcuuagugcuucagugugcugcauauuagucuaccuuguagagcuguguaauuauugaguauacacgauguguuagacauuaauccgugauccuuugcucaagcaagauaaaggaugcucccacugaucguuugacucuguaguuuagaacaucuuauaggagcucgcuuuggauaaccucuccaguuauaccuggguauuaauaguguucugaccaaauuuuacuucuguacuuuucuccuaaauguauguaaauuucuuccaccuagaaugucuuuacccagucuuugugcaaggcagcuuaccucuucacuuaccuccucugucagcuaccacuguucuuuagcuuugauagauaggcuugauauugggcacuuaggucuaugaacacacacacaugugugugucugugucugugugugugugugugugauuucuucuccauugugccuuugaugaucuuaauaauucauagaaaucaguaagacgaaagcuagaacauaacaugacuuuagugaugagacagucuuagggcaauaacuugugcuucucagcuacauggaugcugggagcuaaaccuggguucucuauacgaauagcucucgcucuuaaccacuuagccugguggccuccauuuucuuacagaaacuuuuugcuuuaagucucagcugaagaagaggguguuuaaagaucucccuuuugaaagagucuuuugguguuauguaagauccccacucauucuaguccugagguuuuguuucuuguuuuuaauccuuaaauuaauuuauacguauagaguggaagcuucugcuucagccagaccccagcauguuguucagcacagugauuuuccagugcagaaaaggguauagauggguagcccaagagcggacacaagugucugucuugagaccaucucuccucccauuggaguucagcuuaguucacaugcaucaccuuuagccugugcacagcugcgcccacucgugaauccuaauuuaauccagcaccuuccucaccagcugggugguggcucugugaugggggcucuaagucgcagaccccaacucuucauuuucuuuaacuuuucuugcugcuauuugucucuuuuguuucuuucuuacuagucuuuucuuccuuacuuuguacauacagugccuaaaauauauuauuaacuacuagggacuaaaaaauaugacaaagguuuuuagaacauauauuacauucuccaugucuuuuaaaaauauuuuaaaauauauuuauuuuauaauaaauaaauauuuauuuuuauuuuauguguauuguuuuugucugaaaauauaugcaccauaugugugccuggugccaaguaggucagaggaggguauuaaaucucuuggaacgcaaguuauagcagcuugcaagcagcuacauggaugcugggugcugagccaguguuuucuauaagaauagcaggagcucuaaccauuuagccaucucucuaaccccauucuccccaauuuacuuuuaaaauaaguuugccuuuuagcauuaugcuuauacuacauuauuuauauuucaguauugaaaguaaauagaaucugcucucuuuuuaacauaguuucuuaguaaaccaucauuuuaaaggcauagcuaauaaaauugcacugacauaauucuuugagguuugccagaauuuuuacaacauucugucuaagggauaagcauuuucuuugugaagcagagucaugaagguugguucuucucaacucccugguuagacgaauagugguuucaagucuauucuaaaaccugggguuugcuuuaggaaaguccuuaguagggagaugagccuagaaucuuuuuagugccugaugagucccaccgagcugggugugugcuuguuaacuugcugaccauucauuuauccauuaaggugauucaucugaauacaaggcaggcaggcaggcgggcaggcaggcgggcaggcaggcgggcgggcaggcagaggcugcugaggcucucuguguugccuuauguuuguuuauuaagaaaaugaacgcuuccucaggaaacauugccaaaacuuaccuuugaguauccugaagguggauaagaacaugagagaacagaauugaaucccuguucauucuugagucugguuaaaauucucuccugugguaccauuugcuguggacuagaucaggguucuguagaugggcaagacgcaggacgaggccaacaggcagugucuguacacuacaguuugcuuuugcuucuugucaaauaaccucauuuucuuuguuuauccugauuuauuuuaacucuaaauuacuuaaccuguguauaaaaguagauuaguaaucuuucuuguauauccuguaguuuuucaaguuaauucauauuuuaguuuuuuuauuauaccucuguucuaacuuauacauuaauucacaguuuaaucagaccagagagucuaaugcacuaucauaauuuuuaaauuuauaauuaacuuuguaaucuguacacuauaguaagaaauauuacauccuuacauaguuaaucuaucaguaucauauauuuguugucuuaaaccuguuuuuguaauauuuuuauuuugcaguaaauucuauaaaauuccaucccucagagcaguuggcucuuacugguauguagaaucuucuccuuuucuugaaugaaauuauuaauaaucuuaaaacagcuauaaauuuuauauucuuuuguuaguacuaucagaguuauucaugguacuuaugaaaguuagauauuuuauuaauuacuuuauuucuuuuuaagacauuuacuuaagcuucaguaacuuguauucauccuguuuaauacuggcuccagcagugggggcgcacgccuuuaaucucaguacuugggaggcagacgcagguggaguucugaguucgaggucagccuggucuuacagagugaauuccaggacagccagggcuacacagagaaacccugucucaaaaaaaaaaaaaaaaaaaaaaaaaaaacaaaccaaaccaaccagucagucagucaaacaagcaaauaaaaauauagcuucauuugcugcuuuuggaaaguagccuuuuguacugaggauuauuucuauaaaacugucagacagcuguggggccauguucugggauacagaugauagucuuggaggauauguguuggcuuugaugggccagagauugccauacuucugaaaaaccauuuaggaauauuaucuuugacagaccaugugacaccugucucugcuguguccugcuuugaagcaugaaaguaugucucuguagcaggugaagggacaugcuguucguucauaaaaacagggaugugccugugcuuuucccacgggccguauucugcuggcuuguagagucugccagcugagaugacacgguggguucucuguguagggagaaguauuagcgaaggagcccaccaucaauucuugaugugugcuggacagugauuacuuguuuuggucagaggcuuuucacaugugagaggauauaaugggaagguucucugaaucauuuuccccguccuaggugaucguaccccagacuuacuagagaucugaagagugaaaguggggaagacucugaagguuuagugugugauugguagagagagaagacgcuagaccaguggcaguuguaugugguuuuuuuuuuuuuuuuuugguuuuuugaggcaggguuucucuguguagcccuggcuguccuggaacucacuuuguagaccaggcuggccucgaacucagaaauccgccugccucugccuccugagugcugggauuaaaggcaugcgccaccacgcccggcuguauguguuuagauaucaaucaaaggcuuagaaaggagaggagaaaccaagugauaucuaaacaaggaacuaauaggaacuuugagacagcucaaggagaaaagaaaauuagacugccauucuuacauagugcaagucaggacgaucaguugauuuuggccauuacaaauugacuuugagcucaugguaacuucuuuagguaaguuuugcagcagugaagaggagguagaaagcugaccauguuugugaggggugaggguaacuguucuggagggagggggucuucagugcccuguauggcuguccuucuucuuucauuccuagucaaagcauuuucuugcaaacuucugcuucaggaauaggaaagcagcacaaauauguagcgcuaaaaggaacauaaagaaauaaugcuuauugucaaguccugcuaaugugaauggaugaaagcaucauucacuuucccugagacaucucagacucagugacagucauaaguggaaugcaaugcaauauuuauuacguagauuaaaaucucuuuacauaguuuuuaaucugcaacauuuuucucaaaggggaauauuuucuuuaguaauagcaauaauaauccuaauuuuguacguguauucuauuaauagccuuguacagucuaaaaucacuauuuaaauaaaguauauuuguuuuacuaaaugauguguaaguuagaaaagugugacuguuuggccacagauguaagaaagagcacauuuuaugcauggugugcccuguggauaaucuucccuauuugucucuuuagcuucuggagaucagacugcucauaucuggagauacgugguacagcuuccaacaccucagccuguugccgacacuaguguaagcauguuuagucacucugacaguucucugcuggucuauucauguaggacucuggauguuuucagauuguagaauaagcugaugguaucuggugugguccaauguggcuuaacugaccuacguuuugaaagauuaguguagaugugaacugugaauuuagucugccaccuuagcagacagauggggugaagaaaacagagcauagggugagauggaggaagucugucagagugcuggguucucuaagcaccaggaaaugaaacugccuggcuauaaccaugugucuucuuuuggauagaggaacaaggauccgaaaguguuuagugauaaggagauagucccuccugucugucauaguccugagauugguuuguccucauuuugaaagggcuggcgucuugguuuucaucuuccauaccuuucuguuuuauuuuccucuucuucucccucuuuguuucuuuguuucuuucuuuuuuuuugaaacaggauuucucuguguagcccuggcuguccuggaucucacucuguagaccaggcuggccucgaacucagaaauccaccugcuucugccucccaagugcugggauuaaaggcgugcgccaccacgcccggcuucuuuguuucuucuuaagaggcgugguuacuuuguagcccagcccaagcaggccuugaauuugcauucuuccccagccuccucagaacuaggauuaugagccugugcccaucugucuggccucgcuuugguuuggggagagggcaggaugcuacagcccaugccacagccagucauuggugaagauacugccuuaguggaucuaaaagguaaagaguggagcccaagagcauugcuguugagucuuagaucugauggaguuugcuuugcugggcuagggguuuguuuggaaccugcuguccucccauucuuuucuuuugcucuccugguguuauauuuuauauaacuauaucuuguuuguuuuuuguggacuauagauagauaugaauuuucccuaggcaugaauugugccuugauucucacacagaccucccaaucugaaugguauuguguuaagaauguacacuagacuuaguguuaauguuugaaugcauugcuauuuugggauagaauaaacauuuuucaguguaaaaaagcuccguaauuuggaggcacaggguuagaauguuauggaugaugucuuaguuacgguuucuauugcugugaagagacaccaugaccauggcaacccauauaaaucauuuaauuggggcuggcuuacaguuccagagguuuaguccauuaucgucauggugggaugcauggugggaugcauacuggagaaggagcucagaguucuacauuuuuuuuuaaagauuuacuuauuauauguaaguacacuguaguugucuucagacacaccacaagagggcaucagaucucauuauggaugauugugagccaucaugugguugcugggauuugaacccaugaccuucagaagagcagucggcacucuuaaccacugagucaucucuccagccugaguucuacaucuugauccacaggcagcaggaagugacuggcuucggcuucuaagaccucaaagcccacuuaccuccacaguggcacacuuccuccaacaaggccacaccuccuaauagugccaucccuacaggcaaagcauucaaacacaugagucuguggggugccauuccuauucaaaccacaauuggguauuugugucacuccaaaauuuguaugcuaaaguggcuuuaauuagaggcaauaucuuuaagaaaaaguaguucagguuaaaugaaaccauagugugggccuggucugauaaucuuaguguuguuaagacaccagagacccugcuuucuuuuccccccauuaugugaaaggccaacugguugccaggcaggaaaagaucuuaaucagaaagcaaacuuguugguaccuuugucauggacuucugcucucccaaauuaacuuaugucauuucaccuucuaaaacacgagguuuagucuuuuuugagcccuguuuuuuaauguggucucugcaguggaaaagauccugaauaaggcccaaaccauguacaugaucuuaacucuguguguugcuuaucugaggagcugaggagguagcuccaucugagguauuuuauuuuuuacuuauauauauauauauacauacacacauacauacacauuuguuuuucccccuuagugaaagcacuggggaacuguuaugcagcauccaagagagcuauccgcugaguuuuccuauggaucaccauugagaauaguuacgugggaagugcaagacaggcaggacagugugucaggugucacauacaauauucuuuguugaagcuauguucaguaccuagccaaagagauccuuguccacagagccauccagaacugugcagcaguccagguauagggcuguaagacuucucuggggcaggugugggagcugagaagccucaugauaaagaaccaggccugucugaagaguucuaccagaaacagcucagggcuccaguguuacugcaucguucccaacaggcauuuccggugauuguagcggcccuuccugucuugauauguuuauaugcugggagucauuauucucuugaccagcacagccugggaaugaagcucucaucucaugcagaagggaaccgguuuugccagccuuuaaccuuuucacaguuuuucaggcuccucauuuuuuagcuaguugagcuaaucuagcggcggcccauuauggcucccuuuucaugauucaccaugaguccucuuucuagaguaauggauaggcugauaugucaguggcucccuuggcuuuugagauagaguucuuucuuugcagggcuucucuuguccuccugcuguuugcuuuugaaacugcuucacuguuuaacucugaguggccuugaaauucugguagcccugccuccuccaaagugcaggguuauaggcaugaguuguuauaugcguggacuagagggucugauuuggucucccuuuguaaaccuuucuaggauuaguuuugauacucuuucugcacucuggcccauacugaucacagcuaugcuuagagcuuuccucugcuaggcuguaccuguuuuccccaagcuccccuuccuucgccugucacucaccuguggcuuccuagaagaguuacacuacccuguguacugucgugcacccugcagucuuagcagauguuagcguagucuggcaauuccuuguucugucaguagaguucuacuuccuguucuugauggguucugcagugcuucucuuuccucagaacagcucuaacaccagcacacguuugucgcagcgcccucccagaacuauuaccccacugacaccaacaucuuagcagugucugugaaaaugcacucuuuucccucccgagucccacuugucucgcuuaguguccccacaacucugcuuguccucaguccucgugcugccuucaugguugcucguccaguagacacugaagcugcuuuuggagacucuaacacacccuuucuuccuguuucuuccuucccucaaaucuugggugguucucggaugcucuacccgcuggugugugaguaugcugccuaacugcuguuuccuguacuagucuaguuggucucauucagcaucuaugacguuaaggaccagcuguugcugugggucucaauuugcauacugacuuuacucuuaacuccagacuucaguugucgucuaaucaauaccuugcugggauguccuggguuuuggguguacccuaaccuguugcucuuauccaguugcucaucucagcugugccgucaccagucacucaggaguuuggaccguagacuuuaaauugucuucaguguguguguuccauguguauauauaccugcugacaaauucugcagcuuuccugagggcagaagucagucuucuuacuacuacccacaccuagacuucucuuuccucuagggagauuucccugguuuuuccugcagcuaguggcuucagcaucaauuuguguuagcacagucuguagacuggaagucuaagaacaagguaccaaggguugcuuuauucuaaggccucuauccuugccuagcaggugguuacuuugucacugugcccucgaaugaucuuucuuuguaugugucucuauaguaauuguuuuuuacugcagugcaucagucaugguagacugggcccuacacucgacccaauuuuaauugccucuuaagggccuuuuuuuuuuuacuagggucacauucugaggucuugcaguuggggcuuuggcaugugcguguguggugggugacacaguucagugcauagcagccuccucucguuuuccuguguuuacuucagguaacgagucucugcucagaagugaggauuuuucuaccccaugcagaguagagcagaguccuuuccauggccucccagguuuuccauagcaccugcuacauugccccucacacaagcaagcccaguuauauagcagagaagaaagacuuucuauuuguuuucugcauggaaggauauuccuucaccaucugcauaccuuucuccuuucuuucuucuccauaaugggacucaguuguuguuagucuucaguaauucuguguaagacugcagcccuucggcuggcuguaucuccugcucccuuucuuauucucuucaaaguacucacccccaccugauugugugugcagcgcguuccauaccaugugagugcagaugacacggaugacauacuuucuuauggauuuuguucaugagauauaugcucagccuaguauguauacacaugacauucauucuuacguuccauaccaugugagugcagaugacacggaugacauacuuucuuguggauuuugcucaugagauauaugcucagccuaguauguauauacaugacauucauucuuacauuagccacuauguguauguuuugugaguauguguagugccucuguccuguaaggacaggagcuuugccaguuguauuuaugccggcuuuuuaucauuuagaguaagcaucaucuuaggcaugacagguguccucuaucuucucugccguauaaauagcaugacaguuuaaucaauauuuauugaaugaauaaacauuuucuugacgagcuggacuauagacugcuauuacauuuucauguuaucuggcuuuuaacaaaagauuuaauuaauacaggaaaaucaagugaucucucauuguuagaacaauggaauuguaaguuauuauaauuuagaaguuuuuuaaaaaguguuuuaaaugggcuccuaggaaucaaaaugcauuuuguauugugaaauauuacugacuuuuaauguauuuuuuaaauuucauacuguauuucuaauaagugguaaaaauagaaaauguugaaaauugcuuuauuugcuauuuuauugauuagugaaagugaauuuuaauucuuuuggugccauaguggcuuuagcauuuuucaggauauuauaacuaagacuuuuauagcuaagacuuaacauugagaaagcauuccuuaagcauuaguuacauaucugauacuaugcuuauauugacccuaaugcugacuaaauuuagaaagauaaaugguguagccuuuucagaaaaaaaaacuaaagaguccuauaaagucuuuuucucugauuuuuacccuuagcaacaaauuucuggugaagaugaaauagaaugcucugauaaagaugagccugacauugauggagacguguccagugacuguccuacuguccgagucccacugacaucucucaaaagccaccagggugugguuauugcugcugacuggcugguuggugggaaacaaguggugacagccucaugggacagaacugccaaccuguaugauguggagacaucugaacucguucauucccugacagguaucuugcugugaacaucggagauucugucuaguugggcuguuuuuaugugugaguuuauaaauuacuuccaggcuaggacccuuuagugcucuugacucugagguugccauucuuggugauccuuucugauugauuacuagaacucuuuauaguuaaaugcauuuuacccucaggaaauuaacuguagcauguaguauuucaauguuugaaguaugguuguuguacugguauucuguuucucuuugacaucccacccccacccccaaucacccauuuuaaauaaacuuaaauaacaggcaggagucucuuaccuggauguuuccuugucaggccuucuauggcagcgguggcugcuccucagcugugggugucuacuugguugaagugaaggugcagcguaggcaggcucucugggacuuggaguuguucuuccauguuuacugguuccugggaaaaacccauccagguucuuguacccauguggcuggggcuguauuuuaucuucaggagauuaacuguaacauguaguauuuccauauuugaagaaugauuguuuuguugguauucuguuucuccuugacaguccacccuccccccaucccccgccccuuuuaaaugaacuuaaauaacaggcaggagucuauuaauucuguuuccuaguuaggcuuucuaugucugugguggccgcuccuccgcugugggugucuacuuguaguggugaauuagguauguucugggcauccaggaggccuaggaaaggccccuuccccuagcaggaugcuggcuuccaggccagcaggagcaugccuuuguugcccuggcuccucuagcuucuggguggacuguggccuuuugaaugguucuagcuguuuagaccagccacugaggucagccuuucuuuugauuaacacaaaguugacugauuuagggaccuuaguuacauguguuauuuucuuuggucuaguagauauuccauuuauagacagauauauuuacagguuuugcccagaucuaagacaggauguucuaacggcccauaaaauuacaucauuagcaguuauucuuguugcagucagccuguuaguuugucuggcucucuagcuguuaagaccagaaauugaguuauaauguaucuaguuuccuacucuuuuauguagcuagcaagggacuucaggcaccugaggagauagccuuccacaccacuuaggcaguuccuuaaggguuacuuuuccaucugauauuuagcggugacugugaagaugaugguguuuuuauaaaagcuucccucucacugugugucugcagguggaugacccuguguuuuguuguauuugcuuguagggcaugaccaggaguuaacacauuguugcacucaccccacccagcggcucguggugaccuccucccgugacacaacuuuccgucucugggauuucagggacccuuccauccacuccgugaauguuuuccaaggacacacggagugaguuacaguucuuuagagaucuuaacuauguaugaaaaaaguuuuguagguugccauugaaacuuuaaucuuaauuucuaccauuugaaauuuaucucuuuuucauaaugcucgcucugucucuaaacauuuugguauguguuuccaaagguguagaagaccaaaagaaagcucugauagucuuucaggaaauggagugggauuaaaugugccaggggcuggggguggguggcucccucagggaagagucaggaagcaccucgggcaugcucagugggggcaucauaacccuuggugucuguuaaccggcccaguguaagcucuucacagcuuacucacaaguuaguguaauaugccuuuaaaguucauugauuagcaauuagguuaauuuagacuagcaaacaaaguauuggguuuaauaaugacauuuucauacccaugugucacacuuucucagauguuccccuuuccccaucuggcucccuugcuucucccagccugccuccauaugcuuuccucucaugcauaccccagcacucccucuguuucccaccuccuuuaugaucuccaucccagcccucucauggcucccggcacaaccguggauacaccgagaggagguuucuagaccugcgugugcacacacauguauacacggaucaucacucuaguauguguccuucucacuucugucagcaugaggcugccucaaccuacuucucccacaaacauauauucuuuggucuuuucaauaaacaaggagauuguuuaucuaucuccucaugacacagcuaagggaaugucugccagguuucucccuggaaaguuaugucuuccaguuuggagcuaauaaagugacucuuugagauauguggcuaucuuuuucccagcagccuuuaaucaagugagucuaacauugaugaucugugccagcuuauuacaagaggguugugcuagggucagguuucccauucugccauucucacccucacuggccagcauuucuggauaugcuugucauuuugauuguuaucguccuuuauugucauuuuaauuuggguuccuggugccacugaaccuucuacguguccccuggucucuagacauugcuguccuuuuccuaugguaggaugaugcccuaggcuggaaaauagcacugcaucugacucaguugguucugcuaccugcacuggagcaagcaaaaucuaucagagauuggagcugggccaagaagagaguuuuguuuucagagagcaagacaguuguacuguggguagaguagagcagauggaggucacagggagacuggcuaacuuguccuuaaccaugcuugcaaggacggaauagaaguuguggggaacuggugcaggcuagagcauuguauccagauaaagguacagacagagccagccaggauuuuauaaguucuuggugcgccuggccagauguagucagaauucacagguuggauuugagguugccaggucuuggcagguaucaucuucauucaagagaaaguaagccaugagaagccacgaggcugccuggcuucagugaaguuuaauucuaagggggugauauaggucaguuucuccugcuguuuucaacuugccuugugguggugaauuuuaaagacuuaaaauucauacucuaguuauuugaaacauuuuuauuuguuucaugcuuugagaggagaauauauuugcauuauugguaacugauggagguguguguuacagcuuuuaaggucuugcuauuacaugaaauagcuguuuuagcaauaugaggaccaugacugguugugagacaccccuccccccaacuaccuuuuuuugagucaaggucuuaacaauguaguuguugucuagaaacucacuauauagacuggauuaaccuggaacuccuccuguacugguuaaaggcauacgcuaccacaucuggccuaaggaacauacauaucuaucuaucuaucuaucuaucuaucuaucuaucuaucuaucuaucuaucuaucuaucuaucuaucuauccguccauccauccauccauccauccauccauccauccauccauccauaaccuuuuaucaauucucugugaguuucccaucaugcaccccaaucccacuugucucuccaucccuugauauuugcccuccacccuugcaacccccuaaaaaaagaaaagaaaccaaaccaaaacauaaaaaugaaaucuugucauggaagcuauagugugacccacaguguacucuuuuguccacacaccuguacuugcaaacguuaaguacaaugagucauuggucuguuuugaggccucuggcuucugcuacacucucaauaccagauccucacuaggacugcucucaaauauccuguuguuucccugugucauggagaucuugcagcuuugaaucuguaggacugacuucuucacacauucaguuguuuguagaugagauggguguuggggcaagucaacucaaagcucuggaucugggccggggugguggcuaaguuggucuccuucacccauaccaccagguuaaacuuuccagcccugccuugggcuagcucacccaaugccacaguuggcaagagcccccuaccccaggcacacaccuugagacaggaucucuuuacauagcucugguuguccuggaacucacuuuguagauuagucugaacucaagugcaaagaucucucucuuacugagugugucugaguuuuaaaauagggaaugagaguaggcuuagaauaaauguaucgaauucacaugagccuucucucccacccagcuuuucugacauguaggauaguaguuagauugccuuuaaccacaggauaagugaaaguuuucaugagaggaaaauacaggaaucaggcuacucuaaccuagauuauuuaguuuuuucucuuuucuuucuugauuagucaugcguuagcauaccacauugauguguauaucuaaaaagcaucaaaaugguuuuucuuugguacuaauuuccuugcuuuaucagaaaggauaaauuuacaauuuuuaaggccuuucuggauugacaggaguuggcuggauucuuuugcuucuaaauuuuguguacuuggcucaguggucaagagccuuggccgcucuaugagcacacaggucugauuuuuaguaccuauauauuagcucacaacagucuauacucuagaucuaggggauccaaagcccucuucuggccuccucaguacaaggcacacaagugauggacagacaugcacacaggaaaaacacccauacacauaaaauuaaaagaaaaagauguuuaaaaaaaaaaaaaaagaguagcugaguuuaaaaaguacccucuggccuuucucauguagguuuaggacuuggucagcagauggggcuguagauaucuuuauugaacacaaaauauuucuaguaaugauuaguaagcuuuuagaaauguuucacauuuagaaaaacaggaaaugagacaguucacgugguuuuaccugaggagucgucauagugacuguugacuuucaucuuugucauggauuccggaagcuugagccuauacaaccaaauggcagguaguaaaugcauguagaugugcaucucugauccauaaagggcaugcuuuuauuaaaagcaaacucgauuuaacucuucauuaagaacagaagaacggccagggucugccguguggguccucuuucaucauuuagucugcuguucugaacaugaucuaagaaacugagcccuggccuuccugcuucaucacucugguguguucacagagcucugcaggcuuugcaggcccuucugcagugggcuguaacauuccccaaggcucuguuuuggaagauccucugaguacaugguaaggggcuuuucacagugcagucuucuagucuaacaaagaugauuuucuggagucuuuucauuaaguucaaaagucagauucuuaucucuuauguuugcuguucuuacugguguagcucuaaaaaguuggcuguaagaagguuguuuagugagucuuuguuuagagagacaguauuucuacagaagccuuucuugcauauuucauauuaacaugauaugcaacucuuuugaaaauuguauuuaagguauguucuuuugggaauucagcauaaauucuuuuaguuaaagaaccagugccuuuaaugugaacaguuaacaauuguccaguuaaucugaauuucuguauauuggauuuucuuaaggcaagguauaguuauauaagcaucaagauugucagcucaauuuugagauccaauuucucaaggaauugagagagguuuuuuuuuucuuuucauuuucucuuucuguuaucucucuauggcuuggcugccuuuuugaaaaacuagggguuugagauauaaugcuucacuguaagauaaaaacuguagccaaauggucccuugagauuugcucugucauuaugcuugcuggguacagacagagcuccuugaugucagcuguguucaaggcuuuuacuuuuauaacauguuuuugauguguugcauugaauuucauccuguaucucuucauuauaauaggaaaucuaccauuguaguauuuauugaauguaaagauguauuugcuauuggaucagucuuuaguagcucuguguaucccgguuuaucuaaagagucauuuuaguuacucuguauagcauuguuuuacuagucacagcaaugcaaagcugauccuugcuuugggaaaauagaugauugcuuuggaaaauuuggacuuucagcuaguggcugaaauaauuguuuucccugaauuucuaucugaaaaucaagagcuggcaugaaaauucagugcuuuucuucuaaauuugcccauuuguauaauaauuuaguuuuuacccaguaguauaauuuaguagcccaaguauguacuucccaagccaguguuuccccucuucauccugcacccccuucuuaagcuggucuccccagaucaagaagaucuugaacuauauguaguguggaugauucaugcaugugucaggaucucuuacaguuauggagguuguuagguuaaacccacuuacuguucuuugaaauagcugacuaucugauuucuuacaaauaauccgaggccccagcuccaggcucagauucauccucuugguaccauugucuuguuuacaugcuuggcauuuuuccuuuccucuccgcuaucccgauuccucauguucugaaccuccccuccccccucuccucccucccccucccuuuguuuuguuucaaugaguaugagaaggaauugacaguugaggcagucacuggucauuaaacuuccuccauggguggccaaugacuaguuuauacccgacugacaguuuguuuacaagugugaauaaacuuuggcauugagaacagucugaaauuagcucagcauggaugaguauuugagaacagaagguuuuuuguuucuuuuuggcguuuucuuauacacaacugugguuuuauuuucagugugagcuuuggcgauuucuucuaaggaaacugaacugcaucuaacaaaacaaaaauuaucuuaaaaucauaaugauuauuuugagguuaugaaauuuuuguaugccuuuauuggcaaguaucugguaggugggagguaguuacuacuaaauacuuaauucuagauagacucagcaauguagaaguagcuuguauuauagcaacagguuccuuuccuuuccuuuccuuuccuuuccuuuccuuuccuuuccuuuccuuuccuuuccuuuccuuuccuuuucuuuucuuuuuuuuccucucacgcuuuuaagaaggcauauuuggaaaaugacauuuuuaccuagauggcaguccauuuuaauuagaacuguauuuuguucuuugucagaaucagcauguuugaguaaagcaagggagauauggauacccugaugaaugcugcuaauuuaaugucauucccccauuaaauggacuggugcauuuugaguuuugaauaucugcuuugucuucuguuuuggcuuuucugaagucaguugugguuuuuuauguuaaugucuguggugauuugaguaggaauagcuaccuuaggcucauauuugaaugcuuagucaucagggaguggcacugccugagagggauuaggagguguggccuugcuggaggaagugugucacugggggugggcuuugagguuucaaaagccuaagccagaucccaugucaucucccuucugcucucuguggauccggauguaggaauugucugcuacuucuucagcaucaugucugcuugugugcugccaugcuucccaccaugcugauaacagaccaugcugauaaccuuugaauuguaagccagucucaauuaaauguuuuccuuuggucauggugccaguggaucagugucuaaaacaaugucuaaugauacuuuuuuuuuucaguccucauuuucuccauuuacugcuccuuauauguauacuaaaagcaauaaauguguguguguguguguguguguguaucagggugaagaaauauuguugaucaaacucuggcccucguaugguagggaaacauucugccacugaacuguuucccuggcugcuccuaacacuuuuaagguaguguccuaguuaggguuuccauugccgugaagaaacaccauaaccaagguaauucuuacaaaggcaaccauuuaauugaggcuggcuuacagauucaguggcuuagucccacucucaucauagcaggaaacauggcgguguccaggcaaacaugguucuggagaaggagcugagaguuuugcaccuuggucugaaggcaaucaggagagacuccuucugcaggcaaccaggaagaggcuuucuucuguacuggguggagcuugagcauaggaccucaaagcccacccugacaaaaccacaccucccaauagugcuaguucccaggccaagcauauucaaacaaccacaaaugacauaucaacauaugucaauucugaguaacagcuuaagguacauuccuauaaagcaaggacuugaauguaugggugguaaguacucccuuuuguguuauaaaaugggccaagagcauauaguuuuaugcugcugcuuagucuagagagcacugagauacaugaguacuggugcuuaaucuagaaagcacugagauagaugaguacuguugcuuagucuagagagcacagagaugaguacuguugcuuagucuagagggcacaagcagagugcuguucuagaccuguggguugacauuucuacaguaggucuacuucccuuuguaaaaugauaaagaugauaugcuuuucuucugcuuaguuaauaacuccaaagggcugucacugugucugcaguguugaggcccuaagguaaaacuuuguauguauucagaguaguaaguauaaacgguuucaaaggagucguauaauuugguucauaauaaaaaugucauuugccugauuuugaagggaagcugcuuuaucuuguaggguguuagaauuguagcuuuucaaguaacauuuacuguggagaagguguuuuaaaaguaagguauauauuuguguugguauauaucuuuuccaagaagaagcugaugugaaacaugucacauguuacacagcugugaaaucucacuaggaaaaacaccggucuuuguugaaugguauagguacgaauugacauuuuaaaagaaagagacaaaguuaauuuuuucagugugaagugaguaguuacuggcagugaggcgggaagugaggcuggaggccagcugccagcauggcugucgggggcuggcaggcgggcugcauccuugucccaggcuagugacuugaccugcuccuuuggggccgggguuaggcaugggcgucugagagguuugaugaagaguguagagaggacgcuaaagguuuguuuucagauugaggacuaugggaaaugccagagagcugagacuugguagaccagagggaggcaucaugauggccuuguuccugucaggcagaggcagaugguaaucagaaucuggugauuggauggucucuguggcuuuugguucuggaaguuggauguggaagucucuucagguaaaggugaagggaagaaagaaguaggcgucugcggcuggggagcguggggcaugugcagguguggcaugugcaggucacggggccugaggcccauuggcgaggccggcguggggugcagagcugcugaacuaggugugggucccaggggaacguacagucagccaggccggggccauugaggaagaauacagaucuguagcuaacugcgagucuacuagaauguagucuggacucuagaacuuuuuagggagaaaccagugggacugugacugccauucccuaccagucagcagugcugggccccuugaaggccuauguaacgcagaggauggcaugguggcuaucuuuagcaaguugauuggccuagaggugucacuuaugugauaucugagccuuagcuuaagaguauguguuaaccucagcuugaugaauaugaguaguagcuuucccaucgcagagcuucagucagcucccuucccugucccuguggcagcuacaucugaaggugggugguggauggacacgcauugcuuuucuagguuggagagcaguucuagaaauuucuuccagcagucuguuguauggucgcacuggggcugauugccuaugguggaacugucaugauugaaaaggauggaggguuuugaugucuguagagugguugccucucaaguauuagccguccagcaaccagaaguagacagggagaauuucccaggugcuggaaaguacucagcuguuuucuuggcuugcucucuuuaaagaauuccuauauguuacagaguugugauaauaacucauucugaacuuuuuuugugggcuuguacuuuugaaacagucucacuuguauguagccuaggcugaacuguacuuaauuauguaucacagucuagcuucaaacuuuugguaacccucuugccccaucuuuugaauuaugggacaaacugccaugccuaauuucauucugaacuuuaaaaaugucccuuuaaaagugacauuuuauuuuccaucuuucuuccuugccuaagcauagaacucauucauggguccuucuugacaccaucuuguuauucucuuagccuucucagugagaggcagagucaaauaaguguaccuugcuuuaggguauuccuacaaauuuguugguagcaucuauuucugucugugggaaguuguaauaacuguucuauacauacauaguaugcauucauauagauagacacauuguacucuaccaccucugagagguuucucaccgugucuggagcuuauuucuuccuguggcucaagauguagcuagcugcuuucagcucacacagcauacucaguauuggauggguagaaauaaccccucaaguugggauucauuuuggucagcuuccuuguuugggggaugagggccuuucucaggcccuggaacagccacugcugacccaggacugggugccaguacccaccuggcccacucugcugugcggugccacuagcgacuucuguuuauucaagcaggagugauuuuuguuuuugucguuugagguuuuugcuaaucuauuaauauuuaagaguaaagaaacuuacaguauacuguaguggcuucacuuucucucuuucuaaugaauaaaucuugucugcacuacauuaagaugcuuauuuuguguccugugcauguguauaugugugagcacgagagggcgcucccaugugucagaggucaccuugacagucaguucuccuuccaccauuggguucuggggauaggcuugguggcaagugccuuuucaauuuccagccaucgcaucugccaaagcauuauauuaggcuaaaaguuguuauaaaauguaauuuauaauacuucaacaaauagaaccucaaaauuuuuauauauaaaaaugaauuuauaauaucugcuuuugagauguuggucacuguuaauugacagucaguaucuuggguccagaaaauaaguggaaaguuaaauaguuaaaaaccaagggaggccacuucucaccaaguucaaacaauacauuuauugccacuuucuuuaaaauuaccaauauaauuacaaauauucuaaauuacuuuaaaaaaagagauuuauuuauuuauuuuuauuuaugaaaacacuguugcugucuucaaacacaccagaaaagggcaccagaucccguuacagaugguugugagccaccgugugguugcuggguauugaacucauaacuccuagaagagcagccagugcucuuagcugcugaaccaucucaccagcccucuaaacuacuuuagaauaaaauaaaacacucuauacaauguuuuuuaagucagaaagaccagauuucaagaaacacuggauugccccuugauauuggaagaaugccauuauaguaugauuuuuuuuuuaccccccugaggucacuuuucacuaaguuuaaacaauguauuuguugcuaauuucuuuaaaguuaucaauauaauuaaaaauauucuaaacucaaaauguuuuuaagucagaaagacaagauuucaagaaggcaaauaaguguugacauuugguguugcacaaauaauauuauuguaugaagccuuuggcuuuuugugacaguuucucuguguaguccuggcuguccuggaacucacucuguagaccaggcuggccuccaacuccuagauuuaucugccuccacuuccugagugcugggauuaaaggugugcgccaccacugccuggcuuauuguaugaagcuuaguauuuuaacugcuuaguaauaauuuaaaauagaucuguguucuuaaacugauguuugugagcuaucaguuguguucugggaaccgagucuggguccucugcaagagcaacaaguucucuuaacugcugagccaucucuccagcuccauguacauuucuuuuaaaauaauuuugaaauuaugauauaauuaaaauauaucauuuccccuucuuuuuccaccaaaucuucuuagguacccuucuuuguucuucaaauucaugaccucucuauuuauuuauuuauuuuuaaagauuuauuuauuauuacauguaaauacacugucgcugucuuaaggcacacuagaagagggcaucagauaucauuacggaugguugugagccaccaugugguugcuuggauuugaacucagaaccuucgaaagagcagucagugcucuuaaccgcugagccaucucaccagccccccccuuuuaauuaauuguuauauguacauauuuuacauccacaaaacaacucccaaaagauguuaaggggauuagggaauuugcuaugagauguucuccuaauagugucagaagcuauaagucucaucaacauggccgccuaaacacgagcugaacaagggcagcagcagacgugcuaaaguggacagaggaaaaaccucaucccuuugacagauggauuaugugugcgggaacacagaagccugucugcugauagggaguguccuguacaauuguguuuccacguagggacugcguacugucuguaaccaccggaucuccugcuccacagauacagaaggguucuuuuguaggaacuuacauuuaagaaaaaggguggggggacgggauggcaaccugguaguuggcuuuugagaagaugccagagaagcacagugcauuagcauuucaugguccagcauuuuccacaucauauauuuuuuuuuuucuuagcugugaaauuucagcagauuguuaugcaaaacaguuuugugucucugugugacugggaagacagcuguuaguccuaaugaggagugcuagcauuacaguauuuccguugauugagacccacggagggagcagaauguuccagaucaggcaguggugugcggugagaagguaccauacugucagcuggaaguacaugcucggcugcuccccacgacaagauaaaugaguuuugcuggaguuuggcagagucggaagcuuuuccagugagugguuguaguucacuagccucccugugggacccaugguccaagggugccuuuaaaacuacugccucuuugccagguuuuucuuuugauguccuacaauaccugucaggauugugauuuauuaagaaccuaaugucuucuagcauuucauuaacauagggucagaugaucuuuuguuggggcuuuuuucucuuuguauuaauugagcaagaugcuagcugaaauuuaacuuggccaaaaccuccuagaauauacugcaaacaguagucaguggaugucuuuaccugaugcuuuucaaaucucuggcaguauaaaaagauuuuuaaauguuccuguaaccuuugcuacacuucauuuaaagucaggcccuaugcuguuauuuauuuaaguaaagaaucuauggggcuggagagauccucuuccaggggcagacuucaguucccagcacgcacauggccgcucacagcugacuguaauacuaguucuaggagguaugauacccucacacagacauacacacagacaaaacaccaaugcauauaaaauaaaauuaaucaucagaugauacagagaggucaaucaugauuuacagguuugucuauaugucuguuucucccgguaucauauauuucuguguauuauguguuguuuaugccccauccagacauagugcaguguuucuaacgcaggugguuuugcaagucauugauugucacauguagggaggagguacccacuggccucagaugaguggaaggaggaaagcugcuguacuucucaguguccagcauacccaccgucagacgguaauuccauccagugccaguucuaguugaguaauuggcacgggcaaaauuauguugcugaugccagugccauggcaaagcuugucuugcauaaggcaagguguacuaaugugaaaauaguuuugcaaacccaguguuuguccugguuguguucuggggccucagugguguacuguagguuuuuugucaggucuuguugaaaaccuuuugguucuuaguagcuacacugguggugguguuuaaaauccuugauuaauguaguagaacuuaagacuuaauuagaacuuagcugugccuauucaaauuaauagaguuuucauaaauuggaccuagugacugauuggauuccuauaaugagccuaaauagaacaugaaaucacaucuugguacagguugugggacaggaccaaguaucauuuaaauuggaauaucugaguuccaaguaguuaauguguaaauguaggauacagaaacaaagcuuuuuuuuuuuugcaaauuaaugauuuaugggaauaaaaagacaucauaacuaagcuuaccugauugucaucuuguaagguaacaugugaguggugagccuucacauggaagggauggccauggguuuuguaucagugggagacagcuguagaggcgaggauagagucuugagagacuccugcauuggcaucuuugaaucugcuaauuugggcguuuggaaucagguaguguugugcuuuguguaccaauccuggggagauuagauauuaaaacauuaaccaacauacauagccacauuguaccaggcaggaagcaagaccugcaaaguccuacugcagagaugcaugguaagauggagacucaccuacaugaagucaaaacaguagcauucccuggaaguauuccuacaugaugugccaggucacauuuuaaaggauggacuaucagcccuuaauuccugggaagugggcuuguaucauaagucucuuacagaacuuuccagugaagagaggugauuguguugagguguuuauccuucagguaccauuuuaucauuuuaguccuuucuccacaagugguuggugacuuugguuugaaaggaagggcugcaucacacauaaacccagcaggccaugaccacuucucaccgagaugacuuuccuagugacugguggaggugguggugugugcacacucuuuaggcugcaggucaacauucuaguaucuuugucacucaauugcucuucaccuuaguuuuugagaccaauucuuucacuggaucuggaguucacagauuucagaagacuugguggcuagcauuccaggaauccuccagucucugcccucucaggccuaggauuacacgcugccaugccuggcuuuuuagaugggaucuggggacugaacuugggaccuagugcuuguguggcaaauauuuuacugacagagcuaucucauggguguaucuuaaugucaguugaacuuugccacuugugaauuacccaguguuucccauaacucguguguuuugauugaauuggaaguuauaguuugaguagauuuaauuauuuaauucaucccaccagacauuugccaggcuguuuaaucuauauuuuucuaguaaugucuugcugggcugucgaggaugauaggacagaguagacagugcauucuccuccucuguuggcacguaaagccggggucuuuauuuaacauauuuacaaggagaguuuaagaaauagacacaggcuugcagaguagaggacacuguaaacuugcacauccccaaucuccuugcccucuguugcucccucuggaugcaaaacuuugugcgcugugggagggcguuugguacauccugaacucuaacuacugaugugucuaaccuuuaccuguagcacugugaccucugcuguguucacugugggagacaacgucguuucaggcagugaugaccgcacaguaaaagucugggauuuaaaaaauaugagaucuccaauugcgacaauucguacagacucugccauuaauagguaaggguugauuguaauuucuugucuuguuugggcauacagcuuuugggaagagaguucaaccuccuggggaaauauauuuuauucucuucuuaugugauuucaguaucuguaacuacuuaaacuuacucaguguguaguauggcaguguagaaagacaagagucggaaaagaccuuugguagccagauguuuuagggcuuuguuaacugagaggcucugugugcuauuggaccaugugacuguauuguacgcguguguggagucacuugugaucuggcaguuaagugugccaugagcuuuuguccagugucauaggcagacuucccaugugguuuacucacuuaguuugucuugaaaugaauuauuuucuguaaauucaaaauacuacacugucaguuuuauacaaacuuguuucuuugucuuuuuuguaggaucaauguguguguuggccaaaaaaucauagcccucccccaugacaaccggcaagugcgauuguuugauaugucgggagugaggcuagcacggcuuccccggagcagccgacagguauuguguucguuaugaacagcaaaggagaauuuguaguaucaguagugccucagagaaauacaaacagaccacauuaaacuauuuagaagacauaaaaauuuaacuuuagcaaguguuucaugagaugaugagcuagucauagauuggugggaaguccuggagaugggauaccuaccucuaccuccgaccagagaaacaucuuccuauggugggguaucaccagaaauagaaacuguuuuccguauaaguuagggaauuauuccuugcuaccaucagacgugagauacaggaguuugguggaugcuuuugccuguuguguucaucucauccccuagugccugcauucacggcuccaguuuagcccagcaggaucagaauguauccaaggaacaccuaguccuggugccuuaaagcaggcccuuggaugacuucuugaugcucugugaagugggggcuggggccucagcuuauacuauguggguuaggggcuggggccucaccuuguaguaugugaguugauaaguaguggaggcagaguucuuuuggcuguguguuuaacugagaucccaaagcacaguaucuuaguuggggguuaccauuguugugaugaaacacuaagaccaaaccaacuuggggaggaaagguuuuauuuggcuuguauuccauaucacuguucaucauggaagcaagucaggacaggaauucaagcaggacaggaaccuaggggcaggagcugauguagaggccaugaaggggugcugccuccuggcuugcuccucagggcuugcucagcucagguuucuuacagaaccuaggacuagcagcccaggggugaaaccacccaaaccaugcuggacuacuucagcucaaucacuaugaaagacaacuagcugugucuuauggagacauuuucucagaucaaucgguuuccuucuuucagaugacucuugucaaguguuaugucaaguugacauaaacuagccaggacacuagucauucugcucuuuuucccuuuggcucuuaaugccacuguaaggucugaugagucagccaguauggucuguuaguggaucuguucccuggucccuccagcucacuugucuguuugcacauacacgcauccuuugagcauugcuugcauaccuuacaccauucaucuguugcugucuguuggcuguauuucuuuugauuccuccauguugauaugacucccacuucaucgcguaauacuucagaguacaguucacaagccagcucuggaccaguguguccugcaaacccugaacacuaggaugaguuuggagagcaguguguagagugccgauggugggguagcucucucuggauggcacacuaguuccaagcauggcaguccuuccagcagcggugucucagccacucugucaccagucacaacaguacgcugccuacguuaaugugaucuuuugguucuuugagcacacacuguagggagaugcucaucaaagaagagugaaaacauuucauuuuccuacaaggucacaaagugccugcccaccaaaagguuuuucuuuuuuuggggauuguuugauuuaauuauuuuaauuauuuauaucccaaaucuuguccccccucccagaguucuuuaccucaucuccucucuccuuugccucugagaggguacccauccccccacccccggcuagaaucucccuuuccugggacaucaagggacauccucuacaggauuaggcacauucucucccacugaggccagacaaagcaguucucugcugcauaugugccuggggccucagaccaacccauucaugcucuuugguugguggcuuagucuccuggacucccagggguccagguuaguuggcacuguuggucuuccuaugggguugccauccucuucagcuccuucaauccuuccccuaacucuuccauuggggucccugaccacaguccgaaguuuggcuguaaguaucugccucagucucagucagcugcugguagauccucuuaggacagucauguuaagcuccugucugcaagcacagcauggcaucagcaauaguguugggguuuggugccugcccaugggauagaucccaaguugggcuggucacugguuggccauuucuucagucucuguuccauuuuugucccugcauuucuuuuagacaggaacaguucuuuuagacaggaacaguucuuagucagauauuuugaagguagguggguagccccaucuugcuacuggggacccuguuucacuacuggagguggucucuucagguucuguuuccucacuguuaggcauuuuggguaagguccuaggagccucucauauaccaggucucugggauuuucuagagguucccccauacucccugucccccaccacugacagcugcacauuucuauucauucuccuagcccucucagcuucuguguugucuucccccauacaugauccugccccccuucuccccuaucccuucccucucccaccgaagucccucccuucugccucccaugauuauuuuguuccgccuucuaagugggauuuaaguacuucuuguuuaacuucuuagggucuguggggaguauucugcacuuuuuaguuaauaccuacuuaucaaugaguacauaccauaccaugcauguccuuuugggucuaggcuaccucacucuggaugagugccugcaaauuucauguuguccucauuuuuaauagcugaauaguauuguauuguguaaaugaaccacauuuucuguauccauuauuugauugagggacaucuggguugcuuucaguuuauggcuauuacaaguaaggcugcuaugaaaaucgugguuugugguaugguggagcaucuuugcgguauacgcccaagagugguauaccaggucuucagguagaacucuuuccuuuucugaggaacuguuagauggauuuccagagugguuguacaaguuugcaauccuaccagcaauggaggaguguuccucuuucuccacauccucuccaacuucugcuguuucuugaguuuuugaucuuagccauucugugauugaugugagguggaaucuuagggucguuuugauuuguauuucccugauaacuaaguauguuauacauuucuuuaagugcuucucugccauucaagauuccucuguugugaauucucuguuuaguucuguaccucacuuuuuaauucauuuauuuggguuuuugaagucuaacuuacugaguucuucauauauuuugaauauuagccuucuguuggauauaagguuagugaagaucuuuucccaaucuguagguuguuguuuuguaaucuuagccaaaaucaggguaagacaagguugcccacuuucccuaucuaaucaaauacaucuuccuauauuugaaguucuagcuagagcaauaagacaacagaaggauaucaaagggauacaaauuagaaagaagaagucaagcuaucacuauuuguagaugauaugauaauauacuuaagcaacccccaaaauucugccagagaauuccuauauaaacaacuuuagcaaaguggcuggauauaaaauuaaaucaaacaaaucaguagccuuccuuauacaaauaauaaaucggcugagaaagaaauuagagaaaugacacccuucacaauugccagaaauucuauaaaauaucuugguguaacacuaaucaagcaagugaaagaucuguaugacaagaacuucaagucccuguagaaagaaauugaagaccucagaagauggaaagaucuccugugcucauggaucgguaggauuaacauagugaaaauggccaucuaaccaaaagcaaucuacagauucaaugcaauccccaucagaauuccaauauaagucuuuuuuuuuuuuucgguuuuuuuuuuccuguuuuuuuuuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccauccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaugacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaguuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugagagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacguguauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagguauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuauguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcuaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagugauuggauugggguaggcgcuguguuccacucaccagaggucuuagggucccguggggagucccgugugggcccuugcggguguugggcaagacucugcugucaagguagcccggggcucgagucucgagucgagcggaagggacuugugccccagaucaggcccggguagccugcuucccuauguacagcagucucaaguuccgcgcgauuggauuggggcaggcacugugauccacucaccagagucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauugaauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauugaauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugguccacucaccagaggucuuagggucccguggggagucccguguggacccuugcggguguugggcaagacucugcuggcaagguagcccggggcucgagucucgagucgagcggaagggcuuuuccuguuuuuuugagacaggguuucucuguguagcccagugucaaaacucuuaucuguagaccaggcugaccucgaacucagaaaucugucugccacugccucccaagugcugggauuaaaggcgugcaccaccacugcccaguuccaauacaagucuuaacagacacggaaagaccaauucucaauuuucauguggaaaagcaaaaaacccaggauagugaaaacaauucuuaacaauaaaaagauccucugggaucacuaucucugaccucaagcaguacuacagagcaauugugauuaccaaaaccccacaugguauugguacagagacagccagguagaucaaugcaauugaauugaagacccagaaauaaaaccauaaaccaaggacauuuggaucuuugacaaagaagccaaaacaguacaaggaaaaaagaaaguaucuucaacaaauggugcuggucuaacuggcagucugcauguagaaggaugcaaauugaucuauauuuaucacccugcacaaagcucaauucugcuuggaucaaggaccucaacauaaaaccagauauacuaaauccaauagaagagaaaguaggaaauagcuucaaaccaaaguuuuaaucauacauucagcacgguggacuauucauguguguccuagaauuccuauugcuauauaaagaaugccuuugugaugagacugaugacaguguguguuacuucauuauucugaugauuuuuuuuccucaagaaaguaaggucuucuaaguugaucuuagugguccuaguucuauguagaaaauuccauguagaauuaucuguaaaauauucagguuugcuggaauuagagaaacuuuuuuuuuuggcuuggguuuauucuuucuuauaacaauaugugaaauagguuucuuuuaagacuaaugaguaacauaacuucauuuuagaccuguaauacuucuucaaauaaguguaauuuuaguauaauagccuuacagcuagacagugcuggcauccucuuguagcugcuuucaccugacuaguuuuaaaaacagaaaaccaaaaugagcuuguaugggaagcuuguuuucuuuacuacuggguuucaaaccuggaguucucacuuuugcuaaguuuuuguucuaccacuagucacaguguuguauuaaguugccuggacuggcaucaacuuggacccuccucccugagcccgcuaaaguagcuauacaggugugcaugccacauguccaguugaaaggacagcaacuuuaaaauauuuuauuuuggggauaguguaggaugcaugcuaugaggacuguuaagagcugcagggucaaaaggcccugagguccagugcuuucugaucuauagguuugcagauaugaugggaucccuguggcuuguaaugaaaggaugccuguugugacuauccacaguagugcugagugcucagcucuguguuaggggaccauccccuucucuggguacuugaugcucugaccacaugaugugccgacauuccccuuuccucuucagucagucuugccaaacaaguguggcucucagcgccucccuugguagcucuuagccaaauggccauuuccuuuuacccauuuguccaguaccuauuuucaguauucugugaaaauacucuccacuuaucuuuuaaguaguucuguacuaaggcauggcuuuauugccaacuaauggauguagaugugauuucuuccaaaaaugaaaacaaacucuuagcaaauaaucaaugaaagacaccuucauaauagaccugucacacagauuuuuuuuuuuaauaguuagguuuuugcagcaugguugaguucccuguauguauaaacauuauuuauauugaauguuuuuacaguagaacaucuuauccugcccuugcuaaguaguucuuuuacuugauaaauaccugucauuuucacucaauucuuaugcuuuauuguauaauaaccguagcauauuagagcuauuguauuaauuuauggguaauuccugauguguaguguauagacauucuaaguguuaggcauuauuuaacugcucaaauauuugugucuacacaguguaucacacuguaaguuuuguaaacuauuuuguaguaauuucuuucaacauuuugauauuuaauuagaaauuuugaggguuaaaucauuucuuauuuuuguuucaucuuuuaacacauauauauuuagguuuuuuuuauuauuauuggaaguauuuacuaaaugauauuugaagucuuugaguaaauuugguuuugugucugaaaaugugucuucuggcuucauuuguucauuuaaaaauuucaaagugaucaucuuuguguguaugacuacaagcuuauucaucuucucagaagacuagucaugacuuuugguaugcgcucccccauucacucccccauuccagugguacacagugcucuacuagcuuggcucugaaagccuuuuacccuguguaguaggugucagcucccuugagucacaggugcuuacauuacauuauucauuuaaggaauguagcuaucauggugcaaguguuaaauuuuguuucagaaauaaugcauuaauuuuguuuuguguguuccuuccuagggucacagacgaauggugugcugcucagcguggagugaagaccaccccauaugcaaucuauuuaccuguggguucgauaggcaagcuauuggguggaacaucaauauuccugcacuguuacaagaaaaauaagucacugauguuccuuagcuccaaguuugccauggacuuuugauucaugcaggcucuucugcauauuaaucagccauuauagugagaguuugacccugggaagggugccuuguauauguucuuuucacauugugcccagcuugcaugaaguguacagagagaugugugauucuguuuuuuauuuuugucuuguguauaauggcauccucuggucaguagaagugaagcucacuccauguagcauacaaaaugcuuugaguuguugaagcugacagaugagcaguagggcauuacauuacauuguaugaaucaaaugugaacugugugucuauugugaggcauaaacagucuguuacauugucuggaguaacuagacauaacuaccuuguccugggaagacugcagagcucauuugcauuggcuagcacgaggcaggacugacagauuucauucuuacuugguuuaugugaaguuguagaacgugcuguuguguaauuucauuucgacucuugacuucuguuccgguccuguaaaagaaaccuggauuugcaacguuuugugcagaauuucuuuugagaagaaaauguuucugcuauuuuguagaaaaugauuucaaucucuugaggucucauacaagcaaauuuuaaaauacgauuauucuaaucaucgauuuuagacauuaaacagaauucaaagcacuuuaauuuauagcugugguuauaaacaguuuuuagaaguuucaaaugauuuauccauugaaugugacuugaucuuuauacaaaggcccuucuaccugaagacaaaauauuauuuauuuucuacaucuuugguuuucauauuucuaaauggguucacuuccuuggugguguuuggagagccaagaaugcaaauaaaugagcacuaccucaaaauaaauauugggaaaccuuuggagucucacugcugcauggauaaagcacuugauuuaaagcuggauuauugaauucaaggcagaaggcaagaaagacaaccgcacccuauguagcuugcaggugaaaggcucucuagguagccugggaaggugauagccguggcagacaguuauauaggcaaccagaagcgcuugucuugaacagcuuggauaccucucagugccagucuuucuacugcacgagugagccuuuuguucucuccuucuagacaucacuguucaucugauguuuguaaguuuguguuucauacagaguuacaguuuugauaaagagacaucucaguuacugccccuaaggcauuaauccuuuccauaccgcccuacggagagugaccauuuagggagaagagaagagguaauacacuguuauggucaccccccccccccaaccccaaccccuggcuuucucguuggguggcauaggagggcaccugaacucuaguaagugguaggaaguuugguauaagaugucuaaugugcauagaacauuuggguggcauaggagggcaccugaacucuaguaagugguaggaaguuugguauaagaugucuaaugugcauagaacauuuggguggcacuuuccaggagugagaacuugguuauugacaucuuugacuugggcaccaaaguugcugaucuuaggaacuucguaucugacucguuagaaagauucuuugaguaauuuuguuuuugcaacuuuaaaaaaaaaaaaaacauuguauuuuuaaaguuugaccguuucugaucacgagucucacugugguguauuugagagcugaguccggcuggucacuguaguugauuaaaauguuagagccagcucuggcugucuugaauguauuuugcuugaugguggaauacugugugacgaugauccugguggacugcuugacuuuacagccacgcaggguuuccauaccccuccauuccacucuguucacagaguuguucaugucaguggcaagccauguucuuauguucuuugcaucuuaaucccaaagucuagguauaguuaggaacauugaaaaaauguaugcaaauacaaacagcaaaaucaaacauaggaccuaccagacacaauuuuggagcuuuaaaaagucuuuauuggugaucaucgacuuguauacaaacuaguguccuucacugccaauggcugcuuauuuucuuuggcuaacuggagggacgagccucugacauagacaugaggcuccccacgcauuuccacgagggcagaagacgcuaauggugcucgaugagaguacucaggggcagaugugacuuacauuaacugcuguuugucgucuguccucaccccguugcugcugugagcacaguguuaucuuuaagagucugugauuggcaugggcuugagcucaugaauguguguaggccuuguacguguggcuaaggauaugucaugcuaucagccacagcuaaucuuauauuagaaauaguguuuggaauuaggaacacuauuaugugcuggaguguccagaauuucauuuaauaauggaggggaaauaugugguuacuaaaugugcauuaauauaaaauuucccaagagauuuguuggacagaaauaucccugcccucaccauaacugaagcauaccaguuuuuguagagucaaaaaagcuguacauauuugggaaucugaagacuauguaaaucauuuguuacuuaaaucugugaaaaaagguuuuauuuuguuuuguuuuauuuuugagggaaaagugcauuuauaaguguucuguggaaucaguuaucuuuacuguguugauguaacuguuuguaaauguucagugucuucauugaaauacgaaguucauuaaaacauuuguguuccauaauuacuauuauaaagguuuguguuauuggga

SEQ ID NO: 6878 - RNA, 7540 nt, Mus musculus
ugguuguucgagacauaaacuuuuccccaauuguauauguaauaauuaauucguuuuuccagacaggguuucucuguguagccccagcugccauggaacucauuuuguagaccagguuggccucaaacucaaagauccgccugccucugucuccugagugcugugguuuaagacgugugcuaccaaauuuacaaaagcuucacauauaaucuguagugaaaaauuccuaucuuauaguaacuugagucgcugaauuuauuaagaauggacugucacacgaugguuuaacaacugucaaauuaauucaguccaaacgcugguuccccaaucggccucuacuucauuuaacuuugcuggacaauuacuccacauugcaaaacgccuugggaauuauugcugcugcaaaucuacagcaccuucuaacuggaaacagaccggaauaacauguugagaaggcaggaguaaagcuuccaaacuaacccauuagcaaugaucucuugaauuuucuuaauuuccaucaagaccaacccacaggaauuccagugagaaaacuguaguugucagagcgcgcuucucaaggcaucugacaucaucacgcacagacacucaaggagagucagggacccgcccuagccuugccuccagcugauuggcgagcccgggcaugguccaaggugccauuggcuggcgaccgacaggucgaacccuccucaagaagccuccccagaaaggaagcuuccccaccgcggagcagcuagacgugcgggccgucucagcuguccacugggagucgccaacacccucgcucgggucccagggccgcaaucacuccuggagaccuccagcgcuucuuucagagccacacgcagggcaaguggugccaccgcgcgcuaaccuggcgcggccgugacgucaggcuugugcuagauuggcaauuggcuggaggcauguggcgcggacggacacuggcgcgagcgauuggauaugcuguuagagggcggggccuggaggcggagcaugcugcggagaggauugaaguacagcucuccgcacagcuucucagcaccugcagccggaaucucugguaagccucccuucuauuuggggaaggauggcgagaggggaccaagaaggguggguggcuguaugaggcugaggugaugcgguuucccagcuugacucgccaugguggccucugacguucggggcugggugccugguccuggaaagcguuggguggccgacugagucccaucggguucucaggguuguccauggaaacucccugacgagcgauucagcagucgugaaauguaaugguucauagcccuuggggaguugaguuauaaaaagggaccugagaaaaaucuguucuucccuccaguauggaguacuucacuugucuucuuccaaaaaugaauaaauaggucuaccccuaagcuuucuucuaguuuaagagugcuuugcagguguugugguugguaaacguccacguggguuuauaaagagauggaaacgcgucuucguuaugugucuagaucuuuuucuugaguucggugaugugcauuuguacuuuaaacaucuuuaagugggugagaaaauaucacuuuauccugugauucugaaguucauucuuuauauccuggcauuaggaguucaagauguuauuucagaaaguuuacaaauugcucacauuugaaaacugcccuagagaggauuuuaaauuaguuuaugaauguuguaauugaaguccacuuucacuucuaacaguguuuguguuagaaugucaaacuaauacaaugacuuuucucuguguuaguguucuaggucagaucagacauucugucacaaugccugaaauaaauaccagccaucuugaugaaaaacagguucagcuucuagcggagauguguauucuuauugaugaaaaugacaauaaaauuggggcugacaccaagaaaaacugucaccuuaaugaaaacaucgacaaagguacugucuuaaaguauucuuuguuauaaagugacuugucuggacauuuagcuaagaaaaauccugagaugaaaggaaugcuuucucuucugggguuugaagagggucucacuguguauagcucugacuggcugguugucacagacaucugccccccaaguacugagagauucauuucuuaaugcugucuuaccuuucauuccaguuaaaugguguguacaaguaaaaucuaccuuucuaccucuccuguaauauuucccuccacuaaguggcuucagaguuauuuggggaucauaaagaaggaauagauauuaucauaguucucaagucugucuuucagaagauuagagagaggaguagguauugaaggaaaauaugauccuacacacacacacacacacacacacacagcaggauaccaaauggucuggguucagccacagagaacuucauguuagaagacugggaagcagcagaacugucaaaauaugauugagaauaaucauauucucaacuucaggagggaaaaccagacaaauagcuggcaaaaucugaccaaucauauuuguuuugcuuuuaggauuauuacaucgagcuuuuagugucuucuuguuuaauacugaaaauaagcuccuguuacagcagagaucagaugcuaaaauuaccuuuccagguugguauacuuaaugaauaagguagaguuugcugggaacuauuuaauccgacugaacuuuuuugagccaacaucuaaaagaaucagccaggcacacggcuucacuuguauuuuauaauaaguaaccuuauccacugagucuaaucuaaucugaauuaucucuguguuuugaucuugauuaagaaagcuuuaaaacuuacccauaaaugucuuuuagaaaauacuucuggaaaccuguuauaauuaacuuaaaauucuauuuaucugauuacuuaggaaaguuuuuccucggucuuucaaggauuggggaaaaaauucuucuuuguucauauuacucuuucccagguuguuucaccaauaguugcuguagucauccauuaaguaacccaggcgagcuggaagagaacaacgccauuggugugaagcgagcagcaaagcggcgcuugaaagccgaguugggaauacccuuggaagagguacccgcucuuacuacuauuacacagucugcagccuaaacucaggcauguuaagacacuggguaauuaccagaaagaaauuuucagcaaugcuuugaguggaacccagaguuuuguacauucuugguguguguucuuccuuaaguuccaggccaguaacuuuguuuugagauagaauuuaacuauguaguccaaguuugccuuaaauucuugauccuccugccucaguaucccaguugcugagauuauaguaguauaugaucuguguuucuuaacuuccggauuuacuguauuagcccuucaauaagaacuacuaugugcauuuuuauugucuuggguuuugagacagugccuugcugcccagcucuuauuggccuccaaccaaaugcuagguuuugccuccuaaaugcagggauuauuggcccacauuccaaaucuagcuaaauuuuuaucucacucuuuuuuaaaaaauaccuccuagauuuaauuuauuuuauauguaugaacauuuugccaacauuuauguacacaauauguaugccuggugcccaaggacaccagaaaagagaguguucgauccccacaugggugcuggcaaccaaaucuggaucuucugguagguacugcugagccaucucucagccucuuuuuuaaauaauaauaauaauaccuauuuuuacuuugugucuuuuuccugcaugugucucaugugggccaucuacaugcaguaccagaggaagccaaaagagggaguugaaucccuuggaacuagaguuaaggacagguauuggcugccaugugaaugcuaagacucaaaccauaguccuauggaagaacaagacagcacuuuuaacuccugagccaucuuucuggccacccucuuuauuuuauuuuauuuuauuauuuauuuauuuauauuugagaguccauggaucucauguggcucaggcuaaccuuaaacuugagcuguagcugaggacaaccgugaggugaugaucugccugccuuuagucuccuagcgcugagaauacaaguauacacccugggcuucauccaugcuuggcaagcccucagugagcuaaauuccagcccucaggagguagagguagcugguucagaauugcaggucagucguaucuacuuaagagaguucuaagcuagccagggcuacaugguaaaacuuugccucaaaaauagguuagaaagguugguaggaauguagauagacagacagaaagauacauacauagauagaaaacguuuuuagaaagaacaauuccagggaaaucagcucauuccgauugugguucaugcuucuaaggaugucuacaagaaaacauucaucgcugauuugaucaauuauaauagccagccucguagacuugaacaaaacuaugacuguuauuuuaagaaacaaauuuuagggcuagcuagccuagagcucacuguguagaccaggcuagcccugaacucauagagaucugccugcuucagcuuccagccaacaugcuaggacuaaaggaguacaccaccaggccugacuaaacuguccucuuugaggauucagacaaagugucucagaugcaguugaauguuuuacuguaacagcaauuuuaaaauaaggaugcuccauucuaguuugaguacuuuuuaauauuuugaaaacaaauuaacuuguguuuggucucaggaauaaaaaaauugagacacucaagacaguaauaauuuuuccauauauuuaaaagcucugauuguaaaacugugcugcugucauucaggauacuguuagagggcuggagacauggcucagcuaggaacacuggcugcucuuccaggagacccguguuuaacacuuagcaccagcauggcagcuuacacuccucugcaacuccaggucuaggagaucaguugccuccuucuagucuccuaaggcaccaggcacauaccugguacacagauacacaugcaagcaacacacucauacacaaaaaauacauuuaaaaaauaagauauucuugagauauguuaauuuuagguuaucuuuugucacgagucaguuuucccuuuucuuugguuucuguuauuguuuguuugguuuuugagacaugucucacuguacaucccuggcuagcuuggaacucacugugccuuaaacucagagaaucaccuaccucugccuccugaguacugggauuaaagacaugcaccccucugccugaccucaucaguaguauuauuaacugauuuaucuuuucuucuuguagguugaucuaaaugaaauggauuaucuaacaagaauuuacuacaaggcccaaucugaugguaucuggggugaacaugaaguugauuacauucuguuucugaggaagaauguaaccuugaauccagaucccaacgagauuaaaagcuauugcuauguaucaaaggaagaagucagagaaauuuugaagaaggcagccaguggugaaauuaaguuaacuccgugguuuaagauaauugcagauacuuuccucuucaaauggugggauaacuuaaaccauuugaguccauuuguugaccaugagaaaauacauagauugugaauguguaaaugauuugaaaaauuuucuaccugguaagaaugguuugguuugguuuuaaauugggcccucuuauaugauacauagguauuuuacaaccagaauuuguuuugagaaaagaaaaacucaacuagcuuacaguuuuauaucauauaucccauauauaugcacugaugucuguaaaagauauuuaggugagguuauugcaaaauuaugccauaaguaaaacuuaauuuagccuguccaaauaccuggcuaugacaagauugaggaaguaacuagaacucauauuuuacauuugauagacacuuucagaacucuuugcuaauugucaaguguuguuuauaucuuuagauuuuuaucauacaucagaaaauugagcagcugcuuugaaacagcacuaagagguuaaaugggcagggcucaggagacagcucaguguaccaugauugccuugcaggcaugaugucauggguuguugagucccuaacccuaaagauaauuguaacaacagcagcaacaggcagagcagguucagagggaaguauauggcgcucucucucucucucucucucucucucucucucucucucucggucuucagacaggaugauuaaucucaggaacccuguauaaccaauacuggaugcucaagucgauagaagguaucguauuugcauauuacugacuacacuucaccucgucucuggcguggccaugacacucaacccagcguaaaugcuccuguaaaugauaguuguacuaugcuuuaugauaaggagacgucugcaugugcggcacagaucaaauauuaauagacaguugcuugagcccuuggauguuuggcccacagauuuaaaaggccaguucuguauacuaauuuuugucauucucacuugauuuugugcuuuaaccauccugaaauuauuauuuuacuacuuaaagguaacuguuacuuuugguaguaaugguaacugauuagcuauucagcaaaaucuguuuauaguccuagugaaaaagaugguuagucauaaugugugagugaguucuacuuuaaaaaguugagaaaaccuuugacucuaccauggcuggcccuggauccucuuguuguagggggucuggcuugaguuagauaauuuaguagcauuagcaccccuuuuuaagacaacaacaacaaaagaaaaucuagggaagagugggggcguguuucuuucucuguguagcucuggcuauucuagaacucaauuuguagacuaggcuagccucaaaacccagagauccaccuuccucugacucccagguacugggauuaaaggaguguaccacauggccagcaacaaccagaauuugaaugggugauaaucaagagucccguaacgggcucgcuguucuaugaucagggcuuauuuuagagguggaagugggaaggaguagggcugaggaaacauacagugacuagacugaugucccagaauaggcauauauuaagauuuugagguuauagaauaggcauauauugauacuguguuuugauugauguucuuuuaaaacuugccacaggugugucacauuugagcucuuuagacagcuuuauucuuaagugcugcauaauggauacauuuuuucuuauaaaaauuuuauaaaccuaauuucuugcuaacucugaacaguugauuuaucauuggggauaugacuauguugcaagaauuuauugaaaauuaaaaauaaauuauuuuaauauugucuggcuuguuaauaucuggauauuaugguuaaucuguguauuauaucuuaaacaugauaaaugcuauaaaccuuua

SEQ ID NO: 6879 - RNA, 7540 nt, Mus musculus
uaaagguuuauagcauuuaucauguuuaagauauaauacacagauuaaccauaauauccagauauuaacaagccagacaauauuaaaauaauuuauuuuuaauuuucaauaaauucuugcaacauagucauauccccaaugauaaaucaacuguucagaguuagcaagaaauuagguuuauaaaauuuuuauaagaaaaaauguauccauuaugcagcacuuaagaauaaagcugucuaaagagcucaaaugugacacaccuguggcaaguuuuaaaagaacaucaaucaaaacacaguaucaauauaugccuauucuauaaccucaaaaucuuaauauaugccuauucugggacaucagucuagucacuguauguuuccucagcccuacuccuucccacuuccaccucuaaaauaagcccugaucauagaacagcgagcccguuacgggacucuugauuaucacccauucaaauucugguuguugcuggccaugugguacacuccuuuaaucccaguaccugggagucagaggaagguggaucucuggguuuugaggcuagccuagucuacaaauugaguucuagaauagccagagcuacacagagaaagaaacacgcccccacucuucccuagauuuucuuuuguuguuguugucuuaaaaaggggugcuaaugcuacuaaauuaucuaacucaagccagacccccuacaacaagaggauccagggccagccaugguagagucaaagguuuucucaacuuuuuaaaguagaacucacucacacauuaugacuaaccaucuuuuucacuaggacuauaaacagauuuugcugaauagcuaaucaguuaccauuacuaccaaaaguaacaguuaccuuuaaguaguaaaauaauaauuucaggaugguuaaagcacaaaaucaagugagaaugacaaaaauuaguauacagaacuggccuuuuaaaucugugggccaaacauccaagggcucaagcaacugucuauuaauauuugaucugugccgcacaugcagacgucuccuuaucauaaagcauaguacaacuaucauuuacaggagcauuuacgcuggguugagugucauggccacgccagagacgaggugaaguguagucaguaauaugcaaauacgauaccuucuaucgacuugagcauccaguauugguuauacaggguuccugagauuaaucauccugucugaagaccgagagagagagagagagagagagagagagagagagagagagcgccauauacuucccucugaaccugcucugccuguugcugcuguuguuacaauuaucuuuaggguuagggacucaacaacccaugacaucaugccugcaaggcaaucaugguacacugagcugucuccugagcccugcccauuuaaccucuuagugcuguuucaaagcagcugcucaauuuucugauguaugauaaaaaucuaaagauauaaacaacacuugacaauuagcaaagaguucugaaagugucuaucaaauguaaaauaugaguucuaguuacuuccucaaucuugucauagccagguauuuggacaggcuaaauuaaguuuuacuuauggcauaauuuugcaauaaccucaccuaaauaucuuuuacagacaucagugcauauauaugggauauaugauauaaaacuguaagcuaguugaguuuuucuuuucucaaaacaaauucugguuguaaaauaccuauguaucauauaagagggcccaauuuaaaaccaaaccaaaccauucuuaccagguagaaaauuuuucaaaucauuuacacauucacaaucuauguauuuucucauggucaacaaauggacucaaaugguuuaaguuaucccaccauuugaagaggaaaguaucugcaauuaucuuaaaccacggaguuaacuuaauuucaccacuggcugccuucuucaaaauuucucugacuucuuccuuugauacauagcaauagcuuuuaaucucguugggaucuggauucaagguuacauucuuccucagaaacagaauguaaucaacuucauguucaccccagauaccaucagauugggccuuguaguaaauucuuguuagauaauccauuucauuuagaucaaccuacaagaagaaaagauaaaucaguuaauaauacuacugaugaggucaggcagaggggugcaugucuuuaaucccaguacucaggaggcagagguaggugauucucugaguuuaaggcacagugaguuccaagcuagccagggauguacagugagacaugucucaaaaaccaaacaaacaauaacagaaaccaaagaaaagggaaaacugacucgugacaaaagauaaccuaaaauuaacauaucucaagaauaucuuauuuuuuaaauguauuuuuuguguaugaguguguugcuugcauguguaucuguguaccagguaugugccuggugccuuaggagacuagaaggaggcaacugaucuccuagaccuggaguugcagaggaguguaagcugccaugcuggugcuaaguguuaaacacgggucuccuggaagagcagccaguguuccuagcugagccaugucuccagcccucuaacaguauccugaaugacagcagcacaguuuuacaaucagagcuuuuaaauauauggaaaaauuauuacugucuugagugucucaauuuuuuuauuccugagaccaaacacaaguuaauuuguuuucaaaauauuaaaaaguacucaaacuagaauggagcauccuuauuuuaaaauugcuguuacaguaaaacauucaacugcaucugagacacuuugucugaauccucaaagaggacaguuuagucaggccuggugguguacuccuuuaguccuagcauguuggcuggaagcugaagcaggcagaucucuaugaguucagggcuagccuggucuacacagugagcucuaggcuagcuagcccuaaaauuuguuucuuaaaauaacagucauaguuuuguucaagucuacgaggcuggcuauuauaauugaucaaaucagcgaugaauguuuucuuguagacauccuuagaagcaugaaccacaaucggaaugagcugauuucccuggaauuguucuuucuaaaaacguuuucuaucuauguauguaucuuucugucugucuaucuacauuccuaccaaccuuucuaaccuauuuuugaggcaaaguuuuaccauguagcccuggcuagcuuagaacucucuuaaguagauacgacugaccugcaauucugaaccagcuaccucuaccuccugagggcuggaauuuagcucacugagggcuugccaagcauggaugaagcccaggguguauacuuguauucucagcgcuaggagacuaaaggcaggcagaucaucaccucacgguuguccucagcuacagcucaaguuuaagguuagccugagccacaugagauccauggacucucaaauauaaauaaauaaauaauaaaauaaaauaaaauaaagaggguggccagaaagauggcucaggaguuaaaagugcugucuuguucuuccauaggacuaugguuugagucuuagcauucacauggcagccaauaccuguccuuaacucuaguuccaagggauucaacucccucuuuuggcuuccucugguacugcauguagauggcccacaugagacacaugcaggaaaaagacacaaaguaaaaauagguauuauuauuauuauuuaaaaaagaggcugagagauggcucagcaguaccuaccagaagauccagauuugguugccagcacccauguggggaucgaacacucucuuuucugguguccuugggcaccaggcauacauauuguguacauaaauguuggcaaaauguucauacauauaaaauaaauuaaaucuaggagguauuuuuuaaaaaagagugagauaaaaauuuagcuagauuuggaaugugggccaauaaucccugcauuuaggaggcaaaaccuagcauuugguuggaggccaauaagagcugggcagcaaggcacugucucaaaacccaagacaauaaaaaugcacauaguaguucuuauugaagggcuaauacaguaaauccggaaguuaagaaacacagaucauauacuacuauaaucucagcaacugggauacugaggcaggaggaucaagaauuuaaggcaaacuuggacuacauaguuaaauucuaucucaaaacaaaguuacuggccuggaacuuaaggaagaacacacaccaagaauguacaaaacucuggguuccacucaaagcauugcugaaaauuucuuucugguaauuacccagugucuuaacaugccugaguuuaggcugcagacuguguaauaguaguaagagcggguaccucuuccaaggguauucccaacucggcuuucaagcgccgcuuugcugcucgcuucacaccaauggcguuguucucuuccagcucgccuggguuacuuaauggaugacuacagcaacuauuggugaaacaaccugggaaagaguaauaugaacaaagaagaauuuuuuccccaauccuugaaagaccgaggaaaaacuuuccuaaguaaucagauaaauagaauuuuaaguuaauuauaacagguuuccagaaguauuuucuaaaagacauuuauggguaaguuuuaaagcuuucuuaaucaagaucaaaacacagagauaauucagauuagauuagacucaguggauaagguuacuuauuauaaaauacaagugaagccgugugccuggcugauucuuuuagauguuggcucaaaaaaguucagucggauuaaauaguucccagcaaacucuaccuuauucauuaaguauaccaaccuggaaagguaauuuuagcaucugaucucugcuguaacaggagcuuauuuucaguauuaaacaagaagacacuaaaagcucgauguaauaauccuaaaagcaaaacaaauaugauuggucagauuuugccagcuauuugucugguuuucccuccugaaguugagaauaugauuauucucaaucauauuuugacaguucugcugcuucccagucuucuaacaugaaguucucuguggcugaacccagaccauuugguauccugcuguguguguguguguguguguguguguaggaucauauuuuccuucaauaccuacuccucucucuaaucuucugaaagacagacuugagaacuaugauaauaucuauuccuucuuuaugauccccaaauaacucugaagccacuuaguggagggaaauauuacaggagagguagaaagguagauuuuacuuguacacaccauuuaacuggaaugaaagguaagacagcauuaagaaaugaaucucucaguacuuggggggcagaugucugugacaaccagccagucagagcuauacacagugagacccucuucaaaccccagaagagaaagcauuccuuucaucucaggauuuuucuuagcuaaauguccagacaagucacuuuauaacaaagaauacuuuaagacaguaccuuugucgauguuuucauuaaggugacaguuuuucuuggugucagccccaauuuuauugucauuuucaucaauaagaauacacaucuccgcuagaagcugaaccuguuuuucaucaagauggcugguauuuauuucaggcauugugacagaaugucugaucugaccuagaacacuaacacagagaaaagucauuguauuaguuugacauucuaacacaaacacuguuagaagugaaaguggacuucaauuacaacauucauaaacuaauuuaaaauccucucuagggcaguuuucaaaugugagcaauuuguaaacuuucugaaauaacaucuugaacuccuaaugccaggauauaaagaaugaacuucagaaucacaggauaaagugauauuuucucacccacuuaaagauguuuaaaguacaaaugcacaucaccgaacucaagaaaaagaucuagacacauaacgaagacgcguuuccaucucuuuauaaacccacguggacguuuaccaaccacaacaccugcaaagcacucuuaaacuagaagaaagcuuagggguagaccuauuuauucauuuuuggaagaagacaagugaaguacuccauacuggagggaagaacagauuuuucucaggucccuuuuuauaacucaacuccccaagggcuaugaaccauuacauuucacgacugcugaaucgcucgucagggaguuuccauggacaacccugagaacccgaugggacucagucggccacccaacgcuuuccaggaccaggcacccagccccgaacgucagaggccaccauggcgagucaagcugggaaaccgcaucaccucagccucauacagccacccacccuucuugguccccucucgccauccuuccccaaauagaagggaggcuuaccagagauuccggcugcaggugcugagaagcugugcggagagcuguacuucaauccucuccgcagcaugcuccgccuccaggccccgcccucuaacagcauauccaaucgcucgcgccaguguccguccgcgccacaugccuccagccaauugccaaucuagcacaagccugacgucacggccgcgccagguuagcgcgcgguggcaccacuugcccugcguguggcucugaaagaagcgcuggaggucuccaggagugauugcggcccugggacccgagcgaggguguuggcgacucccaguggacagcugagacggcccgcacgucuagcugcuccgcgguggggaagcuuccuuucuggggaggcuucuugaggaggguucgaccugucggucgccagccaauggcaccuuggaccaugcccgggcucgccaaucagcuggaggcaaggcuagggcgggucccugacucuccuugagugucugugcgugaugaugucagaugccuugagaagcgcgcucugacaacuacaguuuucucacuggaauuccuguggguuggucuugauggaaauuaagaaaauucaagagaucauugcuaauggguuaguuuggaagcuuuacuccugccuucucaacauguuauuccggucuguuuccaguuagaaggugcuguagauuugcagcagcaauaauucccaaggcguuuugcaauguggaguaauuguccagcaaaguuaaaugaaguagaggccgauuggggaaccagcguuuggacugaauuaauuugacaguuguuaaaccaucgugugacaguccauucuuaauaaauucagcgacucaaguuacuauaagauaggaauuuuucacuacagauuauaugugaagcuuuuguaaauuugguagcacacgucuuaaaccacagcacucaggagacagaggcaggcggaucuuugaguuugaggccaaccuggucuacaaaaugaguuccauggcagcuggggcuacacagagaaacccugucuggaaaaacgaauuaauuauuacauauacaauuggggaaaaguuuaugucucgaacaacca

SEQ ID NO: 6880 - RNA, 693 nt, Mus musculus
auuuuuuuuuuuuuuugaguggcagcacugagguuuauuggagcauccuaauacagacgcuggggcuugcccauggugcucuugauguacagagcccgcacauuuugccaguuuuucuugagcaaggacaccaagaaauugacagccagaugaauguuguggacuagcucaucaucggucaucuucacguggccgacagcaacggccagacacagcaccuucuucaucuggaacuugauuguagauuucacaucauccacuuuggcgaaaguguuuucauuguguaucagcagggaggggaacuugccagccuuguuuaggccugggcccaggauacgugggaucugcuuaaucagagacucggaggccaaaaaggcaucauacuucuuggccagcuucuugaccaacuucuuguucuuguuaagcuucuugagcgccucgauguccauguaggggauuuccacggccuuggcuucaucacagugcugcugguccccgacugcgaaguuggggugugguguggaguuaaucguaauggugcuggacaaaccuuuguccuucugagggucguaguucuucaggcugaucugcagcuccaccaucuccagaaacuuguggcgcuugcacugguucccgugcaggacuucccgcaccgccuccaaaagggcaucgcgugagacuuugcugcucaug

SEQ ID NO: 6881 - RNA, 693 nt, Mus musculus
caugagcagcaaagucucacgcgaugcccuuuuggaggcggugcgggaaguccugcacgggaaccagugcaagcgccacaaguuucuggagaugguggagcugcagaucagccugaagaacuacgacccucagaaggacaaagguuuguccagcaccauuacgauuaacuccacaccacaccccaacuucgcagucggggaccagcagcacugugaugaagccaaggccguggaaauccccuacauggacaucgaggcgcucaagaagcuuaacaagaacaagaaguuggucaagaagcuggccaagaaguaugaugccuuuuuggccuccgagucucugauuaagcagaucccacguauccugggcccaggccuaaacaaggcuggcaaguuccccucccugcugauacacaaugaaaacacuuucgccaaaguggaugaugugaaaucuacaaucaaguuccagaugaagaaggugcugugucuggccguugcugucggccacgugaagaugaccgaugaugagcuaguccacaacauucaucuggcugucaauuucuugguguccuugcucaagaaaaacuggcaaaaugugcgggcucuguacaucaagagcaccaugggcaagccccagcgucuguauuaggaugcuccaauaaaccucagugcugccacucaaaaaaaaaaaaaaau

SEQ ID NO: 6882 - RNA, 80573 nt, Mus musculus
gggacuuccgcagggccccggaagugggaucuguguguucucaugcgaacgggaaggagcguuggggaucuggagucucgagguugagacauuuucgggcccgaaaaaggaaggaucggcugccgucgcugccaaguccgcgcccgcucuucuuugcugucuccggcccggcccggccgugccgccuuuucuugccgucucccuccucggccguccccgcguguuuugcgcggucgccgggcaccggggcugcggcgacgagcccgcgggcggccggucgggcggggcgggcggcugacaggugagcggggcgguccucggucaccgacggggcggccucccuccgcgccccgugcucggacccgcgccuccaccagccugucaccgggccgccaucuucccggagggacggggccaguggcgggcagggccgggcccgggcggggaggggaacggcacagggccgggcuggggccggcgcuggggaggacagaaagaggggcagugccgcggagggagcggcagggcaggcuggacuguggccccgauagcccgggguaggcuggaccugggaggaccugcgggccggggucagaccugacugacacggcccuggccggggaggacuggagcgaagugagacgugugcagagucuucccggaggccgcgucucccaggcucuuggggguuugccuaugcagcccgaggagaaugggcuggggucgcaggccaccaucgccccgagggcaggcgggcgggccccggggacccgcagugcggcgcccggggccucgccccccucggucccgccggagaccggccagacagccgcgcucgcugcugcggggagagguggcucauuagggaaucgcauuccuuuagaaccaggaaguuaggauccuguugcucgaguguguguuuggaaugcugcucccuuuucccccauacacuugauagacuugagcggguccgacuuugagauaguuaagaaauaaaaauuaaaugugaagacucaugguaaccggccaggaaccucuuaaccaccugcuucucagugguguauaguagaacaugaaguuuguugaguugaggucauugcaucuugugacuuucagugaauguaaucuuguuaacccccucguuuuuugguguaagguggcuuugaauuuggacugacucgaaaugugagaaaacgacccggagaaaaaugaucucaaucugccuuccauucgcgaccuucucacuggcguuggaauacuuuguuuuaaucauaaacugaaacuuugaaguuuuccauaacugaacaaacgggagggcuucccauggcugcaguggaauuaguuuguagcacacagucaaacaagggaguuuuaaauagaggcaauagcaacugcauuuguuucuuuuaggauauuuagcugcuucccuuuucaaauugaguugaauauuuaaaaugcacuugcaguuuguuuugaguugguguuugcaagaccacaagaggagaaaagggugaugguuuuuguuuuugguggucuuuuaguauauuaugugcaauuucuauacuucccuaacuugguuggcuucucuuauuuacagucaggguuaauuuaauugaggcuuuuuuucuucgugcuuaauauaccaaaauccaguauuguaaucaaauuguacaagaaauaguuuaaggagauuuguugggaauugcuaaaguagaaugcucucugaaaguuuauuuuuuaguuaguacauuuucccuuaaaacuuuaacuaguuagaaauauauuucaucucauauuuugaaaacuaaugugacuugaguugacuuauuuauauggaacggcauggcuucuuagucauuagaagcuauccugagcucaccuuugauuccagcacuagggaggcaaaggaagggaggccagccuggucuacagauggaaugucagggcuacacagagaaaccuaucuugaaaaaaaccaaaaacaaacaaacaaaaaacuuacuuucuuggugacuaaaauuuugaaaagucucauaagacugauguaagcaugaagcaugcagauguuugcuuuuugcuauuuuuauuguuacugaauuccuaauuuugauauucugccuuauagguggcaauuuuaauuuauuacucaugucuugaucacgugucucugucauagaagacagguucugagacagcauauaaguuuggagaagggagcuauacuauaugugaguaggcuccagagagaaaauagaugauuauaauggguguagaaguuugcauucauuuuuccacacuguagaagagcagcugaaaugaaguagcugaaauuucauaguaaugcuuugggggcuuguccauuuuguaaaaaagaaaaaauccugagauuugaagaauuaaauauaugugacuuaccuaaauauguacaaaguuugacaaagauguauuuaaacucuguggaaacaaauauuucacuuaaccaccuguuuucaugaagaagucuucacaauguuauaugaaacgaacuucugaauguuaagugaaagucuguauaacaguuuaauggugauuacaguaaacagugccuucaagaagcagcaggcacucagaguuacaaacacuuuuagacauggcucauguuagcagccaagaaagggcugauagacuccucucacugucguuuuuaugucauggggcauucacacuucugcugaacuaugaacuaggguuauagucuggaucucuucuucuagugagaagugauggucuuuuauggucugcugcauaggaugagguuaauuccugugaagcccauuugcucuuacagaguuaaaggcggaguuuacaguauuuaacuaacauacagugcugcugucgauacuuugagauuaaaguauauuccuuccuuaauuuuagauuaguagaagcagaaaaauuguaucuuguuguaauuuccaccauugaaucauuuuaaccuuaaaaugcagauguuggaggugagucuguuaaaaaggguuagugcugcaguuugcuuauauuauuucaugugaagaaaucuuguuuuguuguagcuuguuuuuguuuuucugugagaguuaauuuuagaguacacaguaagugagcccauuacaggguuaaauucaugagaacccaguuuaguuuaaauguuuuccccugauuuacuuggcaguucagaagacugaacccugguacuugguuaugcuaggcaaaaucuauacucccaacccucuuuaauaaauuaauuuuuuuuuuuuuuuuaaauuaaggccaaaaaaaaaucacuaaguuacccccaggccuuuaucuugcugucucaccugacaguagcugggauuacaagcauguacccccagggcuagcgaguuugcucucauuguuagacuuguugauguuuuggagcugacgcucucugcaguuacuguaauuagaaauggauuuucuuauuagggcauggaauuggaauagcaagccucuagauucccuuaagaaaaggaaggaaggggcccuuuguucagccgcugaggacucuugcucucaagccugccuaccugaguucagucccuagaacccauaugguaggagaguacugauugcugcaaguuaucgucugaccucugcacacacaauaaauacauaaaugugaaaacaaaaccagaagagaaggaagauaaaguccgacuuggaaauauucccccuuaauauugcgccuuucaagcugcuuuauuucccauguauaggugucuuucuuggaauggggaaaauuauuaggugugcuuccuuguuuuuugguccuugcucucuucccccacaccucuugucucugugccuuuauaaagucugucuuugcaccucuuuuguggaagcugucaugaccccuauuuguauuggagugaugcugcugaguuugugaucuuuuucuuccuugcuauaccuacaauccuggcuaacuucugaggccuaggcauuuaacauaugucguaccgagcacaaaugaaaaacauacugcuauuuuuuuagagguagcuuaauauucacugauacaagacucgguugucacugaaaauauccuuuugaaguuugugugcuaagucuuccuuaaagcuuguuauucagggugguucuuauuugcuugaucaaaauaaaguaguccuguguuuacacaagcuguuuugccaucuccauccagauacugccuuucaggcacauccugguugcuugacccuuccuagaaacuuaucaagacugcucuaagauccgugacuugcccacuguaaccuacuguacacuguuucuucauugucugcuccaccuucuaaggccuucuucucaucuguuccucccuucccccacggugcugcugucuuggcucuugguaguuucuuugcuugaaauuggaugcuucaucccacuccccaaaauguaauuuuuguuuuuaaguuuugcuuagucucuuaauacacugaauaauuccugaagacaacgcuugaggaaccauugccagugucugaguuuagacugggugcuuccuauuuguugcgucuuacugacuacacaacgcaggggcaugcuuauggggaaggaagcuucugacuugguuuucccgcuugaagcccuggugugaugagagauggaagcauggcuagggacaucucccaggugugugaaagaaagaaaucgcugagcaugucugcuaacacaaauggacaccugaaaaaggauacauugucaaguuucuuuuagcuuauaaaguuacuuuuacaaaguuucaucugaccuuucauaacuguauguaauggauaagaugguuucggagcagaaacuuaacucccgcaccucagauuucacugucugcuagucuuuaaacauaaccacuggagguagguuuuuguuuguuuuucuuucugucuuuugcuuuaaaauuaaauuauuuuaacaaaacccaaggcaacuauaguauuucuaacauacuuuugauauaguauuaaugucauguacaguggcauucagaugcuggugacagcuacaugguuccuuaauaguuacaguugugauauguauuaugucauguggcucucuuauuuccuuuucuuccuguacuuuuccuucauuuuacuuauggcacuguaacaugccauaacaguauuuauuuguggucuguuuucuguacucauauaaacuccuuaacauauacaagggguuuuuuaaaaaaguuauuuauugguaugaauccaguucucagaacuguauuagacacauaaagugcuguaaaugacuuguguguguguugggggguguggugcugggaaguaagcccucuuugucucaggcaagugcucuagcguugcuccccgaggaauuuaauaaaccccaaucugugaugaugaauaaagcaaaauaucuggucuucauuugaguguaccucguguccacuaaagcaggagugcaaccacuuaacccaguaagaguacgguguccuacaggucagagauguggaccuggagggaaguacugagaaaagaaaggagccgagagcugcauucucagaaugacguuguagucauuuugaggugggcaggaacaaagagcaugugacaaauuaauguugaaauggcucaaugaggugaaaaagccggaagaaguagguggugacugcucuuacagggccuuggaugucccuguguagguugaggauuuuguuguuuauccugagaacaucaggaaacucuuggaguguuuuuaaguagugcauugcaugaucagaauuggcuuuuaaaaauaauuguugggagcuggugagguaaccugagcagauuaaaggugcuuccgccaaaccugacaaacuugaauugacccccagaucccaccuggaugagagggagaaccaguuccugagaguuguccucugacugccacauggaugcuauggcacgaucccauagacaucuauaaguaaagauaguaaaaucgaaacauucaagaaaagacuuguucugcuuuauggaaagugauauggaagaggcaguaauaagcuuacagacaugaauuuuacuuaggggcagaaugcagauucuuuuuacuuccuuuggucauaguugaaaaggcccaguuccagucuacauggaggguaacuugcuuagauuccuuuaguuuguguugugcaaaaucauguaggcuuaaaaaguagcauaaaaauaugccuuaacucugcuaguauuugucaguuguuuaaaaguauguuguugagauuuuaucaaggcuaauuaacauuccuuuuuaaauaacaucuccgaaaaaugggaacauuuguuuucacauuucagaaaguuuuguauuucuauugugggcugauuacaguacaggcugcaaaccccuuggccaucuugauguaaaguuacagguggcuucaaugauuauuacucuuggugaacaguuucagcauugauuuuaaaaaauaccuuguacaaccuuccugucgggaagagcauuuuaaaaaauguuuuuaggagguuaaaaacauuugaaagacaacguauaauauuuaaauuuucugucaguacgucucaggaauucuacuuaugugaguacuugguuuuauucucagucaaaacugcacggcauaaucauuaaguccuguuaccuuagugguugacacccauacuuucccaguuauugccaucaugccagaaugcaaauuaguauuggccuuuagcaggucagugggaguacagaccaguuggguauaugaguaauuggugagucagcaauauuugucucuuuuuacaccuuuggggagggagagaaccaugaggaagaccaaaggguggaauacaaggagcugugugcucagugauggguguguucuguacuuuugugcaggucuuauguuuguuuguauugucgauaaacuuaaaccucuucuauugacaaugcccuucaggagcggccaauaaaggaugaauucaauccaaacacaagaaaauuggagguggaaacuagaauugccaaacacaaaagugccagaagcacuccgagucauagaaucuaaaucuccaugauguggaaaauucaaauuguuucuacagaauaccucccaauucagaaugaugguguuuuaauuucaaucaaaccuagaggcauucuugguguacugugccuuuuaacuucagaauauugaaaguacuuuucauggugguggguuauaauaucuagaucacauaucucaugaagcacaugagguuacaguucaagauagaaacuguacugauagauuugcauauccaguguauaccaaaauaaugucagcucaguuuuaugcagaggcaaaagaaauucugggugcccaguuuucaguuuauguggaggugucauuaaauuuauuauaaagaguaauuaccaaaugcuuaauauuaacauagcauuccauaaguuaaguucaugaguuuaauauuaauuaacauagcauucaauaaguuucguucaugagguuucuuuuuaaacaaagagcaagcuuugaagguuuuuuguuauguuuuuuuuuuaauuuaagauuuauuuauuuauuucauguaugugaguacacugucacugucuucagacacaccagaagagggcaucagaucucauuacagaugguuguaagcugccaugcggguugcugggaauugaacucaggaccucuagaagagcagucagugcucuuuacugaacuaucucuccaacccugguucaugaguuuuuaacuuuguuguuguuauuugucuggaauuacuggaugcucauauaguuaggugaaaauuuauaucacuuuaagguauuaaagucauuuucugagauuucgaguuuuguuucgucuacacucuugccaguuggaauuugauaacuaguuaucaguugccaaaaaaccaguaucuuauaggauuuuagaguucugaaguccacagaaguuauacuugguuggaaauacagcuagcugguuagugacagaguuaggacuguaacucguugcauuccaggaucuggauauagagcuaggacuggcucauagucuucuggcucuucuccagugugaacccaccccaggcucacugcacucuuuagcuacaugcucagucagaacacuugcaagccuguaaaaccagccuuggcauuggugaaaauauuaacuuuauuuuuguugcagaauuucaaagaaccauuuuaauuuuuaaagcaaauuuuuaaaaaaauauuuauuugcuuggggguaggguaagugggguaggugccuagagaggccagugacauugggucuacaggaguuguagcuacaggcuacgggcuacgggcaauuguaaacugccucauaugggugcuaggggugggacucagguucuuugaaagaucaguauaugcucuuaaucuuaaccaccauuucuccaacccuaaaagcauauucuuaaggaagcuuuaaaaaagauugagguaguguuauuuguugcuuaugaugggguagguucugaaaugcaguuagacuguuuaauuauuacuauauugaauaccucagaaugcuuagcacaaauaggauaggcucauuacuucacauagccuuuugauauagucaaggcuuacagugagagauguguaauacauaaccugugccuauauaacauggcaugcuagcugggcgugguggcagaggcaggcggacuucugaguuugaggccagccuggucuacaaagugaguucuaggacagccagggcuacacagagaaacccugucucgaaaaacaaaaacaaaaacaaacaaaaaacaaacaaacaaacaaacaaaaagcauggcaugcuauuuuauaguaagauuaaacaaauaauaaaugguauagucaauaaauaguguaguaaauaaauaaacuaguaagaaucauuuauuauuaucuguacauuauugcauguguuuuuuaaauaccugguacuacaguagguuuguuuacaucagcauugcuacaauggugaguaauauguugcaauuagauauguuacaauagcuacagaagcaauaggcaauuggaauucauauauguguggguguguguguguauacacacacacuuuuuuuuuuccuuuuuaauuguucauuggaauugagguaagguaguggcaggguuuguacaugugaguacgggugcucacagaugucagaaagaagguaucagauccccaggagcuggaguuauagacaguuguaauccucuugaugucagugcugggaaucaaaugccagucuucuacaagagcaucaaguacucuuacugaaguguuucuccaggggcccuuacccugaauaugguaauaagcuccuauguaauguauagagucaccauuauguuugcauuaccuuuaacuuuauguuguguaguacgugacuguauguauguauucaaggaaaauuaaggauuuugucauucuagaauaucuagcauccuugauucagauuguguugugauuuagcauccaauucauauaauauaaacagacuagauuauaguuuaccuuuaagaaagaguaucucaagagaaauucauauaaauuuuauaguauucuuacuaaaguauucauacaguuguucauuuuaguauccuuggugcuaacauaggaacauauguauagguucaaagguccaaugucauagcuugcauuuuugugcauggcuuuuguuaauguuuuuaaaggcaccggguuucauucuguagcucuaccuugaccuuguacucacagagaucccuguguuucugccucccuagugcugagauuaaaggugaaugaauacaaagcccagcauccauauuuuuuaaaaggagaaacuugaccuagagggaaugugaguuuuuggagagcuuuucugugguuuuguuugcuguguucaagucaaacaacuggugugugucaggaucucaguuuaacaauugguuucccacaaaauuagagcguuaaauacauuacaauagcgcacaacagugugcuugucuuauaauucugaagacugaaugaaucuauugauuuguuucucauucuucagaacaccugaggccagaagacaguuugcucugcauuuuccaguucagaaagacagaaaugaugauguuuucuaguuucauacuuugaagcccguaaugacaauacuuaacccguugccaaaaaaagagaaaaggucuuguuucaacaucuuggauucggaugauacgauaauguauaucuggggcuuaugcgagaugcgaaagcuguagccagguagggacuacacaucuuaacuccuagcauucaggaagaacagacagaggacucuaauuuaauccuagagugucuuacauaacaagaccgucuuaaaaagagaaagacgguuuaauguuaucauagaagcugcagguaauaccgcacugaauauuaguaguaaacaguuguauugauaggaagcuucuuuuuuuaaagaacaaaacaaaaccaugguugucaagguugagcucagauccucucacugguaggcaaguucuuauugugagccacacccuauccaauuaauuggaauuaagaauacugauguggauucuuugcuaaaaauugauuaugugaugcauauuaucuacuaaaaagggaguauaauccuaacugccuugaguuguaacccacuugugaaauagaaacggaccuuuuacaguaaguacuaagccaaaguaagauuugauucugguuuauuuuggaaugucaguucuuuuuuuaaauguuguaucgcuucuguacauguuagaggauauucauuaugguuuuuguuuuguuuuguuuuucgagacagaguuucucuguauagcccuggcugaccugaaacucacuuuguagaccaggcuggccuugaacucagaaauccaccugccucugccucccaagugcuggauuaaaggugugcgccaccacgcccggcuauucauuauguuuugauaguaccauuuacacuuuggcaaacuuuuaacaugucugcaauugcuaugcuuacuacuugaagacuguaguuugauacuguggcuuugugagcagugugguauuucaguacuucaguaaucuuacguagacacauuauguaccagguacuuacuguauugucuccauguucuaagacguccucacagugcuguugaugagaaaacccaggggaauguaguuguugugccugguagggaaggaguccaguucccaggcaaguguucaucgacgcacuuccuaaccuauguccacugugaaggaguccagagaauuuggaguaguuacuugauuuuucugaagaauuuagugacaauuggaauauagaaaugaagccuauuugaggaaaggcuaaaauguauuugcauguuucuagcuuggucauuuauauuaaauaucuuuauagugggauaagcuuugagcagauuuucaaaacaguauuuuuacuugcuccucccauacaaauaauuacuuuaguaugugcuugcuacuaagagacuucuuuacugauuuguuguuuuaauauuaaauuaauuuuuaaugucacucuuugauauguaagucuuagaccucaagugcauucuugugcccacacaugcacauaugcauaugcaugcacacuaaaccuagagacuaaaaugaagaugaaaauugauucaaaguaaauuuacccuaacuuacaacugcugucuuuuguguguaacccaucaacuggaguaaaggcuuauuuggaaccaucucauuuccuguguuuucuauuuuaauugcuaggcaagucuucccacauuuauuuauuagacgcacacuuagugggauucuacucuauuaggcccuguuaggagcacagugugaacaaggcaggcaggcuggcaaagaugucuuucccugugacagaauuuuggaguugaucggaugaucauaauuugcuaugucguauuccaggguagaaagggcuaguaagagacauaaaauaaugaacucaggcuuugaugggaggaagaaaaguaacauccaaauagcugcuuauauauuuguacuucaucccaagggcaggcuagagauuuugaacucaucugaggaggccuauguuuuaggaagaccaacuugccuucuagaauucuagaagguguaaggaaacuacgaaguuaagauaguuucagagagauuggcuuucugaagaauuuaauaacaguuggaauuuagaaaugacccuuuuucugagaagaggcuacagcaaucuaguugcagguuuuuuauuggguuguuugcauauccuucaaauagggguuuuauguuuuaaaagagcaauaggguucauuauuuuaaacaacugauagauaggagucaggcaaaccauaaauauuugacuguguguugauuagauagcuguauugagauuuagcgugcaguugugaacuagccuuguggaaagugaacacagggacaugauucaagaagaggcagaagcucugagccaccucggucccgauugcacuugccagauuugguacucuuccugugaaauugugggaccugccgaaugcugccauauggcugcuaggcaccuccuuggcaggggucuuucuccuggcagaguuaucucuuuaccaaagccguauaaccuuguucacauugacccucugcuacugcaauuacauaauuuaauuacugugaauggauacugugucuuagaaaucaaaguaguuaagagagaauuuugaauguuuucauccacuaaaaaauugcaaauggagcuggagagauagcucagugguuaagagaaccagccacucuuccagagguucggaguucaauucccagcaaccacacaguggcucacaaccaucuguaaugguaucugauucuccuuucugguaugucuaaagacagcuacauuguacucacauacaaaaaaugaauaaauaaaucuuuuuuaaaaguuuuaaaaaauuuauaaauguuuguaguggagggucuggggagaucacuuagagcacacaugaagaagaguuggcucagcaguuaagagcacuuguugcucuuguggaagaccuggguucuauucccaggacccacauaaugccauccauaaugccaguucuaggagaucugcaggcaugcacuugguucacauagaugcauacaggcaaaacauuaguacauauaagauaaaguaaacaaaauaggaaaaagaaaaacuggguguauaguguugugcugguuaggccagcucuggggaggcugcgaggaggaugugugggguucauugccgagucagccugaccuauuuggcagucccugucuugagggaaggagcaucuaaugugguuuugagggugacaugaaagguuguguccacacacaacauacacacacaggagaauaguccuauaaauguuguguauuuagauaauuuuccaucuguacuagaugugcuuuaaagaaacagugauguguuuuggcuuauguaagaagaacaucaauacaaggacugggucuagggcaaagaucaaaagaaagaacacacacaaguucaaguuaaguauacacacauuaauuuuuguaacuaccuauuugcuuuugcaguuccuuuuaauugcaugggauacagagccucuuacucugcuuagcacacaggaagaacauuucagggugguuaagaaagaguagcuacagaagcagaagcaccaggccagagggggagaaggcagagcagacuccugcugggcugggcugggcugggcugggcugggcugggcugggcugggcugggcugggcugggcugggcugggcuguggagaucuaucagugguauugcaggggagagauuguuaauggcuggugaggcuggagaaaggagcagacugagagguuauguuagagagacuggcucccagaaacagggucauccagucaggguugacuuggcuccuuucauuucacaccucuuuucuuuugagucaagauuggguuacuuuaaaaaaaaaaaaagacuucuuuuuuauguaugaguguuuuuuccugagcauauguaugugcccagugcccuuggagccagaaggagucagauuucuuggaaccuguggccugcuauguggaugcugaaacuaaacccagguccucugcaagugcucuuaaugauugagccaucucuccagccuuaggcuuuuugaaacaguuacagcaggaaauguugaagcuggggaaagacagacuaggacccagacuauagguagggacucuuacagaaccauugcaccuccaguuacuuguuuggcuuuuucucaaaacuuuuuuaauuuaggaacuucugggaauaaaaacccauucacuucguuuguuuguuuguuuguuuguuuguuuguuuuuuccccgagacaggguuucucuguguagccaaaacccauucauuuucauguuuaccuuuuuuucuuuuuuuaaaaaaccccaucauaucuagucuauauuuaggcaccuugucuuuacuuaggagguauauauauauauuuuuaaggaacacaggauuauaauugcuaggaaauacuuccacuucacugaaauauuaaauauagauacuauaucuacauacuuuuauuuauauacaaacauuaaauggagaaauaagguugcauauucauauauaucuuaaaguaagauguuucaucauuuauaaugcuguuaagugaguuauuuauucaguuguuuauucaguuauucagucucacguuguuucuuaugcuggcguuggacacuagggugcaaaguauauccugcuccucccaaguagcugggacugcaggucuagccucuaccacucagcucauuuuaguguguuguuugcuuugcuuugcuuugguuuugguuuugguuuuuucagauaggagacccaucagccucugccucucgaguacgaggacagguaugcacccaccuuggcauuuaguguuuaaggaaggcgauuugcauguucaugaaacaagacuugaggaggacauauagucaggacuguaauuuaggcucugaagaagaaguugccauuucuguaacugccaucugcuuugucaucagcagguaacuacucccuucucuagagcuucaugcucugguggguuucacaaccuucauuauacauuaaaggcacucuugcuuuguuuggguuuaucgacugauucauauagauuagaaguauuuuuuuuuuccaagugaaguuuugauugaacauucuaagaaacuggaacauuuuaguauuuggauaaucuuccuugagauaaaaagguaaaaauacugucgguuucggguacauuaaaguuuuuuuuuuguuguuguugugaaacuaaucaauguguuacagaaaaagugaagacagauguucuagcaacuguaauagguauuuaagggcagucugauugauaccagcacuccauugcuuccaggauugauuggccaaucgaccuggguagguggaugguccuuacuguuccuuguuuguuucucugaaguuguguguucaguugaagaagaugacuuuugcaguagagcaggacucaucuuugguggagauucucucaguaguuguguucucuugcugaaccuccaaaccagcuuugaaugaugagaaaccucagguuuuaggucucagcuuuauuccugagaauagacaugccucugagcagagcaggcugcaguaucucuagcuguuuucaacucuagcuuuccccuucuuuaaaugcucaugucuaaguuugcuuaaaauuucaaccuucacuguuugucgauugagagucuuaauuguaaauauacauuggaauggaugaugugcagccuucgaagacaaaaggugaggugaauagagauuuuuuuuucccauucaacaauugaugaugaguucugcaugguagauuucuuuaacuuuuuauuauuauuauuuuuuaaucauuuuauuuguuacauuucaaauguucuuccccuccaugaaucucccccacccccuccucgccccucuagaacuccucuagagauaccuuaagaagguaucuuaagggcuggagagauggcucaguggguaagagugcugacugcucuucugaagguccugaguucaaaucccagcaaccacgugguggcucacaaccauccguaaugaaauaugaugccuucuucugcugugucugaagacagcuacaguguacuuauguauaauaauaaauaaauauuuuuaaaaaagaagguaucugaagcuugaaggucuucuguagccacugauugugaauccugugggacaauguacuaaugucacugucuuguucauuagaacucuuuguuuucaaauguaaaugacugaagacuuuugugagaauugucaguggucucaagaaaauguucaucuacucaaaaaaaaaaaaaaguuaguaaagcugcccagugaaagagugaugaauguagagcacagauagaagcaguuggagucagauagccgugcccuuuauaaggagaguuguaauccaugugaaauguugaccaguuauuuuuuucuuucuuuggauuuuauauguauuuuguuugacuuguuugagacauggucuagcuagguaguccagacuagccucuaacuuaggaugcuccaccccuuaauaucugggauuacagguauacaccacccuauguucaucuucuuaaagaaauggcuugaguaaacagaagcacauacauuaauuggauugcaacaacagugacagcaaaugagcaggaccaaguaacagacugagcucaaagccaugauggaggaugacucagacaagccaggcacaguuggauuguuaauggaaaugguugcauacugauugcuaggucagucaugccaaaccaugggauaguaaaccuagggaacaguucuuuuuuuuuuuuuuuuaaaaaagucgucaauaaacaaaugucaauguauuauaagcaggcuggguuugagagacaauugacuuuuaacaugagguuuauuuaacauuuuaauuaaaccccuuuccucuuuuacauacuuucccaauuucgguuaagucaaaauaauuguauugucuuaaaccuuuuagagacgucaaguguaagguauggcauuuccugguagugguauuucccuaaugaccaagaaagauaugugaaucagucaagccugagauaauccuagugggguugucuccuuuucugccuggcuuuucagacucaugugaaauugugugaaguguuuguagaaacaacuuuuuuuuaaaaaagauuuauuauuauaucuaaguacauucuagcugucuucagaggcaccagaagaggacaucagaucucauugcggaugguugugagccaccaaccaugugguugcugggauuugaacucaggaccuucagaagagcagucggugcucuuaacuacugagccaucuauccagcccuagaaacaacuuucucaugauuauugggagaggaacacaauacagaguaaaaggaagagguuuuucugaggggugaagggcuccaucuugccaggcugugauugcccacaugguguagcuuuuuggaagcaaacuuacagagccauuuacauucuauuacagccacaugcaaaaugagagauaggagucacucccacucccaaauccuucaggggauuguuuuagguuuccuuauaaaccaauacuggaguggugguucggaguuugucagaauauuaauguguaauaugacaucuugccuaacaggcuuaccuaaugagaugaaccaaauucucaggguuuuuuguuuuguuuaguuuugguuugguuugguuggcuguuuuauguuaagaagagugccgacuaaaaaaaaaaaaaacuaaaagaaguguucuuuaguaauuugugaaugaaaaugaggacaugauggcuccuagguauaguugaggagaaguguuuauuguggauaugagggagagaacagccagcggcaucuggaaagacugaaccaggccauguggcuuaggguuucucugcugugaacagacaccaugaccaaggcagcucuuuuaaggacaacauuucacuggggcuggcuuacaggucagacguucaguccauuaucaucaaggugggaagauggcagcauccaggcaagcaugaugcaggaggagcugagaguuguacaucuuuugaaggcugcuagaauacugacuuccaggcagcuagcaugagagacuuacaacccauacccacagugacacaacuacucuaacaaggccauaccuucuaauagugccacucccuggucugagcauacagaauccaucauaccaggagaaaaguggugcaagugggccaagaggcccagggcagaguaccaagaccccaagagaguuuguagucagaaugacugaguuauuauaggaaucagaagcuggggaaaaggaaaucuggccucuggcuggagagguguagggugggguagggugagaagugcugggaggagccguagguacuaaguggaaucugucucagguuucuuugggaccuaacaguauuucacaaaagcagucauaaguucuaaauuagauuuuuauuagugugacauuuaaaaauacaauuuuauuugguauauuucuugugaauugauuaccuuuccagucagauuuugcuaauaaauuguucugucugugucugauuuuaucaucccucucccccagcacaaacaacucgaauccuaccacuagcuguuucaguagaagcacaggugugcgugcauaaaaggaaauuuaaaauaaucuugaagcuuauuggccaugucugauuaggaguacaccugcgcugggugccagaguaaauguacaauuagguacuguacugagauugggcucauucuuucaucugccaguaucuuugaauaacacauuuacuauaagaauacucauuaaagagacuauuauagagguaccaagucuguaaaaacaaagagcuagaauagcagccuuccuggagacagccaucuuuuccucuguacauauuuccacuaucaaagaugaauucuguauguaaucugugaguugaaagaacgaagcagaguugccuccccugaggaacucuacauuuuauguagaguauguguguguacauugugcguguguguauguguguguguguguguguguaaaaccagaauacacauuuuagauaugucagaaugaugcugacagccaugagagaauaugaucuagcaacauggagcaaaugaaugagacacuccaguuccuauuuugucucacuuccuuacaccuccucucuagaaauagaaaaauaauaacacuaaaaaauagccuucuuuucagcccuacaaugcuagaguuuuauuuuaauaacucuccauuagaacugcuuugacaauuuuccccccugaugaauuuacuuaguuucaaagaagucagagucuaguagguaaacuguuucacuuauaaauacauuuggacauuaaaaguaaaaacaauuuggcuuuuaaaauugauugcccagggauccacacaguacuaaggcagguguccaguugugaagagccuguuuuucuuauucagagaaaacuguuuacuuaccuaguugaauauuauucauuuacuauuuuuuaacuugcaaaauuuauuuuuguguguauauguaguugcacaugugugugugugugugugugcgccuguguggccccaacccaugccagggugcauguguagaagugaggacagcuuucucgaguucuuuucugccacccuguaggauccccagagcaagugaaagcaucaggccugugcucaaguacuuccacccucugagccaucuuguuggccccucacuuaccuuuuucuucuuuuuccuuuuugguaaacuuuuagaaauuaaguuggaguucuugaacgugacuguauaguagcgucuaguacuuuccuuguguuucaucccuuggucccagucaugagacugagaagagacuugguaaacgucauuguaugaaugcugauggugaaggacauagaguacuuacuuggucagcacuguagugagucauuuguguuugagugauaaugaaagaugcaucaguggacugaguuguacuguuggauccuugcuacagugugucuaucugugcagugugcaagaagugaaaccucaaucauacauugucaaucucuuugcuuauuucuuucuaguuuuguuuuuuaaguaacuacuaaguuaugugaauuuuaaaaaucuaguuacaaccuuacuguuuaucauuucauaucaugguuuuuuuuuuguuuguuuguuuguuuguuuguuuuuuacuuugccgguuuugucaauuuuuaaaccguugugauugauuguacuaguuucugcuuuucuguaguugagugucuuauuuccuuuuuauggcaaaagccaacacaauuauucuucauaaaaaugguuugcagccgggcgugguggcgcaugccuuuaaucccagcacuugggaggcagaggcaggcggauuucugaguuugaggccagccugguguacaaagugaguuccaggacagccagggcuauacagagaaacccugucucgaaaaaacaaaaacaaaccaaacaaacaaaaaaaugguuugcacauuuccuuugauuucaucaaggacacauuuuaaguauaaauaaaugugacauuuuaauugaguaucaguaauaucuaagccauauuuuccuuagauuuaaauauacgaaguuuuuacuuuugaguacaguuucauaaaccucacucagcugaccuguacuaucugguuucagcagccauugaucugccguccuugugguuuuguuucuuuuucucucuuuaaauuuuauuagcauauuuaaaaagcaaauuccagauuguauuaguuucccauucuuacgacaaacugccuaagaaguaauuaaagggagggagggguuucuggcucucaguuugaggccauacauuccaucuugcaggaaaggcacuauauauagcaagaccaggaagugggaagaaugccuagaguuccaguuucagugauaagacuaagaaauggccccagucaggaucugauuuacaguuuuaucuauaaaguaggauaaaaaucccucuggucucgggcuccuaaaugcugacauuguagccauaugccacuauguuaagcacuaaacucuuuaacaucuugguauuuuuaaugauuaauuuuuuuacuaauuaauuaauuucauguaugugaguauacugucgcugucuucagacacaccagaaaaaggcaucagauccccauuacagaugguugugagccaccaugugguugcugggaauugaacucaggaccucuggaagagcagucagugcucuuaaccgcugagcugucuguagcccacaucuugauauuuuaaaaaucauucauucuucauuuacugaggcuuuucucuugaugacuguuuugucaugaaauauugauuaaucugggggggggguggacuacauaacuguuucccuuaauaaucuguaggauaaugaauugguguccuuacaguauaguggugauguuuuuagcuuucagggacuuuuagauaccauauuucauauacauucaagaccuuugccucuccugcuguggcuuuaguguucuuguaguguagccacacuuacuaugaauaguuuccuuacuuucauauuaagauaucccagguuuaucuuuuaaaaaacaaaaacaaaagcccaaccuacuuggugucagacaagcuggugauagcccuuuaaacauuuuuuuuuccuuaauauugagacucauacucauucuggcaccaaacaugcaaggcagcugagauugaccuugaacuucaauuguccugccuccauuuccugagauuauauaguagguaguacaauucgguacuaccacaccuaguuuacauggugcugggaauugaacccugcaucccggauccccuuugucuucuuacugagcagccuguuugcuugugcaugaaugcuguugugugguauauaguuguauacauguacacauguguaugcacaucuguauguaugugcguggaauucaaaggucaaaggcuuaucuacccuuuuugagagacacagucucucacuaaaccuagagcucaaugauuagccuacaguaauuaggcuacugcaccuaacuuuuuauguaugugcugggggacugaacucaguuccucacucucaaugcuaaguacuuuguugccuggacuaucuccccaacuugaagcagccuucucaguccucaaauaaagacuguauuagcaacaacaacaacaaaaccugaacaagguacacacacacaguuaaaauucauuaaagcccauaauggcuguagaacagucaugaggcgugaaaguaaaguguuugcaguuacagguuagaggagggaggacuggagaagggcugggaaacgugacuaaaguggaagaggaaagaagagugaguuuuuaaaaguucacuuagcaaugaaaauuuuaaaaaggauuagauauauauguggggaaaaaaaaaggcaugauagcucuuaaacucaaaauacuauucaaaguauaguaaaugaccuguuggaguggcuuuuucucaguucuccaaaauuggacucuucauggugggcggggugggagggguaggaguuggggguggggagagugucaguuaaacugggagagucuuucuuacaauuuauauuggugcugagcccaugcuagacaagugucgugucugucacugcaguucaguagcgucugugcuuugugcacugggagccucugauggccacacuuaacuguguaggcugugagcugggcagguucucccuccucccccagaugcucugagccugacucuggggugcucuggaaucagggaagcaaacagcacugaaaucuguacacgugcucuaggagauacagcuuuaguccucugcagcuucagugcucagcuucugcugcaacagcagaucuaagucuccagagguuaaggcaucccugccccagggcuugacagauuuggaugagacuauccugcucacucccagauugacacuaagcccugugccacuuagguuuuuucacucacauucuuugaaacgguguuucuuguuauucugacucuugugauucuauucugacacugugauucaagaccagcuucaucuuaaguaguuuucuuuuuuguccuuuuucuuuccauuuuauuaauuauuuauuuacaucucaaauguugucccccuuccuggucccuccuuccuaguaguuuucuuacauaccuaaaucugcccuucagaauugcccugacugggcuagggaaauagcugacuuuguaagaacacuuaacacacacacagcaugaggaccugaguuuaaaucuuaggcacucacauaaaaagcuggauauggccauucacaccuguaacccuagcacugugggagccagagacaggagggucacuaggguuggcagucacccugccuccacauuacugaaacccacucagucucaaagguuuaagacaaagcguacauacacaugugcauauggauccacacaucuaaagcagagagcugcccucccuccagcuucuuugauuuuuuuagaggguggguugggcaaauacuaaguaguuuuucauugcucaggugauuuaggauaaucuauaugacuuauaaaauaccuguuuagggcugaggauauagguaaggugguagaguucuugucuguuaugcacaagguccuggguucaacucccagcacagcauaaagugggcaugguagggcaugccugcaauccgagcaugcagaaaauggagacuuuagaaccagaagucacaaguuuucugacuacacagcaagcaaggucaaggacaaccugagcuacaauccuuagggagucauggggccucaagagugcccacucccacaugguagguugaucacagcugcugugggcucaggaguguuguggccaugcugugccuagcagagagcuuuccuaaauauuuuauccuuucuuuagguucuuacagucuugaaacuaucuucuaugaggugacuguggaugucccauuggucauugaaacugucuucuaugaggugacuguggaugucccauugaugacugagugugcagcagucagugugaucacugugaccacugugagucuguaguuacugcugcucgcugcggggggugucucuugugccaaaguugacagcuuuugcaaaagccuaagagggagaaaugaugggcauaucauagcaaaauuagaccuauagcccccacaggcccagcucugaccaggcuugaugagaccagaagggauuuccccccuggaguggagugggucucaauaccagccaaaacgaaggggacauaccucuauuuuauuagcagggcauacccuaccuaacagguugaugauauaccaugaaagacccaccauagaguaagauuguucaugacaauucucacccuggagccuggguagcccauucugguacuauagaggcuaccuagggagaaagauuuuuaaucucaguucaaauugauuucucugugaccugcaacuuagaucauguggcgucuucagcaguaaggucaucuaguccugguuggcagucaaccacuguggcaauugccuguguuguuugauauucucagaucuuccugaccagcgacuugggaggugagggagucauuggggacucuucauuucauaaccuauggcuucugagaguuagauuaucuacgcagucaaguuacuucaguucaacuucuuauuuuuaaaucagcuuaccaaguauccguaaagcuuuuucauaggguaggcacccuccuaauucccuccuguuuccuuuucuuccauuuuucuuacuuuuuuuuuucuuucuguuuuuuguuugguugguuuuuuucaugguaguguuuuucuguguagcuuuggcuguccuugaaugcguguguagaccaggaugaccucacacgcagagagauuugcccgucucugccucccaaguguugggaucaaagaggcgcagcacuucaucuggcccuucuaaccaaccacccucagucuucccacuuccuaguguccccuccacccaauagcauauguguucuaacacuacccuccugagauuggcuguuacuuacucuuaaauuucauuucuuuuuuucagucaggaucucauuaugcagcccuaccuggucuggaacuugcuuuguaaaucaggcuggcuucuuaaagagaucugccugguucuguuccuccuaccccaccccccaaaguuuuggaauuaaagaucuaugcuaauaugugugugagagauugcuuuugauuaucaaauaaucuccuuaauaagaguguuagaaauuagaaccagguuuuggagacuagaaagaagcauuaaaaagaaggaaaaccccucuacauccuuagcuguuggaaaaaugcgcccaaggcagcucacaucuccaguucuggccucaacaggcgcuaauaaguacagacagacacacaggcaagacacucaaacacauaaguaaauaaagacagcagaugacaacaaaugcugguaaggcuauggggagagggccagcggacaugugaacucguauauauccauuaugaaauuccucaaaauaacaguuuaguauaaccugacuacaugggucuguguauacaagucaacacacaguacucacucauccguguuuauugcugcacuuaauggucaaguaauggagccagccuagauggccaucaauagauagccagccuagaaaaugugguacauaacagaauuuuacacaugaaaucaagauauuccaggaaaauggaugcagcugaaaaucaaaccacauucaagacaagcccacuguuucucuccuuuggaaccuacauuuaaaauucaguucucuccucccucuccaucuguuuauauacauauauauguguauggcagucacaaaacaaggaucaugagaugagauguuaucggaugggaauaggaagauggaaugcaagugauaaagaauacuuugggacuaacugggagaagaaagagaagacagugggaaaggggacucaggaggacaaaguauaaugaggugugugauaagccuauugcuuugugugcuaacuuaauuaaaauaguauaagugaaaaaaaccuggauggagacuuagugaaaccaaacaagcuacuuuuaucugccccaccccaccucacccccaguuguuuucagaagugacugaaagguaccuggccuacauugaacgcuuuaucuuauuuguaaagcauuaaagaagauacgccuucaacucagagcuaaaagauuaugaauccucacaggaguagccauggaaguugucucgaagucguuuguaaaaguuagauauuguaugugaacuuuauugccuagugcugaguuuagagaauauucccugaaugauccaauguuuguauaacgcugcucaaauauuuuuagcuucuuucuagugaaaucauucuuuugcaauuacuguuuaauguaccucuggcuggccugaaaccuauauauagaccagacugguugauuugcuugccuuugcuucuugagugcugggauuaagaauauuugcuaccacgccucauccacaauuguucuugaucaagauaaauaaacgggggaccauucaaaaacuauaaagauacaaauuugaaauucauaaaaaguuuucucuuuuugaaauugguggauucugugauuugcuacuauauacuuaacuaagguauacgugguaaaaugguucuugucaucuugucaucucacauugucacuuuuauguguacaucuacaugcaaagcagauuucugugcacaguaacugacgggagacaucgugcuagauuacugcacuguugaguucugugaccugugguguccucucuucuucccaggcccagggaacuaccguucucuguuggccucuuucccucacucucuccccaccccucugucugucugucuuugauuagguuguaucuguaagggacucauacaguauuaaacuuccagugcuugauguguuucccucagcucagcaucgcucagguuuaucuguucauguucagaaaauaacaagauuugucuaagucugaacaagcgcacacucccuccguuacuccuuuaucuauuggugagucuuuccuuucuaucugucguggccagugucuagugcagugagcaugggcugucuucaugaggagcuaauugcauuuucuuuggauguauaccaaaaaauggaauugcuggaccguguaguguaguaguucucuuuuuaaaaguuugagaaaccucuaccguucaguaauggcgcacagguccuuccagcagcauuccccauucuccacacccaggccaacacuugucacccgucuuuuuuauagccaucccaacaggugcaugguggugucuuuuugugguuuuaauuagcuuuucccugaugauuacugaaguauuugaauauuuuaguauguauguguguuauuuuccauugggaacguguguguguaugugugugugugugugugugugugugugugugugugugugugugugugugugugugagugagcgcaugcucacacgcucacaugcuugcauucuuuggccagguuugaaauuaguuugauuuuugcucuugagcuaugaauauuccucaugugccuugauuaucaaccccuuaauuuuagguuuuaagaugaauaccugagcuuuucuuuguuagcacauguuuucuaagguuucugauacagcuuuuacccgguuggucugaaggagaaacuugcugcuugcuuagugaauagcaugaguguucugggcaaauguuucuaaacuacuuggaauccagagggcaaacaaauauucugaaagacucuggcagucucagcuuaguaauuuacuuuaagaaucaguuauaaugcuggguggaguggcucacacuugugaucccagcauugggaaagcuaaggcaggaggauugugaugaguuguaugcgacgugggauccuaugaauuccaggcuagcuuagaccuggaacauuuagauuagauaaaacaauaaaaacuggugcuucucaaaucaaagcuaacuuucacacucugucuuuuccagcguccugagguuagcauuauacuuuuccaguggagcccaugacuucugaucaggacgcuaaaguuguggcugaaccgcaggcacagcgaguccaggagggcaaggacagcucucaucugguagguguuguuagaggggaggcccagagggaggccuguagggcacaggccacaggcauccauuccuauuucugauaaagaacucuacauuggacuaaagcagagguuaacaguaacacuaauaaaguuucuuagaccauguguaucaaaugagaacagaggaacaagaacuuauucaucaguguuccuggcugagagcucuacagcaagagauacacagaagcuuucagauuucagagagaaagaccuacagggccaacuaugcuaaguuuuauaguaaaagaaguggauagcuauauugaagcauaauuaucuaaaagacgaugugaucugaugguauuagcugggaacuuagcuagagcguucagauuguuuuugguuuuugguuuuuugauaucuguguguggcauuccuccagauucccucuggaaugagggccuugugacauauuguuuuaugguauacuugaggagaaaguaguagaaauucuaguuuccauuuuucuguuucuuuuuuuccugguagcaagcuguaauauuucaggcugaaccauauuuguuugaaaaaaaaauaucugcagcuuuauuagcagaaacuacaaguacuaggugauacagaaagcaaaagacauaacuuuagauacuuagagcuuugaaucaggaaaaugcaauuugggguccacaaagugaguaaaagcaguugccacacaagccugccaaucugaaugugauuugcuguguuccacaguggaaggagagaacaaguuugucaaagcuguucuuugacucccauaugcacacucgcaucacccacccacccacacacaauguguacauauacacauaacacaaaagauaauaaaauaaugaaagaaaaugugagcuggagacauaugcucagcaauuaagagcacucguugcucuugcaggggacccagguuugauuccuagcucucacuuuaugacuuacuuacaucucuaacuccaguucuacggaaccugacccuucuuuccuaccuccauggguaccaggcauauagacaugcauguaggcaaaacacucaugcacauaaaauaacccuaaaaacgaaguauuguauauagugaauuauaugugaagagauaggacuuuauuugacuuuucguguguuguuuuggccaccuuugaauuuuagccuugggcuagagagauggccgaguguuugagagcacugcuuacucuugcaggggucaguccccagcauccacccuggcgagcucauagccucuuguaacugcagcuuuacaccauccuguggucccugaaggcaccugcacacacgugugaauacauacaugcauacauucauaaaaauaauacaucugaaaacaauuuuaauccugucaaacaauaauauuuaaagcuucuaagugauguugggaaaaacagccuuuuaaaauuaccucaauuugaaacuaccagagauuuuguuuguaauguuuagguagaacuucagaaguuauacauuuuaaggugccacuguacuucuggauaucauuauuuacagauuucuugcuauauaaaauugugauuuuuuuuuuucccaguggguuugguuuuacuuaaauugcuaugguuuaaaauuauguuuuauuaauguuaugauaauggaguuuuugauguuuucaauuuuacagaugaaugguccuauaucgcaaaccacuucucaaacaaggucccucccagcuuugacucagguaauucaguaaucacagacugcccaaccacagccaggacugcagguuauuacccaauacacacauauggagaggcacucaguaagaugucggcguuucuuaaaagguggaucuauucggcauugugcccugagugugcuaaauguucauacucucuuuuucacagugugucagacauaguaguuuauucucaaguauuuaugacaguuaaucuguuacguauguauaugauuagcuuuacauuuugauaacuuuuggaguauucaagucaaauccuaaguaauaaaagaacaagaaaacaggcuaacuaucuagcucagcugguagaggauuugccucauauguuaggggagauccucaggacuguguaauggcugugguagcucuuacuucucacccugucaugggaggcaagaagcaagggugggcucaggcucauuuuucauacagagcagagacaugagacaugguuuguuguuuguuuguuuggagaaaaggauaagggagugggaguucauuguuuuaaaucuugcuuuuugcauguauaugugcauauaggaaguacaucuccauaauauuacaaauuuaguuuaucuuuuaaguauuuuacaacucuuaggaacuuuacaguauaauaaacauuagugaucuauucucugaaauacauaacaucuaugaaauuagcacauagaagucagaggacaacuuguaggacuuaguucucucaaacauguggcucucggagacugaacucagaucaucagucuugguggguggcacuuuuacccggugagccaucucacuaacccaucaucuacuuuaaaaaaaaaaaagauuuauuuuauguguguguguuagugccugaauguaugucuccauaccccauguaugauccugaaacuagccuccaauuuagccuccaagacacuuccuuuagcuauuguuguauauuuuccuuaucauucuacucuucuuucauguauuauuauauguuaguauuuuuuuuuccccuaaggugagauuuugcuacauaguccaggccagccuugaacuugugacuuuucugccccggcuucucuuaggugcagagauguguguguauauuccacuacacuugaauuuaauuauuauuuauguuaggcuuaaguguagaauuugaugauacuuaguaguuugcuaaguuguacagucauuacagucuuguauuucuagaacuuuucuugugaguuggaaucuuccuguaugugugguccauguuggcuuugaacucucaaucaccuugccuuaucuuccaaguaacgguggugcaccgagcauuuugguggacaguuacaguuaaucccuggcccucaacccucaguagccgacggaaugaggaaaugaaaguguuaggcuaagauagaaaggaagugaauaggaaccaacugacuugacagaacuggagcaaagcaggccaucagcuaugaccucagcaagcguggaucccaggguaacgugaguggaagcgagauugcagugggcagagaugcaagagugaugggcacagcacuuacagcugcuuucugccuaagguccugauguugguagcaagaggaggcuaacacagauagggaugggauggcuuuggacauaguuugaagacucugggccucuaugaugugaucuacuuaaggaagaaacaagaucugaugacugaaauuugacaagguuaucaguuagagccacagauucugccagaaggaaacagucaccauuggaagcccaguaaggaacucagacucuauaaauccuccugcuuuggccucaggcguuuucuguuauagugguucuguuguauuucaccauaaaugagcaaagaugcuguuggauaaagacaggccauguuagugcuugcuuuucuggggagugccauguucuuuucuacucguaauauuauuauuugauucuuaugcacuaacuccguagacaagucaguaaaguuuggacugugucagaaugacuuuaagcauuucauuauauuuaauuauuccuuguguauguauguguguguguguguguguguguguguguguguguaggauuaguuaggucagagggcaacuuaagggaaaucagguuuuuuuguuuuauaaguuggacccaggggucaaauugggauugucaggcuuggcagcaagugccuuuauccacuaugccguuguguccaaucagaaauaagcuuucaaaacuacuuaaaaacaacaucagagaacuuaggcaaaggaacugucuugggcuaaagcuuggugguagagugcuugcuugucauuuacaaggcuaugguuuaacuuccaggacuuagcuuuucacccagcccccauggagaaacuauaccuuuugaugacauuguuucugagugaauguuagauuaacuacuacauguaugcauaaguaaguagguucacacucaugaaaauagccaguacuugcauuuuguuuguaaaugacaacugccugcuuuuagcacagaguccuacagguuaaaugcuguagcaguauauagugauuuuaggagaauucuuaguagaaauaccagugcauuuucuuucauaauuucaaauuucagcuaucuaaagaguaaagacaauaguaugugcaucucagugcaggcaucaugaacccuagcagucagccuagcucucacucucgugcuucaguucugccccacacaacacucuacacgugcauagaagaacuuuauucucuggacaguucguuaucucaccaucaacacuucaaaauggauuuuuuuugucauucuauuguuuugccugacagaauuaacaugauuucuuaacauuaagaauuuuuuuaaacauuuuuuauuagguauuuucuucauuuacauuuccagugcuaucccaaaagucccccauacccucccuacccacccacucccacuucuuggcccuggcauuccccuguacugaggcauauaaaguuugcaagaccaaggggccucucuuuccacugauggccgacuaggccaucuucugauucauaugcagcuagagacacgaguucugggggguacugguuaguucauaauguuguucuacuuauaggguuacagaucccuuuagcuccuuggguacuuucccuagcuccuccauugggggcccugugauccauccaauagcugugaucauccacuucuguguuugcuaggccccggcuuagucucacaagaggcagcuauaucugggucuuuucagcaaaaucuugcuaauguaugcaauggugucaguguuuggaggcugauuaugggauggaucccggauauggcagucucuagaugguccauccuuucgucucggcuccaaacuuugucucuguaacuccuuccauggguguuuuaaagcuagaaauuaaguaacucuaaaauguagaguuuuuacgauuauuugugugugugcgcgcacguaugugcgugugcaagggcaaguaccugugccacauggaacauguggaggucccgugugccaucuggguauugagcucaggcuugcacagcagggucucacggggccucucgccuagaagucucaugguuguaaguguacagaguaagguucugguauuguuuucuuuaaagggacuuugcaaacuaaauuuuuugguggcuguugucuuaugaaauauaauccagguaauacugaaacacugaaaaaaaagaacagaaguuugaaauuucuucuggcugugcuaaagaacuugaguuguuuuuagaguuaaguguuugaaaaucagauaaaaccauguauauguuucuguucuccuccggcuggcuguucugcagcuuuagauuccaugugccauuugaacuucagcacaagaagucugaugaaugucaggcaggacucuguugucauuaggauuuggauuugaguggcaggagcaugugacuacuuugcaaggagcuauuuuugguaugggcuguuggcuuagucuccaaacuguagcaaguuagugugagacacauuuguagaggcgcaaaaaaggacgaacauugugaugugaguucugaaguuucgauaugggcuguugcuucagcaaagaacucaguaaugacagugacaaugagaaaauuggccuguuacaaaaauguguggaagagaagaaaccggagaccaagauaaguaaaacuuuaucuucauuauuugauacccuugaaggugaggagcuucauacuguugaaaauggacccagcagagcagccgcugguguuacuguguggacuagaguuuuuaccagguccaggcacaaacaggaucauagaucaaagcagucauugaauucuaauuccucuaccacuucugaguucuuuuaugggucugaaaauuuagaugagguuaacaagaauuuagauacuguugcuaccgaagagaauucugagauugccagugauccacuggguaugaauagugauagacaggcuuguucugaaaaugaccagccuuucucacgugugcccaugucuucugaccagcaggagaaaacuuuuguaagugaccaucuacaauguuaccuggccacuugcaaaaacucauuagaaaaagaaaacgugcuaaaugguggaaucaguaguuuaaaugagaguaacucuguuagugugucugcuggagaguugcaaaauacaacccguauuuguguuggugacaaacuguguaagaauucaagggaaagcagauuuuauaguauuugugcuguagaucuggauuguaugaacauggaugagggacuguucacucccauguauggaacagcugcagaagaaagccauucagcuguuacuuaccaaguuuuccaagaggaucggcccuuagauaacagggaagagcauacugccucagaugccauacagagggcaggagagcgaaagcugcagcaggaagagcucuuaccccaagauguccucggcccacgugacacaagagaagugucuagugagagaagugaauggaguucugauccuuugguggacagugcugcaucugaugaagcacucaucagugaccugcaagcugagucucuaagggcaaaaguucaugccaaauucccuaaagaucacacagaacauaguauauuacauaauacuggccuacucccugaauuaacuauuaacauaggcagugacucauuacagcgcaugugugcuguaucugaagagagagagagcagugcuucaggaauaggaagucagaugggugauucacuuguuaauuuaccaagugauaguucccauguugaugggauugcugaaccugcggcuacaacaguuagcacuugucaaaguuuaaacucuaaaauggaaagagagcacaacucugaaaagccacuagacuguaaugauuacuuccacaucaguguuagcaggucagguaggacccuuuccuuuggucuagauaagauuaauuuaaguccugaaaaguuagcgucagagagcuuagacagggacuaucucccaguucaugcuaauuucaaagaagcugccuugagcaaacuugauggcccuaauccuauaucccaccggggaccaguguguguggaggagcaacccuugggggauagcaaucuggaaacuggaaguauccagcuggcaaacagaggugagcuguucuuguguucugaaaauaguuccauuugucaagaugaggauaaaaugagcauuuuagagacggagagccgugccaagagggaguugaaaaguuggugucaagcagaugucuguagagguaauagggcagacaaggcucagagagaaacuuaugauuuaacgcaagugaaaagugaaccagacacagaagaggugguccagaaggcggaucuccugaagcuuggacuuucacaaagaaugccaaaugacgagucucacuccagaccgcaucagggcacaguaacacccccugcauuuauuuucacuuguacugguccugaagcaagggaaacaggccuacaugacaaaacaggagauaaaguacaugugaagagcuugguugguguauuacacaaccaauucagugggcccuauguacuagcaaacgcugaaaaggaaccacagaaagcuaauuauagagagaucugugagaagaacacaggaaaugccgaguccaguuuucauugggaaaccaguguucuuagcaagguugugcccaaugggaauaugguaacuuguauugguauuggcauagcagcagauccugacugugaaacuaaucaaauugaaaacaguuacagaacugauggugugaaugaagacccagaccuuacaguugugccaccuuuaaaccacaguuuauugucaccugaagaggagugggccaacagugacagaagcccagaccugugucucauuaacacugaaucaauucaagauguuucuaaagccuuugguaaugaugcgucagaauugagcaaagaaaagcuaacaugcaaagaagagaacgagacacuugguuuggauaaagacaguaacaauccuaacagcacuggcugcuuaggcccaugcaagacaaaaaggaaaaaagccagguccacaguuaaagaguccacuuuacauggggagauacaguuuuugggaaacucugacgugacuuuuaagaaaacagcauuacaugacucuucugaagugugcucuucuuugauugaugucaagucuauacgaguagauaugccugcagcuaguccugguaaugcuccccuggcuauuccugccaucccagcugacaacacaggauguguagugccaagugcggaccaggaccacauugcaucacccacagaggguguaucugaaaaucccucagaaauggauuggcacaggaucccugaagaguucuaugcucauuuuuugaaugaauuuuccuauuacccugugggaggacuagcaagccaggcacuuucaggacuggcagguggguguggcagauaucaagugggcuaucugugggcuaacacagccacagagaacaugacagaagaugcucaauuuuuuaaugaggaucuacacagcaagccccaauacuuagaaaauacuucauuuuccuuggaacagaccccuuuucagcugccagugacagaggaugguguuauuuggggauggccaaguagagguggacaguuaguaaguaugcucucuuggucuuuuuguguugugcugugccaguuuuugccuuuugauuguguuuauaaaaauuaguuaguucuagguugugggcagucuggaugcuuuuuaaagacugaaugcaugaagcaucaauuuaaccuuuuucgaaugaaaaauacaugugaauuauugacauauaaaucagaguuuguguguaaaaaguugauguuaaagcaugccucucaaauuaacccccacucagcauuguguagaccacagcauuguguagaccuuuucauauggauacuguuuugcuaaguguaccuuacccuucugagagagguucuugucacaugggcagugugauguguuucagcaaguauuugaagucaccaacaacaugucacacuugcagaacacaaauacauuucaaguguguuuucuauuuguaguauguaugucuaagacagaaaaauuugcuacuuaucuggaccuaaaaucuuaguuuagauggaaaucacuuaugucccgaccuccaugguuuggaagaaguuuugccacugacacuggguagcuaacuugagcaucuuuguagaaguucuuuaauaaaugcauuuauuauucagcaacaggaaaccaguguuacucauaauacacacguaccaacguauuaguaaggaaaggacauauacuuaucccuuuguaugugaagggcauugguuccaagacccuauggauaccaaaaccauucuucugcauacuuuaugguuuucuaaaauacuuaaaauaccuaauaccuugcacuaucuuuuuuagcgaaauagcaagaaaaaguuguguuuagaagucccuccucaaauauuuuugaucugugacuuguugaauuuguggaugugaaacccauauagacacaaaaggcugaccuaaaauaggaauuuuuuuauucagcuaguaauuuauuuguagugauuuuuauagggaucaguaagaaaagcuuggcaauaggaagauuucacuuagauauuaaggagauacuuguaagauagggauaagcaagucauguaauugaaugaauugccuaucagucuugccucgccuacuuuuucucuguucuuuaaguauacacaguagcucguuaucaguugcuguuugguacauuuaugcaacaugcagacugagugcugucuuuauccuuguggcuugaagcaagauauaugcuguuuuaagcuggcuuuucaauuacuagauaauguucaagcaguauacuuauuucugguaucauguuuaaugguguugccuucauuuuaaaacuuacuuccaaagucuugucacagacauuuuaaacuaauccuauacugggagguguguuuuacuuucucucucucugucuuuuuguaauauauauauauauauacacacacacacacacacacacacacacacacauacauauauacauacacacauacauacauucauacauacacuguugcuaucuucagccacaaaccagcagaagagggugccagaucucauuacagaugguugugagccaccaugugguugcugggaauugaacucgggaccucuggaagagcagucagugcucuuaaccgcugagccaucucuccaggcugggugcugugucucuuuacugcuaaagggacagaaguagcauugaguggcucagaacucagggcaacuccaggaauacauacaggcuuuccucaggcacucuacccuuugcucuauugucucaucuauuuuaauuuccccguuacuuccccacucugacacuccuaguucugaccugcucugcagccuguuggugagacagaaugcacaaagcaucagagccugcagguggguugccucaucuuucaaagagaaccaguuaccuaccucacagccaaguucaaguggcagccauguucagcuugcuucugguuuuaauaacugaccaacccauacauuuucagagaaaaaauaauucuggcucauagauccaggcagguaaaacuaggguucuugaugauaauccuuuacaaguuucauauaccuacaagcaaaacccaucuuuuaaauaaauaguaguagguuggucuuuguuaaaaauauuuuucaugugaauuuugagaagucacauuuugaguuugcugauauuaggguauaauuuucuaauaauaucaucaccauuggcagguauuuagccuuucuuuuucuugauuuuucacaugaaauggggguagugaucccccucccccuaagcuuguugcaauuguaguaggagugcagaaugcagugacuuucuguuguuaugccagugggucuuggcagucucuucgcgcaucauuucuuuucaguacucucuccaaauccuaauuaacugcucaaaauuguauagcuuuccugacaucuggcuuggauauucucacuuaaauaaugauuucuuccuuuccuuuuuaaacauuucucauuuuagauuuuuuuuuaugugcauaaaaguuuugccugcauguaucuguguagcaugucugcacagcaugcugguuuuaggggaggucagaagaggucuccagauuuccuaggacuggaguaagaaguugugagcuacuauguggguacugggaauuaaacucugauccucugccaguucuccaguuguguccuucuaaaaaguagccuauauuuagccacugagccaucacuuuagcacccaagauauaauaauuucuuacccauagggucaaagucauuucugaacuaaaacuguuguggaaaaauguacauuucugugcuguuaaguauucauuaagcaccuuucuacuauguucugaaugcugcuggguauuagcaauauagugauaagcaaaaugugucuggugucuaccaccccauaguuauguagagccacagacacagcuuagcuguggacaccauggaagacuaacuaugccauacuauaauaauaacuccgagugcugcuugugggcacuucacagccaggaagccauguaauccgucuuuauaaacuacagaacguauauuggucauacuucucagcuacaaaaggcacuaagaugaaaaagauuaaugucaguugcuauuaguaauuuaaugaauguauuuaguauguacaugugacaagagucuguuaauauagugaaugaaacugaaauagaagaacuugauuuucuguuuggggaagagaacugagcuuaauccagaaagugauguaugcauauagucaggaaagaaaaaauaagucauaugguagagaauaauauaauaauacagauaauaauaguuauaauuaaaacaacagguucuuuggagaauucugaugcuaguuuuaugauuccaaauaugugggaaucuuuaaaaauauacaaguuauacuucaguaaaguuguuaaaacgugugguugugauugaagaaucaguguuuauugcuuacacuuacuuggaggaaaauucuggccuuuuuggaaauaccaaaguaaagaauugcagguggauacuugcuuaggcaucuguuuugugggcaugggguuuuaguuuuugcccagugaguggcaguggcagaaggucagagucccuuucagagaaugaacgugaauacuguuugacucagcagccuucuacuugcaguguuagaaacaguuguagggguuucccugggagcuccccaugccugcaacaguguggauuuaaucugccuguuuauaauuacaaaucuccaugcuuccuugauauaacucaaaacucauuagcggugucucguguguuauugagugcagaaauggguacugucuaugcugaacccuggagaaacacagccucccuguucccagcuuagaacacuaguuugagguacacccaggacuggggccccuugucucugcaugaggaggcgcuacuucaggguaccauggcugguggugugcuugaaaaggcaaguagugugccgggcguggugccgcacgccuuuaaucccagcacucgggaggcagaggcaggcggauuucugaguucaaggccagccuggucuacaaagugaguuucaggacagccagggcuauacagagaaacccugucuggaaaaaccaaaaaaaaaaaaaaaaaaaauagaagaagaagaagaaagaaagaaaagaaaaggcaaguaguuuguugaaagagugcaguggcaaauuggaguuaguauuugggaaauaaccacugcugagauguuuuauuuuucauuggguugggggaaaaaaaauccaggguuuguaaguagaagaaagacagauuuuaucuaucuauuaucuaucuauauauuuauuuuggauggggggaggaaauggagaagauccacuuaaugaggggauaugcuaagcuguaaaauguacauacaaagacucaaagucccagaaggaaauguaccgaaguacagaagugcuggugcgcuagaaacagcaagcaguagugugugggaauugaacaaggccugagagguggugauccuguaagaguguuuguucugaugcucugaguuggacagccuuuggagggggucucuagcaucugagcaggggaugcugcuguugucauuauaaccagugagcuaaugauuuagugagugcccagugugugcuaggugucaugccgagugcuuuaagcuggcaaugucacugcugcugcugcugcugcugcugcuaccacuacuacuacuacuacuacuacuacuacaaucugaauuuuuuuucuuucuaaaauuuuuuuucuuucuaaaauuucuaaaaccuguacauuaaaaaaaaaucaugcagauuuuagcagacccuaggucuaaagaccucgacuaacuucuguacaauugaauagccauucugaacaugaagaucacacccuuucacuaccaaguauacccuuagguaauuauccauuaccaagaucugaaaaauuccuauucacuuuaaaaagugagacuggcaagaaaaagucauuuccaggugauguuuauugagauucaguaacugcacagcugucuguaguaguguuagcacaggugagaacccuagacuggccgugucagcuucaccugcagcuuccuguagucgcucuggguaguucguuguucugaagcugcggagagaauagggaggcucucaggaaugggugcgaguagcucugcugagaguguaagggguuuuccugccuuagugauuuguggcuuucucugguguuucgggagucuuagcugcuaggaggagcucugguuuucuaucucuugcuuagugcuuagagcuuuauaaguaagauguuucacuuccauuguauugaauuuguaaaucuauaaauugagauuuguguuaggucauccaggaaaucacagguuauaaaguuuugagacugaacuuagugaaaugaaggaaucuguagucauuuguaguguguagcaagcccugggccuagaagaaacuguaagggugacuuagcuagaguucugacugugucagcuuuguuucuuuuugagccucauuuaaccccaaaggugugugugaauagcuagguuuggccuuuuaagccuaaacucuuaauacuaauguuuguuuuuacuauaaacuaacaaaacagcauuuguugaacuuaggauaaaaauacauauaugugaauuuuuuuucuaggucccaacaacuaagguuucagagcuaaacccuaaugcaaagguaugggggacucauauguuacauuuggaagcgaguagugcagcuguuggugugaaugcugcgugggaagaggcucccggccauccuacagacugugaccagcagggugaguagugagccuggagcagcuugcuguuagccaagccuuugccuuccuccgcauguuaaucugucuuuuccauucacaucuguguccugguuugugcuagauuuagagucuugggagcuuuuauaguccauuuaaaaacuuugaguaaugccaauguaguaagggaauuuacuacuuuaaggaaaaguuauucuucuaacacauccucuugggauaaaacuacaguucuaggauuggaugccaauggugauggcgacaaaagucgagagaaugcagcgcucccggacgcacaggaggcagagcagacagacaugagcacucuggcucuggaccauucagaauaugaaccucugccugagaacaacgauacggguaagccugcuguaugaauuuguuuucacuuagaaucugggauuuuaauuguuaaauguuaaaauuuacuacuuuaaggaaaaguuauucuucuaacacauccucuugggauaaaacuacaguucuaggauuggaugccaauggugauggcgacaaaaguuucuuggucuuucuuuaaacuguguacuuuucauugccuccuuuuacuguuccuugagacugauggauacaggagggaaagugugcuggagaaucaaguggcuucugagacaaauagcauugaguagagaagcacaagguuuuucauggggugaaguguccagacugacagaggaauugagagugaggcaggcugagagucauagacauaggacagaggcuuuggaagcuggacuucagauguguuguguccccuuguuacugcagagugacagaaagaaagaaacuuggggaagcaaaccuguuggauacauuuuucccuuuuuaaauuuguguuuauuguugcagcgugucaucaccucagguuuuaaaccaaggccugucuucagucugcggugcucacugucaccuuuuggaaauauaggaaagcauuaucuuagugagcagaccaaaggggccaggccccugcugugugagacaaccucauuuaguuuaagacucucaaauaugacaaaauuaagcaucgccacuuagguaggaaauauguuuuuuaaacacuaggucuuuuuaaaacuggucaagugaauaagguaagaauguauaaaagaaagaaaaaaaucaaaccucauuacuuucuaguaaauaugaauuagccaucuugaauuuaagugauuuaaaccuccauuuaagaaaggguucaccagcauuuagcaauuugacuugaucagcucuuccucauuaaccuaacacuaacugguuaauaguugggauaaacuagaguaauggugaaguugacuuuuugauggcagaaccagggaagagugcuagacauuuacaguagauuucaaaggggagaguaacaggcauugcauaaguggguggugggguccucuaguaaugaaaggagucagagauagcugagaguguagggugcauuuaaaucuuaaccugggaacagaggcugcaaaaggcaccaaguagauaauaucaaaaaguaaaauaacauguuaaagugugccuggaaacucuaaaucaaaaguuuguucuuuguaaacagguauuuaaagcuauuuuuggaagaaaacaaaaaccuucuccuuugaaguuaggguguaugccaaugcgaaaugcuuguggguaaugggaaaaugguuccuuaccuccaguuuuguuucuggugugauuuauaaaaccuaucaguuuguaaaguguuaacaucugcacuggauucaguccucagcacugggguggaagcagaugaagggaaggcugagaaggagccacugugagagcuccuacugcagugggccagagucucccaggaguacaggcaggagagcaggccgccggccaggccaccucaagcagagcucacggggaucccagccugaaucuccgcagugucuccagcaucuuuauucuuuuaagauguuauucuuuacuauucuuugacaguuuaauacauguauguacugauguuugaguuguuucaaccccauuaccucccacccuuccuucccccaaaaaccccucuccuucccagcaaucauucuggugucuuacccacugaguuugacgaaauuggggcuuaguuacuggcaugcucgcugcuuaucaguggucuauuguuuauauagccccucuccuagcaccuaguaacaucaagggguaggccuucaugcauuucucccucccauucaugaugagugaaacaauaacagacucaauauugcacaggucagcccagcugugguuaggucaggacagugccgugucaugugccgaacgaagacacuguuuggcagcacgcuucaucuucuguuaggcuaucaaaaccuuggaugcggugauacagauacccauuuaaagaguguguuagaauucacagcaaaaacagagcaauccugaagauguccguguauucgagcgugcuugagcaugcgaggagcuaacaggucuaaaauacccucagcucuaggcaaaagaguaaggucacaaaguaacuauagaguagacagagaggugaguagauacccacagcagagaaccagagccaguaggaaacuggaaguguaguuaggcuccggggagacaggaagagaguuugaaacuacugggcacugugacugaauuuuacuuucaagagcuugcuuggggccucacagugacuauuagagacugucuggugcuucuggcagaaggaagugggaaagacccguugucaagaaugcagagcacgcuaucuaccuugacagcaguugcccucagaaggaaccacaccugucaaccagccuuuucuguucuccucuuaccacaaaccugaaugaggaaugacauguucuuccuaacgucuuuuuuucugccuugaacaccacauuauacuuagucaucauccuguucugggcuccucacucuuaacagugcuuagacuuuguuuuuauaaucuuaacaguuuugagaaggagcagccguguacugggguacuccuguuugaaagucuucugacguauuuuccaccaccaugcuuauauuaaagagugaguagaaauugaugaagaugaagcacuguuuucaucaugugacaggaaugcacacuuggugacaaagaaacuucacauuguagcugcuguccuugacagccugcugacgucccauugauuuuuuuuuuuuccuggucuuuucgagacaggguuucucuguauagcucuggcuguccucaaacucagaaauccgccugccuuugccucccaagugcugggauuaaaggugugcgccaccaaugcccggccccauugauuucuuaauaguucaauaguuagaauugaggaguggugcucauucaugccaaggaaaauacugggucguuuauuuuacuuuuuuuuuuuuuauaaguagccucaguccuuguaucugcuuccugcugguggugacucacuggagucucacuggugucggucagucccgcccacagcagccuguccucaugagcucuccucuccuaccgugcacagucuucgcuugccugcugugcuuacugucuguguauccgcaccaucgugaaccuccugcacugcuacaucagucugggcuacaucagguucccgucauucugguuguuauuuaaagguucuaaauuuuauggcuggacaaacacucuaauuuagacaugagcaagacuccggguuaaaaauguugaacuccaucugguaggucugauggaugaccacaguucaguauaaacucucagucuugccguugugugaauccuuacagaccagcuucguucucuccagugucuucucuuagagguguaccugauuuugcuaccaguuuucauccaaauccacugaggaauaggacgauuuugcuuuuguuucuuggccaggaaucacuugauucugaaagucuugugagcagacauggugagaaucaggcguagcaugcaugauggcggaggaggaaaggagaagagcucugcuuuuuuuuuuuuaagauuuauuaauuuuguauaugaauacucuuuguacaugucaauacucuaucugcauguacauguuacauguuacaagagggcaucagaacucauuacagauggcucugagccaccagguguuugcugggaauugaacucagaaccucugaauaagcagccagugcucuuaacugcugagccaucgcucuagccccagucuccaucauuccuacacaguaucuucuguacaccuauguccuuccaucaagguccuucagagcacuguucugugccuuuaucauggccucgugaccugaccagucccuccugaauuuguuuaagccuuaaguuguccuuacaagugugauaauugcauuuaucuagcucuuuaaaaauccuauucugaagcuggacaugguggcgcaugccuuuaauacuagcacuugggaggcagaggcaggcagauuucugaguucaaggccagacugauccacaaagugaguuucaggacagccaggacuauacagacaaacccugucucgaaaaacaaaaaaacccaaaacaaaacaaaaaaaagacccuauucuggccaggccuguuuuguggauuuugguuuuugguuuuuccucccugugguauuugaaccucaugccucuaacagacuccauagcgcucuaacuaugagcuauauaucucacccugcucuuacauuacguauuuuguguguguguguacguguacguguacucgcgcgcauggaggcacgugucuuacauguaaauauacaugcggcuagaagccaaccuccaauguugcucuucaagagacauacuaacuacgucaccacgucucucagugggaucugggccucguugguuaggcugaggaguugacuagcaagcuccaaggaucugccuguuucugcccgcauccccacucccagccaguguugggauuacaaguguguaaccucauagucagcucucauggaucaggagguugaacucaaguccucauuugccuacacaaaaacacauaccaacuaagcugucaccccagaccacugucauuuuuguuggugauuucuucauccuacuaaaucauucccuucucucacuuccaguccccaucuacuucaagguagucuuacaugguaggcucaaugggccagaugcuuccaguagccacuggcauuuuauugcugcagaguggaacauuagugugcuccugagcuaaauagcaggcaggccuuugucuuccauacuuggcuuuggcaccuggagggcagucuuccgucagugacugugcuagcaucuugaucauacugcugcagcuucucuuucugucuguaccauguaaccaugguggucuuuccaaaauaucacccccccaaauugguuccagucacauucaaauaaaaauuucaacaaucuccuugaccugaauaucauacaugcuucacucugugacuuccuuuucacuccacuguuguacagccuccuuacugucuguugacccugccucucgggccucugucugaacuucacugcacucuuuucccccauuagcaaauggcaccuccacguaggguagcaccaugcuacucuggccugugcccagacuguuucuucugagucacuugagucucauuaugcugacaauggcuucuuuagcaguccuuugucugucucucucaguggaaugcuggccuggggagagcuggggccuugcuucuuuuaggcugaauucacaguuccuguaucaaauaauugucucuucaauauggagauuggaaugugaguuuaaaugagauaaccuggggaaagucuccaguucagggauuaacaggccacaaguuuucacuuucaagucucaugaucuuuauuccuugguuauuuuugcaguuuaguuucuuuuugcuagugaagauguauuuugugaaugcuccauauguugugaaugcucuguaagacacuguuaugaacugucagcucuacauuuguucugaauucccccaccuugucugccuuuuacuagucuuuaaccuugacuuuuagaauacaaguguccuuuguccucucuuggcugacuuauguacaaaaacucaauguguucaaugccuucaaaccagugauacuaaauacuaggugacaagguuguccugagugcuacagguggcaggggcuuucagccgaacgucacacugcuagaguccauugccucaccugcugcugcugucugugaccauauacacauaccuguggugccccaaacaucguuuccgcaacaguuuccuccagauguagaacaagcucuugugcccugagaaucugaugaggacucuuuaauaaaaucguuucucauuugccccuuugacagcucuccuauagaacaaauggcccccguaucagcagucuccaacucucuuccuuaccuuuccacuggggugguuuggguucaccuguauucucuuugcuuuguuuugaugcuuucuuuugcaauuacuuuucuuuagagucagugugcuuguuugcuaccugaaaaccuuuucugaaguaaggcaagauaccaaggaagccugugcugacugcugugggacagagucacugcuagacuuggccaaugaaaugccauugcuuucucaguuauugcguuuguuuuguuuuuucacaguuuacuuuuuucuagcagguaaaauaguacuuuuuguauuauugugcguauaugcaggugaaaucacugaaaugcuguacugaauuaccaaugugcuugguaaauuuuaagccauuuuuuuccugaguuauuuauuacuucuguguaggaggaaaugagucucaaccagaaagccaggaagacccucgggaaguacuuaaaaaaacauuggaauucugcuuaucuagguaaggcuguuagugauauuuucuaaugucugauaucucuuguauuacacauuggcuauugauuacaaaugugauuuuucauaguaguauguuuauaaauaucuaacuaaaugccugucuacucaucagaagugcuauugagaacugguagugacccccaggccagggauccucagauccaccuuggugaugauugucugacuguuguuugacuauggauuucagcauaugcagaacacgcugucgaccuucagaugaauguccaaaacaccucuuuagugggcuucuuuauuuauauggcacucacauuuaaauacauguuugccuuacuuucccuuaaaugacaacuuguuggaaaacguugaacuuuugaguuagugaaaguagacauguggauggguagguaacuggcaacaaaugaaguacccuguagcuccgaggacaucaccaugucugaaagaaggucccacaaagacaagaaggccugcuuaagauaaaguaacuaucuaagcauccuuccuucgcuuuaucgcaaccuaguaaauuaccaaguuuuagcaaauggcaugccguaaaaaugaaacauacuuuuguccaaguugcaaaguuccacucccugccauuuacaaaccuuguuguagcucucccauagcugagaggagggacaggugagcagggcuccucucacuguuuggucuucacugaaggagggcugugaaacccaguacuguguuuuuguuuugugguauguuugagacuguguauguuguauuacauacggucguuucccugagaauucacaggaaacauuuucuuuggcccgccuggcauaaaguaguacaucguguccuccuuguuaguauaugguuuuccuuccacccuggcugcaggugcuaauccuguuuccuucuuguuaauaacucuggcugccuagaagcugaaacuuggaguaccuuuaacauguguccagauguuaggguacauuuggggacuaucuccuggcccuuuguauuucuuguagcuuucuuauucauuuagcuagauuucccuauuauuaaaaaacaaaacaaaaagauggacauuuuuaauaaauuacucaaacauuguccaaaacaaagaugaacuacaacugcacccuuuuuugcuuguuuuaaguuauuuauuguuuuuuguuguuguuuuuguuuuuggguuuuuuuuuucuuuuucuuuaagacggggucucucucuauugcccuggcuauccuggaacuuguuccauagaccagacuggccuccaacucagggauccauauugucucucuccuuccuggaagcugggagaugaaagugugugcaccaccccuggcuauaacuauguguucaaagaauccauuuguggcuaauuuugauuguaucaauugugcaaauaaucaaauggaguuuagacucagcucucacuucaaagcugucccacaccacacccaugccucguguaaaauugguaguauuagaggugaaaguuccuuuaaauaaauaucaguuaaaagaguuugcuuucuuucaacagggagaaucuugcuagcgacauguaccuuauaucccagauggacagugaucaguaugugccaauuacaacgguagcuaaccuugaccauaucaagaaacucaguacugauguggauuugauuguugaagugcuaagauguaaguagauaacgauuuaagguuauauuuauaggacuugggguaaaugagauacucucucuuucuggacuucuuaccuuucgcaggcuccuagaacaggaaggaacauugguugaaccuacaguguaaggucacaaauauuauggguaauugaaggagaaaaagaaucuuuuuauuagacaucuuuaaagacagcuacuaaauuaauaaaaaccaaaacaaauaauaacauuuaugaaguaaauauauauugguuuagcuacuaaaugauuuucuuuccaacuuguugcuuaagcuuuggugaaauauuguuucucuuuuuucuuagaaagauacugggaauaaaguuguuucuccagaauuuggcacauacagugaauguuuaaauacuacauagugucuaaauccacagccacuucaggagauacauguuaccuuuugugucaaaacuauuauuuauuuauauucuacuugauuugggggacuucacuaccuuuuccacuuuauuuucuuaaaagagagaaaauaccuucaccuuagaugugauuggcauaaaguaccacauuuaaagguuguagccaguuaguguugacacuuggguacauaggugaagaaacaucacaacugugagguuaagguuaccgcuguuccucucagagcuuugcuggugcuuucuguacguacuuugcugugauguuucuguuuccuuuuaaaucaaauuguuuuuauuauaaaaaugcacuuuuuauacucaagcuacaaauuccaggugagugauuuucccuguucccucccuugagacugaugugugugugguccagcuguuguggcuuucucacaaagaacaugguauguuccaccucacacaugcuagcacaccaguauugcuuacaaacguuugagugaguagacauugcuguuggaaauaaagucuuaauucugcugaccagcuuuuuuuguaggugugugucuauguuucccugucccuauucauugaugagacagucauuucaaaaguuuucugugugcacuugacuuaguaguauauuaaaagauugcugucuuccuuuagaacuuaauuggauuuaaaagacuuuuuaaaauuuaucuuuacucuguguguggggggguggaugcuaugugguuuuauguaccacagugugugcacauggugcucaggguaacuucuggaauuugauuuuuuuuuccuaugaguuuuagggauggaacuugagucacugggcuugagcaacuagcaucuugaccugagugagccauuuggccagccuuaauugauuucucauuuuucuaucccucuacaaaaagcuaaagagcuggcaaacauaauuaucaguaggaccuuaaagcauuauaugacauuuuccaagauaguaguuuacuuuucaguauugccauuuagaauacaugcuuugggggugggguaguugaguuaguucuguuggaucuaguuaaaaagaucagcaacuuggccguauuugucuauauuacacuaagucuguggaauuauucuuauguauuauccuccagcaccacugacuaaaguugucaguuuucacuguagaaaggagaaaacccauuaaccccgugucuggugcuuugaggauuugaucuguuugaucuacagcugucaccucguuuuguguaucuuugguaguucuugaagaaaauuuuaaauuuacauauucauuuugaacauuuaacaggaagauggguuuaaacuguguaguaguuuguuuggguuugaacauuuuaauaguucaccaaguguacaguuucucugguguguuugcuaacuagugcucauaucccguuggagugucguguaauguuguuuuauccuuuuguuuucuccucuccacagcuuuaccuuuaguccaaguggaugagaagggagagaaaguaaggccaaaucagaaccggugcauaguaauacugcgugagauaucggagucuacccccguggaaguaagugcugccuccacuugcgguacuugacauuuuccugggauuuuguuguugguggugguauuuguuuauauaucuguuuuugauaggacuuguuuaaaaaaagauacaaaaacaccuuuucucaggauauacacacugguaaauacaaugugauucacuuguagaagaaaauaaccaucacaccuuuuguucucaagacuccuuuaaacauuuaaaauuuuuaaaauaaugagguuuguauauuucaauaguuagaaauuaaaaauguaauagguuuagauauguagugggugggaaggcuacauggugugggucuuuaugacuuuacaucuuguucuguuuacaucuauugguuuguuguucuuaguuuguuugggcuuggggcuuuuuuuuaccucacuggauauaacucuuuuugguugguugguuccguuuugguuuucuagaggcaaggucucacuauguauaguccaagcuggccuuuaacucaugguccuccuaccucaggcuccugaauguuagcgacguaaguaugugccaccaugaccagcccaaauauuuaccacuuuuagugguuucaggcaccuccaccugcagcccacccagcugcuugcagacugugauaacuaagaaugccacccaaaacaaaacuguaaacuuacuuaaaacaugaguuuuuguguauguuuccuucguaagucaacggauucuuaagcaugaacuuuguugauaauaucacuugguuguaugucuuaguagcccuucagucagguucuguuuuuuccuuuugccugauucuuuugagagaucuuguauaaauccauucguacugaaaacaaccuuuuuuucaccucugguauguuugagagaauccugauuuagagcuuacuaaaagcuuuuuuauuugcuuuguuugguuuggggcgaggaguuaguaaaguuccuggauugguggggagugcuuucuccccaacaccccaauuccuguguuuuaaacacauuguucucugguuugcauuguuucugcugaaaaaaaaaaucugccaguuuuucucuuuguuccucucugucuuucugugacucuugggaaauuuucaucauuaucaagcuuuuccuuucugagcauuugaaauggacauucaguaacuauucugguuuugcugucacuuguauuauuuuaagguuaauccaauuggucuuuuucacuauaagcagccuuuucuauuucuuaaugugauuauuacuucagugagugguaaaaccuucagauaguuuugaauucuaauaaauauucugagauucagcuaaguucccuggugguguguguguagucccaacugcucaagacuaaggcuggaaaggcuguucaaggcuauucugagacacauuugugaagugguucagaacagccuucauacagggcacagucuuguuugcuugcucucauguucucaggguuaagacagacuuuccacucuggcugcccaguaagcuggcuguaggguuauucuaccuuacuauucuaguuguuuuguuucuggcuaaagaccuaacgaaaacccuccacaaagcucuggagacuugcccaucuugugaccuggaaacccuaggcuuuggcgcucuuggccccuguauguucuuucagagaaggcucuccuagccugcuaaugacagaugucuaaaaagcuuuauauagcuuaucuuuuuacuuaugacuugugucauuuggggccauaaaucuauuuaacuuagccagaagcaaaaguucagcuaauauuucuaguuuucaaacuaccuuuuaaauuaauuuguguauuuauuagccuguugauaaaauacaauguuuuuucccccuuccuucccauuccccuucucuuccuucucucucccuuccccuucgcucuccucccuuccccaucgucuuguuaagaauccuguauuccagagcagcacagaacucuguagcugcggaugaccuucaacuuaguugcucuccuugcuugagugcuaguauuacaagcauguaccacaaugcucaguuuauguuguauuggggaucaaacggaagguuucuuaagcacuaggcagggcgugcaggcccuacuguucauauuaaugcuaguuccuuguggggaagggaaagcugucagugauuacuuccuucuuuguggcaugugauccgugggugcucccugcagugcuucugaaagagaccucacagcugcaucagagcaugagagaauacguuuuccuccuaauuugauagauaaaaagcagcgugacugaggacuaauuucuaacuucucuguuuucuguaggaaguagaagcacuauuuaaaggagauaauuuaccaaaauuuauaaacugugaauuugccuauaaugauaauugguuuauuaccuuugaaacagaagcugaugcacagcagguaaguguauuccucugccagccugugaagucuguaguuuccccauguuucaucaguguacagcagaaguuaggacauugagguuauuauagcaacaccguguauguuuuuguagcacugcugaaagaaggucacauuacuucuaaguguauuaugaguaagcaguugugggaaaucaaaucugcucucauaucuggggaaaauuuuuuguuugcaaagugaggaaauuugaaccuaacccugaccagugagggaguguccauuguguggcaaagugcuuucaaagguauugagaaguuuugugcucuuaaaggaggugucugauuuaggggaaguauaccaagugugaaacguuaagcacuacaaacagagggucagaaggaaaaagcacagaaaccuagaaggccgaaggguagaagcucuguucuguggccguggccugccuggugagccagaugggugagcauaggcggaacugaggagccucugcgugaaguggggcuugauaaagacuaaugcucagacaguagauguaggccuacguagugacagcagcacaaauauuccaaucuccugucccugccuucuaagaccuuccuuuccuacauuacauaaucucaguugcuaguuggguuaauaggagggaagcaguauucuuuuguaucuaaauugaagaguuuuagcuugugguuugaggcugcuuauaugguauuuauuaauacuuagaagguuauuuaaauauuuuacaauaauuuggggcacagauacuauaauaaggaugcuuuuagugaccugugaacaaaagagggucaaaaaucacucuuuuuagauccugucugcuauauucaaccauacauaucauuaucugagcuguaaaguuaacuuacaaaguuaacagaacgguauuuuguaucauuuuuacccauaggcuuacaaauaccuucgagaagaagucagaacuuuccaaggaaagccaauuaagguaaauaauaccauugcauauagcuuguuuauugcauuguuaauauucuuaaauguucucaugggaacauguaacaucuugaaugucuccaaacaggcgcggauaaaagcaaaggcaauagcgauaaacacauuuuugccaaagaauggauuuagaccucuggacaugaaccuuuauacccagcagcgcuaugcuacaucguuuuacuuaccuccaguguacaguccccagcagcaguucccucuguacagccugaucaccccccagacguggucaacaacacauagcuaucuugauccacccuugguaagccuuuucuuuguuuuaaauuuacauaacagguuuacauuagguacugcacuaggcacucuaaaagcuuaaguucugcucuaaucagagaaccacgugucuacaguuugucuaguguacagaccucagguuuaugguguggauuuacaguuuaauugggcaauaaagguagaguccugugcaacagaguccugcgaggcugugauccuugccuccugcccucuuagcguugccuuucugugaagcacaguacaguaaaggcuccagcugcuguccugcacagggagaggggcuugacacaaggaauucugucguagaagaagauguaucucaguaguuuccuagcaguccgggaaagcaggagacauauagaaugucucacaaaacucaacauacccacuuuaggguuggccuuuguuaaggucugugguuuuaauuuauaagucuguagugagcauggucacuuuucuccagcuuugugcaauagaccguaggaaacauggacucugauuugacuucacugauguagugagguugugguaagguuccgugauaagaacaucagccuugugagguaaaguccuugaaagugaggccaggugacaaagcuggaugaguucauaucuguaggcuuguguggcacuguugguacugauguaaauguaaggaaagguaaagaauagaaugcauagaaggaaauggucagaacgcagaaaugaaguuauuaacucuggaagacugcguauccagaguguggcuguggacuagauagagaacaagugggggugcucaggaucaggugucuggaugccgccugccaccugucagguagagucaguaccacucauuggcaggcaagcaggagaggugugggaaagagggagcuugagacagaguuguucagacuuuaaaaugcaguugcuguuaaauacugaaagaugaagauaaaugucuaugagaaacugaguacauuuaggagcggauacugcaaaaauagauauaaauagaaaauaccauuaaacuuaaagcaagaacugaugagccauuguguguaccuuaaucugguguucauguuucauguuaacuuagaagaaggaucaaagaaaggaaggucugaggauagaguguguguacaaaggcacccagguugcuaaagaucagcuuuuauucucaguguaccaggcagcugggaacgggggugguaaguugcuuucauaagaguccuuagacacauggacuuugaccugguucuuguaggaaguaauguggaagauuucauuuccuuauauggaaaugggcuggagagauaacucagugguuaggagcacugguugcucuuccagaggaccuagguucaauucccacacccacguggcagcucacaacugacuguaccuccaguucuggggaccugacaccuaugcauauuaaaacauaaacaauuguuuuuaaaaaagaaaaaagaaaugacaguauguuccauguuuuaaagguagcucucuaaccauguguagaacaggaguuacagaagagucucaggcccgugacacuccccucccuccaguucuauaaaacacugcaguacaaaguuugguauaccauuucuaaaaugagaacuuauaucuaucucuaaacuuugaaaugaccagaggaaaauacauggagacauaggcauagguaaagacagcaacagugggcaaacaggguucuguccugcuuaaaaguuucuacccaacaaagaagcaauuaccguaguagagacaaccuguacuggaagagaacuguuagcagauuuauccaacaaaggcuuccuacccaaauucacaaugaacuaaaaagaugaggugagggugcaggggaagagauucuuuguacacgguuccugggaauauaaauuaguucaggcaccauggaaaucaguguagagauucugggaaaacaguaaaaguggaccuggaguagcaucuaguuuaccacccauggcauacauccaauggaauaaauaccuuagacaguagaggugucugcacauucaucugcauugugaacuauacacaguggccaagucuggaaaucacuuuaggugccugucaguuagugaauagauuaauagagaaccaugugcuaacuguugagaggaucucuuguaagccaucugucaauaaaaaagcaggaaauaggaagugggacacuugcaagaagagaggauucuggcuaauaguaagaggaaaaagagacuaggggaagagaugagugauggacaucagguagaugaaccuggagagagacugagggagacgcugaagaggcgagaaggaagaaguggucugggacugaaagagagacaacuaaccaagugguagauguagaaugauuuaaauguaaauaagagcuagacaggaaaugagcuaacacuucuggccuagccauuuaauaauaacuaauuagucucagagucaucauuccaggagcaagacugggaaaggaaaaacagauauauauacacacauacauacacacacacacacacacacacacacacacacacacacacacacacacacacacacacacacacauucagccauagagaagaacuacaucacaucauuugcagggaaaaaaaaagauggauccagaguaagcaaaauaaugcuagauccgacaagugcuugugguuuucucacaggcggggcaugaagguugggggaggggguguuugguuuugggaggguccagcgugggaaggagggcagaagaggcguaggagggccagguggccacgauugagcgcauguacauguggaggagagugcccagugaagccuuugcacuguacaaacgauacaggccgggaggaggcagaaggaaacaaacgccugccucuuuuugaguucuaaugagaaggaaguauguuucuaaaaaggguacacuuucugugggcacagacccuuggcuaugugguugcaucucccagaagugucagaucuguagaggaauugucccaguagugcucuucccccacgugccugccgcacaggccugccuugccgaggucuuccugcaguggcauacucuugucaccucuugucauacuccuugucuagauaccuuuucuguuguuuuauauccagguuuucgcauuuaggcccuuuucugagguauguuauguguaaaauuauguaugaguuuaagcuggaguuuuguuuguuuguuugcuuguuuuguuuuuucgagacagggucucuguguagccuuggcuguccuggaacucacucuguagccuauacuggccuugaacucagagaucuaccugccuuugcugggaucaaaggaauuaaagguguguguuacuacuaccagaauggucuugccacauuuaaagucuccuaaacuuaggucugaguuaagaggcucuuguagcauguaauuuucuuugucuuaauuuuuaaguuaaccgacaagguguaaugggucuuacuacugcauuguggugccuguguauuauuauguuuguucccacuaauucucuucucccaugccccccacuuucuccucuccgagagucgccucugcuuaaugcuaguguguuaccucugcuuuucccuccucucucaugaucuuccuccuagguucauggucucuucccugcaucugccuaccacccuucaaggcuagguuccaaauauuaaagaaaaugcacaguacuuaucuuuguaagguuugguuugcuucacauaauaggaugguuccguuuccuggcucuuauaaauaaaagcaguaauaaacauggguaugugaauacucaaggggaauauagcugggucacgugguaguuuugguguccagacugguuucuauagauaguguaaauuggcuacaccaucuacacuaguggcuaguuagaguuccucuuuuuuuuuccccccaauuuuuuauuagguauuuacuucauuuacauuucaaaugcuaucccaaaagucgcccauacccuccccacccccugcuccccuacccacccacucccucuuuuuggcccuggcguuccccuguacugaggcauauaaaauuugcaagaccaaggggccucucuuuccaaugauggccgacuaggccaucuucugcuacauaaugcagcuagagacaugagcucuggggguaggucagcauuuguauccuucccuaucccgggcucagaaagagucuguuuuugcauucccugaggcugaggcugcgggugccuuuucaaguguaaacuugccagucaguguuuccuuugaggacugaguaguguccaguucauuggcccauuuauuagguggaugauuugggguuugguguuuaguuuuagauuucuucagauauucuagauauuaaucccgugucuguuguguagcugggagagacuuuuuuuaagcaguauauuuuuuauggguuguggaguuugucaaguaguggauuccauaaaaguauuuucgucacuuuaauuuuuuagucaaggaaugauauguuagcucuaauagcuauuuuaaaucagaaugucuguuuccuguuaguauggaagaaaauugcuuagguucucccucccuuuccuucuuccuuuucucagcuguaugggaccuguauuucuuucaguucagugaaagaucaugggaggaacuggaaggccucaggcagcuaaguccuuggaaaguaauguguuuacuuggagaguauuugaaaccgcaugccccagaggcagaaaggugaucucacucuucugucuuguuguuauugguggugaugcuggugauggugaugauagugaugguuauguuuucgugcccaugugcaagagugugaaguuggugcucuccuucugucuuuauaugaguucuagagauggauugaacucagucaccaggcuugaacagcaggugucuuuacccuuccggagccaucucacugugucccccacccuugguuuugauuuugguuuuuuuaagagguuucucuguaaccugacuauccuggacacggacacacacacacacaacucacgcaggccauuaggauccuucugcaguaaagcuuuacgagagauagaugaucagcuucaggagaggagacccagagggcagaaaacccuucccuuauauaggcugcgaaguacgguuagaaguacgguuggagacgugcaccaccaggauuggcugcccaccuucagccagaugaagccacgagagaggcagggcucagguaauggaaagauacccugacgccugcgcacauuuuacuacgagcaacuaaugucagcgccaucuuguaacggcgacugugagggcggcuccucacaacauaccacaccacacuacacacacacacaccacacacacacacacaccacuacacacauacacacacacacaccacacaccacacacauacacacacauaccacaccacauacuacacuacacacacacacacaugccugugugaaccaauggagagaucugccugccucugccuucugaguguuggguuuaaaggcaugcacuaucaugccuggcaacacugaguuuuuaaaagugugugucuuugugucuguagcuggacacaugcuaggauauacauggaccagucagaggacaacggacaacucucaggagauaucccucugacauccgaggauugaccugaaguggugaaaucugugucccgaggcugcugaguuuuaccuuaauuuuauguguuaagauguuaaaagcagucgagugguacuuagaauccugcauuuaagcucuuaaacuuuuuaaaaguacauuuagcucaaaucuugaagccauuauggcauguuguaauuuucuuuugcuuuauuguuguuguuuguuuuguuuuuguuuguuugcuugucuguuuuauugaggcaggguuucucuguagccuaagguguccuggaacucucuuuguagaccucacugggcuugaaaucagaacucagagauccaccugccuuucauucccaaguucuaggauuaaaggccugaaccuauacuguuguauuuauauguucuucaucauuuuagauuauuauuuauaauaauuuauaaugauaaagaacauauaaauacaacaauauaugaaaaaaauuauagucugaaauauaggaugcuguuuacagcaaguuuuacaugaaaguaaaccuuaaaaggggcagggaguggagagaagaaaucccuguuagaagaugugggaguggcauacgcauggcuaggggcaauaagaaugugagaauuccuaaauuugggaucuuugcugguuuuuuggguuuuuuugguuugguuugguuugguuuuugguuuuuuuucgagauaggguuucuuucucuguguagcccuggcuguucuggaacucacucuguagacaaggcuggccucaaacucagaaauccgccugccucugccucucaagugcugggauuaaaggcgugcgccaccacgcccgacuucuuugcugaauuuuauuaaggcuauugaaaauaaagagucaucuuccucuuaccagauuggaaguaguuguacuuguaguaguaacuuauuuaagcaauugagcgcuaccuauguucaggacuccguguuguuucuugcuguucucauuuggucaguauaagaauuaauuacaugauagggagaaaguucuuagcaauagugcucgauagacauuaccuguaguaauaaugugaguuuuuuuccuuacacugcagccauuuuuaagcauaaaauagaaauaacaccugacaagaggaagacauaaucggaguuaccuaagauacaacaguguaaauccaauugaaguguuucguguuuuuacaugcuuguuuuuuguuuguuuuuguuauguuuuguuaauccagguaacuccuuuuccaaguacuggauuuauaaauggguuuacaucuccgaccuucaaaccugcaacgucuccucugacaucacucagacaguauccuccuagaagcaggcaaguucacggguugcuuucagugcucaugaacuucauguugcgguguuccagauugucuguaauaagagauguguguaaccacucaaugcucaucagcgaugagacugccugguacuaaaaacuguaaucuaaaggaagcccccaauggaugccagcagugaggaggagauucuccucagagaaggcuuugggggaagcguuuaccguguguuuauucaguaggaagcagaucuugacauacauaguucacauuagcauguucauucuauacuccuugauugcuuuauaacucagcauauacaaacaucucauuugcaggaauccuaguaagucucaucugcgccaugcgauuccuaguacagagagagggccugggcugcuagaaaguccuucaauauuuaacuucacugcagaucgauuaauuaaugguguccggagcccacagacgaggcaagcagggcaaacuagaacacgaauacaaaacccuucagcuuaugccaagagagagauuggaacugggcguguggagccaaguagucuugaauccucuccugguuuagggagaggaagguaagucacucacauauuuugucaaacagauaucauguacggaucaugaacuauuaauauuuuaaguuucaacuuagauuuuuauaauuauaucguaauacacuucagaaaaaucaaauagaaggcuauacaauguuuuccuuaauuccucaggauagucaggguuuuuuuuguuuuguuuuguuuuuuguuuuuuucuuaaacgaaugacauuuucuuucauaaaacuaagcugguauuuuaggagcuguacaguuucuaaccugcucuuccugcauacaguuucaccuuagcaguuagcccuggcccucgaggucacugcccugcacagacuugggcucuaaggugugucucguggguuccuggccuugcuuucuuuagggcugguaguaagaaggacugggcaugcggcucagcuguggagugcaugccuagcauaaacagguccuggcucugccuaguacuccacacaaauuaaagaaaccggacuggagcuggcauugggauauaguagacagaugugagucacauagccacacacgccagcauuuaaauuccguuucuacuaaauguaauuagaaacaaaagcugcucuuauagagcaauuccuauugccacauuauuuccauucuugagcaaguaguucuuggagucuugauguguguugucauuaucuagggugauuuccauacacugaguguaagcgacuguacuucuuccuguagccucuaaugcagcuuccuuuuugcucaccgucucuucuccugccguuuauacuuccucuaaagaagugagauuaggaaagaaacaggcggccucagggucugcgcccugccccguguuaacuaggccuguugcuaaugcgaugaagccugucaggauuuuccucuaacaaaugcuaagcaaaacuucagccugccuaggcuuuuucuuuuuaccuauuuugaaauguuuaaaugaaaaaacucuuaagcuuuccacacauacuuaugcagcaugauuaaugaaaaacugaaacucaagacuguugauuccucuuccuugguacagagucagaccaaaggcacaccucugaggugcagcagguguuggucuaaagcagcacgauaaagcagguaucguggcaaagcaagccacacaggcuuuuguuuagugugcugggugauucaaaguguugaagguuaggauaggugugcgauacccaagacuaagacagugcugucuaguuucuuuguuuuaaaagcauaugcugcuguuuauuuuacucacagaucucacccccugcuacugccuaaucgcccagugguagucuuaaccuuuuguuguccauccauaccacuggaagaccugagucauuaguagcucuaucucagaaaccauauuuuugcugaucuguacgaagcagcucccuaaacuauugaaggguggauaaguacaguuaggaggaucgugaagccggcugaucucagaucucauccugcuuccagagcuccgaagucacuuccucccaugaaacccccauccauccaucacuguugcccuccgacggccucucaccaaccgcaggcguuuuagcagcaccugagacgcugggccuuuccaaaggcgcucaguugacuuucucuuucagaggauugcuguugucuacgacuguuuuguguguguguguuggggaaggcuauguguauuauguuuaucaacuuugggucuugcucuugucccaugucccuucauuuugaggacaauuucucucauuuaacuggagcucaccaguuuaggccaggcugguugacuacagggcuucccuugucccaaauaccccaauaccaggauuguaaacauaaccacuuggcauuuuuauuuuagaggguccgugccucuaauguucuuacguauguacagauauacaucuuugggugaugcacauagaggccagagacaaucuuccucucucacucuccaccuuugucugugacuaaaccuggagcugacacuuuggcaaccuuugcaggcuaaugagcuccagggaucugccuguugcucccuguguauacugggguuacaggcagagccauugcaccuggcuuuuaugcauccugagauucaaacucagggccucaugcaauuuacaaaaaccaucucccuagcuccagugcaugguuuuuaaaauacggguucuguggcugaagcucaggucuuaaugauugggcaucaagcauuuucugacugaccaucaucuacccaguuccuaugaaguccauuuauugaacacuaaagcccaaaaguuaaaauuauuuuucggcccaugacugcagaaugcauguuguuagguuguuuuuugguuuuuguuuuuaacauguuauuaaucuguuuccauagagcuuuuggauggccaggugcauugucaacaaacaauaguaaucugaaaagaaugauuuacucuuaauaauacauuuucgguacuugcuuaaaacauugaguaaccaugucauaauagucagaagcuacaguagucccugguggagagucagcuggaccauuaaaagcuucagugcugggcauugacuucuguagcuggcauguccuaaauuguaucuuccuucaaugggaagcuguuugacuuaggugaacccucuugugugugcugguagcugggucuucuggcuaccucucugcauccucugccucagagccugcuacuucaccugugcucuggugucaggggggauacuucuuuccugugcgucacaugccaaccucugucagcauguacaacuuccuugccucucucacucccacaggacugaaaagagggagccuuguuacacaucauucccauagccaucugggaauauuguggcucauuuggccuuuugucugggucacuggaaugucuucugucagcaggaaggccaguuggcucuccuguuacucauggauucacuggcugaugugugauggcuauucagcgucucucugcugugaugugccuucuccacuuagcucaaucauuucuagauuuuaaagagaaagacauauggcucuucuuuucacuuaaacacuuguaaggcauugcacaauucauuucaauauuguuguaccccagggaauagggaaauauaaagcuggucaguaaaguuucagaccacauauucaucuguuaaguucaccaucuuacauaggugaagcucuugacaucccagagcaguugcagugguaaucuuaaaacucagacuaccacaaaauacacaauaaaguuagaaauauugcugacuuuuaaaguguggcacaaagacacaguaagugagugacauaggggaaauagcauggaaauuccugcuuggcuggggcugcuaccuguaaaugcucauaaccaugcgugaaggacagcauggaacaggaggagaggaucucuuggcuuucagugcaguuugacggauuuggaagcagcaacuccugucuucagugaugguggcagcaucuugaagcuacugugagacaggccacaggcaccauggcuuaauagaacuaacaauggccugugagucaucaaggaagaaagcucuuccagccauuuuauaccaaauggguuauuggagccugaaaagucaaaaggguagcauugagugaguaacacagugacaucagguggcagccaaggaucauguuugagauucuuaaagacuagaaucucgagagaagggagucugggcaacagaccuucuggguccaacagguacaguguaaaaagauuguaagcugaaggguaaauuuccuauguucuuccagaacuugguaaugaaagcuuagcagagcuucugucagaggaaaagcaguguuugcagaauccuugccaccuuacaaagugaaaaaaagagguaggccgagccuggaagacaucuuguuaagcaguaugcucuacuucuucggugacauagucacuguuagucucccaauaguauuugaacuuccaaguagcuugggacagguuuaugcuucuacaagacagaugauggcgauucuuacuguuucucaacugaagaguuaacguuccuaaguaagaucuuaacacuuccagugaaacuugagagaagcuaguagguucacuuuacuaacaugaauggauguaacuuucaguccuuguuuuugagcuauggaccaauggaaccaggauuaauguguagcuuccuucuuauugcaucauauggccauguccaaggguguauucagaagcaggaggggugaucuagaucuuccuuccugaaacacuugcucuuccacugagcucacagaucucccucccacugcuuuucagaggacuuguuacccauuaacuuuuucuguuggucugaagcacugagaggcucccauagcaucuucaaggcuuccgucguguaucugcuacccuugugcaugccaaggucaauauaguaaaaaacuccaaacgccaggcgcugauuggcauugugaagcucuguuagcucacagagagaagcauugcccaugugugggguccaaaacaugagcguucccagaauccaguugccgauugaguggugccaggacugucuccuugccuguccccugugggcuguggccucuggcugugucuuuacuuugcaaucacuuugugagggaugggcacagauaacguguuccaggacauccugccauuacagaauucaguacauuccuagugggcuaucaaggugcucugaaggcaguaauauuuuuugugggaggccauagacuggcaggaagacacuugucaggcagcauugguauugcuacacacauaccugagggaagccagcccagugaugagccuuuaugguaucuugaggcagcagcguaacacaggugcucacaauggacccacgugcccaaagaccuggucacugggaccaagggaccuauuccuacagguugcugcucaugcccaccuuuguggcacauagcucaucucuccucaggcauuuagccccuacuaagcuaaccagagggucuguagagcaguccucaagcuuauuauucuaauaaaaauacuuuaggaaaaccauuuuuuucucuuuauguuuauauaaugaaucuccuuuggggaguguguucaauugaaauaauagaagagauaaaaaguaaaaauaaaauuacaaguuggaagucaugugugucuuguuaggcaacacaaacucauccaggaugcuauaaaucuugaugcagcggcucacuguggagcugcagggcacagacuuucagccuuucugcccagggucuggcugcuguugaugggaaggcaagcuugaacuuuagggaccucuuaagguuucagagguucuuaauguggcuuuugcaguaaggaauaauuauaguuuuuuuuacucauguuuuaaauagcucaccuaauauaguuuaguguuagauuuucuguuauauauaucuugucauuccagcugaagggauuuaaacauucaaaucuuagaaauucuaaguagcuaguagcuacuaagaauaacuauuuuucucuuaucuuucuggauaucuaacuuaaugauuuccuuucaacauuuugauuuguuuguacuuuuauuuaagaccauaagaccauuuuguuauaugauacaggcugaccauaagcuugccagccuccugccucggccaccccaguacuagaccugcaggcgugugcugcaaugccucgccucucacugugcuuuuaaaagcugacuuuuagaauccgaauuuauucaugaaagauuaaacauauuaaagacugguugaguuggugcaugcugcuuuguauacaugaaccaaacauaagcuuugcaaauuuuucaagugaggggaaaaauaauggucuuuugcuuucuucuaggaaaaauuccuuuggcuaucggaagaaaagagaagagaaguuuacaguaaguauauauagaguguguguguguguguguguguguguauauguguguguguguacucacacacacaagcucacuaauguaugaacccauccacuggaauacauaagagccaaaaggagacuucagguaucuaucacucucaaccuuauuguuuuuagauagucucuuauugaacuggaagcccccuguuucagguagguugguugccagugagcuccuuugauuaucccgucaaugcuagggcuccagacauccagcuacauuuaucuuuuuacaugaguuccagggauuuaaacucagguccucauguuugcagagcaagcaaucuuacuuacagaaccaucucuuauccccaaagggauaucuuucuaagacauuuaaauauaagauagcaaacaugagcacuaauuaaguggauuaagacugagauaugaggaggaacagagcaaagaacuuaaaaagugauaucauuaaacuguaacugacauguuuggccuaauuaagaaaggauuguggaguuuuuaggaauacugaugacugguuuauggugugcuucuuuaauauguaaacaaaggugcugugaacaacucagguacgaguucacuuuuaugaaugguuuggucuauauguuguucagaaaagguccucaguggguaacuauagugggauuuuaagcaagagcucuccucccaaccacugggaagcaucuaagacuggagagugcaugcugaaaccuuggcuaauaggaaacaucaaguuuguuuggauguuagaugcaguagccaagcuagcaugagccugucuucccucugcagcacugugagcagaggcuucguuuguaccauagaucuuagcaaccuagggguguggaugucuuucuucccauuaguagagaacuaucauccuuuccucagcaggaagcacuuucuggcuucucucuuauugacauauuggagccacugagguauggguuacuuuucaacaagcucugugagaucacauuugaucugaucaccaagaaggcuaccaagagagugguuguaagggcucauagcugggugaacuugagcugaaagguuaucaguacagccucuguuugguuugucaccuuagauguauuacaucuuguaaccugcuuaucuuuggaauuuuguaaguguguguguguguguguguguguguguguguguguguguguguguguguguuugcacgugugaauaugcacagcucacauguuuggcccauauaugaaggucaaaggacaacuuguaugaguaguuucuuuuuuucuuuguacugugugguucccagggguuaaguuuagguccucaggcuuagcagcagacuuuuggccacuguacccucacacuggccuacuguuuacauuugaacucugacguuauuguuuucuagacucugcuuacaguuuaucaugguggccuaaguuucaaguuaguuggacccuaggaauuauuugugcaacauuuauaaauuuuggggcgggugugaaaguuggaagauucuuugacuugcuuucuacccuugucacuucacacuugugugaccuuacggggugcugcuguguugcagagcagucagacgcagucuccaacaccaccaaagccuccaucaccgagcuucgaacugggacuguccaacuuccccccauuaccuggagcugcaggcaauuugaagacagaggacuuguuugaaaacaggcuuuccagcuugaucauaggaucuucaaaagaaagaguaagcuauguguuacaguugcugauguuuucuaggcacugauuuguaccaggacuugacccaggucuuuugcacacauuagaaaguggggggggggugagguuggggugauagcuguuuauccuuggagccagcucaagccagccuuuccuugccaucugcugggguugccguugaagccugugcuguacagaugccuagacccauaagucugaauuagagcagaaauaagacuugugguaaucuacguagugcacguaggaagaagcuuaggcucgcucugcuguaguguaguggcuucagguaaacucugggcugcaucguggucuuucacuacaguccucaucucaggagaucccuuuccaggccugccuuugaaggacacuuagcuagcaggcuggaaaugggauuugucccucugccagggucaguguuugaagacugugggacauguagagaaauuacuuucugcccaauuacuaagguauggcuaagugcuagggguacacacaguggggggcuguagaauacaucccuccugcugcaugguaaacuauggcuguacaucagauagcacaugugucuuuucauuagagggcgggacaccacucuacuacagaguuuagagccacaguagcggcugccauaguuacuaggccagaugacuuugcuauaguaacuugagauuaaggucagguaaaaguugaaucucagauugggauaguaauugccacuguuuuuagcauggacacugaguuucccaagauccuaacuuuucuaguaaggguuacauguuagaguugagaugucuuggacaguguaagucuuaacauucaccuaauaauuuccaguuggcuuauaaaacagaaaaugaucauuucagcagucauggagucuuguuuucaagcauguccuccucccuuaguaauaaauaagagaguaauaguaggccuccuagcuccaaagacagcugcugcucggaauguacuucaguuucuguggaaagcccuguuuaaagaaacaauuauugcuuucugaaaggcuguucuugacucuguggccaaguuacacagucuucacugcugccaguggugauaugucugcagaaacugcagaggacuugggacaauaggccaccuagccccuccgugcuugaccuggauuuaugacucuuugcaaagugccauauguaucuguguuagucaguguuuaacacacgaugaaucugagcaugcuuuuacaaauagaaagccauuagcuuccuuguguuagguuucuuucacuuguucucaauccagcagaaccucugucccccucccauacuccccccccccccucagcccccuccccggcaaaaguauaaauuguuccguucucccaaagcugaaguuccagcuacucuauuccagcaacuuuuuuuuuaaccuuugaacuuacaccuucuuugaagagaaaagcaguuaguaaauuuugucuuuuuguauuuaaacuuguagccaauuacuuaacuugcccuaaaaucacaugcuggguuaaugacacaccauguguacacuuguaugaaucacggcuccacuaagcaacucguugaugggguaaugucugauucacucaggucuuaccuuagugaccuugccuauuaaauuggauaaagcacuuuuguacaccugcuucuaagggugguuuguggauucucaugagagcuccuguggguaucuaccucccaccacugggcacucagauuuauguaagcauggauaugucagucuuuguuuuguauuaguuacaagugugaaucauaguguaacuugguaauuccaccccagcugauaugucagaucccugauaugucagaugaguaagguguguuuggaagcucuucacuugaaaagacaaacuuacggguaauuauaaugcaucugcugggagcaaaaaggcugagugcugugcagccaaugacagacucaaaaugucauuauguuugcuggaggcuucuccugugucucugcugugacuugacaguuguugguaacaugccauuguuuuguuugcuuggaguauggauacaccagucggcaucaaucguagggguuaggaagcagucuccaaagauggguuagagauugccgugguuggacccuuaacuucuugggcaaagauaugacaauugcuaaauacuacuuuaacgguuuucagaaccucaguacagaugcaagcacaaacacuguuccuguagugggacccagagagcccuccgugccagcgcccugugcugugucggcagcauuugaacguuccccuuccccgguccauuuaccugagugaguaucaguauucugccagcccucugccagguacaaguuuaagugcucuguaauauuaagugugguucuuaaaccagauggcauuuucacagggaucccaagguggcagaaaagcagagggaaacucagaguguggacagacucccuucuaccccuacuacaacugcauguaaauccgugcaggugaauggagcagcaacaguaagugccuugccugcccuccacagcacucaggcaucccguguguguccugacucugacgaugggcuuucaguagugugugccuucauuucucuguaugaguucacugaggucuucuauuucagauaguaacaaggucccaacucuguccuguauggaguuuggugaccucuguauuuaguguguguguuguacauaugaaaugauuagcuggguaguggugguacacguauaccuuuaaucuagauacucuagaggcagaugcagguggauuucugaguuuaaggucagccuggucuacagaacagauuucaggacagccagggagggcuacacggagaaaaacacagcaacaacaaaaguuugucugcuucaaaggcuuagacagauugugggguggggggucuagaggaggggcaugggugguucacggcuucuucauccuuugagggagggaagacuaaggucaguauguaauauaugagagaagaauaaaaggaaaacaggguaagggauggaaugaagcagaauggcauaaagagcaacacgcuguccuguugcccugcuuaugugucccagugacucugccagcucuguuggcuuaggcccuuagguccaaugcuugggagauggggcagagagauaacugcaaauuugaguccugugaucuacauagcaaguuucagccagccagggaugcacagugaggcaggaguuccugcccuugaugaucuggcaucucuauacuugggaggcagaaguaggaagauugaauuccacaagucuguguaagugccaaaccagcuacggcucugcaguaaugcuccauguggaggaucgggagugaagccaucucacgaccugaccgcugugucacacuguccccgccugcucucuguguaagcauagcacuugcacugguccugacuuagaucaaacgaagaggggccaggguuugcaucuuuguuuuucccuugagccucauaggcuuccauguuucucaagaaugcuuuaaggcuuuguguugguccccauuuuauuguugugccuuuauggcugcuggcuguucuagagaggcaucucuauagcaucuucagagggaaacuggacuacaaggaaagggagcggugucuuuaagaucagagacaucuggguuuuuuagucuuuaaaacuuaguguuuuuuuuuuuccaagacaaccaugauuagcuuagaaaaauggauguguauuuucaaauuauuuaaaucuaacauaagucaagagacugcauuugugcuucaggaagcaguauuguuacaaugucccuauuuaguaauuauucuuccuucugcaguaauuucaacucugugacauaguccaucaccacauccuacaaguauaccaauaacuuuuuuccucacagagugaauuuuugauacuguacucguguccacaagcucuagaggcguuagcuuugaugcugaucacuagcugccauagacaugccagaaguugcucuugaauuuuaugaaucucuuaaaaguaaaaauacccaugaagaugaaauuguaauuaaaacaaaaacuuuaucuuauauaacuucuucccugaaagagcuuccaucccugauauuuuguauacauaaccccauauucuauguuuccaggaauugagaaagcccaguuaugcagagauuugucagagaacgaguaaagacccuucuuccuccucuccauugcaacccccaaaagaacaaaagccaagcacugucgccugugggaaggaggagaagcagcugucugagccugucgagagacaccgagagcccccugcccuuaaguccacgccuggaguccccaaggaucagaggaggcagccugggcgccgagccucuccuccagcugccgggaaacgccugagcaaggaacagaacacgccucccaagucuccucagugagagcugcgugccugcgagggcucuggaagagcuguacccaccgugagaagcucucccacucaguacggaaugagccgcugguuaggagcuugcagugucuguggggcccgugggauaccugcaaguuacuuccuucugugagucggauauucccccucuuggaaaaaaaaauguauuuuucaggauuuaauuauauaauauaaaccuuauuuuagguuggugcuuaacuggaggugauacagaagucugguguuuucaggauagaaaauguauuuauccuaacaaauggauauuuuuuauuaagccuccacguggcucugagugcaaagcuauaaugaguuuuucuaaauuaagggaacucugcuacuuccuuuuuuuuuuuuuuuaauaguuggucuacaagugcgcauugguaggguguccagcagauggaugggggcugauggcaggggcaggggcagccuuggccucacagagcaagggacuggcaugucaggacacugacagacuggcauaggagcuguguuuucaucuaaacccuuagcaacagguaacucuagcuuuaaaacaagauacagauguacauacaguucuuuuuugaucuagugggcagaaccugcaaagagcacccuagaaagaccugaaaccuuugaguuuugauguccugcgagcaaguaaccagccucucacuccaguuccaaguggcuacuauguaaaauaaauucaaagcacauugugaauagaaccuagauggaauuagaaacugcugcugcccacugaugucagaaguuguacacgaugugugucccugugagugaguggcuaccuggcucucauccuccaugcucucucugugucccccacacucuggagagucgugucuuagccagcucuguguggaugucuucuugucccucugcaucagcacguggauuuagaaguaccuagccgugagagagugcugucggugguccccucuggcuugcgaggacagaguccuugcucuuuuaccuccaggacgaggguuuucuugauuguuucagaagcugcacuucugaggagcgagagugcagucaaguuagcaaguucauaauaaaguuacagauaaauuauuuuguuuuaaaacgccuaagauuuuucuuuaaguauucuaagcagcagacauuaaacuauuuccugcuauauguaaccauacagcuuauuccacaaaaugcuauuuaaugagacugaagguuguuuugguuucuuuuuucuuuuuuuuuuucuaaggaaaaaaauuauuuccauccaauauuuaaagacuugaauuuuauuuaaacuugaaaaugacuuugccuuaacuuuuguauaagacagcuuagagcucacggagaccugccccuggguuggcgggaguggaucgguuacucaguugccaugcggaucuccugguguugguuuugcugagaacgcauacuguuguacaagaacuccagugguuuuuguaacauaccuacagaucuucaacaguugaucuuuuuucagauuguugaaaaguccuguaaaugcaaauagucgcuacuguguuaaaucugugcacuugggagugugcucugcuuguacaguguaaauaaucagaacauaugagaaagguacccuacagagaagaaucugauaaaaauuauugauauauuauaaauguugcuguugagcugauguagauaaacuaaauguugugguuugaguauuauuuuaauuuguuaagguuuuucuuuuuccccuuauacugguguguugaacugauuuugccucuuugcugcaaaagggaaauggaaagucuuauugaaagccuuuggauguuuucauacucuuaaaaagaauguaaguacauacuaaucauaugugauaugugaggguuuugaaggagaguauagagagcagagacuggcaggaucuuccaaugaaaguaaaaaacagaaugugcuaauuaaaauuauacucuguuaagugauuuuuccugccagaggcaaagauggccugaugcacgugaccauuuccuucagagcaacugucauucaguuacauaggaguauacgcagugcugauguuucagacgccugugaaaggaacauaggacgaauuuccuuauagaugucagaucacugacaaaaaaaaaaaaaaaaaaaaagaaagaaagaaagaagaagaagaaaacagcuggccucuugaacccacacuagcagauacugucuaucuggaaaggcgagccugaggccucaggcccuucacaucacaucuuugcuggaagaggggccaaauuauggucagcaccccuuacccccaagggugcucucacagaggagcuuugauuuuuaaugagaaguccuuuccccaaggcugagcauugcagcacgaaaccuguguggcagagccaagcuguaggugcuugcugucugcuggcuggaaguguacagcucaguggccacacgcaagggcaggugggcagaugcacgaggugggacacugauuacugcuuagccagugacagccuggcaucaggaacuaaagccuugcucagaugugauuuuuauaagcacucguuuuucaggaagcaaaggugauaugccaaauagcuguauaaugucaaaacagagacuuccugaacacuuugagguuuuccacucagaaaaaaaaggaaguuaucaaaauaggaagcuguugagggugcaugcagacucuugcuaugucacauccagcaagugugguauguggcuuucauaaucuauuuacguuuacucauuccuuucaguaucucaagguauagaaucagagauaccacagucacaaggaccuuuuuaaccuguaaaauugugugaugaugcuuacuuaccauauggaaauacggacuaggaaucuggccccaccucaccagacaggaauuucaagugauuccucucucauagucagugucaugaugucucugugaaccccuccugucauugcaucacugguugccacuaguggguggcaaaaaaaaaaagaaaaaaaaaagaaaagaaaaaaagacaaaaaaaaaaaaggaaaaaaaagucuuauauugcuguauuaggguuucugcaguugauauugaaaaacugguccagugugucacagcaggcgacugauggugcauaccugucucuguguccccuucagugagcuguaguuguggguuugugugcuuuguagccuguuauacggaaagcaacagacaaucgaagauuccaggagugcuaacuaacagcugcaagucacagacggggaguguaacaaguggaagcuugccugagggcuucuguuucuguucuacuuuucauuaagacuggagucaagcuuacauguaaacuauuggugauuuaaguuuccuuuugugucauuuuuguguaaaacugucuaauuugaaaaaaauguagcuuaugaaaaauaaagauuuaggcacuguucaauuuuucuuuugauucuuuuaaauuaaaauuuucuugaagaaugcau

SEQ ID NO: 6883 - RNA, 5314 nt, Mus musculus
guacaccaaaauuuuuaaugacuuuaaagacaggaugaagucggaccacaagcgggaaacagagagagugguccgugaagcgcuggaaaagguggggcugugcauugcuggggggcgguggagagugcaaagcuucucacaggagcggcugagccaguauuccucauaguuuacauuaguaauacuuucuugcuaacagccuuuauguggaccaaaauagugggcacagagccuaaucccagcagugaggccuugucuauguguggaucugaucugucgcugucuucauuucaguugcguucugaaauggaagaagaaaaaagacaggccgugaacaaagcuguggccagccugcagggcgacauggacagaaaggguaagcagcugaaggagaagugcaaggaagaguuuguagaggagaucaagaagcuagcggcgcagcacaagcagcucauuucccagaccaagaagaagcagugggugaguacaccguccccgcugcuccugggaacacgaccauaccugcaguggugagggcagcucgcucacacgcacgcgcacacgcacaaucacacacgcauggcccccagaaguaaccauaaccacagagcacucagagcaugcccuggagccccucauaggcagggcacugcgagugcagucaccagcaucuuccccagcagugcagauacugcugugugagggcucaagcuccacuuggccgaguagugacgacuguagugacaucuguaguguccaagcugaaaccugguggcugccucccaacaggacauuccaguuaugguagcuuacagaaauugcuuccucuugcuuauaguaaguguaugucauugguuggcaaguccccucccuucaggacgacuuggaagugucaccaaguccuguuucuaagccuuucuuccccuugggacagagcccugggcuacuuucucagccccacaguccuguaggagcuaccuuguggacaauugucccuugagcuccuaaccuggcuucaauuuagaugguauuccauauagcauuucaugauaauucuuccuuuuacccaacuucuauuauuaagauuauguaaacauauauaagguuuucaugaaguauaugauaagaaaaaguauuauaaagacuuagcaagagcaacaagggcaggugggcacacccacagaagccugugaggacgcgugcugggaggggcugcugccugaggagacaggugucacagaugggccuaggugucagaaggcucagacaccauguugaugacacuagauauguugagcacaugacucuaaggucacuaggagacaggagugcagugagacaggcguuugaagacuucugacacugaauguugacugagguugcaugagaggugggguuguccuaaaucaggauccaaaccccagcuuucugcucugaauguugucucccaccacgguaaggacucacagggggacaggaaggaacacacacagauguugagugucagaugagaacugaggagugaaaagcaugcugggaaagcuggguccccagagcaucugcaagaaaagggaugaaggcagggcugucagggagaccaggagaugaacuaagcuuagucuguagccucagcccaagauuacaauuccaacccgaguggcuaaccugugcucacucuacucccagccagcgagugguagggcagaagcugccauuguugaugugacaaaaaucacaaaacucaaaauauuaauuuugacaaaaacaaacauugcaaccaagaggaaaaguggaagguugcacuuuaccagccagugaaagagaauguucuggguucugcuuugggacucuaggucaccaucaucauuuugcaagucugucagcccgcuguagaggacugcuguagucucguggguuaggagcacagccugguugcucuggcuuugcugcucauccucccugcagaccucuacaguggugcagccaccagcucugccugcuuaaaacucaagcaugaacuuuccccucauuucuucucccaugucuaacagucuggccucaauacuagccaccuuugaccccgcugacccugguagaauagugaggaaaaggucucucuaggucuggguguggcuguacaguauugugauucccuaacacauaggagcccagcacuucauccagagcacccacacagcaaaugaauguccaugugagguagggauggagaugagagugcuaggugucaaucauguacaugcaguagagggaugggauguuggaggauagaacuguuagggacucaggaaugugagggaagcacggcaggagggcagggacagcugacacuggagcugacggaaugaaugagccugugagacccgggcugaugcagugcugggaagacaccugaggucugauggcgugagauacuccagugugaaugccccugugggcuggucugagccagagagcuuugcaagccuuagaagcauagcggguccugggcuguugaugcuggccucccucacaugugcccccugcccccugcccugcagugcuacaacugugaggaggaggccauguaccacugcugcuggaacacguccuacugcuccaucaagugccagcaggagcacuggcacgcagagcacaagcgcaccugccgccggaagagaugagccugccgccacccucacacgcagcgguuuuuguucccaagaagccaaaauuguuuagaauuugcuucccauuuugcaccagccuuuaaacacuuuucguggugaaauuuugcacaguaguuuaaaucuuuuguuaaugcuccuccggcauuuuucgggggcugaaguaacaucaauggaggguacuacucuaaauaaaucuaauugcggauuuguugcauuuucagcaaauuuuaaaacauuuuuagguuuuacagaaauuuuaaccuuuaaacaacaaaucuuaaaaaaacaacgacaggugaauaagagagagucuaacagagacagaacggagcugaauguaagagcggaugcuucagaacagacuaccuggccgugaccuugcugagcugguuuugggcagcuugcuuacugccuacaggccuugccuggggcugugcuggcggcaugugauugaauauagggaacaggguucacacagcagggcuagcccugcggauuuuuucuuaaauauuucccaauuguguuuucauuauuucuuuucaauauauaacuuuuauaacaaauuauuagcuuugaucuuguaguuuaaaauugcagggaaacugggguaaucuuuuacugagcuggaucuuagagaaaaaugaauauuuaaauuuuaaaguuugcacauuucaucuuuguccugacaugagugcuuguaacaaaaucagcagcaaaaacaaaaaucaaaagccaaaaacuaccuguacucagaacacggaauuacagcugaggcauacgaguuuauaacugaguccccucccaccuucccuccccagugccacccuaacccacccugugucuccuacucagagggagagagcacuugcgugucacacacugcuacuaacaaaucccugacuguacacagugagaaugcaugcuccguuccuuguauuaaagaugccgugauuuguacaaaguccguauucugcggggugucugcuuaagcagcguuacugguaggaauggaucgauaguugaauaacauuuuuuauacauagauauauaaaagacaaccaggaaaauuaaauuucuuuaaaacuaucucaccaauuguuuuuuuuucuccuccaagacucaucacagaccgaaccaaauuccuacuuuauccuuuaguuauuuuuugagguuagagaaauaauuuguaaauauuuauuuagaccuuugauauuuauuaaagcaauuacucaaaacagaagugaaagagucgggagaaaagccuuuaagacaguuuuccccgguucaucagggucacucuaaagaugaaaggaaggagccgucugugaggccuccuccacgcagugccggugcuacugcagacggcguaacuacugccacacacgcgcacggggcgagcucuuuuguaaaaccaaccguagcccaggagcucccucggguuauacaggaacugcaauagcuuacaggcaccaccgcccccuccucgcugccguguaccaucacugcugcugcgcugcccgaacaaggacacuugacggucuuugauuguuuucagacguugauccaccccugugagagcaaguuauugugggaauauuuuugguguaaaaucauuccagaguauguacuauuuaccugauagcugcaugaacgugaggucccuguuacuuuggcuucuugucucugucgacacggcugcacauuuccaaguaacuacagugugaaaacuguguguuuuaaaaaaaaacaacaaaaaaaaaauuaaaaaaagagauuguggccugguuuuguaaaaguuuuagguaaaauuacaauugauuguuuuaggacucauuaaauuuuucugcaauccuaaagcucuaucaagguguugagugucccgcucugcacacuguaaguaccauuguggcuguccaguucuaugaugcccucuggcauuuuguaagcugcucugacuagcaauauauagauuucauuuacuguguuaacauugguuaauaaauguauuuaaaaaacccaacaacucuugucaguaagcugcuucagcucagugucugcugccagacacaacacagcuacagaaaagcuuggucgagagcgggaguugcucaugaugauagugaagccaugucgggagcuggguaagagcacugacugcucuggcagauggccccucacaagcaucugucacuccagucccagggaagccagugucuucuucagaccucuguggacuccaggcacacacauggugcacaccgcuaugcaggcaacacaauucacacacauaaaaauacaaaaaaaaaaaaaaaaaaaaaggaaaaugcaaguuuaucaggugcaguucuucacuucaacauuuauacuggauuccaugggucacuucucagaaagaagagggcgagaucauguacuuagggcugcucuugauggacucugagcagccagggccagcuugcucucauuggguggcagaugcugcuguuuuaccagucuccggccuucacgccaacgucagcccgucuucauguagcucugcgugcuuucagcacugccgucuaguagugagaucacaguugggaugagaugguuuccucuccaacuuccaacugucaucacaaaagauu

SEQ ID NO: 6884 - RNA, 3779 nt, Mus musculus
auuugagaauagcauuucacuuuuucuuuauugguuaaaauauauuaaauacucauauuuaaaauguacaaaaaugcuguauguagucaacagccauaacccucccaccuaaaaacuaaagcagcuauucacaauucacuuguguacucuucucuggccccuuuuaaucccccaccccacaaggcuaucuaucacuaaacuuaauuuggggauuucugugaccuuuuaaguuuuuaucacacauguaacuaucauauacauucuuugaucucauucacuuuugagcucaaugaaaacagcaucaugccauugaguagacucaagagacuugcuuugccccuauuuccugugauucaccuuuauugccaaguguagcuguaguucacucaauuuuacugcaucaugauaucuuauaaaaccacuuucccauggacagaacuuuaguuauuccuguuacuagccugauuauauugccaugaccaaaauguaagacauggcugaacaugccuggaguucuggccuuguucacaucugugaaguguaacuguucuccagcacugauauguagcaugugacuacuuacagaucugacauugugggccacguucuugcaaaugucauagaugugaacccgaaucucacacuucucaucaccacagagcaucuguuuaccagccucaagagaaagccuuucucucuucuauauuuuucaaaauagaacauuucuauacauucuaguagcuaaucccuuauuaguuacuuaaaaaaaaaaagucuucucaccuaaaucacucacuugcuuagcaaaggucuuugguuuuggguggcacugauguaagccacuucuguacugcgccugacacuauuucugcaguaaaauuugguguacugucagacgaauucccugaaucuuucuucaucuucagcaaccucuagccaguuuugacccuuugcauuccacaugaaucaucugcuuaucuucgucaugacaucaguugguauaacugcuggaaaucuuugacuuuauaguucacuuuggaaagaucuggcaucuauauaaccuuuaaugcuucuauuuacugucccucaucuguuccuuuccugcugcuccaucucuguucuucagguccuaaaccgaggcaaccaggaccuucccugaauacuuccaccaccagccuaucacauuuuugagcuaacuagucuaaaaacggacaguaucgggugagccugcaaucugcugauuuggugggaccaauucgucuuucuacuggagagcagaugagacacuuagaagcaaggauugggacacuuuacugggaaacgccguguguacuccuucaggagcuggggggggggcaaccuuaugaaggaacaaggauuaaggauggaggguccuggaguaugauagaugagaucaaccucugaaacaacaggcugggagagcaacuaauacaggauguaagacuugaaguagguagaagaagaaacuuaaggaaaaaaaaauauaguugagaaaugaccauagaggcuaauaaaaaaacugucauaaggaaggggauaaagagaaagcaacucucuaggaaggccuaauuaaaaagucaucagugguaagagaugagaaacauaccuccccugacuccacugaauuaagugagcgcagaagaaaaauaagugguacaugaaagaagcacaaugugugugaggagcacacacaugagagaaucaccuagaaagaguuagucccaugugugcuuacuaugaauggaggggaacugcuagagaaauagcucaaaggagaaaguuaccaagacuacuaucccuaggcccuaguaccagccacugguagcagagcaagcagcaaaauggagaaaacgccuuuggaguugguuuucuucuaccaugugggucccagagcacaaaccaggugagguuuggcagccugugcauuuacucacuaagccuuccugcugguccuguuuuuguuuuuggagaggcuauggaacucaggauggccuguuacucaagcaaaucuuccugccucaacuucccaaauccugugauuacagacaaggguagcacuucuggcuacguccaauucuaaacuggggggguggggguggggggcgggggcggggaaugcagcccuaaugaauaugcaagccucaagugugaaugaguuccugucaggaucucagaggccaacugugagggaacaugcuaggugcaugcaaucacacacaucagggccccgguuagaacguuagucuuugagcccagcuucucuggaauacuuaaaauaaaugaagaaggaugcuuucgaguuuucuuuuauauuucuuaguaucuauacaccuaccuaaacaugcaaggaaaaggaaaaagggagaagagagaagaggaaggaggaggaagaauaggaggaagaugaugaaaaagaugacggggaugacauaggucaugggauuagaucaacgacauauuuggggagccagcugaaagaauggcaaggaaauaagaagacuuaguaacucuucaaaugaaauacaguaaacuauaugacagugauuccuucucacagaugaauguuccaaagccuaaagaacaugccugccauggaacuaugucccgaaacuaagagacucaggccagugagucccauuuacaauuuaggacaaguuaaagaugccuuaaagaaaaguagacaguucuuuucacucuaaggaccagugguacaaaaagugugugcuacuugaaaauaagcuuggaaagauuacaaacauauaggauugucauuacccaacuaucauuuucuucuuuucaccuccaaauacaccagggagcguguuugguguaaguggcuuggaacaacauaugaggcaaggaaggagucugucucacacaagaugaguccugaugcuauggauaacacaugagagguggcuucucuuucucugucaguguaaacuguaaguugggguucuaaucccaggaggucagucacaccccauacauacuccccuacucucccuccccccuuaacuucgcucucauucuuccugugaguaccuacagggcuaagacuacagagcucuacagaaccuccacuuauuaaauaucuguguguauguaucagaaccaucuccauacauaauccuguugaaaccucaccccaaugagaccgacugacacgacuguucucguuuuucagaugagcaguguggggaagucucagcacuuggcuccugucacacagcagcuacacagaaaaguuaaagucugaguccgugccuucagagccugugcucugagcaauuucuccagaaauaucaaaaaacaagacaacguaguauaucuaaaauauaaguaguuggagucaagugcaggcaaagaguugaguggcuuuaagucagcccuugguccagcucugcacaggacaucagggcucagcuaacaaccuguuugauucugagagcagcagaugauaaugccuuugggagucacuuucucucuuccauccccaccuuagagcaagugacugugaaacuacaacagacaagaaaccuugaaggauaugacugugccuaccggcacaccagggauaucaguuccaguccgucuguccagcaagcagugagccucugccacagaguucuacauccgcuuaguuacaccucagaagugagaugucacaggagaaaagaaaggaauacuuuucucccuguccagguccuuugcugaaaccacuuagacugaaaugucacauuucucacggugagacu

SEQ ID NO: 6885 - RNA, 3779 nt, Mus musculus
agucucaccgugagaaaugugacauuucagucuaagugguuucagcaaaggaccuggacagggagaaaaguauuccuuucuuuucuccugugacaucucacuucugagguguaacuaagcggauguagaacucuguggcagaggcucacugcuugcuggacagacggacuggaacugauaucccuggugugccgguaggcacagucauauccuucaagguuucuugucuguuguaguuucacagucacuugcucuaagguggggauggaagagagaaagugacucccaaaggcauuaucaucugcugcucucagaaucaaacagguuguuagcugagcccugauguccugugcagagcuggaccaagggcugacuuaaagccacucaacucuuugccugcacuugacuccaacuacuuauauuuuagauauacuacguugucuuguuuuuugauauuucuggagaaauugcucagagcacaggcucugaaggcacggacucagacuuuaacuuuucuguguagcugcugugugacaggagccaagugcugagacuuccccacacugcucaucugaaaaacgagaacagucgugucagucggucucauuggggugagguuucaacaggauuauguauggagaugguucugauacauacacacagauauuuaauaaguggagguucuguagagcucuguagucuuagcccuguagguacucacaggaagaaugagagcgaaguuaaggggggagggagaguaggggaguauguauggggugugacugaccuccugggauuagaaccccaacuuacaguuuacacugacagagaaagagaagccaccucucauguguuauccauagcaucaggacucaucuugugugagacagacuccuuccuugccucauauguuguuccaagccacuuacaccaaacacgcucccugguguauuuggaggugaaaagaagaaaaugauaguuggguaaugacaauccuauauguuuguaaucuuuccaagcuuauuuucaaguagcacacacuuuuuguaccacugguccuuagagugaaaagaacugucuacuuuucuuuaaggcaucuuuaacuuguccuaaauuguaaaugggacucacuggccugagucucuuaguuucgggacauaguuccauggcaggcauguucuuuaggcuuuggaacauucaucugugagaaggaaucacugucauauaguuuacuguauuucauuugaagaguuacuaagucuucuuauuuccuugccauucuuucagcuggcuccccaaauaugucguugaucuaaucccaugaccuaugucauccccgucaucuuuuucaucaucuuccuccuauucuuccuccuccuuccucuucucucuucucccuuuuuccuuuuccuugcauguuuagguagguguauagauacuaagaaauauaaaagaaaacucgaaagcauccuucuucauuuauuuuaaguauuccagagaagcugggcucaaagacuaacguucuaaccggggcccugaugugugugauugcaugcaccuagcauguucccucacaguuggccucugagauccugacaggaacucauucacacuugaggcuugcauauucauuagggcugcauuccccgcccccgccccccacccccacccccccaguuuagaauuggacguagccagaagugcuacccuugucuguaaucacaggauuugggaaguugaggcaggaagauuugcuugaguaacaggccauccugaguuccauagccucuccaaaaacaaaaacaggaccagcaggaaggcuuagugaguaaaugcacaggcugccaaaccucaccugguuugugcucugggacccacaugguagaagaaaaccaacuccaaaggcguuuucuccauuuugcugcuugcucugcuaccaguggcugguacuagggccuagggauaguagucuugguaacuuucuccuuugagcuauuucucuagcaguuccccuccauucauaguaagcacacaugggacuaacucuuucuaggugauucucucaugugugugcuccucacacacauugugcuucuuucauguaccacuuauuuuucuucugcgcucacuuaauucaguggagucaggggagguauguuucucaucucuuaccacugaugacuuuuuaauuaggccuuccuagagaguugcuuucucuuuauccccuuccuuaugacaguuuuuuuauuagccucuauggucauuucucaacuauauuuuuuuuuccuuaaguuucuucuucuaccuacuucaagucuuacauccuguauuaguugcucucccagccuguuguuucagagguugaucucaucuaucauacuccaggacccuccauccuuaauccuuguuccuucauaagguugccccccccccagcuccugaaggaguacacacggcguuucccaguaaagugucccaauccuugcuucuaagugucucaucugcucuccaguagaaagacgaauuggucccaccaaaucagcagauugcaggcucacccgauacuguccguuuuuagacuaguuagcucaaaaaugugauaggcuggugguggaaguauucagggaagguccugguugccucgguuuaggaccugaagaacagagauggagcagcaggaaaggaacagaugagggacaguaaauagaagcauuaaagguuauauagaugccagaucuuuccaaagugaacuauaaagucaaagauuuccagcaguuauaccaacugaugucaugacgaagauaagcagaugauucauguggaaugcaaagggucaaaacuggcuagagguugcugaagaugaagaaagauucagggaauucgucugacaguacaccaaauuuuacugcagaaauagugucaggcgcaguacagaaguggcuuacaucagugccacccaaaaccaaagaccuuugcuaagcaagugagugauuuaggugagaagacuuuuuuuuuuuaaguaacuaauaagggauuagcuacuagaauguauagaaauguucuauuuugaaaaauauagaagagagaaaggcuuucucuugaggcugguaaacagaugcucuguggugaugagaagugugagauucggguucacaucuaugacauuugcaagaacguggcccacaaugucagaucuguaaguagucacaugcuacauaucagugcuggagaacaguuacacuucacagaugugaacaaggccagaacuccaggcauguucagccaugucuuacauuuuggucauggcaauauaaucaggcuaguaacaggaauaacuaaaguucuguccaugggaaagugguuuuauaagauaucaugaugcaguaaaauugagugaacuacagcuacacuuggcaauaaaggugaaucacaggaaauaggggcaaagcaagucucuugagucuacucaauggcaugaugcuguuuucauugagcucaaaagugaaugagaucaaagaauguauaugauaguuacaugugugauaaaaacuuaaaaggucacagaaauccccaaauuaaguuuagugauagauagccuuguggggugggggauuaaaaggggccagagaagaguacacaagugaauugugaauagcugcuuuaguuuuuaggugggaggguuauggcuguugacuacauacagcauuuuuguacauuuuaaauaugaguauuuaauauauuuuaaccaauaaagaaaaagugaaaugcuauucucaaau

SEQ ID NO: 6886 - RNA, 45972 nt, Mus musculus
gcaccaaggagcggaggggcgggacuuauagguggcuuucuggaaagaagggggagguacuguaggcguggcuuagcacauuuucgugaggguggagcuuaaaggaggggcguggaauaaauguggugucuuggaaagaggugcggauggaaggcggagcuuaacuggaugagcgagcggaggguggggcuuugagguucaggcccuuagaggggaaaguaggcggggaauuaaauggcuggccugaauaggcggaacuuagagucacggaggcggggccguuguauugcguuuucuacaaaggugucccuuuucucuugccguagugagaagccggaaguuccuaugaggcgugcuuuagaguuccgggacagugccggcaccaugugggagcugaucugaggaguuguuagcugucuaauccugcugauauuccgaguucagggugaggaggagcacggugcggcuaggcgcggccgugacuuggaacggguggccgggugggccgugaggucguggugcagagcuggggaaagcuggugcugcggaggcguaguuaacgcaauugcugugguggguccuggagggucggggaagcaaguuucuguguccucgaaaggacugagcgcuguauugccagagcaugagcccuggccugccaucuguuaaggcgccugacguuuccuaaaaacuuuucacgcuguucguucuuagccgguguuuugagacauccgccuccgugcaagaugacguccuuagcccagcagcuccagcgacucgcccucccucaaacugaucccagccuccuaucgagacgugaaguugccucucuguuauuugaccccaaggaggcggccacaaucgacagggacaccgccuuugccaucggugagccaccuuucacuuagcaaagcucccagagcaugauaucggggaguugggggggggggagguucuguauuuucuugcccccccccccguucgcuucccgagcaguaccuuguuuucuugguaagggggugggaaacagcaauacugcuagaugugugaauguauuuauaaauaaugguaucugaaauuucacaaacuaacuaauauguaaaaaggaagaaaaguaaagaaaccgagacaaugacuguggugugagaggagacuuucagaacuagauguaguuuuaaugacuaaaaagaagggcucggguggaguucuugucaugaaguacuuucuuuucuccuagugagugggggucagauuuauccuauauguuaacaacuaaagccaguguuugagagugucuaacacaugguaacagaguucaugagcuugggggugaggagaacaggagaguaucuguuggguuugccuacaaagaaguuacacgugacucuccuccuaggaugcacuggccuggaggagcuucuugggauugacccugccuuugaacaguuugaagcgccauuguucagccagcuggcaaaaggcuuggagcgcagcguccagaccaaagcagugaacaagcagcuggaugaaaacauuucaucguuccuccuucacuugucuccuuauuuccuccucaagccagcgcagaagugucuggaauggcugauucacagguagcuaaaccuucauuaguugccaacacuugguaagcuagauugcuuucacaaauuucaaagguuaacaugauguuuagaaugucaagugaacaugcucuucuugaauagggugccauuaguuccugucuaguguguuuaggguuuaggggguuuguuuguuuguuuguuuguuuuuugagacauggucucaguguguaucucugguugaccucaaacucacagaaaucugccaccuucuuccccaagucugagaaguaugucauugucuuuggcuaguuuuguuuuggggauaaggucuuauuauagagcucucguuuguuguuauuguuguuuguuuuguuuguggagagagaguuucucuguguagucucagcugucuuagaacucaguguguacaccacccuugccucacacccagagauccaccugccucuuccucccaagugcugggauuagaggcgauaccacaccuggcucaagcuggguuuugacuuacuuuuuuuuuuuuuuugccugucuggccuggaacuuacuaaguagaucaguuugccucagauuuauaaaucugccucuuuuugccucccagguccucaguagugugguuauaagugugugcuaccagaccagccuuaacugcaucaguacucaggagcugaugcagcuucacauugcagauccguuaacaugggggcaaaacguacaguuccuucuuaccucgcuagguguaaagaaugucuuuuaaaauaucaacccaaaucacgugguauuagugaugugcgcguuaagcauuuauguaccaggccuuguacucuaagcacuauacgugcuaggaaccaaacucugaccucugcgagagcaacaaauccuguagauggcugagccaucacuacagcccuucuucauguaaccuuuauucagcaaauguuaaagugauaaaaaaauauauauauaucuguagguuuuccuugguugcuaucuuuuaaauaaauaccuaaauaaaguuuuacacaagauuuagagagguagcuaugccaggguuuguugaggaaagcuucauucaaguaguguuuuaguuaauaccaaagcuuguauaaaguagauagaaggcaaggucugcuacuauuaaaguccauguagggguuuaagagauugcucguggugaagagugcuuaguguucuugaagagggccuggguuggguucucaguacucacgucagagccacuuagagcuaucuguaaaacuccagguccaagugcccucugaccuuugugggcaaggguaugcaugugcugcacaggcucacgugggcaauaauacaugguguuuuuuaagugcaugcaagagaauaggagaaucuuuaaacauuuuuaauguagagagacugacaaaaaauuuuuucaaguucauauacaaauuauauauguugucaucuuuuccuuuuccauuaauuuauuugucauuuucuaucugaauaaauuaaugugaucuuauuaauuuuuuuuucuuuuuugcuggcuauggugccucauaucuuuaguuccagugcuugggaucagaggcaggcggagcucugaguucaaggccagacugaucuuuaaagcauguuccagagcaucagggcuacauagagaaacccugucuugaaaaacaacaaucccuccaacccccaacugucccccacccccucccaaaaaaaccugguuuuggaaacauagcuaagaaaagcuguagacagugacuguagcacagagaagcucagugaagcucaguguuuauugucuuguuagccugcuagcuuucugugacuuaguggugacuacacaguuucauuaaaguugaaagaaagugaauaggguauaaauuuugauacugaacauucaaaauguuacugccuccaaauugauucaaaccacauugacucuaacuugaaugcaaaauguagggcuucuuguguucaucuuguugugauugauacuggcccuagcucuuuguaguucauugagacaggauuugcaccuuuuagaagcaggcaccuuccagacauguugauacacucuugagaagcaggggcagggggaucugugaguuuggcuauccuggucuugucugcauagcaaauuccaugccaggcagggcuauccagugacacuuugucaaaaaaaaaaaaaaaaaaaaaaaagaaaagaaaaagaauauaaaagaaggaccuuugugauuuuuguauuuuguacugauuuaauuguuucauauuuuucuuagguuccacauccaucuuuacaaugcagauagucucauugcuuguguucugccguaccaugagacacggguauuugugcgggugauacagcuucuaaaaauuaguaauccgaaacacaaaugguuuuggcugucuccuguuaagguaacauuguuuaaugacauauucauucauguacaugcuuauuauaaauaaugauuaagguuucauguuugguuugcuuugguggguuuuuguuguuguuguuguuguuuccuuuugaggcagggucucacugugaaguccuagguggccucaacucagagugauccacccccuuccuccuuaguugcuuaaguacuuuuguuuuggggguaggggcucacuauaugucagcugguuaugaacuuuucuuuuuugagaaagggucucuaugugacacugcauggccugaaacucacuauguagaccagguugaccucaaacucacagaucugcuugcaccaagagcuaaugacagauggcaguggagcuggcaaucagaacagaagagaauggauggggaauuuugaguucaacuuaauuugguuuaggaaaagucaagcccuuacugauccuggggacagucaguaguauccaugccauugauuuccuagcugaaacucuuugucaaugccaucuaguguuuagacauuagacaacacauuuuacaucauacucuuuauaaucguggagucucauaaacucuuuuuuuuuaaagauuuauuuguuauauguaaguacacuguagcugucuucagacacaccagaagagggagucagaucucauuacagaugguugugagccaccaugugguugcugggauuugaacucuggaccuucggaagagcaaucgggugcucuuacccacugaaccaucucaccagccccucauaaacucuuuauacaggcaagaacagacucagaaaauuuaagcuacuugcuagaguuccuauaacugaaguuggcacgguuacuauaugagcccuauucuuuguacaguuacucugcaucaguaauuuuggugcgaaagaaauuuuuuuaaaagauggaaggaguggaacuuuugaaaaacuuacacaaauuaaagggacuaggauuacuugaagagcaucaggauauuguuaaacuugagaaaguguuuggaaugaaaggauaguuaccugagaagaaagccuagcgagaucugucuguaacagagacuagaagaaaguaguguaugucauaggcaggaccuuuacuccaugugagcuugcugauggggcugggagcggagcugaugaggaagagagcagacuagcagacugugggccugcaccaggagcuaaugacagcggucgugaacucagcagucagaaggaaggagggagggaauccccaguuuugaauuaaaaagaaaauuucagacucuagauguaaauuggucggacuaacuggaguucaaaacgugcagcuugugagaaagcagcugcucaaacugaacauccagccauuuucuccuggucuuccacagacggcuccguuaucuagacacuaacucuuuccaggucucuaaaccucauucuccccaucaagguuacuugcagucuucauuuaauuguuuuguuaauguuuauucacagaccaugugcaguaguaguuaguagcaauauaguuuggcucgggucuauuuaugcuauuaggauauugugagccgggcgugguggcgcacgccuuuagucccagcacuugggaggcagaggcaggcagaucucugaguucgaggccagccuggucuacagagugaguuccaggacagccggggauacacagagaaacccugucucgagaaaaaaaaaaaaaaaaaaaaaggauauugugaggcagacauggaacaauaucauguuggcaaaaaagccaaauccuacuaguagaauuaugcagagcuauagaguugggguuaaauacauacauaaacagcacaugcugaguguuuuauacugaauucuuuugccuucauugucaccugcucuuuggaguuucuaaggguuuauguauuaaucucaucaccaccaguuaugaggggagauuguaucuguguuggugagcugccacauguuucuaauaacuuguucuuuuuauuaauaauagcacucuggaguaccuuuagcuagaggaacuuuggucacccauugcuacaaagaccuuggauucauggauuuuauuugcagccuagugacgagaucugugaaggugagccgugagugaguugucgaguguguggacucauaaagugauugcuuacucugagaaaggaaauguguuccguggaacuuggaagaaguugggguacaugagcaggugaagaaucagucuuuucaccggagauauuuucuauuaaaaaaaauuuaucuauugguugucaaauuccagcuauagugauuauuaaguagaaacuaucugaaacugucaggaagcuugucaggcaagucauucucagugcugugugugauacuuagagagccgacgugugcuguggucucuguuccaggccuucgcugaggauccuggaagcuccacccgguugagagugcucuuggccuucuaugccuccaccauugugucugcucuaguggccgcugagaaccuaucagacaauguagucgccaaacucuuuccauacauccaaaagguaggucaaguagaucauuuucuaaaggaauuugcuugcuugugaaaauuucauggagaaauaaguguuuucagauugauuguuuuuuuugaaugguugauaagauucaaucuuucgguuuaaaagacucgucaguucuugaauaagugucuaguaaugaauguuagcucucacugcaucuagauuuauuuucuuagucauagacuguccuucagcacaggcucucacuuaccuguucuuucagcacugacaucuuuccagacucuggacagaggcucugcuuuuccuucucgggccucagguuacuagcuuuaauucaguauaguucuuacccccgugagggaugagaugaacaacucccuuccgaagacacgagcucacaggucaggcagagcuuguugccucuguugggaugucugaguuaggaggcuuuccugaggucccuucucauccuguagacuugucucaucccugugcccauauaagaguggaggugaacaccuugauuuuuccaccucuagagagucauugguugucaguguauauuacguuuuauugauccuuuaaaaugugcaauguauguauuuguuaagguauuuuuaaaauuacauuuugcuuaaagggcuuauccuuuucauuuguuuguuuguuuguacauguggguacugguguggaagccaggggacagcaugugagggcuuguucuauuuuucacgcaugugggcccugaugauugagcucaggucaucaggcaugauaccaagugucuauaccugcugaaccaucuugccagccuuaggguuuuuguuuuguuuuucgaggcuuuugcugugugguucacacugguuuuaaacucauguucaucuugccuuggccccugagugcuaugacaacuggcuuagaauuugauuuuuguuuuuguuuuuaucuuauacauggaaacauaaggauuguacauaacgcugcuauagcauguaauguuucaguauguguaguuacuauguuuaacauuuaaaucagggcaaacauugacauuucuaauuuguuguaguuaauaaacauguuaaguagaagaacauaauuuuauauuuugucauuuucuuuauauuuuaaaaacauuuagggauugaaauccucuuuaccagauuauagagcugcgacauacaugauaaucugucagauuucugugaaaguaacgauggaagauaccuuugugaagucacuggcaucccagcucaucaaaacacugaccaagguuccuucucaggucaaugauggauuagguugccugauaauucucuuacagcgacagaagccagagaaccuuggggaaaaguauguauuauuguauaguuagaggccaguaaaguauguauuguuguauaguuagaggccaguaaaguacguauuguuguauaguuagaggccaguaaaguacguauuauuguauaguuagaggccaguaaaguugauuugaauaagguuugguaagugugcuuuuuaaaaugcuacuugucuaauuuguugcuguuguguaugcuugcuccuugaaaggccguuccuucacuugugugguguuccagaccuuauagggcuacuucacgggaucuccgagagcuacgaugugagcccucuccugcgcugcaugcuuccccaucugguggccucuguuguucagcacauugcaggugugugccuuucauuugagucugaaagcuuccugucaauuaucuucaagugggacgccuguugguagauuuaacuguuuaauauuucuucuaauucaguaguuucuguguaacuugucuaaugagugaaagaaucuuuggguuugggagcagguucacugacgggggacuuguuauucugagaaauuucucaggauucuguuacugagagaggcucugaagaaaugagagaauuugcccaagugaacuuuuguuucccuucuagauacuuauuggucucuaguguuucauucacaguaaauauccagcuuccagaaguaagccaagauuucaugcauaaaaaucaaaauuaugaaagaaaacgauuaauuugcguuauuucucuuuauuucaauaaacagaaaagaaaguaaauacuuggcucuguugcugcuuagagaauacuaacaaaaauuauucuaaauuaucuuaaauaugaugaauacgaagaaaagcauuuuuaaaauuauguuggagucagauguaaaaaagauuugcacaacccagucuuagcuuaaagcuuuuuuuuucuccauuuuuuauuagguauuuagcucauuuacauuuccaaugcuauaccaaaaguccccuauacccacccacccccacuccccuacccacccacucccccuuuuuggcccuggcguuccccuguucuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugauccauccaauagcugacugugagcauccacuucuguguuugcuaggccccagcuuaaagcuuuuauuucagucaagucuagaagacggcaaccuugguuuagucaggaggcauugacacaaaaacuuaacuuguuuguucucagaaaucuagguuauagccuagcgucacuaacuuuuaguuugaucugaggaagcaauauauaauuuuugcacuuguuuuuuuauugauaccugugccaugguuauacuuacuaaaaguguggagaaucugaggugaaggacaaaugagaguaauauacacagaaacaguuuaaaaacuguaaauuacucaagagucaaaacauauauucaaauguaaguaaaagaaggcuagggagauggcuuagcuauugagagugcuuacugcccuugcagaggacccagguuaagugcccagcacccauacaggggacugcauucuuaccuguggcuccaguuccaggggaucugauguccucuggccucugcaggcaccugcaugagcuccacauaggcacaucgucauauacauaaauaaagccagcuuuuuacacaaagagaagagguuuacaagcuagauucugguaucuauguuuuuaaguuauuaguaguaaaguuuuucacuguaaauaaaucuaauuaugagcaugucaaaaagaauaucccuaauucaguuuucaucuguuacauauuaaggagaagaagcugaagggauugauggucagaucuacaagaaccacuuagaagaaauacuuauaaaaauaccacugacgaacaacuuagaccaccuacuggcuagguaaguuuguucagcaugcuucugaugugcauauuuaugggugaguauacauuucaggaguuaggaguaguuuucuuuuuuuuuuuuaaguuuuauuuauuuauuuauuauauguaaguacacuguagcuguauucauacacuccagaagauaacgccagaucucauuaugggugguuuugagcccccauguguguuacugggauuugaacuuaggaccuucagaagaguagucagugcucuuaaccucugagccgucucuccagccccgggagugaguuucuagaaugcuuuuuaacguauuuugcacugucuauaucauugcacaaauuguagguauugagucuaacaguugauagcauaaaaugcaaaagcuuauagaagggaaugagaagguaggaggcuagcuacauaugaguuguaacuaaguugaugaguguuuaaguuguucucuuaauaaaugggcuguagagucugaaauagcacaucaaagccuagaaucuucauauugagaguaggugugcaaugggaauuauuuccuccuuuucucugaaaggcauuucugucuccccuuucauuuccuauuugauggacggugcuuuguggugaauggaaugcuuaaguauaguaguagaugcagguuggaaucuggcuaauaccacuauaguuucagaggugauuuggaagccaguccuccagggucuguuuuugccacuguguuaggugagaaauggaaugccugcaguuuguguucauggaggcuuacuuuacacucuggagucagaacagccuuuaaaccuuaaagcccuguccuacucuuucuuacauagaaagggucacuaguguugcuuugcguuugaccucagacaaauuggaagguuuccuauguccuaguuuuuucaucagcaaaaucaauauaauuucuuuccuauggaagugugauuauuagagacaugauuuauaaagcguuuagcacauagcagggauuccaugaaugguaacccauuuugcugguguuccacuucuuuugcagccaucuuuuugaagaauauauuucauacaguucccaggaggaaacccaggcuaauggaguggcuuugcuuaaugagcaguuucuuccacucaucagacuuuuagaaagcaaguaagucaaguguugugaauguugucuucaguguuuauugacuguucuucaaagaaauaacuugcaaguugugucuuaaagcaauggguuguggauauuuguuuuuauuuuuuuccuuuucagaaagggacaguauauuuauuaugagauauauugaaagacaaaaggaaauaggacuguagaagguuuguggacaauauaauuuuuuuaaacuagagauauuauugucuucauagugacagacuugaucaauauuagccuuuauauauagcauguguuaaaauuacguuucacucuaaguaacuuuuaaaaugucauguguucuguacacguguuugagugugguuagcagcucugucaggaggacugaugacgugugacucccgcuuagauaccccagagcguuggaugcuguguuagaggagcaccugaaggagaucacaggccuuaaaaagcaggagcuguuccaccaguucauuucucucucuacgaguggaggcaaguaucagguaaguuguucuuccgcagcacgguuacgacagggauugcuggacagugucaggcagaaauuucugcuuuccucccucuuugaaacuucaaagagcugaggauguauacaguuugauagucgcuagaaauagaaauaggguagaaaucauaacuggagaauguaauaucagggaaacauugggaauuuuguaugauguugguuaagucaccacaggguagcuucacaggcucccagcaugccuugucccucuuggcgugcaucuaccagugcagggccugcagucacaugauuacaaccauaauagaucuugagaaauauucuggugauucaagccuaaauacuagaaauuugauguuuaggcagaaguucuuauaauuagccuucaaaacaauuauuuuauugaaauaugcaguuuuucuccugaaguugggcuauuaguuuccgugcuguugcauuuccaaaucaaguagauagguagcugucauuugucgccugauuccauguucagcuaagcugccaccggcuggaacaugucuuuguuguuagcugcuguguucugucuucagugagguaccaguuuaguaucucacuuggaauuaaacauccaugaaaagugcugagcuacuuuaucauacuguuucauuaaagugaacccauacaccuguccacauaaguacacagaacgcaucauguacaacauguaugucuuccuguguuuuaacucaugcguguuggcuaaguuuuagaaaugaauguaauuuucuguuccugcauuuaugauuguuguacaauacacuaggcagcguaggguguuuucauuuuugguuauguauuacucagauucagugaaauuaauuauguugguccuacaguuuuuggaggauucugacaccucuuugaugcucaguuugaaucacccacuggcuccugugagacuucuggccguuaaucaccuaaaaacuuucaugaaaacaucaaagguuugugccaacagcuuuuacuuuagauuuuuuccaccuuagaguaacuagucuaauuuuagaguaagaaauugggauuucuaucaagaauuuauguuguauaauugcauugucaaauuuuaccauuuuuuaguuucuuuggaauaucugccuuauagaguuuuuuauuuuguguuguuuuuuuuuuaagauuuauuuauuuuauguauaugaguacacuguugcugucuucagacuccagaagagaguaucagaacccauuaacagaugguugugagucaccaugugguugcugggauuugaacucaggaccucuggaagagcagucagugcucuuaacugcugagccauuucuccagcccuuauuuuguguuuuuauauuguuauauuuuaaaggguauaguuaauuuuuuaaauuacauuuauuuauuuacuuauuuagugccugugcauauaugcacaggugugugcacagaggucacagaaaaacuucugggucagagcaccauccuguggauauaggagauugaacuuaagguaucaggcuugguggcgagggccuucaccugcccacagagccaucucaaggaccuucaucucucucugagcuuuuuuuuuuuuuuuuuuuugguuuucagagacaggguuucucuguauaguccuggcuguccuggaacucacuuuguagaccaggcuggccucaaacucagaaauccgccugccucugccuccggagugcugggauuaaaggcgugcaccaccaugcccggcuugucugagcuauuuuuaaggucaacucccuaauuaaaagaugguauuuagaguguauauauuauguucagggagccuggaagaggacuguaguggucaccaaucccagaaggccugguguugauggccuaguucugcuuuuguuguguucucagagcugggccugcucucggcacugguguucugagaugucucuuccggugugaagguuugugagcuucuuuguugcaacaguuaauuugcuuuucucuugcucaggagggcauugaugagacuuuuauuaaagaagcuauucuaacccgguuaggcgaugauaauguggauguuguuuuagcaacucugagugcuuuugaggugaguaaacguuuugugggugugcacguuuuauuugucaaugcuuucuuguuccucuuacaugguccuugacuucagaugggaauggguuuggaaauuaguucacugacuguagacuuaagucuggugaugagucucacagggguaguuagauugcacaauuugcuggguagggaaguacuacaaaaaggaagagugcuuugugaguucuuaauauugcaguaagagcuuugugucaaccauggcaaauugggucaugaaagcaauuuuugagaaguuguucuccuaagugaaaagaaaaguucugagagaaaaguucucauagaaaaaaguuaaauuggaaucuuuggagaaaaucuuucuaauuagucuuuucaauaguaguguuucuaaaaugaaauugaaaagacuaauuagaaagauuuucaauauuuacucaugguauuuuucccuuucuagauuuuccaacaacacuuugguguagaagagacgguuucaagucuucugaaucucuuucaaagagcagaccuuucaaagaacgaggggugguacguguucccuucugugucaugcucuugucagucagugacauucucgaguucucucugcugcucuuccuuucugaccaauggugucagugacuuugugaucggccuuugcucaugacuguagaacagagcuuuaagaaaguucucgcuguguguguguguguguguguguguguguguguguguguguguguguguacaugugugugcauaugccgcugcacacccuuggagguuagaauacaguuuugaggaguccguucucugauuucaccuucccauggucugggaauugagcucaggugcauaugggugcgauguauuuagauuauauguaccccaauuccuccuagauccaccccuuucccccuuaccuccucucaguuuugugucuuccauucuuccuuuauaacccucuaaguccaguuugugcugcccaugugcugguucagggccagccaguggaguguguugaucuaccuuaauagaaacuagcucuccauuucccagagaggauauguguuucuuuggcaaugugaucuauagggguuugcccuguauaaauuuaugugcaccucauauauaccuuguguuucuggaagccagaagaagguguuggaguccccagaggugguauuacuacugcauguuaaauuaccaugugaguguugcaaacccagcccaggucuucuagaagaacagccaguguagucuucuuagcugauccauucuuucuccagcccugggauaugcuuuauuuuuuauuucuuuuuuuaaugcaugagugaauuucuacuguccaguggagcugagaugucugauuuaauauauuuuguuacaguuagaaguuuuuguuuuuuuuuuuuuuucagauuuuugauuuuuguuuguuuccuuuuaagauauuugacaggacaaaguuauuggcuagauaacuccuuuuuggaauggauuugagguuguaucuuggugaucucugagcaauauuuuugucuaggagacuagacaaccugucaccaguugauccagaacaguauaauaaugaauucugcugacuugaacaugugucugaaucaaagguacuuucaugucuuccagguucagggugcuugagcuagcagcaaacauacuaauuaaagaagagauacuaaguaaaaaugaccaguuggcaaaucaggugguuguccaguugcugccuuuuaugguuauuacuaguaaugauauagagucuccugauaugaaaauugcuauacauuugucaaaaucaggaauuuguucucugcauccucuauuaagaggcuggaaagaagguaagaaagucaguuguuaaagucauaguuaaacgcccacuucuguucuacaaggcuuuuccccuccucacuuuuugcuguuguuccauucuuuuuuuuuguuuuuaagauuuauuuauuaucguaaauaaguacacuguagccaucgccagauguaccagaagagggcaucagaucucuuuacaguugguugugagccaccaugugguugcugggauuugaacucaugaccuuuggaagagcagucagucagugcucugacccccugagccaucucaucagcccucuuuucuuauuauuuuuuguuguuguuguuguuguuccauucuuaaaagcuguuuugcuuuaaucaaauacaaagggaauuuuauuuauuccuuugagaccauggcugagaguuauaacucaagcuggccuggaacaacuuuauaaaacagauauaaauuuuauagagaagauaagaaaauuugaaauuagauuaaaaguaaaaauaaaaggcaagccuugguagagaacuaguaaauauuuuaucuaaaugucuuacuuuuccccaauacuuuauguggaugccagugauacagugauauaguauucaaaccuuuuuuuuuacagcucuugaaaauguuauuaaaagcagaaaaucaagagaaauaauugguguaggaaaccagaagaugguucagcugcugggcagcaauuuaaguuuaggagagcgcucuacaguguugaagcugguauguugccaccccuccccuccacuccgccuucugcuccucaggcuuauuaggcucccacuucugcucuacguggcuucuuuucugaaguuuugcugcuguuccuuucuuacacccuguuuugcuuuaaacaaauacaagaguaauuuuguguauuccuuuggggccauggcugagaguuauagcucaagcuggccuggaacuuacuguguagcccaggaugaauuucugauccuccugccuuaaccucccaagugcugggauuauaagcuuguauaaaccaccuguggcuaacuuagcauguuggacagauuaucugaaguccuuaauauuuuauaucacuuuuggacuagugagaauacuuuguucuuuuuaaucucauuuuuccuauuuauauuuagacuauugaagucuuuucauuguuaacauagcaaaaugaaauuaaaagaaaauacuuuaguaaaccuuuuaaugguauuaggugucugacuuacugauuuuuguuguuuguauucuuaggucuguggguuaaaugcauaaacuugucaaguguaauuuuguccauuuuaauuucuaaguuuguaucauggcuuagcaaucaguguuuacugaucuuucugucgucuuacuuuauacacaguaccuagguaggccugagauagaagacugacuaacuaguaauagagggugcuuauuucucaaggucgaagaucuagucugugcuggggaaaaggagucuuacagccugaagcagaaaguggcguuucacgugacugugucugugcugaucucuugcugcucauccuuccaagaaaccugcuucccguuugcucuaagaguguucaguuuauugcagaaaaagauaaggaagcucaaaagcgucaucacugcugugguaaggagugcggugucugcaggaaguuggguguuggguaaaauaacacuguggucugauggucacagcuaaacugaggcccagaggucuggcucugguuggggaagugggaagugcuggucagaauguuagccguggguaucaagacaaagcacucucgugcuuuuccaggaaguguacuugaaucacaggguucugaggguuggacucuucugcuguuuuaucagcgcauaauccagguuuccuuccuaucuacuccacugauucacguccacacaaaacuuguccuaguauuuauugaaagaauaucguagauauuuaaaaucauugaguauuccaguagguucagaugucucuggcccacuguuguccuggacaguguuacuaaaguuccuagugucccauuuugagguagcaagcuuuuguuuuaauaccgcuguuugcaucaguauuuuucuuuuauuuaucuucuaaacuucaaagggcugcucauuacaggauuuucuaagagaauuacaacucauauuuauguauacucucaggaguuuuauaaauucuagcuguagccauuguuaacuaaaauuaugugaaauuagcaugcuucuuuagacuuuaaaaaguggcuccagugagccucucuuaacgucugacugacuuuuuuaugagguacaguaacuggagcugugcuuguccuccgggccagcaguguagagugguguguuuuguucaguguaggcagcagguuguuucacauugcucuauuaaugcccuuuaugaggaauguaucuuuucagcuguagcacuguguccacacacaugcacacacacacacacacacacacacacacacacacacacacacacacacacacaugcacacacacaccagugugacacucccgacuaggagugcguauccguugcagucauagagcaccuguuuggaacucugaggaugagcuagcuucuguuuccauucauguuucaggaaauccccucagaguggcaccuggaacugauguugaacagaggauugccggaggagcugugggugcguuacgugcaggagcuccacggugcccagaggguugucauggaggacgccauuuuacuuguauuuuccaugaaauguuuuauuuuugcaaugaaggcuccaaaaucuuuuccuacagguaaggcauggucaugagucuucagugugaugcgguacugcguuccuaacaccauacacgguucaccuucacuugaaugacaagcucccccuuguccccucaggugccaugugguggaaucccgagcagcuagaugaagacagcagacacuaccugcaccugcucauugguaucuuugagaugcugcuggagguuucugaugccaugcauuucaggguucugauuaggcuuauaaugaagguacuuggcucacuccucacaggcauuucugcuauagguaguguagguuauuuuaguacuaaagccuaauaauaaaguauauuuugcggcagugaacaaugugugcugauaaacaugcccucgagagcagucuaguacuuacagccagguagcauguugaguauagaguagcauugcagcaucccuauugaugagcuguuguguuuaaaaaucaaaacaacucagucuguuuuuguuuugaauauccuuuauagaugaguaaacuggcugaguguucagagauggugguuaggagaugcagugucacucacgaagcuucugugggcuuuacugccuccaugaugcaagcagcguguucuuguccuugucugacuuacucuuucugugucuuucagcauugucgccaucucuaacuccuucgagagcuuuuaguguagcuuuccaggucccacuuuagucuugaccuuuagcuaaugcgccugucuuuuuuuguuguuguuguucaguauuuucaacugcaaaguuagagugaggcuucuugaaugucauucuucagcgacauccguccuaacagguuggaguucggaauauugaagaagugauucaucaacucauuccugugugguuauuguacaguagugaaaagguccagggacagcauaucugaguaagaacuagaccucacuuuguuuucuuuuguuuguuuuugcuuucuuuucauuagguacaucuacaagauguucugcaguuguucaaguucuuuuguguuuuguggaccuaugguucuagccuuucaaauccacuuaacugcacugugaagucagagcugcagacucaagcucuuuacauaggcucugcgaugcuuucuucucagaauacacaguauaaacaaaagcuggcaucuacugcaucuccagguacaacaggucacauuuaacuucuuaauacauuuuagacaucuuacucugugaggaagugugguauacaaucuugcacuugauuguauagagauaacauaauuuacuuaaauaguucauucuauaggggagauggugacaaggauaaaggcacuugccaccaagccuuaugacuuaaauuuaauuccaguccccacauagcaaaaggagaaaacuaaccccucaaaguuguccucugaccugugcauucagucagugaugauugcaccccuacuacauagagauauagaaaauauucuuguuuuuauuuauuuauuuaaaauauaauuuaaaaauuaagaaaaaaagcuaggugugguggcacauggugagaguagauuuucuggacucauuuguaugcuuugaggagcgugacccuaauuuuucugaaauaauuaggcaacgaauagcuucagaagagggagucugggcugaugagauggcucagugauuaagagcgcugacugcucuuccaaaggucccgaguucaaaucccagcaaccacauggugacucacaaccaucuguaacgaaaucugaugcccucuucuggagugucugaagacagcuacaguguacuuacauauaauaaauaaaugaaucuuaaaaaaaaaaaaaaaagaagaagagggagucugagagggaaccuuuuguguugccagggugaggauagugcuagagaugguguagccaggccugaugcaugcugugccacugaccuugcucccagcccuagaaggaaaccuaucacuguguaccuuugacacuauuuaaguuuugcucacugacacauccuuuccccuuugguauuaguggugaugucucuacuccucaaucugggaagccauaucaaagaaguccgcagagcugccguccagugucuccaggcccucagagggguacccucaaaguuugagcuggugauagaucaccucauuccuaaggcagaagagaucacuucagacgcuaccuaugugcuucagguagaccacugucaaagaagguugagaaguuuucucuuccuguaccuuguagggauuuugggaggcuaauccacuaauuuaaauaauuugcaucagcaacuacaggcuuuugaucccuuuuuuuuuuaaaggccauagacuguuucaauucugccguccuuuucuugugugaaagaguaauguugaagcuuucaaagugagcuagcuuuuggauacugauauucuuucuaguugggacuuuauugaagagaaauuuaaaaaagcguaagaagugucacaucauuugaaaagaaucuuccauaauuuaguccugaaaguuuguguucccuuuuuaauacaauuuucuuucuuucugguauccuaggauuuggcuacacuauuugaugaacuacagaaugaagagaaacagaaaucacaucagaaguugucugaaacccugagaagccuucuucacuguguguauggcugcccaucuuacauugcaaaaggcuugaugaaaguacuccaaggugugaacagugagguaggagggauuuucacagaacgcauggacugugugucccgugugaccugagguguaacugucauguaggcggaaguaaccacgugcucccagggggaugauguucuucacgaaucugaaggaagagauacagaagacaaaaagauacaggaugcaaaaagcgcauaucacaaaugcccauucccuuuaacauuacguguguuaucgagaucagcuuuacuccagauaggcuuugauuuguguccaguuuuucaaggagaaauucucuacaaaggaacauuuguagucucugaaauuggaacuuuucccuuacuuauaaaauauauggcuucauguauuuuucuggagggaaaagcacaggcugcauuguguacuaggaagccugugaugugaagggagugucugcucugaccaguggagcucuaagugccuucuucacacugccucacaugcccauguuucccauugcucuuaacugacuacaguauucagagaauuaaaauggguaaaguggaauauaaauuaauugauuauauauucaauuguaucaguuaucagcccugaguugucacuggggacauuuauaagcugacaaaacuucuuguauaaaggagugacuaugaauaugguccauacuccugucugugagguucaugucuucugacacaaccaggcucaaauuggaaauguuugggagaaaaauuauguuuauaguaaacaggcaggguuuuuuucuuguccuuauuuccuaaaaaaaacuacagcauuauuacuguaauuaacugagagguaaguuuuggaaagcugugcuagauuauaugcucacauuaugccguguucuauaaggagcuugaguacacagacuuuuguuuaaggaguuggguuagaggcaguacucuagaaaucaagaaacaagucuuggcucuguggaccaucuuucuuugcagcugcucagaucugccacuuuuaggaaagcagccgcagagggcgugcaaacagauaaauauggcuguugucaauuaaaguuuaaaaagauagggcaucacugacuuuguuagacaagcuaugauuugcugaccuuugguuuaauuacugaagccuuggcuuuuauuaauauaauacgaauauaauaugaccuacauauaauaugaauucacuugaguucauauuggucauaucacacuggaaaugguugaggggaaugcaguguuuuagcaaauguugaucuguuaaucuacucauguuuuaggucauauuuucuguccucacaaccauagugucuuagagaacugucagguggcuagcccugagcaaggcaugagucugacaaccuucucucucugucuuuagauggugcuugcccagcugcugccuaugguggaacaacuccuagagaagguggagaaggagcccacagcuguccugaaagaugaggcuguuguuuugcaucucacucuggggaaauacaaugaguauucagcuucacucuuacagaaagacccaaagagucuagaccuguucauaaaagcuaugcacacaacaaaggagcuucacccaggaaugccaacuguucggaucacugcucucgaaaaggucaguggcuuccuuuagaaacccaagcuuaaccaagcaggaagaaguuguaaguuauuaguauguugaaccugcuucuaaaggcauagguauauuuuaccuacuguacaaaaguugcagcaagccauuagaaaggauugcauuuaaaagccggugagaugacuccacagguaaagaugcuugucaugcaaacucaacaacuugagugauuccccagagcucucagugagaacggauucccaaaaguucuucucuucgcuccaccugugcguaugcauguaagaaauacauccuccccuuuuuaagcacugaauuugaaauggaaaaauguagcaccaguuguauuauaguuagguuaaaguuguuuucucacucugggguuuuuuugcuccuagauuacaaagccguuuuuugccgcugugucagauggacagguccagcagaagcuccugugugugcuguuugacuuguuagugaacugcaaagacgcacacuguguucagacggucggcaguguuuuuaagggggugaguugcaaacuuuguaauuuguacauguuuagucuuuccaguugacaaaauauaugaccuguguuuuacaguguuccuuugggaucagauuucacuguuaacaagauucaaagaaaauuauguacuagagaaguucaaaacccaaaucuuaugucuucaccauuuuuuuuuucauuuuuaaauuuauucuuuaaaauuuucauaccuuguacaaugcaucuuaaucauauccaaguacuuuuccugcuucccucccucucuauccccugccaguauaucuccuuuccagcuucaauuccuccuuuuaaaaagaaacaaucccagcacuggggaggcagaggcaggcagauuucugaguucgaggccagccuggucuacagagugaguuccaggacagucagggcuacacagagaaacccugucuugaaaaaaaaaaaaaaaaaaaaaacaauccaccaaguccgacuaguguugcucauguguggauauguguggaaucauacaccagggcauaagcaaccugccagugaguggcgcccuucucucagaagccauuugcugucaauggcuccuuagccaggaguggagccucaggagccccugcuccauucaugcuaaaaauuuuaacaggugugauauugugcauauaaacccagcauucuucucucucuuucuggucuucaguuaugucugccuacucuagcaaaguguucccugguccugguuuggugugaggcgggucaguauaguccugguccugguuuggugugaggcgggucaguauaggugucccaucuggcugaacauucacagccacuuccucucaguguuuuggacgguuaggacguuuguaauagccauuacccaccguauaggaagcgucuuugaacaagauuaagaacagcacaaaugccuccaaaacaagagugcauaaugguaaaggcgguacgguagcagguggcugaaaucagaagcugagaggccgcauuuccauacaagaagcaggacaaacugaaagcggggcaguguuuguuguuuguuguuagauaugaaguguauauuuucagagaguuacucaugguugucuuauuuuuggaucuuacucauauuaggugcaccugccugcuucaugaaaggaauggggaauugugaggggcuugauguugcgcaagaugaccuuauuuuacuuaaauagauaugugauguauaagauggaauuggagcucugcauguuauguuuguauguacauugaaaucuagccgucauuggaguggguuauuucauuucuugaauugacuacaguagagaauguuaggggggguggauaaagugaucaccacacaagugccaauacuggaguuuguauccuacguaaaucuggguguggaugguagguaguccaccucuaguuccaguacuuagaagacaaaagcagggucuuuaaagcaagcuggcuaguuagacucgcuguguaguuaagcucuggguucagguaacagacccugccucaauaaauaagguggagaacaaucaaggaagacucgugcuauccaugcuggaucuccacaugcaugcacacugagcaugugcauacacauaacagacacgguauguauguaacaauaacggagcaugugcauacacauaacagacgcgguauguauguaacaauaagaauaauagaagucggggcuggagagauggcuucaguaguugagaguacuuguugcucucccagaggaggaccuggguuugauucccagcaccauguugcuacucacaaggaucugugacucuaguuccagggcaucuaacauccucuucuggcuuacacaaacaccaggcauguaggugguacacagauguauauacuggcaaaauaccauacacauaaaauauuuagcuuaaauaaugaugaaaauguaauauacagauuuagcucucagucuuuaacagcuuuuucuccucuuuuucuuugcagaagaaaauauucuaaagcaagucuaaaacauuuaauuuccaucccuauguacuuuuuacauuuucaccuuuuaaaaauguccauugucuaacguaacuacaacauaccugaaaaaauugauagcaauuccuugguaucauuuacuacucaguccauaguuguauuuuaaugaaugucuuuuuuuuaaaagauuuauuuauuauuauacacaaguucacuguggcugacuucagacacaccagaagagggcgucagaucucauuaugagugguugugagcccaccaugugguuguugggauuugaacucaaacaugccauaucagcuaaagauaagcucaaccuugacugucaggcaaauguaauugauguuguacauauuucugaaccuagugacagcacguaaguaccauaggaaucugcucagcaucguacuugagagcauccuaaauaacacauaagauggcguuuguagugcuuguauuggggacuaggcagacuucaaguggcacaaugacguaaauguagacugaaauguuuucguugaccugugcagugaugcuuauugcagcuauguuuaucuauugaucgauugauggguuuccucuguggauuccuggcaguccuggaacucacuauguagaccaggcugccuuugaacucagauccgccugccucugccucccgagugcugguauaaaagguguacgucacccccacccaacuuucuuguuuuauuuuaauguugauaguugauaauuacauuacaacuauugcuguacucuuguuccagugacucacaucacuagccauuauuucaauauuucagauuucugucgaugcugaacaaaucagaauagaacuggagccacgagauaaagcuaaaucuuugggcacaauucagcaaacgagaaggcagaaaaugcaacagaaguaagagcuuugaauacaccaaggggucuggucuuguaccucaggcucaggcuuuuguugugguuucuagauacucaccaguuuugcauaaacagggguaauaguguuugcauugucaacucuguuucccagaaagucacaagauguagagucuguccaagaaguggagggcccuuacuggcaaagagucacccucauccuggaguugcugcagcacaagaagaagcucaagugcccucagauacugaucccaccccucuucaacuugcuguccagguaauggcgcguggaucuggucuuggggacaagcgggugguaagaauuugcccauguugauuuaucauugucuuuggggacauuuuucuuguucagaucgucuguccaauaaaggaaguuaaagugcugucauuaaauauugaagccuggguucaguaacccauuacggguuuccuacgcuggcuuccuccugagcuucguaguaacugacuucaucgaucuaccugcuuuccuaccuaacuuccagggccgugucuuagccacucauguguauuuuaaggaugcugugugacgucugcuaucauaguuguaaaugauuagaaaacauagcuuuagagugugccacugagcugaggagucuguugucauuggaaaagugccgugauucuccacgucguuaggagauugcgaguagguuagugggaguaccuaaauuguggacagaaaccacuugauguacuugacuguaugagaaacaaaacuagaguuagaaaucuauuagacugugcaauaguaguguuuucuuuauuccuuauugaauagguuuugaacaguagucauuaaugugacuguauuaacuucuaaauucccaaucauuucucuucuggggcuccugaagguguuuagagccuuugucaucagagcaggggaacauggaguacacuaagcaguuaauucugaguuguuugcucaacaucugccaaaaacucuccccagaugguggcagaauaccuaaagguaugugcuuggugggcgggaagggcaggaaacggccugcuugcgcaugagucuaucagccacuccuucccuccacuguagauguuguggaugaggagaaguucaacguggagcugauagugcagugcauccgccucucggagaugccgcagacucaccaccaugcccugcuacuuuuggguacuguugcuggaauauuuccgguaagugaaagauauaagacccgaguggcuguuucaggucucuucuucaaugcaucgguguguagagguuuagggcucaguggaagagcuuuugccuggcaaagguuagaucuagugugauucccaguguuggggaaagaaagaaagagaaaaggaagcuugaguuagucgguaaaaagaacaguaacuuuccucacuggcaugugauggagcuucagcuggacaacaugugguuggcuccucaugcauuaucugacacccugauacucuccaggaaacuccagcuugccaguccccagaagauacuaaacaaacgagacacacacagaaaaauugguuaucauguaccucaugaaagucaagugacauccauccaguaguacagcuccuagccacugugguggaugcaaagggugccuuguugucacuuugauaucagucccccagucuuggaugcugcugcuuuuauguuuaucuguuuucccaacauucuuuuguauguugaccauuuguauguuuggaaacuugagauuccccaccucugccgccaccuuuaacuuuuuauugguuuguugugaauuucacuucauguacccaguucuacuuacccuccaguccccuuguaccacccucgagccuugcaaccuccccaccaaaaggagaagaaaagaacucgcaaaagcucauuguggaagcuauagugugucccuuuugucugcacuccguugcuugcaaauguucuuugcacugacucacuggucuggucugaggccucuggcuucugcuacacugucaguacuggagccucaccggacuccucuuagauauaucuuguuggucugugucauggagauccaguaguuuugaaucuguaggauuggccccuucagacacucugauaguuuauugaugggguagauguuggguggaucaauucaaagaccuggaucuaggccugagagguaucugagcuggucagucuaccagcucucccucccugcuccggcuggcccauccauugcugcagccagcaugggggaucuacccaguuuuauuuccuuuuuuuuuuuuuuuuuuuuuuuuuuacuuguuuuucuuucuggugguguaggacauuagccuuaaggucuugugcaugcuaagcaggcacucugcuguugaacagcccuuugccuguucuugaggaagaauaguucaaauuuuuuauugaguuuuaaauaacucuuugguauuugaaagagaaaaauggugauaacuguaauuuauuucaggauaaaguucuucacaacaucaugucuauuuuuacauucaugggagccaaugucaugcgucuagaugaugcuuauaguuuucaaguuauuagcaagacagugaaaauggucauuccagcacuuauucagguaagcugucugcaugccaccaucauuguuacuauuuugaauuuguacaauuuucauguaaaugccaguuuggaagcacucagguucuuugucuagagcuuuacaguggugaagccagcaaauggcaguaccacauauucugguacugccaucaaauauguuaaaugugguuucacugaacucuaguaguguagccauggaagcguuuugaccucauaaugaugagucaauugacuguuuaaucauuugauaaugaagcuuuuagauugagaguacaauaaagagaaaauaagagauaggaacuuuuauagcugcaaugucagauuugucagcaggcaaguuaacacgaguuuucuaagcauggucugagagccaggacuuguccuuaccagguaaagauaccugaugugagaaggagcuucaagcauaccuguuaccccacacucacacuugugaauaucauuuaccaugcuuucaacuguucggaggauaagagauucacacuguccccuuuuaacucuugguguuagauuggugcuuccuguguucaauacauuggcagcuauagggcgagugccugauguaugcgucuauguguauacacuacauugugugcgaaaugaauaaguaaaugcuaaagagucgagaguaaggaaacaucuacauggucuagaacaaccggaaaaguucauaagaaacaggauuugaacugacaaaagggaggacacgauuuauacagaaguauggcugaaauaagauacacacucacugaguugucacuaagagaccuaaucccucugaaagcugguuuugaagguuauuugugccuccucacaucccugucugaucuuuugcagucugauacuggagacucuguagaagucacuaggaauguugaacagauuguggugaaaaucaucggugucuuuguggacgcacuuccacaugugccagaacacaggcgccugcccauccuuguucagcuagucaccacgcuaagugcaaaaaaauuccuguggauucuccucguccugcuuuuugaacaguaugucacuaaaacagugcugguggcugcuuauggagaaaaggucagagcauacaucagucaggugggguggugagagucacaugggcuuugugacacuggccagcuuaaguguacgagagcacugcuuagugugcaguuggacagugcucacccagaagcuuuugcaagauuguuucuugguuuuggggguggcuuuuuuuuuggguggguggggggaggugaguuagcuuucagaauguauagacacagaacaucuuuuguuguuuguuuguuuuucuuuuucuuuuuuaagugugaguuccuucuuuuuauuaacacauacacaacuacuugucuucugguuuguugaagcaguuaagucagacaacacuugccacagcaaugccuguccaaguggcuucccaugaaaacuccagcaccacauucaucaggacacugucgacgaagucgacuaauuuugccauuuuuauccaccuuauaguauuucagcacagccaacuuaaccuucuuccucuuaugcuuauucuucuugggagugguauaagacuucuucuuccuucucuuagcaccaccccgaagucucaacaccagaugaaggguggacucccuuugaauguuguagucagacaaaguccggccaucuuccagcugcuuaccagcaaagaccagccucugcugaugaggaggaauuccuuccuuauccugggucguggccuuuacauuuucuauagugucccaggguucaaccucgagcgugaugguuuucccuguaagggucuucacaaaaaucugcauuguggcagcggcuccacccacaauggcagaucgggaaggaaaggguuugcuuguuuuucaagacaggauuucucuguguauccuugacuguccugggacucacucuguagacuuggcuagccuccacagagauauccaucugccacugccuccugauuucugggauuaaaauugugugccacuacugcccagcaacccagaacaucucuagcaaccaaacaucuucuaagggcccuugacuuucuguuucuaagaaacgagucugaagucccacuggugguucucugcccagcagagaggggcauugaaacagggucucugcaagcugccuguggaggcacuaugugaggggaggacuggccaauuguuuggaagagccagcgcuccugaaucucuacugcugaaggaauucauagcuuucucaucugcugacagcuacagggaaaggcacuuacugcugcaggguguguucugagcguguccuuaguuugugcuuacugauggacuuguuaggccuuguugucaccuuuccccuucuuuccaaacaggaugcuauuuuagaggcagauacugaguucuggauuucagucuguugugaauucaguguccagcaucagguccagagcuugaugcauauccuccacuaccuagaaaagcugccagaggaaaaggaagguaagccccggucaggggugggcucucaucuaacagagcugcggcagagcagaugggaacccuagugcauccauaaaugacccugaccacuguaucucuaacacucucucaucuauaucugaaguuuaaaguucugagauacacaucuucagcuuuuagauaagcauuuugaguggcgauguucuccuucagccucugggcuccagcccucaggaucucaacccagaucuagaaggucugauugucuccacuuucccguguuguugucuuuucugcuuugacucacucuucucaggcuugugggguggcugcuuccuugguaaacauucugcugucacugcuucggcuaaggacaggucugguuccuagcccagcacaguucucuuugagauagcauccugcucaccgugcugcucuugcacaucguacagauuaguggcuggagagggauaaaguuaccuggucuguugcuguuuuucagaagccaccuccaagacaguaucuacuaagagugaaguacaagaugaaauguugccaguuuuuaagguggacgcucacacaagcaagcagcuucggcauuuuaaguauuugucaguguccuucaugucccaacuccuggcuuccaaucauuuucucaaaaagguaauguguucuuuaagcauguuuaugauaagaauugaucuuguuuuggcuaaaaaaaaaaagcagugucuuagacucacaagaacauagcucaucaaaugucuuauggaacugugaggcaugccuugaaaaauagugaaaaacagugcacuucacaugcacacuguuggacccugucucccagaguugagacccagugaugacauucucgggcagcauagccccauuggaagcacgugagcauguguaccaccagucaucuccaggcaaauggaggauagcauaguuuaugccaaccgcagagcacucccaacccagugucugccaguugaguggauaaaucaccugguuccgagggaagauugugaacaacacagccaccugaugaagcucucguaggaaacuaugguuuauagcaaggaugaagugucggcaccucuccagaagacaggaacacaggugccuucuguuaccacuucugugcaagcaaagaaagugagaaccaggaaaaaagaggaucagcagucucuuagaccuagccauuagcucugcagcuuccucauagagauggcguguuagcuacauugccauuauaaaauguuacuacuuuuagauuauagggaaaaaaucuuugcaagcaauacaacauaaaugagguauugaaaauucagccuaaugaaacauugcuaaggauauuauaauaggauucccaggguucucuucaagacaggguucuugguguagccuggcugucccggaacucagagauccgccugcuucugccuaccaaguucugggauuaaaggugugagccacacugcuccacuaauuucuuuuaaaaagcacaaaagaauacuugaagaacagacaguguucuugcauacaaagacacacgguugggcugccuggauggaucaguggguauacccauccugccaagccuggugguucgagucugaucccgggagccugaauauuggaaguagagaacccauuucugcaagcuguccucugaccuccacacgugcacuguagcaugcacauaaguacacacacacacacacacacacacacacacaaguaaagugauuuaaaaacaaaacucaacuguucaaagauuuuagauuaacauaaaaguuaacacuuccccaguuaacuucuuuaaaaaugauguugaugugcugaggguuaaaccaaaugguagagaaccgugaucagauaggucagugugacugaccaccaggcugagaacacaccuaggugugggggggaggggguggcagaugguuuacaaagccacaaagaaagugcacuuaaugcuggcaugguguguuucuauuuccgggggaaagggacucugcuuucacaccauggacaucacauaauuuuagguagaggaaaaacuuugauguaaaaagcaacaccuagagcuuuuuaaaagaaaauccaggagaacaguguugucaucaaaggagaaaugauuuuucuuucaaauuuugagucaacaaacgucacaguaaacgagcagaaggaaggcugcaggcgaggaucacuuagaucacugcgucucaugaguucaucaguuuccauuccaacacuggcaaaggauggcguuuugaugaagaggaaccacaauggcuacuuaauacuugauaggacucaagggcccuggugagcaaaccuagaaacacagacuaagugggacgcggcuuugcuguucauccaaguagcagaaaugggaaaacuguugaugccaacaggugcaaggauaggagacgugcaguggcggguggugugugugcucgcaggucagaggugaggaaagcuugcccaggugccuaagagacuuaucaagauguucccaagcuuuguaagugcaggagaacgucccgaaccucaaccugacaaaugcuucuaaauaccaaacuuguaaagccauuucgaaccacucgcuugacagcguaaguggaaaauugcacaccugaccucgugucaggucacggucaaaaaacagaagcacgugagaaacaugucgugaaauuaccuucaggcuuauaagguacuaucauguuuauacacgugucccauccuaacuaucauuauuugcaaauuuuucaaaauaaaaauauccagauugaaauaggucucaucucaagcauuuuaggguaaggagugguauucaaucuauguguagagaaaaacggacauaaauuaucuagcaauaaaggaaagugauuaaauauauuuacagaggaacaauauguauuacuggacugaaagaacuagaacaagauagguuuccauauccuggccucaaaaaucugauguaagggccgggcagugguggcgaaugcccuuaauccuagcacuugggaggcagaggcaggcagauuucugaguucgaggccagccuggucuacaaagugaguuccaggacagccagagcuacacggagaaacccugccuugggggaaugggggugugaggaggguaucugauguaugugcuauuuagaaacuuaauggcagguucaggcuuucuuuggugguuugaaauacaggaagaagcaggaagcaauuacaugauaggccauaucuguuuucauaaugcuugauuuaauacccuguaugagcucacaggggcaggcuuuuuauaaaagaaacaucgauguuuuucugaaucuugccaugcugaacacauacuauaaauccaaugaacugguugcagccagugagggagaucugcaucuaaugaaauugcgaugguacaagagcuucagauuugugauagcagucuguuucagacgaccucauaccguucucauggagcuucuuuaauuccuagguuguaggaaguggugguccuaagagccugcacggacuugaacagggguauguuugugcuuuuuuaaauuucucgggaauaaguucaacuugcaaaggaagagugacuguaacaauggcacacagucuggccauguucacugcugcucugcacccgggcuuugucauucuugcugcagacauuuuugucucucaagucugucaaguucguuccuuugcccugaauauuuugcuccaaggcagagggaagacugcggacugguuuuccaggcaggauaaccagugcugacccguccucuccuuucccuccuguaacuucugagguaagucugaaguaauuuacugacuugccuuuuguggaucuguuucuuuuagucuguuagaaacgguucucagcuauauuaacacgguagcacaguccauggaaaagaaugcagacaaacugacugggaaguuuuggcgagcgcugcucagcaaagcuuacgacaugcuggauaagguagguuuucugggcuuucguuucuccccuuaacuacccuguuuguuacuacuuuuuaugccauuguaaaauuauuuaacucaagcuugcacuuuaacaauacacuaaguaauaacuuuucuugauguaagaaagcucacguuuuccuuguucaagucucuuaaugucuaaaaacaaacuuguuucccuaccaaugaugagaaagugugccucaauaaaugugaugaauuuaauaauugaucguguagauauaguguucugcaucauugaagugggauaauauaaaaaggccaauuagauguauuagauuuacaugcuuggccuugaaauuaggacauggccuagaguaguuagcuuccuuuuaguguugcuguuuugguuuuauuugugguuaguaauaacugccugagagcuauuguaugugagagcacauguauggaaaugucugccaccucaggguuuauaauaaguaagagucugagcuggccauggugacuugugggacaugccuguagucccagcucucaaaucggaauucaaggcuagccugggcuacauggauaugcugucuguuaaaaucauaaagucugucuuacagaguugaguucuccuuuuuguuugguguucaauguucccuucucuguaggucaaugccuugcugcccacagaaacauucaucucugugauuagagggcuggugggcaacccccugccgucugugcgucggaaggcgcuggaucuuuugaauaacaagcuccagcagcacacauucuggaggaagaaaaugguaagugagggcccuauugcaagccugcagggcuuccucugcugcuuagcucgcccacgguucucuggcacaccaugggaaauggaaggcucuuaugaucuggauuggcauacugugugugaugugugagagagcaagacacccgcuguggcuccucaugcuagagaugugcuaaggaagaucugaggauggaauuccuaaugcacuucugcuugcugugacccaggcagcccuggcugaagcauauuugccucuucucgccgggacacuguauggaucagcaguuggucagacaguuugugcauaugcuuagcaguaagagaggcggauggcaguggcacugaggagaccgagaggcucucgaguucacgccccgucuaggcugucuagugaguucagggucagucuuaacaguaaaaagaagucugaagcuggagcucuguggcuggauuacuguguagcaugaccaagacccuagcugacugcucuacacugggggugggggaagaacaguugcuugaaugugguugugugacuugggacucagacccaagcaggggagaugggaaagaagacuggcccuucuuguagcucugauuacagguuguuuuggcuuccauuucuucagguccaccgcuuucucaaacugguuccaguccuucuggccauugugcaacauaagaaaagggaggcagaggaugaacaggcaauuaacagacagacagcgcuguacacccugaaacuccugugcaagaacuucggggcacagaaccgagagccuuucauaccaguucucagcacugcaguaaagcugauagaaccagagaaaaaggaggagaagaauguccugggaagcgcccugcugugcauagcagaggugacguccacucuggaagcgcuggccaucccccagcugcccagguaccuaggaacaggagccacuacaacggaaauggggaaggaaugcguucagggcuucggcuucuugaauagaaaguaaaggaaaauagaguagugaaagaauugaucuuuucuuugcucuggaaagugcaccauuuccugugaccuucagacauugcuuggcgauguucuuccuuuccagagucgcagugcuuagggagcagcggaagcauggccagagcagccguuugcuguggcagaggcaagcugggcgcuccugacucugcauuuggcucugaccauagccugcuagcauuguaacaaguuacuaaucuuaaaacccugccaucuguaauacagggccauauccucuacacacacagacacacacacacacacacacacaccguguuucucuuuauaggccuuguugugcucugcacauguucagccauugaagacauuccuuuucacggcuaccaugugucagcacuguuggcaccaaggauuuuuuuggaucuaguaguagaaaauguacaggcaguauucugcauacuguggguuacaguguuguguagcaaacacagcuggcugagaguuuuucuucauguccccagcucccuucuucaguguuuguggcuugaagcugcucuaacacacuuguuccuucuugccagccugaugccuucgcugcugacagccaugaagagcaccagugaguugguccacagugaggucugccugcucagcgcccuggcugcccugcacaaagucguugagacucugccacacuucaucagccccuaccuggaaggccuucugacccagguggguuugguuauugugacuugcugcucaggguggccagggggacaguuucaccccucagucaucuuacuggcucgcucuuccuaugauucauuaugugauucuuguuuccaaacagaggugugugucuguugaacauguaccucuuucucuuucguugucaucucugcuucaucauggaaccaacaggcaaaauagggugucuuucuuucagcugugugugauguacagcuuuuauuuaccuuagaucguugaggguggcaggaagaguugcccgcuguuauuuaggaaauuaguauggcuguggcuuugaugggaaagcgucuuuagcuguaagguguuucauauagugggcuucuuccuuuacaggugagcuguugccugucagcacacugugagcgaguggcauuagcugaaaauagccaugaaagucaguccuccuugaccagguuacuaguguucugguuugugauuccuugccgugugaagcugagucuugacugccauggugccagugacuugacauucauugucuucagcaagggcucaaagcugcugucucuuggaagggggcuaagcugauggagucuuccucagcugcuuuuagugagcaagaaccugaguuguaggaaagccaucgaucgggcugagaguucucuguacuccugcgcucgacauucaccuucuucaucggcuuccagucaggggagucauccacucaguuucaucugcagauaaucaguuugcuuuagaagaguuauuuguucauccugugagugugcuugccagcacaguccagugcccucagucacuguuuuucauguuccugcaggugauucaccuagagaaaaucacuagagaaauggguucugccucacaggcuaacauucgccugacagcucuuaaaaagacccuggccacugagcucucaccucgaguccuacugccagccauuagcaagacuuucaaacagauccagaagaacuggaaggugaguguuaacuguugaucucuggagcgggaagguggugcugaaugcucaguguucgugucugggagcauagcaucguucacuucugugaggaugcacugagcucuaagacaaggcaaacauauucucugcuguauucacgguagaaucacaugggcccauuuaugagcaucuuacaagagcacauuggggugaugaagaaggaagagcucuuaucucaccagucucagcugaccacauuuuuccuggaagcccuggacuuccgggcacagcauucagaggugagcugguccccacuccccaggcccugaagcugucauuuccuaucugugcaagagccagauuaauuuuuaacaguguagcauuuguccuugccaaaacauugaguccaugccaauuaguuccuuucuuuucaggacgaucuagaggaaguugggaaaacggaagguuggaucauugacugucuaguggccaugguggugaagcucucagaggucacauucaggccucucuucuucaaggugagccuuucuuaccugcaugucaugcucacugucacuggcagggugaguagaugaugucacuguucucuccugguuguagcuguuugauugggccaagacagaagaugcgccgaaggacaggcuguugacauuuuacaaucuggcugacugcauugcugagaaguugaaaggccuuuucacucuguuugcuggccacuuggugaaaccuuuugcugauaccuugaaccaaguaaacaucuccaaaacagguugguagcuccuuugggccaaggcacccguguccgugugucugacacaggcacguagacaagaccuagagcucagaaaagacuuacaauccuugguguaaggauggugaacuuuuacuuugccauauuuucuauuauguuagaacaaauaaucgacauaagagaaaggguaaagugggcauuauuacucauuauugguaguagcuguauaauuugggacuggagacagcccagugguagagugugucccugauauagguaaggucauggguuccuccccagguuuggaucggucuguccuuugcugauaauuaucugaacuugcucaacuuaagcaccacagucuuagcucuaaaggagagccccaucuguggacaccauuguuugguguuguaccauuuacagcuucuaggucauucgcacagucuccuagcuguaguuauggcagugucucuaagcaccaggacugaguguuuugcauuuguacucuuucccugcauacagacgaagccuucuuugacuccgaacgugacccugaaaagugcugcuuguugcugcaguuuaucuugaacugcuuguauaaggucuuccuuuuugacacccagaauuucaugaguagggagagagcagaagcccugaugaugccccugguggaucagguaacccacugcaaggccuucugucacugaggccuccuggauccgucucugcaggguuuguauaugugacaugauagcuuacaaggcuuagucauacaguguuuucaggagacggauccuuuaaggaaaauguuacucaaaaauggauuuuccauggguuugacuugucuuuauuguggaguucauugaguuuuacuugggaauuucaaaaggaaagaaauaagaucucauugucaguuuauccauugaaaagguuuguuaacuauuguuaaaggagccucgcugagcauggcugcucccacaggaaaguuccaccaccccaggucuuccagagggagaaguuggugcuaagggcuuuugcagcuguuugagauccagagggaagaaguuggcccuagagacaagauuaguauggggagaacuuacuuuuugagccuguuaaugcugacagcccauguaucuucccagcuggaaaacaggcuuggaggagaagaaagguuucaggaacggguaaccaaguaccuggugcccugcaucgcacaguucucuguggccauggcagaugacuccauguggaaaccccugaacuaccagauuuugcugaagacaagagacucuuccccuaaggugagcacugggagucagucucagaugccgcauuccccugguggguguugccuaaaugcccaccuggagucaugaugucagccgggguacugacagggacagccuggcccuaggcccgcacuacuagaggucugagcugcuguauaauauggaguucuagcuuucauaaagaacucuugggcugggaagaugauucaguugaugaagugccuguugugcaagcauaugaacaaaguuugaccucuagaauucacauagaaagccaccugcuaggggcuagagagacggcucagcacuugggaguuggcuucucuuccagaggacccaaguucaauuaccaguacccacaugguggcucacaacuuuuuauggcuccacuuccaauggcuuugcccacuuuacucagauauacacucagacaaaacaccaaugcacauaaaacauaaguaaaucauuuaaggaagaaaaaaagaaagccagcaugcuggcauguaucugagaguuacaugcaaaacugagagauucgcuggaaaaaauuaaaguguggcaccugaggaacagcacuugaaauuggccucugaccuucagaugcaugugugcacaagugcacacucagccaccacacacacguauauacaguaaagaauuccugauuucuucuguaggcucucauaaauagcuauauuucacagugcccuagguaaaguaggcaggagcauuagcauacuaaauaccacugguuagaaaugagugccgugguacauugagugaaguuaacauuccuuaccuggaauuuucuagccguuuuauuaauaaaucaccacuaucaaacuaucaaauaagagcuucacugggggacuggagagauuggcucagcgguuaagagcaccaacugcucuuccagaggucccaaguucccagcaaccucauuguggcacacaaccaucuguaaugggaucugaugcccucuucuggugugucuggagagcaaugguguguguguguguguguguguguguguguguguguguguguguguguguguguguauguguguguguguguguguaucuuugaaaaaaagaaagagccucacugauaagcagcccaaagucggagucauucaauugaucacauuucuaggaguuaaaaacaguaaagcuauuuaucauaugguugcagaaacaaauuuuaguauuuuaucuugauuacuguuaggaaaaucuugauuaaauauaauuaugaaaauuacuccaaauuagaaagggggcuauuuuguuucaguggccugcuauuaauaccucauagcuacuugcauugcuuaugauaggcaagguguguggagagaaacaccuaagcuuuuguucagugcuggaaggaaacuagccuagugggagucucggucauucagggacugccagaggugcugcaucaccagguuggcacagucuaggcaacccaacaaaccgccuccaccuaggccuaugcuaggacucccugaaguuuacauguggugguguuuuguuuuacauuuauguauuagggugggggcauaagcuugcuguugggggggggggucagaggacaacuugcaagagucaguucucuucuucccccauuaaguggguccugaggauugagcucaggccacaaggcuugguggcagcaccuuuacccacugagccaucuuacuggcuucucugugguuuuucuguuuugguuugguuugguuugguuugguuugguuugguuugguuuuuauucacauuuuaaagagcuacagugcuagaacacaguuugaaaaacuguuauguagacuaccagcucucaaauggcuacauaguaguucuuuuugugguagacacugagugaucacagugaggguguaaaagagcacucaguguacaaagcaccaucugcaugcgggucaggccucacaggagugagcagcaguagggacagacgacacggucucauucuugaugacugcuccuguuccuuccaggugcgguuugcagccuugauuacugucuuggcacuggcugagaagcugagagagaauuacauuguucugcuaccagaguccauuccuuuccuagcagagcugauggaagguaagucugcagcuaacacugacaaaauauuguggccacaggcugucugauacaagucaggaagcugucaccucacagccccugagauuguacuacucacauaggaaauagcuucagauauuuacaggagucagugucuaugucauuacgggcagucaguugugcacuggaaugaggggguauacuugcugaugcucaguuaccacugacauaaucuuacucaauacucacaguggcucacacugccuguuuuaagagaagcuaagaaaggagagguuagaaaguucuaagacuuugauaauagcacugaggcaggugaggcugguuuaaacaggaauucuucauugaccugccucugcauaugaauugggguugcuucugcaucugaccagaagcauacccuuuuaugucuggugucgggugucuuggagagcuucuggggugcagggucccuugagagcuugaauuugaauguguggccccuucuuguggcauccaagaacaaguacaugccugugaggagugggggacaguuggggagcaccucgggucacagccugcuaggugcuuccuguaccuugacacaacagugguaauuaggcaggacagugggcagcccacuucuaauucugguuuucguuguuagacgagugugaagaaguggagcaucagugccagaagaccauccagcagcuggaggccgugcugggagagccgcugcagagcuacuucugaggcagaaagcgcaucugcccaccgccugugcucugggaagaagucacacucauucucauguuuuaauggggguguggugccauguuacuuucgguacuuucacaucugccgauacuuaauguuuuuacaaaaucccugccugucugggauaccacagaauccucuccugccuuuuguacagaguugcuaaggaguaaaccggaugguauuuuuauacaaacugguauuugucuuuauccugagugguguucagaugagacaggcauguuuaauuucaguaccugaggccuagugcuucccugaagcacgagcugucacuguuccuugcagcaccucauauuugugguauagguguuagcaguacuacaauccacaguaguggucucaagaaaauggcaucacacagcagcauucagcaggaguuucuggugacagccauuuggaguagguuagagcagcucauccaugcaguuugacucagggcuguggaugucuccgcuauucaucuuuucugugugugggggcuuggggugggaugggggggggugggucguacgcugcuaaggaaacagcccucagcugaccgacaggacacaggaaggauagcaacacuaguggugguggugguuuugaaguucuuugucuagaacuguuagguaagacugaaaaugagaguuccaacagaaucaaaccaguuugcaucuauaaccucuaaaaacuauuccagagaguauucauuccaauuuaauauaaaacuuuaaugcagaauuaggacaagcaaaaaggcauuuugcaguuuagagauagaauuucggaauauacaacagaaggucucacaaccuaaauuccagcagcuuuuuaaaaaaaaaaaaucuaagaacuuaagacugaaucuacuuagaaucagucuuaauuguguaaaaauagaaaugaaaauaagcuguuguaugaauaggcuuuuauuuuuuuuuccugagugccuuugagcccccaauaucucaguagugcauucuuuaugaagacucauucuuuaugaagacauaacucuggagaauucuagagccuccuggccuccguacaaauuacccaguuccacccaccaccccauauugaagagugaacauaauaaauuugcaugaaaaugaaggacuagcaguugcugccuugaguaagacugcugaugguauuauuucauaugcacaagugcauauaucuaagcagauuggcugaauacuccuaaaccccagcagaauucuguccugugguuuaaugugccugaccucgcugcugcugcagaccgacaucuucagacccaaaggcacgagggcuagucuccacaccaacuaagccuuucacacuacgccccuggguuugcuuugauagugcuuguuuuauauauacguccaagaggguuuuacacacacgguuuauccaacuucugccuuacuuugccacagguacccacacacccuggacuugagcgccaaucaaccagcagaaaucugcuuggagcagaacacuuguuuugucauaauucaggguuuuggccucaguuuuucugcuguguucagcaucauacauuuuauaaaguuuaaagcggugagagcuaaguaaaugcuaugcagucuucaauuaugagauaugauagaaugcugauuaugaaaaggguugcuggggaaguaguguuugccauccauuaguauauuuuucugaccuuaacugcaaaggccccuagugggguuaaugcaaugccagcaagaagacccuacauuaggaggccagaaacugguacgaagugcuagaaaacauggaccacacaaguucugggcccugccaugucugugcccggcucagagaauauacaaaggaaguaugcuugccaucccuauuagcuaguauauguaguauauuaggcacuuaaauauuugcugagugugguuuauaagagggacccagugugcagagccucucuggcagugagcugugauugccccggcucuguuccucugaauguacugcauggccagaccugacaacaccaguaggacuugauguuggaggagcucaacuuagcaauauaaacaauauggugaaagcgagaugcauuugacauggccaguaccggauaagccauuuuguauuucggggguuuuggcagucaugguagcuaccagcuccuuacauccagcaaacggauaucaccaucgacugauaguguaucaauacugcuuaggucuuuaaaucuguguuuguacuccaggcugugcacaccauuuauagcaaccuugaauucccggacaucacaguagauuaucaucug

SEQ ID NO: 6887 - RNA, 47349 nt, Mus musculus
ugcgcagagggcgugaucauaacugaggacgccgggggcggggccuccugggaugaagcgggggcgcgcagcacugguacaucagucgcugcugcugcgaacgguagaguguuccuugcccgagaccggcgcucagaccccggguccuggaggcucccggcucccaggcacugcccccugcugucgucgucgcggcgggccgucguuccccagccccgaucggccgaggcgacggcagcggccgaggucaccaugaguccgggguuccgccgggccguuacugggcagggggcggcggccgcggugcaacugcuugucacccugagcuuccucucaagucuggucaagacucagguaagcccgaggaccaaaggcaggggacgggucacgccggcgucgccgagaggccgaggugcaggugcgaguggccagccagggauugagaaccgcgccggcuagugcgggaaacgucuguaaagcgcggcgggcgcggggacacgacacgcguggugaugguuuacggaagaggaagauggugacggccaguaagcgcuagcggcuuuaucuuugugauggugacggggagacacaagucuugaguggugaagguguuggggacacaaaccucugacauccuucccucagaugacagggaggcagacccuccauccucuuccugggcuagagggggcauuacuucauuuccuugaacuugugcucuagagauagcuauaggcauuacccgcuuuauaauuauccaccuguccuacguaugcaaaguggcaugccaggugagcccaguuaugacacuggagggccuaggccccuacugugggcuucuuaagucuauagugaggcuugcuggcuggacaguccgguagacuuugacguugccuugguuaggcagguauuacugaaguguucacuacauacucgaaagccaaagcacagccucuugccuugaaaagagauagguuagcucugccucuuuuagugaggaagguuugaacagguugccagaugcugcuauaucuugucugcaccugcugcaaagugcuagcucgaagagccaaaaccgaagaaaaacaaaagugucucagauggccugauaaugaggggcaugcaguuugaagcaauuaacacucauugcuaagagaaaaaaaaaugaugguaacugugagaguaaccguguaaacauguuuuucugccuuguucaugguguuaugguguccagcaugaaguccuagaauacaagaauauucuguuuguguccaugugugaguucucuugaaugauuugauaaaaauaaacagcuaggaacaguggcauacaccuguagccucagcucucagggguaaaaaacacaaacaguaggaaaaacaguaggauugccgcagguuggacgcuggccuacauauugagauucuggguuagccaggacuacauagcaagacccucucucaaaaaacuaaacaaugaaccagucagagaaaagaaggaagaaagggaaaggaaaagaaaccuuuuguuaaacguggagcuugcugaguccaucuggaacugagcaaggaaucagaauuuuaaacaagccuuguaagugucugugaugcaauuguucuuuccacuauacuuuagucaggcuuggcaaacacuaugauaggauucuggguguaucuaucagauuuagaaaaaauaaauuuccuaggcugucaauagcaaaguuacuuuguaguuacuaguuugaguguuugacuugaguggagcuuacauuuagaacuuuuaaauaaagucugauuucuuguuuucuugcuugauauaugucauuaauuaauuguauacuuuuaaaaucacuagucuagaagcuucacuuaagguuucucuagcuaccaauaaucacauguaauuagugguuuauaauguaccuguaauucuauuuguugauauauauuuguaauauauauaucaacaauaaaauauuugugcauuucaaaguaacaccgugccugucuacaaaaguauauuuuguucuucuaaauacaguuuugaugucauuuuuagauagcacuuuaaccuguaacauguuuaauuauauauuaccucauuuuauuugguacauaucauguguaaggcuguggugguuaagugaaguucagagagcuuaauuggcuuauuaaguuacauaaacuggggcccuaauguagcccuuuaugcucuacccagcauuaacaaaucagcauacuugcuucaguggacagaaaaacagagaccagacaaucagaagguggaacauagacaguuccucuacuucucaugcauccuaaacuugggggacggggugugcagggggagaaagaguaaaaguaagaggaagaauuagaauuguugaacaaacaccucuguucacaagaaaucaaagucauuuaaggaaauagguacuuugccuucuauauugaaagcaggaaaauguuuuugacuaugugagaggauguucauuuguauaucugaugccccauuuucuuauaaaugaaaugcaaauaugguucauggcaugcuaacauacaguuuuccuguaaaaggauauuucugucaaauauauuugaaacccuuuaaaaugcccaucugagguggcaugaaaucaaggaacacagagcuccccacuaaauggaggucagaaaugugggacucauuccacuacccggaggauuuguuucuuuuaaaccugaagaccaagcuuuuagucucacagcuucguggagguagaauugguaagaaauaacaccagugucuucccuaaaaauggaaaaaucauaagagacccccaaagagauacauuguuaguguaagugugaauggaaaaugagccccauuuuguggaaaaggaaaaaaguuacgaagaaggggcugaaaacucggcugagaagcugugacugugagcagccccucccucacgugccuuuucaggcuuacucuguaucacucgugcuaggaugagcuuuggcuagaaguggaauucacagcaagcccagguuaccagagagagcaaauauccguuccuccuagagaaguguguuuucaacucaaggacuuaagagauuucagagauaguguccaguggaguaaacagcuaggagcgugccaaaaaaaguuaucacaagccacaaggcacuagguaccuugaaucagauacaaauagcccccggcuuaugaugguugaauuuuuggcuuacgaugguuggacuuuuuuuuuuuucuuuaaauuacacaggugagaaagcuauaucugcuuaguagaaacuacuucguaauuugauacuuuuuuuuuucuguuaugcuaguucuguaauuucagugcuaggaagggacagugagcaacaguucaccaucagcuaugccaacacaagcauaauaaacaacucagacuccacaaguugucuccugagguucugauccaugcuguaugguaggcuaugugucucaauugcauuuccauuugauauuuuuguuuuaguggguuuauugggaggggagcaauuucucauggaaaguugaggaacaccuauaaguggaaacacucaagacaauaccuuaggcucugaaauuuuuaaguagguaauuuaauaucaguuuuaguguacuuaagaaaagcauagaaguauuaaacaucuaaaagaauagccagaagguuaaaaauaaugaaauugacguguucaaaguaaaauuuaagccaaguauggugguaugcacucauaaucucaagaaugagugaacaaaaucagaaguucaagguuggcuuuaguugcagagccaacuccuuguuagccugagcuacuugagucucugucucaaaagaccagcggggaagggaaguaagauuuaaaacuaaaagggugaauuaauuaaauagcugauuauaccuagcuuaagaaauaacgguuacagauuuuccuaaauaauccuuugucacccacucuucugcccuaucggcuucacgccuaacaaaagagaauuuccacagaguaauccacuuccuggacucuguaccaacuguugugauccuguugguuauagccauggaugaaucauucgugcucuuauagcauguguuaggguccauuucuucuuuucuucucaaggcugugguucucgccauguuuucacuucccccaccucauuaguuucuccuuaacgagcugucacugucauccuagcagaugaccuugggucuuggugcugcgcucuuguccuuguugaacacuuuuccugacugagcugccaccugccccuuuuaauuucuguaucuggaaaaauuccuaggcugucuucauuucauuuuuccugacuuguuuuguuuaaccuauucauuacagucagacuguaccaaauuguacuucuacugcccugaaaucucucuugucgaggguucccagugucuuucuugcuaagacuguauaguuccuaaaccucagguucuaccuguuggaagaauuguuguuacagcucagccuuuacucacuuaagugcuugcuuugguauccaggaugcuaacuuuucugguccacuuccucuguaguggccucgucuacuuuagaacacuuggcuuguuucuccucugcccuugaucaccagucauuugacccuugagguuugugucuuucuuguucaucuuaucugaacacuugguuuuaaaagcccaucuguaccugagucucaaguuuauauuugaagacaagaaaucuuaguuguagaccaccgcaucuaacuuuuuauucuccaccauuuacauuugggugacacacaaccucaagcgucagaaucagaaagaaauaaauguaggacauuaucauuaggacagaacuccacucuucccuccuaccucuuuguucuuguugguugguaacaauuaagccauagauuaauauuaguauucaggguggcaugucucaacgguaacuccugaccauugguggugagaugcauacuugauauaaaaacuuaggaagucaaucugcuguccucuaauaaagcugauaugugcuuagagcaauuuuacacccaacauuaucaccuugauaaacucuuccacaugucucccaagauauauguacaaagaugauugcauagguuuuuucuuuuuagcaaaauuuauaaacaguguggaauauauuuguuuccuguguugcuauaacaaauugccacaguuuagucacucaaaacaguguaauguuuuuaaucuuaugguuuugaggaccaaaaucuggaaaugaguuuuacagugauaauauccuuaauuuuaucaauaaggugggaguccuggaggcuguaagaacuguuucuugauucugccaagcuucuaagggugucuuuagucuuugccuugugacuucuuguaucuucacugucaguauuguaaacucuucugauuucuccuguaccaguaccccugucucuuucugacaaggaauucauuuuguuaacucuauuggucucuuucuauuaauccaauauaaucuucaugccuuaagauccuuaaucaugcugggcagugguacagcacaccuuuaaucccagcacuugggaugcagaggaucucugaguucgaggccagccuggucuacagagugaguuccaggauagccagggcuacacagagaaacccugucuugaaaaacaaaaacaaaacaaaacaaaacaaaacaaaagauccuuuaaucauaucuuuaaauuuuucuuuaaaauuuguauauuguguguguuugcauguuugcacguucauguaugcuugcuugcuugccauauacuagcaguauguagaggucagaggaguucuuuguuuccaacuucauuuggguucuaaggaucaaacucagguugccaggcgagcauccuuacccacuaagcaaucuugucugcccuagucacaucuuuaaagacacuuacuuuguaaaagaguauccuucuaagauuagguuugugcaauagaaucuucagaaucaggauuuucauaccuugggcuguucuucugcauggaacaaaauggaauggguaagcugugauuguucauauuauacagcguuuauaucaggaaaaguaaaugagcuagcuagcuacacauaaaacuuaucaucauagaugccaaacuaaaauguuagcaaaagcaacagcuuugcagaagaauugaacugaaaugacauuaauguuacuaaaaugggaauugugaguauauucagggaugcauuacaaagaaaaucacaauaguaagcuuucauuuauccucuagguagcuguacuugagaaagaacuucaggaaauauuugcaucuacauuucagacuuuuggugauagacagguuuuacaaguuacagauguguguuaacaguaauuuauccuuagcacaaugaaaauggccuaugugugugugcacacauggcauggaggcuagaaguuaacacuaggugcuucaaucuuuuuuccaccucauugagucuugaugaagcuggagcuccgcaguuagaaugucugacaccaagcccccagcaagccuccgucucagccuccccagugcugucucccaguuuuauguaaguguuggagaccugcauuuaggccuuuguguuuguguggcaagcauuuuacugacaucugccucccagccccugaaaauauucaaggaaaauaauaguuuacaaaccaaaaguuuucagcuuaaaaagccuuacuaagaaagaacaguuaccagauaaaggguuuuuguuuuuuguuuuugaacaggguuuuucuggcuguccuggagcucacucuguagaccagaauggccucaaaugcagacaucugccagccucugccuccugaaugcagggauuugaggcauaugcuaccaugcccagauuagaaaagauauuuaaacucacgcacacaugcacacaggcgugcguguaugcauguacacacacacaugugcguauguauauaugacugcugugacuagagaaccuagaagcucaaugaaauuugagaguuagugacaggauccuaggaaacagagagauuaaguggggaauuccagcccuuguuccuucuguaaaggugacauguuacuguguccgugugggauggaguugagagagacauuuccacgcugagaaagaaaaaaaauuggcuagaacuucugcuucugaucucugcuucuaugucuccuccuaucugagggcuuccugaauacaacauuuaauaggcagagugccauuguuuuuaaaaccuugaacugacauaguugcaaguucaugugcaguuguaggaaaaaauacagagaaauacuaugucaugguaccaaguuacacaaugguaacauuuuauaaagagagaguuguaaauaggauguugccauugguagaaugauuugauauuuuccugguucuguguauauuauuuguguguacauauucacauauuuuggggggagggggcuguuuuuuuuuugagacagcguuucuguguguagccguagcuauccuaggacucacucuguagccaggcuggcccuaaacucagagauuugccugccucugccucccaagugcugcgaugaaaggugugcaccaccacugcccgguuguauucacauuuuuauuauauuguguuucaugcauucaccaccacaaugaaaauauggaucaggcuauucccgucaagcaucuguucuguuccuaucucccuccuccccuucuccuccucauuauuucaugucugcaugcuugcaaugaguggguguagaugcucaauugaagcaucuauccuguuccaucaucaccaucauccucaucaucuuggaggcgagggugugggugcgugugggugcagacagacacacaugucgaggucagaugacaccuuuagaaauugcuucuuccuacuuaucaugggauccugggacugaacucagguccucaggcuuggaggauagaggcuuuuaccugcugagccauccuguuccuccuccagcuugcagccaucacacuuuccaccauuuccaaagcuuuucagaacacucuguaccuggaaccacagcgugugaguuuggggaaugcugcucuuuacuuaggagacgucucccagggucaauccaagucgugcauauauacguacugagagucauuuugagugaagcugaaggaugucuuucagaaucuuuuggacucaaaauuuaccucauauguaccuguuucucuucauggauucauggaguaguggggaagaacacagacuuuaaagacugauagaugugggaguuagguuccauguauguaaaacaaucauuggaagcuuguuaaaccaugauuuucuuacaguggggguuauuuacaggauaguguuaaagaguaaaugaugugacauacaaaagcucuuaacaccacauguggcacacaaauagcaacccaaaagaagguguagguggccucagcagagcauuacaggcuguggcuucuagauuagucugaauccaguggcggcuaagauuuuuauugauugggcagaggaaaggcagaaguaucuuccauuuugaacucuaaaagaaggauugguauuucaaaguagguauauguaauuuuccuggauuuuuuuuauauuuaacuacuauacuuaaaaagugacugcuuuaauguuauaagucuuaaaaauacuuuuuauaguaguucguguguguauguauuggggacugaauacacaugugacauggcaugcauauaaaaaucagaggacaaguuucaagaguugguacccuccuuccaccauaggagggagauugaacucacauugucagacucgacagcagacccuuuuaccuacuaagccacuucauuggcccuaauguuauaaaccuuaaucaguaaaacuggccaacuugaaugaauaaauugucuuuuaaaauaguagguuuauuaagguguaaacauuaguaacuuguauaccuuagaucuuacucauguguguauucuaggugacuggaguucuggaugauugcuuaugugacauugacagcauugauaaauucaacaccuacaaaaucuuucccaaaauaaagaaguuacaagaacgagacuauuuucguuauuacaagguaagguggcaauuuuuaauucuguuaauccaaaguuuucuauauaguugucugcaaaugugacuucuuuuauuauguuuuucaaaaucuuuguaagaaauaucauugugaaaagcuuguuuacaacacacaccaagaaucagaacucuucuucuuauguuuggaaauucuuccucuuucaguuucaguuuugaggugacgauuccuccugcccacacggacuuugucagccucugugagcacagguuaugugcucuggaccucacuggcaggcugcagcggggcacugggcugguauaaugggcguaucuuaaacaccacagaguaauaggaggucacuggugcucuuuguggggacugcaaacuaagucaugcuacaaguagaacaugccuccaccguuagucuguggacuccguuuuuuaaccuagcaugaguccugggccuucuaaaacaucaguggaaaggcaggaacgguauuggauguacgucaacaauuagaacgaaaaaaaauguaauuuuauauuuuuaaggagacaguacuaaggggguagccuagugaguuaaaacaauuauucaugucuauucauuguacaaggcagugggcgacaugguggccucuuuugguucaaguccauccugugcuuugaccauguucacucuccguuucuucagucccuccccucuguguguuguacagucuauuuuauagcuauuuuuuaaagcuaugcuuggcuuucccuuaaucuuguucuugcucuuacgauuugacugguagauaauuugguuuuuauuuuaauuuguucuaaauuuuaaaccugguuucuuuuuuaaucaugacucugaauagauuaucuuaguucuuuaaauauuuuugagggugaaauuuuuaguuuuuggcaauuguagauuauccaagaagauaaauuagaaaauuacaaauugggacuccaucccuuugacuacagauacaacgaauauccagaaagcaguaaauguuucuucucuguacagaaucuguugagaaugcagcugguagauuuauuucaaagauaaaucuuuaccuaaaacuguggcugaucuuuggguauuuuucauauaaauaagaucggugcucaugaguuccugcaugacaggaguggcuguguguauagacguguccuucauaauauuagauaaaccaaaaagaaguuguuacuucaaugguuugaaaaugguugaacaugucaguuucuuaugguccagucuaauccaguggaaacuuuguguugcugucaggcacugugcuuucaugugggguccagguaccauuuccucugacucugucccaacccucucucagcacaucucucugugggacugcaucuucuauuucuguauucacauaaggccuggcucauugaagaauugaacuuuuagaugaauggauaucucauuuaaucuucaugugaaauuuuuguuccuaucuacauuuuuaaauugaagaaauaauaggccuggguauccuaaguaggauacuuuuguugacuaaaaaaacccguaaguuuaagagagaagauaauugagacguuuacaaacuucaaagacaaagugaagugguacacaucagaaggaugagagaagagcaggcgcggaugggccuucucuucaugguaacaccagaacugcagaggugggugguugacugagaguaacuaggcaagcacuguuacccugagcuguagcaucagcccuucaggccaaaugagcuauuuucccaucuuguucuuguucuuuauaaaagagucaaauuucuggaggagugaaucaugacugguccaggaagccaugugcuaccuuuaccaaaagaagaaaagauaccuuggguggcagugcuauuccaaggagcaugagggaucauuguuucugaaaggaaauuagaaggcuguuacaggagaagggaaaaugagagcuaaggcaaaaauaacaguguggccaaucaacauagacuuguuuagaaaugcuuuaacacgauaagguuguuccauauaugaccaauccaugccugucucccaagaggguguagcccugaucuugcugaugccuucaucucagaaacaggcagggauuugagagaaagaugcucugcuucuaguucugccugccugagagauaaauagaaacauuuauccauucacaguauguuaacuagugagaaucuaagagaaauugauuucaaacacacauauacaaucuaggaauuuggggaacaaggcgcugcuggagguggaaguaagcucccaccuuugcagcuaggcaauugauuggucacaccgaugaccucuagucuuguacuguggauucagcagugaguaagacaaagcuugcguucugcuuagggagaaaaacaauaaagaagucgauauugaacuguauugccagauguaaggugguuacuauagagaaaauaaagcaggagcaauguagauggcgugaggauaaggaauacagagauagguagccuugcuuugaugaagugaucaggaaaggaugguguucaugcuaaugugauauuugagcaaagaccuuucuaaugugaaaguauaagugguggggagaucuggggaaagcacuucagggaaguugagugaauagauuuaagaguuuagacacagaaguaagcuucguauauuugaggaacuagaaggcaacuuaggccacagaaagcaggugaaugagaaggaggauuggagagagagguagggaccagcuuuaaaaacguguuucuagcugcauauguagcagaagauagccuagucggccaucaguggaaagagaggcccaucggucuugcaaacuuuauacgccucaguacaggggaacgccagggccaagaagcgggagggggugggaggguaugggggacuuuugggauagcauuggaaauguaaaugaagaaaauaccuaaaaaaaaaaaaaguaauguaaaaaacaaaaaccaaaaccgugaacgugaacacauggcacacacacacagacaugauacagaaauauacugaggguugguuacauuugaaguacuacuuuagaguacuagucuagucagggucugcugcugucaagagugaggucgaggaacaguaauucagacaaagagaaugggcaguauagagauaggcuuuggggcuuacagagcccuguauaucaaguaaaaaugcagugugauagaugagguaagagaggcaggugacaauuguuacauaguguguguagagcugcugcagggauagagagcugaaaaugcacaggacgguucugagcagucaugggaaaggucugccuugguuuugauguaacuguugcugagugcaauaggugggggcgaaggagggaaacuauugcagacccuugggcaagagacucgauggugauggaggugguagaaaguagcaagggaggaaacagaaaacugucuggguuuuuagcuugggcaauacaucuguaagucgugugggauuaucaacuuccuguuguaugaagacuaugggaacugguguuuaccauguaugugaccucuacacguauuguccauucuuuuuccaccaaaaaugguggaacuggugguucuucauuuuuagcaccaucaaagcucuccauugcuguagccaaaugcacacuuccccaccuuucaucuuccuaaaacauggucuccucagaggcuccauccaucagcacugugacuacaaaacucuaggcucuccuuuggaacacacacuacaauuugcaaugaaauaaacaugugaguacuugauuuuucuuuaggauauuguaaguccuagaagagaaggcucucguuggccuugagccuagucuggugucugacagcuagccagugcuuagcacauacuaaggucgcgcugaagcccuaaggcuaagguggucguugguguuuggggaaugaguauuaaagucauucggaaaugcugcccagugacaacugugcuucaaacaagcagugaacuugacugcugucccucuuuugcaaugacagagaaccuauggccauuaaaagcuaacacuccguccaagugccugcauagccguagucacuuacugucugcaccauguacacgcugcaggaucaagcagcuucccccuccccaucacuacugugucacugugcccaacacagugacaucugcaaacugucuguaauuaccaugccugaucacuaauguugauuuguucuuccuggaaagguuaaucugaaacgaccauguccuuucugggcagaagauggccacugcucaauaaaagacugucauguggagcccuguccagaaguaagaguaugauaauggggagugggagggggugggcuggcuucuuggcuuuuaaaaaaucauaccccguugccaguauucuuguguuuggacuuguuagaagagucauaagcuuucaacucuuaugauuagaguucuuaaaagaucgguugagaaauucguguauccaguggcguuggugaugcgguguggacauaggucugauucuaaaugggaggaagaucagaggcuuaaucuaggauuagaccuacaagggcucuauugaaucugcaucuuguuucauaggcaaaaagagaaguuuuggaccuuaaacuucaauuuuuuuuuuuuuuugguuuuuuucgagacagaguuucucuguauagcccuggcuguccuggaacucacucuguagaccaggcuagccucgaacucagaaauccgccugccucugccucccaagugcugggauuaaaggcgugcgccaccaccgcccagcauaaacuucaaauuuaaauugggaauuucagugcgugaaguaggaaaauccacuuagagguuuucaauacuuuuuucuuuaaagguuguguuuacuaccaagagaauguuacauuccagguaggguuauguaugugugaaucucaaugcuggcuggcucauaauagguuucuaaauugaguguuuuaaucauaaguucaagcgaucaguuacuuuccauauguagugcauuauagccacuucugugguacauuucuaguaagaaauaaacacaguguuuauuuuuaaauucaaaacaagggcuggagagagagagagagagcauuugcugcuccuauagaggacuuggcuuuaguuaccaguacucaagugguagcuuagaacuacccauaaccacuguucaggagacccaguacugucucagcugccauagacggcaggcaaacaugaggugcauguguguacaugcuggaaagcacucauacacauaagacauaacuuuuaaaaagagaagucaaacauaggaagcaaacuacagaugcguuuugagaucaguguccuuuuguuccuuccuuucccugauaguaacuggcccucugacuaucuuuuaaguaauggucuuauuuuucuuuuaaagaguaaaauuccaguuggaauuaaagccgggcguucaaauaaggugaguuacucuucuuccuugacuuuuuucggauaguggggacaguagagagccaugagucuaccuggaaugggggguugagggacucuuggccucagaguucaaaauguuaacucuugaaucaagcagugagguuaugcaugccuagcuucuuuugaaauuauaucuguuuucagaaucucuaaauaggaaaacucucaauuguaauugcagcagaaauacuaguaacgauuuuaauauucuguuucaguuaguauuuguuagauucagaauuuauuguauaaaaaaaguauucucaagcuauuuugagccaagcacuuggaaaugguguuaagauagucacuauacuuuuuauuuuuauuuauuuccggauaagcuaugcucuuagcuggcaaguaacucucaucuuccaauguugcacauaccuggagauuucccacucucgcugccucccucuucuuuacuguggcccugugcagccaucuaucccauguacugaugcucacugcacuuccccgacaccauguuaaucccauuuuacuuacucuucccuagagccagccauuuucugaagugacuuaagugguucuacucuuauuccauauguaucugucuauaaguaacacuuucagaguguguguccucaguacuauauagauuacuuuauggaaagugaaaaacaauuuauuaauauaaauuccuucaaguuggaaauacuuuuaguuuguauuuggcucagugcuuuugcuuguaaagccucuuucucuguuuacacauuggcucugcauguggacguuucaggcauucuaguuucuugcucuugcagugaaacacuggcauuuuuguaccuggucucauugugugcacaugaaaguuucccuaguauuguguauagaagugaugcuggaccauaagagcugaguaucucagcuuuuuaaagugauacaauacacuaagauguuguaauauuaaaaaacaaauuugccuuggguuauggucuaaguugaagacugcuguucuaaggauuuauguguuuguaaaacucuagauacauauuuauccaauuuugcuacccaaugacaacaucacuagcacacuauugcauuuuaaaugccuuugcucacuuaaugguagagauucaugccuuuuuaaaaaagucuaacuguaaggauuuugauaauagaaugugucaucguugacugcuaaagaagagcuaaucacugucauuuaacuacaucugagcuuucuuguaguacucgcaagcagcaaacagcaccaaagaacuggaugacugugagcaggcuaacaaacugggcgccaucaacagcacgcuaaggcaaguuuaguuguacuuuguuuauaucagucccuuuguguaauuuuuuuuuuuuuugagacagaguuucucuguguagcucuggcuguucuugaacucacucuguagaccagccuggccuugaacucacucuguagaccaggcuggcugacaucagagaucugccugccucugcacuaccaucacugcccagcuuaugauuuugauagaacauuuuuuacuuaauuguuacauuuucagcuaauaacuucuaaaaagaacaauguccacaguugcauuaaauguugcauccuuuguccuauuuuguccucggugguaacaccagaggaugaguggacugcagggcuuuucugcucuucaugaacauugugcggaaggagcugagcccuugagucuuuaauaggcaggaauccaggcuguguauuugcaguaaugaaagcugcucgcaacauaauuuaaguuuuauaauuuuuaucugaugacuuuuucuuauuugcucuacacagaaacuugcuuuugaaggucagaauaauuuauaaucucggauuauucaguauaaagugacaucagugugacuuguaguugggaugcaauacucauacauucuuuuaaaacuuuauuuguuuagauuuauauuuauaaacuauaauugcuauuaaaucauaaaguugguggucuuuauuaguaucuuuguaauagggcgauaauagccuauauuauuuauuauuaaaacuuuaauguagaaaggugaaaggaugauauaaaaacagcuacaaacucacucuucaaaugaaugccacaauuuuaaguaauguuuguuuauggggcuauggccugagcccagggccucaccuguaauaguugagugcucugcugcaugcccacauguauaaauacacauacauacauacacacacacacacacacacacacacaccccacacgcacgugugcccuacguauaagaggaacagggagagguauccugguucugcauuucucuaacaauuaguaguauaauuuuaaacaacuuuauuuuuaagucuaauuggcaacgcagugugaugugcauauuugaaauacacagcuucauggcuggacauuuguacauaugccaccuccacuuccccaucucaugucuccucacauguuuuuaccuguuguguuggacugggagaggggaacagugcggcaccaagcuggguggugcacaccugcaaucccagcacuuugaugguggggaugagagcauuggggguuuaugaagccagccuaagucacacaacaccgcccuauuuugaaaauccaaggauuggagagucaauugugauaagaggacuagucuggcaugcagagugugagccaaugcgucaugaauuagucaauauaauaaaguuccugguauuugggguuccuaugaauauagaagcaacuuacauuuaaagaauucaaaaaacaaauugaacuucuguuuuuuuaaaaaaaguacuacaauuugucaguuggaaugguaaccuugaguuuuguauguguuuauuauauaaguuguaaauuaaauuuaaauuacugaacuagggcuaagaauuauuuuaaaguagugaggcaauauaaacaagccauggaaaguggugacaaugccuuuauaauuucuuaguuuaacuacugcuagaauuuagggaauuuauggcuucaucuucugaagaaauuaucuuuauuuuuguucacuagaauacaauguuaaaauuucagcuccaaauauauauauuuuuuuguuucuuuccauaguaacgaaagcaaagaagcguucauugacugggcgagauaugaugauucgcaggaccacuuuugugaacuugaugguaaucaaauaaguugucauugucacuuuacccugaaguuuuuuguaagacauuugaaccauugaaaauauggccugaguuagugcugcaacaucggguuuuuccguggacauuacuaucgauaguugcauuuauugagagaguauguuugagguccuguacuaaguacuagagauauguuauuucuuucugaucuuuacagcuuucuuuagauguguauuguuccauggcugagaaacuugagccucaaaaagcaaauaauuugcucaagaccacauaauagcaagagguugaggcaugguucaguccuagaucugagucccaagccuguguuuuuaacauuccaacgugccgucuccugugggccuucacuuuagaucacuugguucucguucugugaacaggccaugaacaggucuacucagggugagcuacucccugcaguacuggggaggauucugacuuaacauccucauagcccucuccuuccaagcauccuuggaagggugauuggcaggcucuggccagccaagugacugccacuuagcaaagagaauuacaguaacucaaauuuuccagagaguauuuccaccgugcuguguauucaaaucauuccuuugaccucuccccacuuuguacuguaguguuaacuuguguaacgugggaaagaacaaugagccccaaccuacacagguggaaauggaacucgggaagcagaaacuucccaaguccuuuagcguucucaggugguuauacuccuuuguaaagauuugaagaggauucucagauugucuuaguuuucuuuucuuuucuuuuuucuuuuucuuuccagacaggguuucucuguguagccccuggcuguccuggaacucacuuuguagaccaggcuggccuugaacucagaaauccgccugccucugccuccugagugcugggauugaaggcgugcgccaccacgcccggcuugucuuaguuuucuauugcugugauaaaauacuucaacuaauguaacuuauaaaagaaagcauuuacuuggauuuaaaaguuucagggggcccgaguucaugguggcagagugagggcauggcggcaggaauaacuaagagcucacaucuugaaccucgaacacagagcacagagagggaacaccaggaaugguuggagucuugaaagaugagcaccuacccccacugacucaccuccaccaaaaaagccacaucuucugaucuuccaaacagcuccucuaaugguaccaaguauucagacaugaguguaggggaccauucucauucagaugacacagaacuaugcucuaauacacuuagauaaguuacagagggcuuuugcuguagcagaaucaagaugagagcugagagcuagaguguucccaugacuggauauaccaguauagaaccagagcaaugugaaauguccccauugggaggcuuagaguaggugguuuuguuagagacacuuucuguggcugcugucaucucuauuugaguggaaguaccucaaguaguuggcauuguuuauuuuaugucacuauucuuucauuuguuccgguugacaacucaaguaugcugagugccacaacucaugccugugaucucuguacuugagauguggaggaggagggaggaucaagaccccaaagucacccuugacuacaguuagucuagcuacguaagagccucaucuuaaaaagaugagccaaacaaaaaaacccuacuaucaucacuucuuucaauuaaaaauuaagcauggagacuuucauauuaauguauucugugaauauauauuacacucaaaauaggcauuucauggaauucucaggguuggcgauauggcuugguggguaaagcgcucgccuugcaagcccagggaccuggguuugaauccucagcaacuauguaaagcuggacauagugaagagcaagagaucuuaccucaaaguagagggcaaggacagacagccacaguugcccucugaucccuacaugcaugcuguggcaugugcgagcgcgugcacacacacacacuccauacaugggguuaaaaaaaauagcucaccaccaauaccaguauccuaucagucugcaggaugauuguuaacacagaaguugacauauuagauaaccuguaauauaguguuaacaauuuuuuuugguuuuuguuuuguuuuguugagauaggguuucuguauagcucuggauguccugaaacucgcucuauagaccaggcuggcuuugaacuugagaucugccugccucucccucccaagugcugggauuaaaagugugcaccaccacccagcacuuguuugguuuuuuuguuuauuuauuuguuuuguuuugaagacagauuaucucuauuuugcccugacuaccuuggaacucauuauauagaacagauuagcuuugaagucuuagagauccaccugccucugccgccugagugcuaggaaagguauguggcacugucuuagucgguguuuuauugcugugaagagacaccucgaucaugacaacucuuauaaaaagaaaaccuuuaguugggguuugcuuacaguuucaaagguuuagucagucaguuauccacaugguggggaacaugacagcaagcaggcagacaugguagcugagaguucuacaucuggguccaaaagcgacaagaagagagaguaccacugggccucauugggcccuugaaaccucaaagcucaccuccagugacacacuuccuccaacaaagccauccaccgaaucccucuuaaguagcacuacuucguaacaacuaagcauuuacauauaugaaccuacgggggccauuccuguucaaaccaccacagccaccgugaucauuuuaaccaguuuuuguuuguuuguuuguuuguuuuaaauacuguuuucacaggacuugcuggcauacaccuuugagagacaaagacaggcagaucucuuuuugagguuagccuacucuacuaaguaaauuccaggacagccagagauauucaaagaaacucugucuugaaaaaaaacaaucaaaccaaagaaaaaauaaaaacaaaaaacaaaaagccaaaccccacauugguuucuuaaauuguacauauggaagguaugucuugugaguauauuuauuuaggcaggucuuuagagcccaguagcucucuuacuauagcugcucuagccuccuugcucugagaggcccuaguucugccucuggcaugcuggaguuauauagguggccaccauuccugucaaacauuuaccugguucuuuugggacaccaacucugguccuuaugcuuucaggacaaguggcuuauccacugagacaccucccuagcucuacuuuaagauuuaagauuaugaacuugaaacacuuauggcuuuuauauaacuuuaugcauaugaagcuaugcugcauacucuuacucugaauagcaguguccaccugugccccagugauguuuaccugucauuugucauuguugccaggauccaggauuguuguuuagaugugccuguuguauuaaugucaguggauuaaaauuaaaaccucaagaauauucacucaaguguauucaugaaaauacuugcaugcaccuguuucugaugucuuagugguguuucuuucucuguguggaaggaagagaaugcuauaggucaagaaguagguuuucaguacuuuugugguuuaauacccacuaacucgggggcucucucuguuccccugcuagcauuauacacagcuaguugcuucccuccguucauauuucugcucagaugucaccuguuucccccaggccccacacuggugguuucugcccagcccacuuuccaacauguaccuacagccuguuacccaggagguuuuguuugugugcugucugccuucuucaguuagacugauauaccuguggacaagagcuuggucuuugacucagagauguaauguccagacucguauguggacauggaaguccuuaaugaauacucggcuaaaugaacaauuggccuaaauagggugaugggcagggcguguucauuaauaauuugaaaacacuguucaaaguaaucguuuccaaaucuggcuguuacgauuacuugaacuucauaaacuauggauccuccucaagugugcagaccaugcuuuuauagcgaauuuggaacaaauuagauaagauuggcaauggacuuauaagcucaaccaagaaccuuaacauguuuaaaucuguaacguaugcaacaagucugcacucacugugagcugacccaauguuacacuguguuuuaagaaagugccuggguuguguuugguacacuagaaaaugaggugaaaccucauaccacugcuacuaaguuaggacaguuaaagaaaaauucauuuggaacaacgcuacauuugagggaggacauauuaauccagucugauaaauuugcaaaauuacgaagggcagaaucccaaucucuggauccuuagauaauaguuagcguggcaaaauagaaaagauagcuuuguaggaggaagaaaacuuccagggagaggggcauagggauuauaagccagugagaauuagguaggaucaauguccuagcagaccuggguggagaauggccggccucagcaccacugugggaacuugcugcaucacucacucuggagagaaggcaguccucaucaguguagggcggggcuuuucaguaaauaccaaauagaaaucuuaggguuuuguagacccccaucucuguggcacucucucagugcugccagggugaugugaaagcagcccgugaccaccaccccucccucccagcagcagccacgugaggcgcguggguagcuugccagcucccuuacgugagcuaacaaauccuacccuuuugugauuugaaaaaaguauuaaaagauguuuuaacugaaagaaaaccgagaacaaaaauuuuauuuaaugaguuaaaaaaaaacuugauauaauugcuuauacacuuuuuuuuuuaaacuuccuuaaaguucuuagaugauuugaguguggguguacacauucguggugcugaguaucaaccacacaugcuaggcaaguaugguuucauugagcuacauugcugacccacuaaaauauauuguaaaucgucaugguuugaugucaucaguguagggcagggcuggacagggcuuuucaguaaauaccuuuucuuuauaguuguugaauggguuuucugugguaaggagacuggugcaaguccuaccuacacacucauagcagacccugcccaugauauauaagaauauauguguauaaauauauacaugcauauauuuaaaaugaauauaugucuauacauaugcauauauauauauauaucagagaauacauuaaugacauucagugauauucaagaaguuuuauuuauaaccaaaucugcuuuacagaguuuaaaaaauagcucaaagaauuaaaaauauguaacugaugcuagagacauggcucagcaguuaauggcugcucuuacugaagaccuggguucaauuucuagaaccuagauggccgcucacagcugucuguaacuccagcugcaggggaucuggcgcccuccuuuggccuuuguuggaacugcacgaugugguacagaagcauacauguaggcaaaauacccauauguaagguuuuaaagaugaaugacacagaaauuagaaauaaaaugagaaagccauucuguuccugcccaggccucugcucccugaagugugcucaguaaaauugucuuuuuauuacucuggaaaaaauagaaacuaaauaguacauuuuaacauauuguuuaaucacaauauuauacauauguguguguguguguguauauccauauacauccuuuuuuccgcuuaagguuugugauugcguaaagguaguaaaaaccagagcuucacaaguaucucacguagcugcuuccugcauccuuacccuacaaaacaaugcuuaaaaaaaauccucuaccgcacucuccccgggcucuguccuaguggcugguguggaguauagggcacccgcugcccacugaugcacggucccuuuccacagugcuggagcugggcuugagucugugcccguguauuccuacgacuucucagagucccaugggcaaugacugaggagacaaaccaugcaggaaacagucuuuuaaaaaaacccucaugauuugaacuuuuauuuuuuauuagaauuuuuaaaauuaauggcuucaagucaaauuaaacuucuugugaguuuuuguauauucaauuguaacuuguuuccugugucuuugugacuaggauuagagauaagaucuugcauucuguaaaaucauguuuccauuaucucuguuguauucaauccauuuaauaggacaauuuaugguuaccuuuuuauccuccuacaucacgauagcagcagguaguccuuguagggcaugggccggguugccggguuucccugugauuauggggacaacagucaaugaauaucugaugcaucuuguuaaagagacagaaaaauacauugccaaguagaaaaggaagaggaaguuuaaagaccaaauuauucuguagagaauaauggaaaaaucuuuguaauacaagauggaacaaaauaauguuucugagccaggcaguggugguguuaccuuuaaucccagcacuugggaggcagaggcagguggauuucugaguucgaggccagccuggucuacagagugaguuccaggacagccagggcuagaaggagaaaccccgucucgaaaaaacaaacaaaaaauaguguuugagucuauguugagauagauaaauuauagaaagaaaugacaugaaucugauucauuucuuuuuacuccugugugguuaaaucugauucuguuauuucuuuuuauuccuggaugguuauaacuaagguggagaauguuacauucccugagugaacuuugaggaaccaaagaaaggaaggaguuguucuuuucccucuugaguaauuuguccaagugcuacacauucagggucaaggguggucacagggacuaagcacccaaccgugugagguggaguggacuugacccaggaacuucucugguuggagagucauuguccuguggcuuaccauuugcuccugacagaugagcggucuccugcugcacaguauguggaccugcugcugaacccggaacgguacacuggcuacaagggcuccucagcauggaggguguggaacagcaucuaugaagaaaacugcuucaaguaauugagggccggaguaggagaggcgggucuuguuuguguuguaaaagguaccacauguacguuaaaccauuuuacagcucgguuuugugcucuucuucaggccucgaucuguuuaucguccuuuaaauccuuuggcgcccagcagagguggguuuuccauacauuccaugcuuuuucaaauugaagaaaaacaaagugacaauuuuauauuuggcuuaauuuuagugauaugaauggucuaugcauacccuagauuucuugagaaauuuaagcucuagaggccagguccugcccuacagagagugaggacccugcccccauguuuuuaaacacuaguuucaugacucucagccuuccuaaugcuggaaccuuuuaauagaguuccucauguuguggugaccccaaccauaaaaguaucuuuguugcuacuucauaacugcaaauuugcuaugguuauaaauuauaguguaaauaucuguacuuucugauggucuuaggugauaccugugaaaggucauucaaccccaaagagcucaugacccacaggcugagaaacaauauccuaguugguuaagugcagccaagguggagagucaggggcucaucacagcuuccuccacagugcacgcagguuaccugggagccaggugagcacacaacacaggggcugugucacaccagagcccuaucuaacacacucuuugugcugccugggguacuuaccuauggaccaugcucuguacagagagggugaugggaauguaggcagucuggcugcccucauacuguuccagccucugcacugcuccacaaaguggccaguuagcagcuggccauuagcuguuucugagguuagugugagccugaauuauaguuuugcguuuuaaguuuaguucacuugauguaaaugugguggcagugccaucugccauugucaucauguaagaacuugcauguuuaggcagaacucuuggccuacagcaugugacacugagguuguagugcccaggcacaccucuaaaaacaucucuuucagguacauaguagccacugugccguucagaugguguagcauguuguaguugggacauugucauccucucaucuacgaauagcaaagaccuaagacuggcccuguagcugaccucccaguccagaguucaggucaggacugagacaaaaaguggaaauuccuuugaagauuuguaccuucuggccugaggcccaaauagauguggaauaauugaacauaggcauugcuuuuaaaugcuggcuguaucuaggcaaaaugcuauucuccaagcuaguucugaaacugccugguaagguugggauuaugaacuuauuuuuuugugucuuuugcugcuuuuacaucauaacuuugguuuucaacuucaaugucuuaauuacacaaaauguuagaaaaaucgagacacuggagaagcuaucuaaaggacaagaggccaucccugccugucuguccccuucacaguuaaggaagacauuucuucugaccuuuccugugguuacucuguuucaaagaagaaaauacaauuuauuuuuaaauaaaagaugccagauacaaagaaacacuuuguuuccauuuaccauaaauuagacaagaaacugcuggacagaggaagaggggaaagaaaucaacaaagagaagauggaagaaaaaagcugggacaaacuuucaaaggcaggcccaggcagugagaguaggcacagcucugcugcugcucaaggaagccugccacuguggcugaugguauugguggguucuugacugacauggagggcucugccugcucgggauacaguuucauccacucuauuccugaagcagugucaucucuaggccucuguuuuucccaaagguuuuaagcaacagaaccuuuuccugagaaauaaacugugcugucagacucugucagacaaaggcaacaggcagaacaauagugaaggcagcucagccuugagcccucucccuccccaggaggauguccuugcucucguucaggccaucugggcaaaagacuaauccucuagaagagcacccagcacagcaacugugcuguccucacaggugguggguagggacugaaggauauuuucuauaucugauaaguacugaauuuagcugccucuggccaucucaguugcuuccugucuuuuaaagugcugaagauggaaaucccaggccuugugcacauucauauuuuagcauagcuacacuccagcuccccagagucucacugagcugccauccgagccuaaaacugggacagacaggccuugaacucagcgaagguccugccuucagcaucccaaguaucugggauuaugaccuguguuaccaggcccaguuccuucucccuucucaguuucuuuccccucuccccaccuccuccaucuguuucuuuuguagaaugugaaagucuuguacucuuaggucuguguuuuuguuaagaaccuuauuugcaggaugcuugcaauagugaucagaguuaacgauacaguaaacaguuuaacagugaggauuaguguugcauuaauuagcagggcuggaaucugaguuggguaagacaucuuaucaugucuuucucuuuuuuucuuuuaggggaagaugauggugaguugaaacucuuguguuuacuuuaaccaugaaagaagucuuuuuacuauuaaauauuugguguuuuucuuucauucuuuuuuaaagcagaugacuuaaucuauuuuuucagaaaugaauggugacugguaauaaauaagauuuuuaaauauaaaguuguuuuauguuuaaaaacaagcaugagaccauuuagccuaaguguuucguuuguaaaguagguccacuuuccgaguuucccguuuucuguuaaugaaaucuugaauguuggugaugaagacccuugcugccaagcuugcuggcccgcguuugaucuugaggacccagaagauggaagagaguuaauucccuuuaauuguccugugacuuccacacauuugcuaggcaugcaagaaccucuccucccacccacauacacaauggauaguuuuuugguuuuuuguuguuguucccucccccccccgccccccccccccccagacaauguuucucuguguaguccuggcuguccuggaacucagaaauccgccugccucugccucccaagugcugggauuaaaggcgugcgcaaccaccgcccggcauggauaguauuuuuauuuuaaucuacaugaagauucugagaagauguaguaaagugacuuuuaucagauaauuugugacuucuuuauuuucuuaacugacuuugaaaguuacauuuucaguuuucaauaaugugcuuaauuuuauaaagacuauuuuccagcauuuggcuaugaaacagccagacaguuuuuccagucgguuuccccuuaccuguguccaguggcacuauacagacugaggguguauaaacugcacacguucccucugugagccaagggcgcacagaggaagacaaaugcaauacacaacccacgccacagacacacagaaacccagacacacagccccagcagcagguguaacucaguaagggcgaaacaaagcccccucaugcaugagcugaugaugagaaacuucuuaaagaagugggcuuuagaugaacucugaauuaagggggcagguguagaggaguagaauuagcuagugcugccuuacugggauagcagaagccuaggaucugagcagaagucuguccugggugacccuuuugcagugggaaggacuggacucaucuaaggggauggguuaagaggccacauggaagcuuuugggagcugccaguuaaggaagugugauaguaacagcccuuagccaguauaagagggacagauggcugcagaaagcugcccgugguguuuuggggugaggugcagugucacucaggaugcagaacaacucucaagguucauuccagagaaugggcagcaccucugugagccgaggguucugucauucucucagaaagugcagcagcacuucccuaacucaaaagagcauuauugagccaggaacaauuuucucuuaaugacaaaaguauguccauuuaucagcaguguuuugaagcuugugucauggggugugacuaaacaagaucaaugcuauaucaguuugucuguauacuucgcuucuuuuuguggcaaaggcacuuaaacucucucagcgguuuauaaggacacaaggcauuguugugcuaacucuggucuucaugugugcaguagaagggacuacugcagcagaugugugccuuaccaccguccucucagucccucucagucuuaggucccacgcacaggagucacagccacucuaagcauuacauugaaaauuauccuuugaaauuuagucuuagcuaauugaggaaacacaccuuccuuuauuggcuuaagaaaaauugagugauuauaauuuaauuuuuauauucgugguuuacugguauaauuaaauacuaugcuuguugccucagacagauuuauuguuuguaccuaugcuuuugaauuuaagccuucagugaauaagauauauuuuaguauuuauacugcauuguuuuauauauuuuaacaaucaaaacaucuauaagaaaacucuccacaacuauuuaaauuaucaguggguuuuucuagacacacaugcccauuuuacuauuuagucuaaagaaguagauauuucucgagggaguccucaaaugaucugacuuauuguuuauacaugaauauuuaaaauauuuaaccaaauuuuuguuuuuguuuuuuuaaggagaaucauucuauacguggcuagaagguaaacuuuauauuugugguugauuaucuacacaacugauacuuaauaauauuugaaagaaaauaccaguuucauuuguuauauuuugugauaaaacuaugugaaaaucuugaggcuacuggggagccaaaaaucaguaccagaugaauacacaggcucgaagggccauuaggugcuccuaagugacucaucgggcuuaccugacuuauccacaguuuacuaguaacuaguaaacaugucuacuuuuuagagaucuuucccuuaguaaggaaccacuugugauauguaaaacaggacaagguaaauuagauucagaagucuauaacauguuugcccauguccacaugucugcauguaucugaugaaaaagcaauguagugugcagugcacuuuucacucuucauguuuucuguaucagaaauauaaagacuauaggcuaaaagcuaaauguccuaggagcuaacagcuuuggcugguaacugggaauaggaugcuuuugaaaucaugcuauacuguuaguggaggauuagcaagcugaaugagagagagagaaaugauuguuucauagcccuaagcuuucaacaguauuaaacucuaaguagucaauuccauugguuguuaauuggcuguuuuuuucuuuugaacauaauuuguugguucuuagucaacuauguauguauaugucuauguguguguguguguguauauauauauauauauauauauauauauauauauauauauauacauauauauuauaaaguaaacauguaugaauacuuuuaugaguuguguuggaaaauacuuuuaguaaaagaugguguaacuaaauaagucuacucuaaagaugaacauuguggaaaguaauuaagauugggguguccgacauuuugacacugugauaugauacugggguuuacaaauguucuggaugcauguuacacaugggucacaucuggacacuucugacugacacucagagagguaguaagagacuugaaugcugauaaugggagaggauggagucccuggcaguguuugaccuuaggcacugugcaucaacuacuccaccagugcucugcugccuggggucccugaaugugguuccagagagcaccuggcucagccuuuucugagaugacuuugucuucuggagcugagggugacaacaguugugcugcuaccuacucuguugguagagauuacaccagggagaguucuugaaaacaaccaauugacagucaaaggcagaaugcuucuguggcaguaguaaauuuaacccucuugucagagacauguggacauauauucaguguccccuaaauccauuguugaaaaauaauuugagugccauuaaaucuaaaagagaucucccuaaauuggguagucuaauuuagaauuagaaguugguagaauuggcuuuguagggugucuuuuguguguuauuucagagaaagaggugaaagcuuuugucugcucuuguagacaaagcccaaccuuuuuggcaccaagcugggccagaaggucugcagcauuuccugccaguguugcaugucuguguggggcaguccgucaucggcaugucuuugaugucaguauuuugcuugagaucacccaggucacagaauuuguauuccugcuccaccuuccuuacggugccugcucgacuccagcuuaugagcugggugagcuuugcagaaagcaacucuucuuaguuccccaggcuuugguuuuaggccugugagugcucaugaacuuggcuaggccugugagugcucaugaacuuggcuuugguuuuaggccugugaagcucaugaacuuggcuuugguuuuaggccugugaauguucaugaacuuggcuuuacucgcuguuccuucucuagacuuuggccauuuuguaagacagaagcacugcuuauacagguagguuggaagaaauagaaauugaaccucaaaugugaccaauugcuugauuauguauugaaggaaaauuuccuugaaguuaguacuuacuauuuuaguaaaucucuuuauuuguaguccuuguuauaaacauuuuaaauugcauaugcuuuuuggagaaagcuacaaaguaaaauuuaaucucuauauuuuggucucuauaacacuuugaauuagagaauaagaucucaaaagaauugucuuuccuaguuugaggauguuuguuucagagccaucugugguaaggaguaaacuaauagucugagaguccuugauaagauccaacaguaagccauauagauccucuuauguuagaauuuuacagcacauaaaugagacugugccccaauguuuacguuuucccaguacgaaggauguuaaaaagcaaacaacgccuguuuggugguaaagaaaaacuuuaucuaacgacucuuaaguacuaguugcauuugcaaagggccugaguuugguucugucacccauauggcagcucacaaacaucuguaacucuagguccuugggauccagcgcccucuucugaccucagcagggaucacgcaugcacauaguacucauacauacaugcaaacacacauucauauauguaagguacaucagaauuuaaauuuauuguucugcauuucacuuacuuuuaaauuuucuauaaagaauauucauucaaauuuuuccuuucuucaugugaauuaucauauuggccuugggguuuguuuuauuuauguauuuauuuauuuauuuauuuauuuauuuuccguuaguguugggaguugaccucaggguugugugugugcuaagcauauuccuggcugcugagccucacuccaggcaucuuagccguucucaagcuuacuauuuggcaccacuaagugcacuuauaacauauaucacuauaacuuauaacguauaucacuauaaaagaaaaucuccgcguacgccuucaaucccagcacucgggagccagaggcagaggcaggcggauuucugaguucgaggccagccuggucuacagagugaguuccaggacagccagggcugcacagagaaacccugucucgaaagaccaaaaauaaauaaauaaauaaauaaauaaauaaauaaauaaauaacaaauaaaugagagaaagaaagaaagaaaaucuuaugaaguagcagcagaagugaaggauuaugggauuauguggguauuugccauaaauuuugagcagaagccuguguguguuaaggaagcuacauguagugacuuuauaucacauccaugaauuccauauggugaggcuuguguuauacucgauuuuuuuuuaaguguuaaaauucugggagucuguuuccuagguuuuguuucucuguaaguagaguaguaugucaacagagggaauuagcucaugccaaggcaagagcccacaaaggcccuucuuucccaccacaaaguagauucaaagaacacagagggaagguauaagaugacaaagggaucgcuaaggcaaagcagugacuuccuccugguaguuguguauagugcauucguagucuagacuacaaccugugcaauugcguucugguagccaacgaacuacacagcugcauccaguguuugggccacguucagggaccaggcuuuucugucuuguucuauguuaaguuuucacuggauucaguuaagucuauucugaaacaaucuuaguguuuucuagucaaaaaucuucaucuaauugccuauagaguuaucuccugauuuguuuuuauuaucuguguugguuacuuuuaugucaagggaccaacauagcugagaaagauuucauauacagaacaguuuaugcggcucagaguuugagagggcucacuccauggugacuugguccugagcacgccugugagcagaucaugacagagggaauguguggcagaggacacuguacugaagacaggagcagauguguauacuauugcccacucccagacccuguccccuacccccugcuguauuuccuguagcuaggccccaacaagcaccgcagaccuaagcccgcagggacacugcacauuucagccauaacaguguccuugaauauuaaccugacacccauguacuaacuguuugugauuugauauuuuuuaucuaauggauacggguucuuuuuuccuguuuuucugaauagguuugugucuugagaaaagagucuucuauaagcuuauaucaggacuccaugccagcaucaauuuacaucugugugcaaacuaccuucuggaagguaaucagauuucguaaauggagacguuuuauuuuuuuagaugucauaaaaaguguuggaaaguaaaacacacucugcagagccaaagcaaacgugccaugcuaaacgguggcgugcuucuuuuucuuuucagaaaccugggggaaaccuaguuggggaccaaacaucaaggaguuuagacgccgcuuugacccuguggaaacaaagggggaagguccaaggaggcuaaagaaccuguacuuuuuauacuugauagagcuccgugcuuugucaaagguggccccuuacuuugagcgcucgauuguugaucucuauacuggcaauguggaagaugaugccgacaccaagacccuucugcucagcaucuuucaggauacaaaguaaggccuggcuuuuaguuucuuggaauccuccacugcucagcugacguggagcgaggggugauaaagacuugacuagaggucagaagagagagacaggagcaguaguagcacaguggucuuccagaugcugaacacaaagcugcucugaagccuggcuacagaagcauuuacacuggaaaacaggcuguguauguuuuacuaaagaauuuaagauuuuauguagcaucaaaaugccccaacaauggugguauuucuguuacugcugaaaguugaauagugucauaaguauaagcauuacagcgaacauaaaaguaguugucuuaagguuuucugcuguaaacagauaccaugaccaaggcaaaucuuauaaaggacaacauuucacuggggcuggcuuacaguuuaagagguucaguccauuaucaucaaggcgggagcauggcaaugucugggcaggcauggugcaagaggcccugagaguucucuuguggccacuagaagauugacuccaguggcuaggagucgggucucaaagcccacuaccacauugacacacuuccucuaacaaagccacaccuacuccaacaaggccauaccucuuaauggugcuacucccugggccaagcauauccacaccaccacaguagugauagcucccuuccaaaccgcaaccuuuuacagcuuccuuauccuguaaaacacauucauugguuguuaaacaugaaggagaaggcagauggggaagaccuaaaguaaacuacauauuaagguguacaagaauauugaguguuggaauacuuggagauuguuuuucacuuuuaaauaauuuuacuaauuuccuuaagauacugcauccuuaagauaauacagucuugggaugacaauccccuaggaagacuaacagugucaacuaaccuggacccuugggaacucccagagacugagucaccaaucaaagagcaugcaugggcugguuugcacccagcccauguguagcagaggacugccuuguguggccucagugggagaagauaugccuacccaauccuguuaagacuuguuguuucagggagcagggaugcccugggaguggggagugggguacucuuuuucagagguggaggggagauggaggguaagaacucugugauggggggaccaggaagagggacaauauuuggguuuaaaugaauaaaauaauuaauaauaagaaaaagauaguauagucuuauaaauuacaaagucauauguaguuuucucuauuaguguacaugugaacuguuacccuccuacauuauaaauaauaacauauuuuaaauauuugcagggcugcaaaacucuugagacuaguauuggguuucucauugguaacuuacuaauagucuugucauuucaucagguccuuuccuaugcacuucgaugagaaauccauguuugcaggugacaaaaagggggccaagucauuaaagguaauugaggguagcgugggaaccacuucucaauucauccacacuugcaguuguccuacaucauacuguuaguuaacuuagauuuugguauaaauugagagccaguggcacaguguggcaugaugaauuuacagcggcgucuguccuggggccaguguucuaacuuagguuucacucuaguaacuuuuccuuuugcugugaggaaacacccugacaagcuagauuaguugagcucucacaaguaaaggccucucacuguuagcuuuccagcccuucauuaaagcgccuucucaguaaaauguguugaaauaaugugcaacaugaaucuucaccucuaucaaugucugcuguuuaagguacuauguuguacuacacaaauuuagaucguuuuaauuacugaaaagcaauagucacuuguaaaccuuaaaaauuuauuuuauauguauaauuugaccaaacguaucuuaauuucaaaagucuaauucagauauuuuuugcacaccaggaagaauuccgguuacauuucaagaacaucucccggaucauggacuguguugggugcgauaaaugcagacugugggggaaacugcaggugugugugauuuuuccuuuccauuccuucuucuuuuaucuuuuuuuuuucuccucuucuuuuggugguggugguggugcauucucuguguagcccuggcuguccuggaacucacucuguagaccaggcuggcccugaacucagaaauccgccugccucuggaaugcugggauuaaaggcgagcacugcugccgccaccuggcucucacauuuucuuuuuuccauuuuuuaauuagguauuuagcucauuuacauuuccaaugcuauaccaaaagucccccauacccacccacccccacuccccuacccacccacucccacuuuuuggcccuggcguuccccuguacugggcauauaaaguuugcacgaacaaugagccucucuuuccagugauggccgacuaggccaucuuuugauacauacgcagcuagagacaagagcuccgggguacugguuaguucauaauguuguuccaccuauaggguugcagaucccuuuaguuccuugggugcuuucucuaguuccuccauugggggcccugugguccauucaguagcugacugugagcauccacuucuguguuugcuaggccccggcauagucucacaagagacagcuauaucuggguccuuucgauaaaaucuugcuaguguaugcaauggugucagcguuuggaagcugaucaugggauggaucccuggauauggcaaucacuagaugguccauccuuucgucacacuuccaaauuuugucucuguaacuccuuccauggguguuuuguuuccuauucuaagaaggggcacaguguccacacuuuggucuucguucucuugaguuuaauguguuuagcaaauuguaucuuauaucuuggguauccuaaguuucugggcuaauauccacuuaucagugaguacauauugugugaguuccuuugugauuggguuaccucacucaggaugaugcccuccagguccauccuuuuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguggggacaucuucuggauauaugcccaggagagguauugcgggauccuccgguaguacuauguccaauuuucugaggaacugccagacugauuuccagagugguuguacaagcuugcaaucccaccaacaauggauugccucuuucuccacauccucgccagcaucugcugucaccugaauuuuucaucuuagccauucugaaagaugcugaugcugauacaccccaggacuacauaagaaguagugcuuucgagauuacaagucaaauacuguggcucugaugaagaaaaggggccuuuuaguaacguggaacagaaagguguucaacaagcuccagguugcuuagguucugagaaguguugugcuuguguguguugugcuuguguguguugugcuugugugugugugugugaucugugagaagugugcuuguguguguugugcuugugugugugugaucugugagggcguaaauacugcuuccugaauaggccagcacuguguuguaaagcucccuucguggauuuuaaaaacagauugucuuuguuuuuauuuaggguauguguguguccaccgaggcaguggagggugucagauuuccuggagcugagguuacaggugguucugagccacuggaugaagagcugggcauccccagcugcuggcugucucucuagcucccucauacggguuucaguguccucccuaaguaauuuuucauaguagcuauuguguaaaguuaacuguaaauuugugacuguuuucuucagacucaggguuuaggaacugccuugaagauccucuucucugaaaaggaaauccaaaaccuuccggagaacagcccauccaaaggcuuccagcucacucggcaggaaaucguugcucuuuuaaaugcuuuuggaagguaagcggagaccugauucccuccagguuucaacauacggcaaagguuaucuuucccccaaagguaugccuugguuugguuugcugacagauaaaugcuggcugugguggcacacacucauaaccgcagcacugagaaguugaggcagacagaccaugaguucaaggcuagcuaucauggcccauguaguaaggaccuuguuucaaauaaacaccuuaaauucauucuucaguguggccuccaggcugauaggcaaguucucuccaucagucccaggaagaacugagaguuugcagcuauagugcuuuucaauuuucuuucucaauuucaugaggaaaauagccuccguguguguguguauaauuaucagaaauguuuuuuuaaguaauuugaauuuaucuacagaaauauaugcaguguugggauauaaagcagaaggaaaagaaucauagaaaauaauauucuguguuguaacaguagaacaaaauaagucaaaucacaggggaaaauuuauuuuuaaaacaggaccagggcuggagagauggcucagugguuaagagcacugacugcucuuccaaagguccugaguucaaaucccagcaaccacaugguggcucauaaccauccuuaaugagaucugacgcccucuucuggugcaucugaagacagcuacaguguacuuagauauaauaguaaauaaaucuuuaaaaaaaaaaaaaccaggaccaaaugacagagauuaauauguauguuuuaugagugugauuuuuaaguucaaaggagaccaaucacgcaaagaugacuuagcuaugccccagcguaaugccaaagccuucaccgaguuccuccaugugcucaguuuuguccaggcaggguuuuguucuaguggagccugaccagcucacugagccugccuaccccaagcccuaggugaacugacugcuaguccagcucuugucuguacuuaaagaugucugugcuaauugacauacaaaccacaaggcagauagcauccugauuacguuuuuauauuucaggaaauaucaguuuaugcauuuuuugaggucugaaaaaaaauaauaaggacgaggcgaggugaaacguagauuauuugaaaugaaaaagauguuaaauaacuuaguuuaagcacaaacaaaauuaaauugagaaaggaaaauuuuaauugaauauuucauuaaaacgccauuggcuuucauaaaugcucccuuuuagccucagccugugucuagagcccauucucccuccaaggggcgcuggacaggaagcaaguccuagaguccugggauccuggccugcuccuugccagcgguucagcucggcaaaccuuggcuccacacccagaacccauugagaccugggggauccuggaaaaagauuugauccuaauuuuaccuaaaaauguaaaagcugggcugguaagauggcucagcggguaagagcacugacugcucuuccaaagguccugaguucaaaucccagaaccacaugauggcucaaaaccauccauaacaagaucugacucccucuucuggagugucugaagacagcuacaguguacuuacauauaaaucaaucaaucaaucuaucuaucuaucuaucuuuuuaaaaaauuaaaagcucagcuguagcuaacuucuguuguguucuuugaguuuguugcgcguguauacuugacagguggacacuguggcuaggcuguagaagaaauagcagguucguuagguuaacccugaguucauaagggagaggaacuuguagguucccauucuuccaaccccaggguuugaugucuguguuugagcucuuuauuuauucauugagccaguaauuacuuguacaaugccauaaguauagacggguacugggagugggagggacaguguagacaguggcacuguguccauaguucaucuauaggcuuuuugugguuguuucauuuuucaagacaacguuucauuguguaacccuggcaaguccuguaacuuacuuuguugaccaggcuggccccaaacucaagagaucggucugcuucugccuuagugcuguagucaaagguguguauguaccacacaccugccucucauggauggucucagugugaagacagagugguuucuguugcccuuuuaagcaugcccaaaggcccacagcuccaugaccugucagcuuuaguaggaaucacagcauuucucuuuuaaauggaauugucagcauucaguguuuugguucuuuuagauucuuugcuuccagguuauauagcucaaggaagcuguauuggcuauuucaagucuguguacagcaugcccucuguauguucuaauaugcacuuguuuuccuccuauagacuuucuacaagcauaagagaauuacagaacuuuaaagcguuguugcagcacaggagguaaugaagacuuuucuaugucuucauagacauagcagacuguaugaagccuuuuagccuuggacacugggcaaagagacuacaugucuaagacuucaagaauucugaacucuuuaagagaaaauucaaauguccacuugaauauuuaugaucuuuaauagaauaccaauuagagauauuuauaaaugaaguauauccuuuaaaauuguaaguuauacuaaugccauguuuguuucacauuuuguuuguauuguauuacucugcauuucuaguugucaaacuuuaaaugacugucuauccugagaagacuauucaaucuguuguagaaaaaaagaaccagggaaccaguguugccuagagcuggucccagugacagaaaucuauagcugguguaguuaguguuuuagacuugccuaacacugugugccauccucuguaaugcagggcuguaacuauagugaauaggccuuucagugacuagcgagagguucuggauggcuucccagggcuucaacccuguuaccauguuuaguugcuguugcugcugugguuuuggccuaaagggaccugccuuggugaaggugggucagugcccucccgugcucacuuggcccguguaccccagccuggcucaagaguagaguguccuuuaccuaaagccuacagcuccccuucuggcuuuucucuuuguuccucuucuaauuauagacauuuucaguuguuuuaugaaaagcccuauuuauuuaauggauuuuuuucuucacaaaauuugaaugggauccuauggguuuauaaugcuaauuggauuacacacacauuuugcuguuuuaaaguaagcauuuucaauauuugauuuugaacacaaucuaugcaauccucuaccucuuuugugcgacugucuggugagcugcuucagcacggcugucacuuccucccugucccuccaucuucaguucaucccggaucagccauccuuggugacucaagacaguggaggacuaaaauggcccuaaacugccauuuucuaaacccgggauuuaaaaaaucuuuaaauauuuuaaaucuugguucuuuuaaagguggcaguguauaaugggauuacuugaaagguuuuuaucuaugcgaguccaaaaaucucgcuucuccuuagauucugucuuucuggaguaaacaguaagugcucuuaaauccacauccuaucugccaaagucuuuacuguguuccuuguaacuucaugguguaggccagauuauuaaguuggcucauuccccucugaaugccuagucuuccacuacagaggugugaugagaccugaggccucuaugauuauuucugcuccucauuccuaaucuuuauaaacuuaauguuuuguugauaguagugaauuuugucgguugauuacucuuuuuaagcuggcuugaaguuuucuuuuuucuuugcuuuuuauuuuuuaaagaguugcaaguauugccaugugaugggaacgggccacucuaagauaaaaagcccaccaagugaaugccagugaccuugccuuguacaccagcggguucuguagugcccauuuagaauguaaggaaagguggaaauuuugcacuuugucuauuuuuauuuuaaauguggagauuguuuggaaaugucacuuaucaccacugcaguuagaugcuauuauuuaaacuauuugcuuaaggggggaaaaaucuucauuuccacuugcugaauuuuucuuaacuaugauuuguuccaagcuuaggacacacaguaguacaguguguucuaggaaguugaaagaaaugguuguuagaaugaauuccuucaguaagggaaguauucugaaguugguacucacuggauuaauuuuuaaauacguuaggguguguuggugugugcacagcgacaucaccaugacaucugaggacuguggacugugggacuguuuggugacccugaugaugaaucuguaggaggcuaucugccgguucugucaccggugcuugggggaaauucaagcacugcuuacauugugagauugcuugugacaaaacacuugcuguuugucugugucucaucaccugcuguaaaaaucuagcacuugacagcaagccugacugaaaagauuguaccuggugccauaacaaugugaagaggaaguguuuucauugguggccuguauauuccuuuaguggcauccauguuauacuaaaauggcccaugcucaguacuccucuuguuuuggauuauguggaggaucagccgaacaacaagauaaucaauuuugaaacuugccaacucagauguuagccccuguauuuuguguaugaaaugcugugcugugucucuucgacccugccuaggugccaccauguguaaggagggacaacugugcuggucuuccucagcacugcuucucagcaguuugcagccugaaguuccugcaggagcccuuaguagucaccaaaaggcucagaccagauacacgcugucacggaaacuccuugguccaaaccaaguacauaaauccacguguccuuuauuuaaaaugacaucuacaggugcagcuuugaguuuucugagcagaauuccaaauaauuugcuguuguaaccacuggagucugaaccaugaauuaaaauacauguuucugcaaucuuuuguuucuuuguuuuucccccuccuccuuaucaagggcuucuuaugagacuguguuuauaauuuauggauuggaggaaaauagacuucugcauagucuggaggggacucuccuugcagucauaauggcagccguuggccgugugugcugaggacuuugcauggagcggcacacuaggugguaaggacagguguuuccuaaagcaugaaaacaaauggggucugagacucagccagagcuugcuauucuauucuaagcucaaggcguguagagccugagcgaaccaccagagccuguacugauaauguggacuuaauaccauucaaucaaaagguaggaacaguauucuaugauuuguauugagucauaggcuuaaaaaaugcuuguuuuauuuaacuuuccaaauaggugguacauucacaugguuaaaaaacacaauauacacuaauaccacaaugucuucccaguuucccauagugcacacacauguccucugucccuggcuuuuuguauuuccauccacacacuccuuuuuuaaaaaaaugccaacauauauacauauaaagccuuauuucucuauuugcucuuauuuuacuuggaguaauaccacauacacaccaucugcuuuuuaucaccuaauuauugcaguagccauguaccaccagagagauagccuuuucacuuuauugguugcuugguauccuuacuauggcuaugccaguauuuaguugagugguaccauucuugagcauuugaguuguuucuagaccuuguccacauaucaugucacauuuguauauguacauuucuaaguguucaaaggugaaagaccacacacacuuguaggcuugagagguacugacuuggacucugcccuccacagggagggacuagcucagcucauguacaugugugcuugcucauccauggccucaccaccagagacaguguucaaaugcuagauuuggacauucugauaggauggaaauuuaaaauguucauuuuaaaaacuaaauguauaaaauuaacaacuaacccuuaauuugcuugguguucuuugugcacuagaccccaccuuuuagagguguucuucaagcgugaugggcuucagucuuccaauuuguuacguggcuuuguuuuaaugguuuuaccaugcugugguauggucucauuuccuauaccaguuguuugauccuuuggauccuaguacaaaauacagguuaaagaaaccaaccuaacuuuacauagguguaaccuguuugguccgggaacucuagccauuuguuccaugacuccuuugaggaaucauguagacaggaagaucucugacaccucuauggaccuagcuccuuaucuagguuauguuuccauuucaucaguccauuuuccuauauguaccaguagacauuguuuuaauucaauaauauugaauauuagcccuugguccucuccaagagacuggaguggaacuuuugauggaccuuacaggcaagguuaguagacccugaggucacuugugacguaagaugcuauccuacugugugcucagcuuuuaagaaaccgguguuaacagucacccuuacuuacccuuggguuucccugugccuagcuguaaucucaaguccuguacucuccgugucucugaccaacaguaaugaaugggugucauuugcugaaaacagcacacacagaaguugaaagcaaucuccuaaagcgaauauccaccacgaauguugaacacaacauuuaaauauugcucgauaaacaauaguguuugagauacuguuuucugggucgguugggguuaauuggaguccgauuuaauaaucccuuguaaaacgcuguuaaagauuucuguuaucccucauuccuucuccauguuaugcuuucugggcugcucaauagagaacaaagcccuuugugacagaugaacacacaguggggauagauuuacaagacagucuucaggcaggcacagauuuagacucguguaacacacagaggaugaagacagaagacacagggaacaugaaauagaaaauaaaaucugagcuuacucuugguuaaaugacaccaaggggaaacgcuuucuuuccuuaaugugucaccaacacguuauuggugauuuggaauuuauuauuguguucaaacugacuacacgcucuccuuccccugccccauuuuaguuuuccuagauacuauagauuuucaugauuccacgugagcuuugaaaaaacuccuccuagcaaugcagaacuguuuucuguugugggucccuccuccccucccuuucuuuacuuacagggucguuagugucucagacuauccucaaagucccuauauagccaaggauggccuugaacuucugauucuucucuuugucucccaacuuccaagugcugggaccacagguauaaacugccaagcccacuuuaugcagugcggggaacuggacacaugggcaagcauucuaccuacaacuacaaucuuagauuaaagguacuuuuaaccucuugaacuuaacuguuagaacguaaagaucaucuuagauuuucuuuucagcuaccuuggguaguucugaguucuugcuaaaugggaacauucauagagguccagcacaccaccauggagucagaggucaucuuguaagacgagcuggcgggcaugguggugcacgccuuuaaucccagcacuugggaggcagacagaggcaggcagauuucugaguuugaggccagccuggucuaccaagugaguuccaggacagccagagcuacacagagaaacccugucucgaaaaaccacaaaaaaaaaaaaagaaaaaaagaguccccuccauuuauuuguccaaagaguuagguaucuguuagagacucgcacagcaggccugagaagacccuguuuaucugaaugcaugcacucuuaugcuucaguuagggucuugaaggaagaccaugaucggcgagugacuagugggugucagagucauggguaacaguuauguaaacaagaguugagagggaagaauuuugaggcucauaugagcugaagaaagugagucucugaacuccaguucugaggaggcuaaaguucagaacauaugcuccacucagguuauagaaaaucagaauuugaggggugaaccagauaaggcuuaggggaaaagaagacacuaguaagcuaucugcauccaaacauggaggcagaugaagguuuggggagguagguguggauccuauaggcauuuggauucaaugaguccauauugaacacagaaccuacccagggcaagaaugaagcaaaggcauaagaaguguaaucguuugggacauagggauggccacagcagggaucagguauuuuguuccauugggagaggguuuuucauguguccugccaggagcggagaggaaguuuaugugcgauucucuuaguguggucucagauccaaacucaugacaacuucccagucuaacagaggcacccaguagacuaaauuccauugucugucuucacaguuccauuuuaaaaguuuucucacuucaauuguccuauuuauuuagucuuugaugagaacucugauuugagccugcuccuuuuccuaacagcucucccaucuggauccaccagaagcuguggaua

SEQ ID NO: 6888 - RNA, 6800 nt, Mus musculus
auaagaaccuggguccaagucccccagaaacuauauuaagagcugagugcaacaguaugugcuaggcaggaggcagaggaucagcaagcuccagguacagacagacagacagacauacacaaggagggaggcagcuagugugccugcaguggguacaucagcaaugguccauuccuguuggcuuugucuuccagggcucaucagugugucagguaacugccauuggugucaccgucaucuugcucuacgccucucgggccugcuacaaccuguucaucuugucauuuucucagaucaagaacguccauuccuuugauuaugacugguacaauguauccgaccagguaggugggacaugacaaggcgcugcagaucaguggaauguagugaguugcuacgacacuggggacaaaauugguggggacuagauacauggggacugggcgaggugcugccugcacagggaccagagcaguggaguguggucagaugcugccucaguggggaccagguuaguagcaugcagcgagugccugcugucaugcaguguuaggugcacaaaagcaggcaggcauuuuuccuugccugugggaguugacugcccagugagguguaaacacagauaauuccucaaacgggucucuacuggauuguucugcaaacacucccuagugucaccuagaaaaacagcaaauucccaaaaguguguaaguuuagcuauaaaaucccaccaguggucacaaugggagcuaauuuguuaagacaauaagauuaaaaaaauauaaaaauaaaaugaccacagugagcuaagucccaaauggcuacaugcacguuagcccuggaaaagaugaaacuaugacuguuuccuagcaacacuggccaagccugucgcacaggugcagcagggagaaagcaaggaaaggacgcucagguaauguguaccauucggggaaaaccagacaugggauuucuagaccuuaccuaagcaguggcugugcauagagcuguucuucgugcacggggguuucaagagcagccaguggcacugguauggaugcguucaaaccaucacugcuacccacuugaccuuucucuuucaaaacuggaguuccaucaaacagcaacuuuaacaaauuacuuccaauuuucuuucaaucaagagcuuaaaaacucucugcuuggggugugaugcuuuugagaugcucauuuuuucagugacuucaagugccugugccuucucagugaaaaggagagcacacaggguugagcuguggugaugaucuagaaguaggagaccugagaaucaucacucuggggaccagugucuggucugggcuuucagcaugauguguuagaaaaggccugaggaccaggcuguggcucagugcucucuuccugguaaugggcugagaggcugccauaacugguuccccucuauccugggacauucccuccauagccauccccuuaggcucugccuugcucagaggacuuuuccugccuguggucagcccucauggguuggagaauagagugugucuaaugucaggaugacucuggacagacaagccguucuccuuuaagagucagggcugggauaugggcucuggguucauuccugaaccacaaaaguaaaugaauagccagucauaauccaucuuccuaaauggguuccagcguccuccaaggccugaccuaucucugugaccaaguuucaaagugcgagccuuaggggaagcauuucaguuuucugcucucuguccuccaacacaugaagucucgugacucucuucuugcucuggcacaggcagaucugaagagccagcugggugaugccggcuacguaguguuuggcguggugcuuuucgugugggagcuccuacccaccaccuuggugguuuauuucuuucgagucagaaaucccacgaaggaucuuguaaguacuccuuccuugucuguuugcuggugucccgaauccuccugaaacuggugaggaggaugugcgccccuccccuuuccaguggcgcuccuugcauuucuguggggugggucauccaggacucuuaaaaggagaaucuucuuuucccuuaauuuucucaaagaaauguguuuggggauuuuaucuguauuuuacaaaagaaagaaaguuaaguacaucucauagcccggggacaguauucacuguccuccaaacacauacacugcugcucuucuagcagaaaaugguggccuggagauagggcauuugguagcguguuugccuaauaugaaugaagccuugaguuugauccuuagucacacauaaaaccaggcauguaauccuagcacuggggaaauagaagcaaguggaucagagagguucagugguccuugucuacauaaugaguucaaggccagcuugagcgacaugauaccuugucugaaaguaccaguaaaaaaaggaaaacagagcuggagagauggcuggagagugguuaagaguacugacugcucuuccaaagguccugaguucaguucucagcaaccacaugguggcucacaaccaucuguaaugagaucugaugcccuccugugguguaucugaagacagcuacaguguacucauauaaauaaaucuuaaaaaaaaaaaaaaggaaaacagacucacucuauccucggacuugaugaccaguccagggagugggagaguagugcaguggcaucuuggugaccaugcuaaagccacccacacuuucugcuuaaccagcacuacagaagagaaaaccaagucaaguuuagaauccccuggaagcauugcugcaccacacaagcuaggcuacagcuuugccuuccugaugcauaugcacucaggaggguggggagugaaguucuggacaguuugaguaggaggagggcacagaaggaugcccauggacauggcacacccaugguccacacccagguaacagcuugcugcucuuuuccccacucaucucugguggucacuacugagccaggcacaggaaacagagcagggugagauggcagaugaagcccaaccuggcuaucucugccuucucugcugggauggacuccaaaaauguacgcuugcauuuuuugagaauucaguuuggggcaaaaaggaugaaaggaucgagagaggauccugggguaagauaguccccugagagccugugucauuauacagcugugucucuauguggaccggcugcuuuagucuggggaacuucuugagacaauuccacucuagggcauggcugaccuugagcuaaaaccucuuaccuuggccucccaggugcugggguuauagucgcaaaugaccaugccuggcuauuuggacagaucagugaggauuaaguauauucaccacuggaaguuaagagcuauggauuuauuagcauuauuaacuguauguacauaauggauuucacugugguguuuauaccggcauguuuuuguuuauccauucucuuuccuacugaucucuugucucaccaauuaguccucuuccuauuuucaggucuuuuuaaaaaaaucuauagguccucaaggagcgagcagcucuucccucccccaugcuauauuuuggggacuguaacucaguugguagagugcugcugagcauacaggaaaacuuagauucaguacccagcacuugaaacguagaggaaaauaaaaaaaauucaaugacaucuuuagcuugagacuagccugggauacgagagacccugaacaccacaccacccccaccccaaagcaugcacagacacauuaagcaccccagcuagugauagcacucuuuccucaugcaguugucugcauggaugcuaaaaggaugaugucuucuucuagaccaauccugggaugguccccagccauggauucagucccagaucuuacuucuuugacaacccccgaagauaugacagugaugaugaccuugccuggaacauugccccucagggacuucagggaagguaagagccaacuccuguuggagagugcugggccgcuggaacagacgccaguggaagacuccuacugcacagagcaguucugcagggccagguucaccaugggaaguagccaguguaaaggauucuuaaagaccuccccacccccggggcguuuuuccuacucuguaguccauggaaugcuuaagagcugugcugguuuuaaaagaaauccaccuuuacuuauaggaccucuccgagccuacccagagagagccagggcaugugcugcuccacucacucacuggaacgugaucugggacauccaggcagaccucuuggauccucuucuaaagccagagaauauaugaacaauuaucacuagagugaauauauuauaagaaccaaaaauugaaauuugucauucuuaaccaauuauuuccuaagauacugacaagugucaucucguucauuguuugcuacagucccgugaggucaguauaauuaagcucucaugguuccaggucugugggagucccuuuucuggguaagcagcauggcuggccccggggccuacauaccucaaugccagagcacaugggaacugccuccuuugaaaauucacuugcagacuggacuguguccuuuuuggggugggcacuuacacaugguagcauucacaaugguguguguaugcucaagacaguaaacaagcugugccuggugccuucagccagauccagagucuaggaaagggaggacgggaagcaccuugcggcccucagccccuccucucccugugcaccuggaucuacccaaggcccagaaagucgugcuugccuuuugcucugaguaacagugaaaguccuuggaaaugggggaagugcucugaaaggaccuugguuuagaaauaaagagcugagauagaacacauugcugucucagagaggagggaggagagaccccccccaucagauaacaagacaagguagccaguaggggaaggcacagaugucaagucagacucuggaagcaagccaacauaaagaucucucagggucaagagcuauccuccuaaagucugagcuccaccucuuccuaaagcuucucucuuaucuaaucuagcugccccacacuuucacccuguaaccccgcuggaaugcuggagcaucccuagccacuacuugccagaaguuacugagagggcaguacucgcccuguaccgagagcaagaaaagacccuuuucuaugauagaggaaacugaaagguguuuuucaguucuaaugauaucucagguaucgcucuugaggacuuuuauagguguuuacuuaacccugacaacagcccaaauagaaaauugcuaaugucuuccuguuccacagacaaggaacuugagacauagacauuaucuauccaaaacgcacgauaauaucccacaccuuaggggucacuuuuuuaaaauuuaauuuaauuuuuaaaauuuuuuuuuauuucuuugguuuuguucgagacaggguuucucuguauagcccuggcuguccuggaacucacuuuguagaccaggcuggccuagaacucagaaauccggcugcuucugccuccugagugcugggauugaaggcgugcgccaccaacgcccggcuuuuuuuuuuuuuuuuuuuucccuaaaucuguguucuccacaguggcuaguuuuagguucuguaguugcaaacuucuaagcucugcgggguucaguagacuugaauucaggcuggcagcaaugugcauagcaguuugguagaaaaugggcaagauacuaggccugaagacucagguguguugcuaaaauccacauauggcauauaugcaauacccugugucaagccacugaacugguuuuguuuguuuguuuaaaguuuugcuccagacuacugugauuggggacaacaaaauaacagcuuccuggcacaagcaggaacuuugcaucaagacuccacuuuggauccagacaaagcaagccaaggguagcagcagcugacacagcccuauggaagaguucucuguugacagccuucagccagacagaccggaugacagcugaguugcuaaggcaguuuuccuuaggaaacagaacucuaguuuuugcuauagcuuucucauggcuccacagggcuaagcaauaauuuagagcaauaaacccuuuaguacuagcagagaaucuggcuauuucaguggguauaauuuaaacuuauaaaagagauucuguacuuuuauaaagauguauuuuauauaacuuaaauacuaaugcuaaaguauacuagguuuuuccuugauuguuaauuuguuaauugcaacguauguuguaguuugcacagacuuucacgcagaauucacuuuaaaacguauagaaugcguggucuaauaguuuaaagcuuugggaaaacuuuccacaaaucuuaccucugaagguuccucuugugagugccacguggugggcuccuuucaccgccacucaagcauuccaaguuaaggggaagcagaguaccacggucuguacguaacaggcucagcagcagcaauuucucguaaacucuguccuaagccugguccuucuucaucugaaagcacuacuacaagcacuccaguaacaaguggauacuguuaagauguaguugcugacacuauuaaaccuccucugcuguguguguagccauuuuguagaguuuucuucagcccgguguaacugaauacucacuaccucaguaggauggaaggacugcgccuucuuugacucagccagugcucucuauagucaggcuacaagccaagagguccccacagaguauuaacaauaaacacuucug

SEQ ID NO: 6889 - RNA, 430 nt, Mus musculus
ggaggugaggagggacugcggaggggaguaggguuauaucugcgccuccuccgccugagcugcuaaaccgccgggauugugggaccacaguugggaaacaugcuggacgcgagcggcuguaguugggcgauguggacgugggcgcuguugcagcugcugcuacuaguggggcccggaggcugccugaaucgccaggagcucuuccccuucggcccugggcagggggaccuagagcuggaggccggggacgacguuguaucccccucccuggaacugaucggagaacugagcuucuaugaucguacggacaucacgucggucuaugugaguuggggccgggaggggaggaaggccaggcuaugcuggggucgccaguccagagagacagauguggaacuugggcgucgcccuccgggacccgagugcuagc

SEQ ID NO: 6890 - RNA, 430 nt, Mus musculus
gcuagcacucgggucccggagggcgacgcccaaguuccacaucugucucucuggacuggcgaccccagcauagccuggccuuccuccccucccggccccaacucacauagaccgacgugauguccguacgaucauagaagcucaguucuccgaucaguuccagggagggggauacaacgucguccccggccuccagcucuaggucccccugcccagggccgaaggggaagagcuccuggcgauucaggcagccuccgggccccacuaguagcagcagcugcaacagcgcccacguccacaucgcccaacuacagccgcucgcguccagcauguuucccaacuguggucccacaaucccggcgguuuagcagcucaggcggaggaggcgcagauauaacccuacuccccuccgcagucccuccucaccucc

SEQ ID NO: 6891 - RNA, 956 nt, Mus musculus
auagaaccuaaucagcacuaacuauauggguggguuuuugacauuuugagaguauuaucaugauuuagaacaugguuguucaagaaggacauaagucagaaaaauaguauauaugaggagugacaggaaucuauauauuauaaacauugagcuacaucucacaugccuuucgggaauggaaguccacauuccccuuggcuucauugguuuaacaagaauagguaauguacagucuucaaaauacauugaggucauucuccaaacaggagaagauuagauauggggagaagaaacagugucucugauacagaaaaaaagucaacauuauuuuuuaacucuuugucaaguuaucuagaguuaucuuagcaguagaagcauuaccuguucgguguucuucuuugcacagcuuaguauuuuugcauguauaaaguaauaaacaucuacuguguaauuuuaguuacuguauuuaugcagauuaauauaguguugcccuccaauucuuuccuguuacaaccugcagugccuugauauucucuacacucuugaaggugaaguggagacuggguuuucaaacuguucacuucagauagcucaaugucucaaaggauucuucugauuucaaugacaugacaaaacaucccaugacucuucucuaagggaugugaauaucuuuauaacaauggggaaaaugcagcuuuagcuacauuaucuaaugccagggcauuacuaugaucgauucacauuguaaaugagcaaaguuaacucuaugccauaaagaauaaaggcauuuucauguccuaugaaaauagauaccucuaagacuuucacucuuuuguccagguauguauuaggaaaucacuucuuacauguuugcugaauuuugggugcugaauaaaauugcuucauuuuuuucuccuaagcacuggugcacaaaaucaagaauuaaucauacacua

SEQ ID NO: 6892 - RNA, 36398 nt, Mus musculus
auuaggaucuugggaguggggugggguggaaugcacggaucccggacacggauacucccuagucccauccccaccuacgggauaauggggagcacacgggucgggggcacagauguuuucccagccgcagccgugagguccugaaaggcccaugcacacagguuaggaucacgcacugcaccggcgcgaaucacccuagacuuggcccguggggccgcacagccacaggauucuuggcauuggagcccagaccaggcuucagcucuaaggccgcuguccccagggcgcgcgcaccaggggcgcgcaaggccgggaugggcgggucgggugcggacgcgcgcucccgggggcgcggcgcugccaaucgcacacaaaggccgcccagcagaucauguggugcggcgggaggaagugcggcuuguuuucccggcuaggcucuggagcggcgggcgcggcgcgaugcgcggguacccgggagcgaacggcugcgagcccugaugaagcucgagcagccccagccugauggaggcgccuccgugggagccggugcgcaaugacucccugccucccacgcugagccccgcggugccgcccuacgugaagcucggccucaccgcggucuacaccgucuucuacgcgcuccucuucguguucaucuaugcgcagcucuggcuggugcugcgcuaccgucacaagcggcucagcuaccagagcgucuuccucuuccuuugccucuucugggccucgcugcguaccgugcucuucuccuuuuacuuccgagacuucguggcagccaacucguucagccccuucgucuucuggcugcucuacugcuuccccgugugucuacaguucuucacccucacgcucaugaacuuguacuucacgcaggugagagacgcucaccugccggggucgcccaccauccuccgggagggguaggucuccucggccgcagguggagagggucggggcgaggugcagguucuagggugcugagaccaucccaucugcaggcccuacucucaggcgacccccaguuguucccaaacguagggaggacccaccgggugccuggagucuucugugcacaucacauucggugcugaugcaagaggugucugauucuacuuuccccugucucccuugcucaucucaagacaccuaccccuuauccuggaaggccaucugcauguuggcuccacuuuggggccaggcaccagccuguuggaaguaaugaugagacaggcuugauuuugaugagauguuuugaaccuuugggauuaggaucccuacuguacugugaauuaguaacucauuccacaggauugcuucacuagggcagucugguggcacacccaacuccucaguugcaggagguuuuuggcuugcugucugagcucaucggagaagccccaagaaauaagccauaaaauugaaccuggacucuuuuacaggaccagcagcuugguuuuaugagacccguaguuaaugagcuaaaggguugcacgagggcucuuguggcugugucucaaugaaaguacagugauugcaggaggcugaguaaagcauuagccaaggcuuaaugauacugauguugcccuuaccgacuacuccaguucccauuagcuucccaggcacuaaguugugcauuuucaguaguacucugcccaaggggcgagcuccuguugugucaccuguuggggugauugacuugucuucuuggcagaggccccgugcaagcaggcauuccgugccuuugaacgguaucucuauuuuucaaaagaaaaaaaaagagugcaggucaguggugccaugaauaaugggucagacuagcuagggucacaaauguucuuguaugguggaaacugaugauugaaaauuuggaagaaauauuuuuggcuaacaaauaccagguguguuguuacacaccugaaauccuaggacuugaugaguggcagcaggaagaucagggguucuaggccagccucagcuacacugcaaauguauggcuagccugggguauaugagacucuguagggcaaucuaaaagagggagggggaaagauaucagacacguuggguguggugguucucauaccuguaaucuuagaacuuggguggcugagccaagaagauugcuaugaguuccaggguagccugagcuacagcaggagaccccgcaucccuccccgagucacauguaauauuuagaggagugugaauauacauauauuaauauuuaaugauacuauauguauucagucucugcuuggagacuucuuagugguccugugggucagcauauuuuccagcucagggguaaugggcauggccugucagagugcugcuguugaacuccaggcuguucauaaagcauagguuuuguaauugggugaaaauaaggugguuccugcaagaugcacgugucagguaagguggugucaccuggaaaacugucucagguggagaucuuaucucuugucccuuuugaguacaauggccuggcucucuggcagucacaugccaagccugcucuuagagucggauuaggggcuggccggccggccagugcauuuucugcaccaucugcugguugcuggguaaaugcugagcaaggggaaaagugaccaggcagacggagccacuggucaggaggcccccggucacuauccuuguuuccuuuaugccccgucacccccacccugugggcauuuugucugaggacucagagcuggcagaagguggcaccacagugagggcauuccuaacuuucugacaagaguucuggcccuucuggagacuucgaaaguuggcucuuggacuccagccugcugggcugaaauguggguuuccaaggaucaucucacaccacgcaaacccacaagugugagggagggacaugacuaccaauuaagaaguguguagccgggugugguggcacaagccuuuaaucccagcacucgggaggcagaggcaaguuaauuucugaguucaaggccagccuggucuccaaagugaguuccaggacaaccaggucuacacagagaaacccugccucgaaaaaccaaaaaaaaaaaaaaaaaaaaaaagaaguguguauuggcugggccugguggugcguaucuguggucucagcaugugguagguggagacaggaggauugcugaaaguucaagaccagccuagacuacagagugagauuuacuucaguucccccuaaaaauauucaaauccaguuggggugauaaaauauguauacacacgccugccagucaugacuuaagggacugaagagagggagggcugggcugcuugugcagggcaaugccugcauccccagagauggagguccugagguaggaggcuggguaggagagagcgagauggcuuaggaguuggaaaugaucaagaagagggccugggagguagaggaggcugucuccuauugucaagaccuuauaccuggcacacuaaggucacuuggccuuccuuguaaucugugagcuguuucuccucccaagacucagaaagagaaggccuuaccccagguggaaugaccccacccuggaaugcccccauggcauuuuuguuguacacacacacacacacacacacacacagcaguuuggaaaagggugugucccgcucacgcugucagccuguugcucuccuucaaggacuugucaggggagcagugucgugcuugguagcucaaccugucuaccccaucucugccucugugggugacuacuuugucuaugaggugggcuuuaguuuccuucuggcucgcuuucugauucuuuugcaugaagccuuaggagugguaggauccccuguauuguuuaaccacacagaugcuaggcucugugccuacuaguaucuucuggauuccucaucugggccuguuucccuugcuugaugggagggcccucuccccuccugaaaacugagcugggaacaggcaccaccccgagguuugcagacucgaaggacuucaguauggugagcucugccacaacucucuuaguaagucaccuuacucugauaucuauaccuauugggcccacagauucucaggcuagugagugucuguugaggcuccucggggacccugaagggggugcccucaugccagcaggcucaugagauucuccauuucagccucacuuucugauauagccagaaagauggaggggcagccaguuacuggcuuggccuguuaauggaaagaaagcuguaucagugugaguguaugcuaccccuaaauauuugggcucuauuuaguauucaggguauuaaggaccugcuuuucccagugguggauucuuacaccaacucugugggacaguugaguugcacguagcuugcaggggagggccagacauacacagaagccuuggacccaaagucggcugaguaccacaucauauuauuuucuucauaguucaggcagcauggggcuuuggcauugaggccugugauaguuucugugcacaggacauuguagugccccccuuacuggguuauauggggagaugguccaaagcaaaaugccucagcuccuugcauuuucacagcagaggcugaaggucaugaggugguuggugcucugaaauccugguugcugugucugccagacacccuagaaauuucugguccaggacuucaauuugauagauuccugaggugguugagaugagugcagacauuuucuugaagccuaugacaagguggugccaugggaggagugagcucucuguggagaggugggguggcgaauggacauugacuugggaaauaggagacaucagaaaaucagucugugaacugugugucaccucaccaccaggaacacgggguagcagcuuuuggacugaguguauucuuguucuggcuucuagcagucaguuuagucaaaaauuaucuauuaaauaccuguuguauguuggaccucugggaguugggaggaggaagccugaggccucuuggcgauugugaaguagucuaaagcuuggaaaacaggcaagguagaucccacugguucccagguaucucaugucagagcuggaacggugccuagucugggcugugcaccacacauagcccaggugcucuuggcccgugcgugcggccacucccuaggcucuuggucagcuagagcugugugcauuucuuagugugcauuuguacagcugcacgugggaccccaugagcauagguguugccgacacuguauguacugaguugcuccccgugugcccacuuaccugucagugucugugugcaccugugagacguuauguaugcaugcuuguguguauauguauucaaaugccugcaaguaccuguaccuggguacugggugugaacccuuauauaugucagugugcaugcuugcguguaugccugugugcaugccccuuugcacaucuguaaaaacuuggcuguguguacaggcuugucugcauuuuggauguauacuccugugugugggcacguguguguguguguguguguguguguguguguguguguguaucuccaugcuuaugugcaucuuugaauauaugcuugcugugcauucuuauaugugucucucaauaucuguuugucuaaaucagugugccuuugcauauuuguaugugcuaguguuuggauagcugugugacguguguguguguguguguguguguguguguguguuugucugugugccugcucauuggagagcccgcauucacugucagugcuccugccccuacugccuccuggguagaaccucuccugucugagcaggccaggcuucucuguuguuccuucagugcugucuugacuuguuuuguuuuguuuuguuuuguuuuguuuuguuuuguuuuguuugagacaacaucucacgagauugucaagguuagucuugaacuugccaaauagcccaggcaggcuuugaacucuugacucagguauucaaaugccugcaaguaccuuacuccugaguaagcagcugggauagcaagccuggguuaccagguguaacuuuaacaucuuuauucucugcauguuguuuccucccuuuccccaaacucccuucgagugcuuggcccucugggaacaggcagacaccucccacuguauuuugugguucaaguccucugacuguggcuucccucagaggcuuggcugagaaaacugcagaguaguaguuagucaccccugggagcaccaucgucagaaaaauagaggucaggacacgaguccuaaguuggugucauuguguggaugaguucaguggcccaugccagggugcaucugccagcauucccaggcuugccugucaggccccaucccuguccccuguccauuggauguucuuccugucaggcucucagcucugagcccagcaugggagugagcugaagcaggccagggagcaugagaaggaccgagcagccaggcauugccccaugaggcacucugcagcgacaccucccugccaggauccaggguucagggaagauccagucuuacgucuacuuccuucagcccuuccuggucaccuggaauguccuugugaagaggaagccacuuccagauuggaaguccagccagucuugaacuuuagcuggccagggcuccuaagacagaaaaauagcugcaccggcgcucagggagcaccuaaggggggggggugcggaggagcaccuacaggggugcggaggcucggagggucuaagucauucuucagcuaggcugagguccaugugggagggaggagugaagccuaguaguuuccucuucacaaugcauauucccuagguguccugugaagauagugagaaaggaagggauaccaggacggccaggacuuuagcccauggccacauguggucucugucacguaucccuucaccccuuuuauuguauuuuuaaauaguccuuguaaaggugaaaaagcauccuuaacauacagguuuuaaaaauagccuccaggguggacuuggucagugaauugcaguaggcucacuggcccuggggucuuggucaguggacugcaguaggcuagcccugggguuaggacaagccuguuuguuuuccuagcucuugucccaccguuucuguggggguugcugaagcaaguccugcaggcaggucacucauucagugucagaguucagacuacaacucaguauggccacaggagagaccacacuucgaacauacagaaccucggggguggggguggagccaaaucacauccaacacuuagucacuccuuccucuucaagucagccucagacagccaccaccaucucuucuguauggacauugcauaucagagugacccccugugucuagcuucugucacuugguauauuauuuauuugguucuggggauugguccuagguccucuccuaugccacauaaguacacccauuaagagcuagauccucaguucccuugucacuugaaauuuugauugaggcaggguuucccucuguugccugagcugucuugaauucacucuguaguccagacaggcuaaguccugauucuugugucucaucuuuccaaguagccaggauggugggcuuagcugccuuuuuacuucgaaccagccauccuuacuuuagugccucuccuuguuucucuguugugauuugggcuugucccuucccuccugauggcuguucuuuagaguccuacucaguagcugggccugcuggcacaggccuguuaacccugccauaugccagagacugaggcagaaggaugaacgugggcugcagaaugaguucagggcuagcuugggcagcuugguaggacauugucuucaauuaaaaauguaaagaggagguucgggauauuguagcucaguggaagaacacuuuauuuagcacuuugagguccuaaguuccauccccaguauggggguggggaggccucagccaggucacuucuccuucaggguuucccauagcuauuauucauuguaggacacgaggaacaccauccagcaccgcgugacccacaggucauggguuccugggaaagucugaaaaucuccauguuugcuucugaggcagaaagugacucuaccagaggaaaccugggcauuuugggcacugaccuuguguuguguuuuuuuuuuuuuuuuuuuuauaaauuuugcuuuccaagaaggaauccuaugguaagauguggagggguucuggcugcaugcuggccaacugacccucuuuugugaagcccuugggcuugacucacuaguuccuaguugacucacugugggagaaacacauccucucugucaccugguuaaucucccuagggcuguuguggcagacgagcagcccugucuaccaaacugaagcugugauuguggcucucagugagaagaugauuauagcacccugucagauacagcgcugccacuccugggacugaggagagcuacugcgacagaggcuguccucgguuguuaguuuccaugccaacacagacggacagggcuucccuaguuagucagcuugggaugggcagggcagagcucagacugaagcuguccuugaggcugcuaggccaccucugccucuccauuggacagguagaagugugcacggccccuuugaaggaggucacagugauaccugugggcacccaaggacagagggcacagacaucucugggaaagcauucugaugaagaugugugccacccugguuauaugacagauguuaagcccacacaggacaacagucugcuccugggcucaguguguuugccccugaaucuggcucucaguagaccugacagggagaagcaugaguaccacugaucagcauuuggugucuuuggguucaacucgaagagcuuuccauaggagaauggcccugaagucacuguguagccccugcuggccucaaacucaucauccucccaccgcagacucccugagacuggaauuauagacauuuaccaacacauccagcucuaacugcccuucuuaagugauagggcaucccuaugggaccaaggaugauuuugccuuaugggaccauguguacagcauagccuggcaaggccagucagcuccacugucauggacacaggcauagguguggauugcagacacuccccuggucccauuagcuguaucucccaucuggaaggagacaauuaacagagaaugcaaaagcauucacucucacauugcugucuugcaauggugaccucagcugcagauccccuacagugacucugaauucuccagggaaucucauaggagggggcacacucugcaccugauuucggggacccuggcugucccguccugcucugugaagggggaagcucaacaccuaugcugcacacccugaagcaaugggaugaugucugguucugggaggcaauggagggaggaggaggaugacccacuggggcuucuggguuuauguaauaauuuccccagucuaucaggaagugggcugugcaucagggccauaaggagaacccaugugccucugaguccaucaccugauucagaugagaguuccuuuuauggucaagaaagcauccaggcuagucuuuuaacauuuagaaucacggcuugcagacaugucugauaauacacaauccuaguagccauauuaggccagcacaggcuuacaugcacgguaccuaucaggaggcaggugucugacuaaccucuuuacacauuugacucaccugggccucagaaacauaccgggcaggugcuguuauccaucuuauguuaugcguacucggugaacaggaaggucagguaccuaucccagacgcacagcugaucauuguucaagccuggacucagcacaagacuccccacucuuggccuagauguuccucugcuugagauggggauacacagguggccuguggagacacgguaguguggaacugggugaaacaauaaggauuagagagccguguguccugaguguugucauaggcagacaggccugauggagaaggcugugggagguguggaugcauacaugaagaugcagaccugagugugacagucccauacaucauacauauaucagcgguucucaaccuguggaucaugaccccuuugggguugaaugacccuuucaugaggguugccuaaggccaccggaaaauauauauguuuacauuauaacccauaaaaguagcaaaauuaccguuaugaaguagcaacaaaaauaauuuuaugguugugggucuccacaauaugaacuguauuaaagggucgcagcuguaggaagguugggaacuaccagcauuccuacaaagaccuaguaaaagcauaagccugccuggaucaaaaacacuagccucagggaccagaucacccugcaaggggacagaaccaaguagggcuuagcuggcaauggugacaagguuuuauuuauuaaaaacagaacagagccagagagauggcucaguuggucaaaugcuugcugcacaaacaugagguucuuaucuuggguauccacauuuaaaaaaagaaaaaaagccaggcauacauaguaccacaugccuauaaucccagcacugacuggggagacagagacaggaggauuccuagaguucccuggcuaaccagccuagcuuaauuggaaauuuccaaaucagugagagaugaucucaaaaacuagucaaagagugguuuaggaagaaagacucaugauguugaccauucacguguguguucaaguguaugugcgcgcguacacgcuugcacacacacacacacacacacacacacacacacacacacacagacuugggacaggcacacaaagcaucacgauuggaagugaguggugguuacaugaauuacuuacucuuugugcggguauaugcacaaagaaaauuuugauuuugaaauaaaauguuuaagagucuagggauauagcucaaugauaauacucucuuuuuuucuuuuugguuugguuuuccaagacaggguuucucuguguagccguggcuguccuggaacucacucuguagaccaggcuggccucgaacucagaaauucaccugccucugcuucccaagugcugggacuaaaggcgugcaccaccacgcccgacgauaccacucuuguguaguauguaugagaacccuggguguaauaccgagcaccaagaaagaaagaagugcuaaaagugcaagccugucuauucaucacacucccaggccagucugcaugcucacaagccugugcgcgcacugucagcuuccaguuacuucugggggcuuucccggggcuccagcccacaggcagggucauagccugcagaggaugaagggcuguacugaguccccuaagccagucguuuucuauggaacagcauuucaugagguugaaugcagaacuggggacucuuaaagaagguuagguuuuggaaagauuuugcaagguuuuccaaugaaagaauucccuuugguggagguggguaauuuggagacagggucucaauauguagcccuaggcuaggcucaaacuccaaacacaaagugcuccuccugccagccuuucagaugcuggguguguacgaguccugaaaauaaugaaaguuaggaagcguggaggauccuuaguuggcacagcugucucugggaacagcagguuugcaaaggacauugucacacacugaaagguagguaguguggguugucucggccaggaccaacuaacgugacaggagugaaugugagugucagugccaacuuuaagcaguggcugaaaacauagcaucaggaguuccaagggcgugagccgaucugugacaucaacagcccaugauuuauuaggggagagaggcagaggucagccacuucucaaaagaacugcgucacuggcagagcccugggccuccuuuguccucucggauguggagaaggaccugggguuccugagagguuuuaagguuacuguaguuggagggagucagaaaaccaugcaggauccccgaauuccaucaucugucagcugcugccucuuaaggcugaaacucagauauacagcuaucagcauagagaagugacugagugcuaccuaagacuuguaugaaacccugcccugguccuacuagggcagacuguaccugggugagacuuuauuacuguccuuaacucccuucccuuuccucuugcuggagacagaaucugagucacuuugaaugugaggugagugagccaucacugaacuguguacgaagucccuuuuuauuuuuuuuauuuugagacaguagcucacccauuuguucaggcagacaucaaacuuggauccucucuccucagccuucuuuguuuuguuuuguuuuuguuuuucaagacaggguuuuucuauguagcccuggcuguucuggaacuuacuuuguagaccaggcuggccucgaacucagaaaucugccugccucugccucccaagugcugggacuaaaggugugugccaccacugcccggcuucucuucagccuucuaagaggcuugcaucaucagugcucagcuccugguagaauguaaagcagaugaagugggcugugguggugugggcuuguaaacucagucccugagagacagaggcagguggauagaucuugauuuuugaggccagccugugguaacugagacccccuucccacaaugguaacaaaagguugacggagcuaagcuaaaacuaaaaggcauuuuuaaaagccccuugaaacuuucagaaagccccuuugcaaacuaggugguagugguggaacaugcuuuuaaucccagcacaugggaggcagagacaggcagaucucugaguucaaggccagccugguuuacagagcaaguuuaggacagccaggggcuacacagagaaacccugucuugauagcccucuuccaucaaaaaaaagccccuuugcuucugucauagaggaggccagcgguggcaggccuauggagucucugaugagacuggugugucuucucccuucuucaggccacuccuguucccuuucuuucucacugugggggauccccuaaaagcccuggucucaggguugggagaggaaagaggaaaugccgauucccgauccagucucuggaagccugccuuagucacuguucuauugcuguaaagaaacacaugaccaaggcagcgcuuacaaaagaaagcauuuauuuggaggcuugcuuacaguuucagaggcuuaguccauuaucguuauggcagagagcaugguagcacacuggcaggcauggugcuggagaagguggguaggggugggggcucaaagcuuaccuccagugacacauuucucccaacaaggccacaccuccuaaccccuucaaaacaguucccugaugacuaagcauucaaauauuugaguuuaugggggcccgcucuuuuuuuuuuuuuuuuuuuuuugguuuuucgagacaggguuucucuguauagcccuggcuguccuggaacucacucuguagaccaggcuggccucgaacucagaaauccgccugccucucugccucccaagugcugggauuaaaggcaugcgccaccacgccuggcuggacccacucuuuaaagaaauauuuucuauuauauuuuuguuauuugaaacaaauuuuaacuuuauauuuugaucaucuucuucucccccacccccaaguccuucuagauccuuuccccaucuuuacccacccaacuguagauuuuuugucaaaaaacaaaggcucaauacaacaauaaaaacaaaccaaaaccaagaaacuacccaaacuguaguaaccaaaugaaaguacaaaaaaauacuguggaguccauuauaugauggucaacuacuccugaacacgaggccugcccuggagugguugauauacauacccagugucacuccauuggaaaacugcuuuuccuuccgccagcaggcagguauauguggccauucagucuuuaaccuuuacccuaguggcuagguuuucauucgcuuagucauucauucauguuuuaaaaauauaacaauaaaacauaagaaaaaaacaaaaacuauaucaccucaaaguuggacaagacagaccaacagaaggaaaagagccuaagagaagaccuaaaaaucagagacccccucaucugcacacucaggaaucccauagaaacacuagacuggaagccaugauauacaugaggaaggccugguguagacccaugcaggcccugugcgugcuaccucaucucuguaaguuuggaugagcucccgugaauucugacucuggcucuuauacucugccuccucuuccaugugguugcugagcccugagggaagggauuuaauagagacauuuuguuuagggaugaguguuccaaguucccuuuuuuuuuuuuuuuuuuuuuuuuuuuuuuguaaugucuggcugugggucucuauauuuguucccaucugcugcaggagggagcgucuucugcugauagccgaacaaggcacugaucaaugaguauagcagaaugucauuaggagucauuuuaucacugcacucccccccaccuuuuuuuagauuaguauuauuugguuuuaacauaggcuccugggcuauguagucucagguucauggucaccuaggcagugucagguauggguuucaucucacagagugggccuuaaagaucaaaucuguuauugguugguugcucccauaagcuuugugccaccauuacccuagcauaucuugucgauagcacaccauuguagauaaaugguuugugaccggcuugguguuuacaguucucuuuugguaaagugcaaaggcucuuccuauaacaaagacacuggaauuaggggaugaaggcucuauguaggcaccagcuguacauguccauagucaguuaauccuuuguauguuuucuucagccauggggccuugcugucagcuuggggagagcaaucuauaacaaauguccuggucuugguaacauccuggguuguuaagugauucccauggggucccuuuggccaacaacucaauuagauggaacccaaacaugguacuggaugcuucuuuuagugacaagagauggccaguugggacucucuuuauggggggccacucuuacucaaaccaucccagagaccacagcccgaccacuccaucccuuugcugaguaccugccucuacccugcucaggccucccagucuuaaaauuuuaacaagggccucacacccucaaauaaccucuggcuuacaugucaccugcauacauuuuuaaagggugauuacguccagaugugacucauggcucccacuucccucugccugugguuuugggugugcacuucccuucaggcccuccccagcugccaggcccggugaccacaguccauacugucucaccucucagcacauaugacaacccucugacccugacugcugaagagaucccaugauuccuucugguuccuucagcucuuuucuaaacaaacaaacaaacaaacaaagccagcuuuacuaagggguaaugcacaccucacacgauucucuuuuaaaaggacacuguauucacagauuguacaacucucaccacagucacuugucacugaaggaagccuugugcccauuaguggucacuuucucaccaccuuccagccuagacagucagucguugacagcauggcucugauuugccugccaacuccgucuuuucaguguggacccuuugcuucugacuccagcagcucucacugaaaaccuuccaucacucguaccuggggcauguacacucccaacccagugccaggcugguaccugguaccaccugaugcagccguggugcugugccagggucccccaggcucacacucaacacuccccuauccucacaauucaacuucuuacuuuuccugacagccccacuccucaucucauguguccucaggcuucacagcuuuucaccuccccauaauuccucaugucauguccguagaccuucuuccacuucaagucugcgcacccucuaauaacuccuuccugugauaccuccauucaucucucgccuucucacaccucucagaucuccucagaguuccucgcuuguccucagacuuucuugcaccccacaucucuccacaccuggcuccgcguccucaugccugguuaaucucacaccucccuucaccucacacgucuccaaaccuuacaucucuuccuucccucuucucuccauaccugcucacaucuuuuccuaccacuugugcuuauuuaggagguggccugucugucuccgggucaggagccagcuuuccacaguccuucagaggccaccagaugccuggugucugcccagaaucuuuugacuggcccguuacaaugguuucccuaaucucuuguugaauucauuaauuaaccucaguuggcugaggucuuccuccucucucucucucucucucucucucucucucucucucucucucugucucugucucucucucucuuuaucugacuuuguagcuaucgggugccugugcugucaaaagcucuguaaacuauuaucauuaauccauguuugccuccccaucucccccagaaccuuauucugcucucaacugagucccugccaaagucaguaggagucagugcaggcucguggugguggauagcagguuaggagcucccgaggaccaggaggucacugaggacugaguuuuuagcacucuuuaaugaaguccaugcaggcagagugaguacacggacaacuuagauuuauugauauuauuuuacaacuuacguuuguaaauuguaaacuuaaguuugaauguguaugucuuuuaauuaaugaggacaaaguugauguucaaaauauauuuacauguuuuuugauacauauguuaucuguagaaguuaggccuggcucuuccucccagccccaugcucccagaaauacgacucagacucaaaauauauuuucaaaaacuuuggucaaauagcuaggcucuucucugacuagauuauaacuuaaaauauccuauuuauucuaaucuacauccugccacaugggugguuaccuuugcucagguaccaugcguuugucuugucaaaucuuccugggccaaucucucauguggaauucccagaauccuuucugccucccggauggcucaccuucuuuucuacccuuuccaauaggccauagaguuuuuaauugacaggcgaagcauccauacaacacacaagaucuucucuccaaaguugucuauggaauauccauauaucucacaucacguuauuucaguuucaauugucagggauugguaaaaacuugagggagcuaaaguuuaaggaugaaggaagagcaaagcuugaggagccuggcuggauucagacaagauguaacugccauacguggaggguggguggagcuuuuugccucuaucuugaugugacccuggcuguuggcuugugaggaucauagugaugcccuucuaucagaguggcuucaucugggaugacuucuucccuucaggcauggaugaguccuaguggugaggugaguuaguguugguaaguuagucgccucuuugguaguggugggugagggugggacucuccuacucaguguguuacuuggguuuauguccaggggcuagaauuuggguaucauuuuauuuauuuauuuucaaagauuuauuuauuuauuuauuuauuuauuuauuuauuuauuuauuuauuuugcuuuucgagacaggguuucucuguguagcccuggcuguccuggaacucacucuguagaccaggcuugccuugaacucagaaaucugccugccucugccucccaagugcugggauuaaaggcgugugccaucacaccuggcuuauguauuuauuuauguauacgaauacauaaaauacagcauauaugaauacgcuguagcuguacagauggcugugugccuucaugugguuguugggaauugaauuuaggacuucugcucgcucccagucaacuccauucgcucagucucugcuugcuccagcccaaagauuuauuuauuauuauaaauaaguacacuguagcugucuucauacgcaccagaagagggcaucagaucucauuacaggugauccaccaugugauugcugggauuugaacucaggaccuucggaagagcagucaaugcucuuaccggcugagccaucucuccagcccuuggguaucguuuuaaacuugcucuuccuaauuauuguugguuucauuguugguaugguuauucuuucucaggcugccaugaacaucccaucuguaccacggggcaguguuucccugugucuguucccugggcagccauuaggaagacuggguaguuaaauuuaaguuuggaaaacugcuguauaacaucguuucucuugaagauuaacauuauaguaaucuuuuaaaggcucugagaauuccuguaagggaacaaguauuuucuggaccagccagauagguuagucaguaaagauguuugcuaucaagccugacugacggccugaguuugauccuugggacccacaugagacucaagguuguucuuugaccucuaucugcauggcaugucucugcccacacacacacacacacacacacagacacacauaacugaagaaacuaaauguguuucuaauguuucuaaauguauuuccucacaugaucauaguuccaauuuucaauacugcuuauuauugauuuccgguucuguuggaauagcgugacagguucugucucagagcucauucuuaugguguaggucuugagcugaagcagguaaauguuuacaaggcucacgugcuggcacugagaacccugccuuuacucaggaccgggagaggaguuuugugggucucagcuaggguuguccuaucccacccggcucccuucaauguguccuucacugaaagggggcaaguggagcugcagggccagggacuguaggaagcacaaaacugucuccuuuuucuauaagaugcauaguugggaggugggcuauacugcccaugggacuguugggcuguuuuguaucucuugagugaggacaucauucugcaggucccagggaaaacagucauagcauuggccaaggcugggcgugaaccacaggaguccuggguucacucuaguccacucacaggcucuuccagguaucauugugugaccuaggucacaccuacagcacaugcugagagcagaguugguggcccagucugaggcugaguccacggccuguaggucugugcuucccccagcuacagcuagaaauuucuuuauaguucucuaucucugggccccuuuucuccagugagacuguaagccauugaaggcagggccggucuuugcuggucuuucucuuuucugacagcaucaagccuggagcuaagcccauuggauagggcuacucaguugugccuagcuggcaaugcaguucccagaggcacuggggguaaggacaaguagucucacaggaaagucaccagagccguaggagacuguagauaguuagacaaaguuauauacuuugauccuccaacuguggcacaacuuccuuauuuuucugucauugcaggugauuuucaaggccaagucaaaauauucuccagagcuacucaaauaccgguaaguaccccagaacguugcuucucaggcagaaggugaaguguuuguacauagaaccuguuuugccagcugauguguacacaguuaccccucuguaaacauccagacagcccugcagggguccugcuugccugguggaauauguucuuguucaugagagccugugauaggauuugcagggggccucuguaacaacacacacacacacaugccaccacacccccucacauuuccuccagguuugccuugcacacucuauccgcauuccucugccucuugcuugcuugcuuuucagguacgcacagucaugcuugcuucaaacacuauuuaaaagaauauagcuuuugguagagcgcucacuagcauacacaaagccuugcguucaaucccuggaaugugcugcacaccugugcacuggacucugaggguggaagcagagggacgagaggucccaagucaucucagcuagauaccaaguuugaggcuguucuggcuuguucuaggagccuaggagagugacaugcacggccuggagggaccuugaaggacacgcccaguuuaugggaaaggugacagugcgugcuccuccugcauugucagagaaaucagucauucuucaaagcuucggauggucagauuugggucagggaugagggugcacacguguacucucagcacuugggugcugaggcaggaucuugcauuugaggcuucucugugcuauguagugaauuuugagcuaaucugggcuaaugagaccccauuucaucaaaggcaagcaggaauagucagguuuggcuaugggcacuguaaggaaaggccuccgggagggcuggggcacaaggcauucuuuguguuucaugagcuuuccccaaagcacuccacuaccauaggcacaaaaugcuggaaaugugaaucauugugucaccagagaaauguacccggauuucauuuaaauacaaucagccuuccucauccuugauucaaccaucaauggcucaaaaauacuaagaaaugggcugcugagagggcucagugggugaaggugcuugcuguuaagcucgaugaccugaguucuauccccaggaccuacaugguagagagaagugacuacaauauauugcccucugauuucuaccuaugugcugucacauauaaacccacacacauacugaucauauacagacauuuuucucgucaguuauuuagauaguauuuacauuauauuggguaucaugcgugacauggacuugaugcaggaggauacauacacauaaggucuaagugaauaagccaucuucuguaaggguuguccaggcaucuuuggauuuugguaucuuuggcaucuuaaaaccaaucccuuauagguucugaggugaugacuguguauguaaugaggacucuucagacauuuuuuauucaacauucuaagaguauuacucuuaacuuauuuaaaugcuuuuagggguguguguguguguguauguguguguguguguguguguucaugugugcaugugugcgugugcauauuuacggggauaccugagaaggccagagguguucgaccucuggagcuggaguuauauggaguuguaagcugcuugcugggguugcuggggaaugaucucacgcccccugaaugagcaauacacuuucuuaacuuucuuaaagagccaucucuuuagcccccagaagcaauggcuuuuaccccuagucuguauccaggauacacguucagaaaauuguguauggauugagaauacgugcccaccacugacugcucugcaguuuguugucacugcuggguauucaguaugugucuccaucacacuguaaagagagagagcuggaguccacucacaugcugggauguuggagccgggaggcagagcaucucaaaauggcacaugcccucacacucaagcaccugaagaugaaaacauaagugauuuguuuguucuuuauacuuggggucuguucccaagaugugucauucuaauguuacauucccagcuuucuaaaacaacuugauuuuuuauaauuaauucauuguacuugggauuaaaccagggcuuuguguugucacaagcauuuuggaugaaggaugcaguuagaagugaguccgcguggaaagcugccauugguaacacaccagcuuguguucccuuguacuguaacccccauucaugugccagccaggcugacccuguaaccuuugcggugucuggacgagugaugcucaaucuguagacacacgggcagaagugagaacugcguccccuugcgcuccccaccucccaggaccugcagugauggaugccauccagguucuaugucuaacaaagcaucugaaagcuugcguucugaccucuucuuuccuuuucuguuuuagcauggauugggguggggaucugagcuagcuagcguacagcacaggcuggccuuaaacuccuuagguagcagagcauaaccuugaacuccugguccuccugcuucuaccuccccaguguuaggucauaaaugugcaucacgcauauugggacguccaccccaaauacucaugugggggccagaggaggcugacagguguccugcucuaucccucucugccguuuucaggcuucucagugaacuugaacuagguuugcaacuggcuagccccagaaauccucuugucucugcccgccacagugcuggcaugacgugcagaugcaaccacaccuggccuuucacuuccucacaaucgggcaguaagcacucuuacuugcugagccaguuccuuagccccacauucuaacuuuaaagacuguuggauccugcagguucagagagcuggcuuugauacccagacauguaggaaaggaaggacacaggugggaagaucagccuguguagaccagaguggagaaccguggaucuagcgugcaucucacacccucuucucaugggccgagggcagaagguggauggcagggaagggggaaaugaagguuuguuacucuugcuguggcagccagauagaaaguggaaugcagggcccauccacagcuggcagugggugcuaggguucaugcugcuggaugauguaccacaguguucucugcgacuggaugguguuugagaugcuugucggugccccgugguacagagaguaccccuugguauucuauggugccccguggugcccuuuguuuucccaacacuuuauccuguugguacuuucccagugugcuuugcuguugugaugaaagaacaauagccauaguuuuaaugauauguaagauuguauccugaggagucaccuggacagauacccagcagacugugcuguaaagcucucagcuaccgcucugggccaugccugucugcuuucugccaugaugaucaaguauuaacccucugaaacuguaagcaaacccccaacuaaaugcuuccuuuuauaagcugccuuagugucuccacauagcaacagaacaguaaccaagacucuggguaagacucaggaaaguggcaaagccuuccccugguugguaugcaaaugugugccgaaacuguucacaguaccuucuuccuggaagccugagagugugucucuacagagacaucccuauugaaauucguuaagccucccuccuuauucagcuguauauaauaacccuaccuccuuacucaauauacaauaaacuucuaauuacauguauaaagugugcuggguuuguaggcuacugccaagucuccaucagagcacaaagcccuggcaaagcuuuuuuguaucugugguuucuucgugucaaccuuuaggucagauccuguagcaguacugggucuugguaggagcuauaguuuccagaugcccucggccauaggccacggaacacagcaucagcugcaaagguuucaagaagggaagcagucccuggagaaauggcuuuauuucuaagauggguucgaaguggugcauguuguagagcucaauuggugagugcaucgcacaccaaagggcacacuggggccacagaagaggcaaaggagaaagugcuggguuuacagggcugggauugggaccaagacucuacggugccccaggagcucuacuucuggguucaggucccaccgccucccugacaucccugcuuccagaucccagccaucacuuuuacuguuccuggaacucccugggaaggcacagguugcagucucuccugccccagugcugcugccaucguccuccugaagccuggauguggucaggugaugaaucagccuauguagcuaauucaugcccuacccauccucugucccaacugcgcucaagugccagugaccaacuccaauccacugggaccuuaucucucuggacacacacugggggggggggggcgggguagaacaacuccuagucauuagaacuggcuggcuuaagugacucccccuuuuaucagaagauucagaggugcauguggcucuggauucagggcugugcaaguaggcgcucauaguccuuucuguccaccggggaagaugucccuuguccauggcaagcugucuccaacagggagaugcugugauagaguauuuugagagacagggaaucagguucagguucucacacaggacuuugggcccgaguucuuccuucuuaggugaggucucguguauuccaugcuggccuccaacucauuaugucacugaauuugaccauggacucugguccucuccugcuuccacaucucaagugcugggauggcaggcagagaccaccauucccagguuacacacacaguacugagaaucaaacccagggcaagcacucuagcagccaagcuauauccuccaccugcuccuucuaucucaaaacauacacgacaguggcaggacacacacacacacacacacacacacacacacacacacacacacacacacacacaggccugcugugguggugggcacagcuaggccucagacucugaaccuuguauagguggaagcaucaagagagagugcugcuguguagguauggaagggucagcguuggcaaaggucucuguagcagcuggcugagcgcagcugauuacaggcuguacuggaagccagagagcaaaaggcuucaugggaucauggggucuaacugggauuaagaguacaagcacaggcaaccuaugccagucuaguguguguguguguguggggggggggcuuauauacgcguauaugaauccacuugugcacucagaagccagaggagacauugacacugugcaucuagcucuaucccuguccucacuccuuugagguagucucucaccgaaucuggugacuaacaacccccaucagucacacuccauccccaccacauguguauagccaugcccuuuuuuuguggguucuggguguucaaaccaauacgcaucugccgagcugucuauaaagcccucacaccaguccauuuuugagguacacaacuucagcccuuuuugcuugucuaccacaugggugugccguguauauaguuauauauuauauaugucauguccuaaguuaaauaccuaacauaaugugaguuaugaaaauaguguuuugaggaauaauguugucuuagugguuccacugcuguaaagagacgcaacucuucacaagugugaaguggccaaggcaacucuuacaaaggaaaacauuuaacuggggcuggcuuacaauuucagaggcuuagucuguuaucaucacgguggggaauauggcaggauacagguagacaugaugcuggaaauagagcugagaauucuacaucuugaucggaaggcagcaggaggaugcugugugcuaaauuggauguaucuugagcauagcagaccccgaagcccaccaagugcuuuggaggccccacuucuuccaacaaggccacaccucuuaauaagugccacucccuaugggccaagcauugaaacacaagagucugugggaaccguaacuuuucaaaaccaccacagaugucaagagaagucuguagguguucagcacagaugcaauucaguugcuugguuucuuggcugguugagucugggauauggauacagugaauaugggggacugagcaaucugucuucggcgacaaccuuguaaggcaggcaucacaguuuuaguuuucaaagaugaggcucaacaaagauuguauuguggccccuuuacccaugcugagggugaugggguagacauuugugcuccccccggaguucucugagcccaagccuguucucguguacaggcaauuuggagaggaugcucaggcaaugcagccaauaggcacagaccuaaaacaguccuugccaccucuuagaaaugagacccugugaaggaaggauccucaggcaaggaggcccagaaaguagccauuuuguaauuuggagcugagaaugucuauugccaagagccaugcuccugccucagcagugagcccaacaucccagcuacuuucuagacugacccaggauguauagcuaauaugaagugacagguccugaagcaugucucucgucuccuccagguuaccccucuaccuggccucacuuuucaucagccucguuuuccuguuggugaaucugaccugugcugugcuggugaagacgggagacugggacaggaagguuaucgucucugugagaguggccaucaaugacacacucuuugugcugugugcuaucucucucuccaucugccucuacaaaaucuccaagaugucccuggccaacaucuacuuggagucaaagguaaaggugggaaugugaucaaggugucuuagucugaaaauggcuuccuggcuuacacauaggacaaacagaucuugcucacucugguucacugaacuuuguauccaaguaguuuagcuagcguaguauagggcauguagagucucugggaaaacuuagucugguuuagaacuacagcuguuuagcacuguuaacuuacguuugugguguuggauaucaaacccauguuuguuaggcaagcagccaccacagaguuacagccccaggcauuuuaaaaaugauuuggagacaaggucuuuguaaguugccugggcuggccuugaacucacgguuaccuaggcuggauuugcaauccuccugcuucagccaccuccgguauagcugggauuauggacuuaacaccugcaggugugacuuggacauuuuuagugccugagcuaauaaugccagucucccauuucagugggguagguaguacuaaauccccauuuaguggacaaaaaagucaaggcagagcacuuguuccaggucagugcucacaaauacagagcugaagugaacgugggcugucgggggucaggggucagcacuaacaacaacugacauuuguuguaccuccauaacgacuccgucaggcagugcccucgccagccucgcccuggcugcgggaauguucccggcacuugcugcaagauggagucagacuuaaaggaggaggcagcucgggucucuuaaccaccaccgugucucacagccugagcuccaugcugucuuauccccaggauuaugagaugggcagauauacccaaaaugugguaccaaaaugcuucagccaggucccugacucuccuuuucugacagguucccaaccugagcccuggaaagcuuagguggguaagaaugggguagguagcuauguagagaguaguguugggcccuggguagccagggggacugacccccaccuccauccuuacccucaucauuucucuugcccggccuugccagcugugaagacauuaagugauuuuuccagugucugcuucugaaggcagagccuguguagguugugaugagucugcaguagcuuuucuccaggacucuucuggccuuaguaugccuucggccugagaauugcagggcagcugggcucccaucaaguugugucuuuagaagugaucaguagugcuaggcagugguggcacaugcuuuuaauccuagcacuuggaaagcagaggcaggcgaauuucugaguucaaagccagccugaucuacauuacagagugaguuccaggacagccagggcuacagagagaaacccugucuugaaaaacaagcaaacaaacaaacagugaucaguagaugaaaauuucugcuucaagcccucacagggcacccgugauucagcuggacucaggaaaauccuacacauuagcugggccaguucuuucaugaugaaucuugaugaauuuuacccuugauuuuugccauuaaguucauuaccuuaucucuuauacaugaguugugcaaaaauuuugaaaaaacugcagguuuuuuuuuuuuuaaguuugauugauugauugauuauaugaaggaacacuguagcuguuuucagacacuccagaagagggcaucacaucucguuacggguaguugugagccgccaugucguugccccagcaauacaauuugaacucaggaccuccggaagaacagucggugcucucaaccacugagccaucucaccagccccaaaagugcaguuuuuuuuaaaggaaggauuauaucauagauugucagguguacuuagcugaccucugugacaaaaugaaagaugcucugauuaaugacuccuggugcaggauacaagucaguccugccuuucuuugcuccuguuaacuagaugaggguccuaaaacugacugcaggaacugacaaacuaaagagggauaagucacagauaacucaagugaccccaccccaggggccaagcaggccuucuguguucccagucuaaaagguucuucuaaaccccgaauaaggcuauaugcuuccugacugggacuggccugguaugcugaucagccuggaucuuguuccugagcagugggacuuaagagaucugaugaacguuuugauauucugguucuuaaagaucguugugggcuggggugauaccucagucaaucaagugcagauauaagaaccuggguccaagucccccagaaacuauauuaagagcugagugcaacaguaugugcuaggcaggaagcagaggaucagcaagcuccagguacagacagacagacauacauacacagggagagaggcagcuagugugccugcaguggguacaccagcaaugguccauuccuguuggcuuugucuuccagggcucaucagugugucagguaacugccauuggugucaccgucaucuugcucuacaccucucgggccugcuacaaccuguucaucuugucauuuucucagaucaagaacguccauuccuuugauuaugacugguacaauguauccgaccagguaggugggacaugacaaggugcugcacaaugaccagaucagcggaauguagugaguugcuacgacacuggggaccaaaucgguggggacuagauacaugggggcugggcgaggugcugccugcacagggaccagagcaguggaauguggucagaugcugccucaguggggaccagguuaguagcaugcagcgagugccugcugucaugcaauguuaggugcacaaaagcaagcagacauuuuuccuugccugugggaguugacugcccaguaagguguaaacacagauaacuccucaaacgggucucuacuggauuguucugcaaacacucccuagugucaccuggaaaaacagcaaauacccaaaaguguguaaguuuagcuauaaaaucccaccaguggucacaacgggagcugauuuguuaagacaauaagauuaaaaaauauauaaaaauaaaaugaccgcagugagcuaaaucccaaauggcuacaugcacuuuagcccuggaaaagaugaaacuaugacuguaaccuaacaacacuggccaagccugucgcacaggugcagcagggagaaagcaaggaaaggacgcucagguaaaguggaccguuuggggaaaaccagacaugggauuucuagaccuugcuuaagcaguggcugugcguagagcuguucuucgugcacggggguuucaagagcaggcaguggcacugguauggaugcguucaaaccaucacugcuacccacuuggccuuucucuuuccaaacugaaguuccaucaagcagcaacuuuaacaaauuaccuccaauuuucuuucaaucaagagcuuaaaaacucugcuuggggugugaugcuuuugagaugcucauuuuuuaguggcuucaagugccugugccuucucagugaaaaggagagcacacagggcugagcuguggugaugaucuagaaguaggagaccugagaaucaucacucuggggaccagcgucuggucugggcuuucagcacgauguguuagaaaaggcuugaagaccaggcuguggcucagcgcucucuuccuggaaaugggcugagaagcggccauaacugguuccccucuauccugggacauucccuccauagccaucuccuuaggcucugccuugcucagaggacuuuuccugccuguggucagcccucauggguuggagaauagagugugucuaaugucaggaugacucuggacagacaagccguucuccuuuaggagucagggcugggaugugggcucuggguucauuccugaaccacaaaaguaaaugaauagccagucauaaucuaucuuccuaaauggguuccagaguccuccaaggccugaccuaucacugcgaccaaguuucaaagugcgagccuuaggggaagcauuucaguuuucugcucucuguccuccaacacaugaagucucgugacucucuucuccuugcucuggcacaggcagaucugaagagccagcugggugacgccggcuacguaguguuuggcguggugcuuuucgugugggagcuccuacccaccaccuuggugguuuauuucuuccgagucagaaaucccacgaaggaucuuguaaguacuccuuccgugucuguuugcuggugucccgaauccuccugaaacuggugaggaggaugugcgccccuccccuuuccaguggcgcuccuugcaucucuguggucauccaggacucuuaaaaggagaaucuucuuuucccuuaauuuucucaaagaaauguguuuggggauuuagcuguauuuuacaaaagaaagaaaguuaaguacaucucauagcccggggacaguauucacugucccccaaacauacacugcugcucuccuagcagaaaauggaggccuggagauagggcauuugguagcguguuugccuaauaugaaugaagccuugaguuugauccucagucacacauaaaaccagguauguaauccuagcacuggggagauagaagcaaguggaucagagagguucagugguccuugucuacguaaugaguucaaggccagcuugagcgacaugauaccuugucugaaaguaccaguaaaaaaaggaaaacagggcuggagagauggcuggagagugguuaagagcacugacugcucuuccaaagguccugaauucaagucccacaaccacaugguggugcacaaccaucuguaaugagaucugaugcccuccuguggugugucugaagacagcuacaguguacucauauaaauaaaucuuaaaaaaaaaaaauaaaggaaaacagacucacucuauccucggacuugaugaccaguccagggagugggagaguagugcaguggcaucuuggugaccaugcuaaagccacccacaccuucugcuuaaccagcacuacagaggagaacaccaagucaaguuagaauccccuggaagccuugcugcaccacacaagccaggccacagcuuugccguccugacgcacaugcacucaggagggugcaccacacaagccaggccacagcuuugccguccugacgcacaugcacucuggagggugcaccacacaagccaggccacagcuuugccguccugacgcacaugcacucaggaggguggggagugaaguucuggauagcuugaguaggaggagggcacagaaggaugcccauggacauggcacacccaugguccacacccagauaacagcuugcugcucuuuuccccacucaucucugguggucacuacugagccaggcacaggaaacagagcagcgugagauggcagaugaagcccagccuggcuaucucugccuucucugcugggauggacuccaaaaauguacgcuugcauuuuuugagaauucaguuuggggcaaaaaggaugaaaggcucgagagaggauccugggguaagauacuccccugagagccugugucauuauacagcugugucucuauguggaccggcugcuuuagucuggggaacuucuugagacaauuccacuacagggcauggcugaccuugagcuaaaaccucuuaccuuggccucccaggugcugggguuauagucacaaaugaccaugccuggcuauuuggacagaccagugaggauuaaguauauucaccacuggaaguuaagagcuauggauuuauuagcauuauuaacuguauguacauaauggauuucacugugguguuuauaccggcauguuuuuguuuauccauucucuuuccuacugaucucuugucucaccaauuaguccucuuccuauuuucaggucuuuuuaaaaaaucuauagguccucaaggagcgagcggcucuucccucccccaugcuguauuuuggggacuguaacucaguugguagagugcuacugagcauacaggaaaacuuagauucaguacccagcacuugaaacguagaggaaaauaaaaaaaauucaaugacaucuuuagcuugagacuagccugggauacgagagacccugaaccccacuccaccccacccccaagcaugcacagacucauuaagcaccccagcuacugauagcacucuuuccucaugcaguugucugcauggaugcuaaaaggaugaugucuucuucuagaccaauccugggaugguccccagccauggauucagucccagaucuuacuucuuugacaacccccgaagauaugacagugaugaugaccuugccuggaacauugccccucagggacuucagggaagguaagagccaacuccuguuggagagugcugggccacuggaacggccgugaguggaagacuccuacugcacagagcaguucugcaggaccagguucaccaugggaauuagccaguguaaaggauucuuaaagacccccccacccccggggcguuuuuccuacuccguaguccauggaaugcuuaagagcugugcugguuuuaaaagaaauccaccuuuacuuauaggaccucuccgagccuacccagagagagccagggcaugugcugcuccacucacucacuggaacgugaucugggacauccaggcagacaucuuggauccucuucuaaagccagagaauauaugaacaauuaucacuagagugaauauauuauaagaaccaaaaauugaaauuugucauucuuaaccaauuauuuccuaagauacugacaagugucaucucguucauuguuugcuacaguucugugaggucaguauaauuaagcucucaugguuccagaucugugggagucccuuuucuggguaagcagcguggcuggccccggggccuacauaccucgaugccagagcacaugggaacugccuccuuugaaaauucacuugcagacuggacuguguccuuuuuggggugggcacuuacacaugguagcauucacaaugguguguguaugcucaagacaguaaacaagcugugccuggugccuucagccagauccagagucuggaucagagcuaggaaagggaggacgggaagcaucuugcggcccucagccccuccucucccugugcaccuggaucuacccaaggcucagaaagucgugcuugccuuuugcucuguguaacagugaaaguccuucgaaaugggggaagugcucugaaaggaccuugguuuggaaauaaagagcugagauagaacacauugcugucucagagaggagggaggagagacccccugaucagauaacaagacaagguagccaguaggggaaggcauagaugucaagucagacucuggaagcaagccaacauaaagauuucucagggucaagagcucuccuccuagagucugagcuccaccucuuccuaaagcuucucucuuaucuaaucuagcugccccacacuuucacccuguaaccccacuggagugcuggagcgucccuaaccacuacuugccagaaguuacugagagggcaguacucgcccuguaccgagagcaagaaaagacccuuuucuaugauagaggaaacugaaagguguuuuucaguuccaaugauaucucagggaucgcucuugaggacuuuuauagguguuuacucaacccugacaacagcccaaauagaaaauugcuaaugucuuccuguugcacagacaaggaacuugagacauagacauuaucuauccaaaacgcacgauaauaucccaccuuaggggucacuuuuuuuuaauuuuauuuuuuuuuauuuuuuuuuauuucuuugguuuuguucgagacaggguuucucuguauagcccuggcuguccuggaacucacucuguagaccagguuggcccagaacucagaaaucugccugcuucugccucccgagugcugggauuaaaggcgugcgccaccaacgcccggccuuuuuuuuuuuuucuccuaaaucuguguuccccacaaugacuaguuuuagguucuguaguugcaaacuucuaaacucugcgggguucaguagacuugaauucaggcuggcagcagugugcauagcaguuugguagaaaaugggcaagauacuaggccugaagacgcagguguguugcuaaaauccacauaugacauauaugcaauacccugugucaagccacugaacugguuuuguuuguuuguuuaaaguuuugcuccagacuacuaugauuggggacaacaaaauaacagcuuccuggcacaagcaggaacuuugcaucaagacuccacuuuggauccagacaaagcaagccaaggguagcagcagcugacacagcccuauggaagaguucucuguugaaagccuucagccagacagaccggaugacagcugaguugcuaaggcaguuuuccuuaggaaacagaacucuaguuuuugcuauagcuuucucauggcuccacagggcuaagcaauaauuuagagcaauaaacucuuuaguacuagcagagaaucuggcuauuucaguggguauaauuuaaacuuauaaaagagguucuguacuuuuauaaagauguauuuuauauaacuuaaauacuaaugcuaaaguauacuagguuuuuccuugauuguuaauugcaacguauguuguaguuugcacagacuuucaugcauaauucacuuuaaaacguauagaauacguggucuaauaguuuaaagcuuuggggaaaguuuccacaaaucuuaccucugaaggucccucuugugagugccacguggugggcuccuuucaccgccacucaagcauuccaaguucaggagaagcagaguaccauggucuguacguaacaggcucaacagcagcagcagcagcagcagcagcagcagcaauuucucguaaacucuguccuaagccugguccuucuucaucugaaagcacuacuacaagcacuccaguaacaaguggauacuguuaagauguaguugcugacacuauuaaaccuccucugcuguguguguagccauuuuguagaguuuucuucagcccgguguaacugaauacucacuaccucaguaccucaguaggaugcaaggacugugccuucuuugacucagccagugcuugcuauagucaggcuacaagccaagagguccccacagaguauuaacaauaaauacuucuggccuucaagcucuaaaggauugcagacuccugacagcuuuucuguaagacaugccugucauuuguaugaggcugacacggggcucacugccuguuauuuuuagauaguguucuauuaaaagcuauguguaugagaaaguaggcucugccuacguggcggcagcauccccauaucagccagagaguguuccagacagugguccucuugugccaucuccgugcuguccugggaaaacgcuggaacaacguggcccuccuggaggccggaugcucuggcuucuucugguccuauaggucacagagccacgcccacuuucucccauuuuguuauauuuaagauugggagcccaguuuccaguggguuguaauggggucuucguuguacagaggacgacguggaggaacuugcgcagccccgccccacacccugccuuuggguuugaguaaacaucuggguugcaagccauuuaaaauugcuucuuugccagggugaauucuggcaaagccuacacaaaucgccuguacgauagcacuguauaaaaguuuaucugucaccauaccugcaaugauuuggcuguugcagccagugcccacagcuccuguguccuugucucuagcagggcgguaccugucagcagccaagggcaaggcuugcuggaaagcacagccucauuaaggcuguucuguuugcacccauuuuguagcacaugcacacuuuacaguuggugaaugcugggcgucuguuuucuuacaguaacaagcaagcuaucauccauuuuuacaauaaaguugucagcauucaugucagcaauaaaaagacuacagcucuuaaaug

SEQ ID NO: 6893 - RNA, 74733 nt, Mus musculus
cauagccccucgguucuccuccccauuuccagggguggggacgacgggaggcgggaggugaggagggacugcggaggggcguaggguuauaucugcgccuccuccgccugagcugcuaaaccgccgggauugugggaccacaguugggaaacaugcuggacgcgagcggcuguaguugggcgauguggacgugggcgcuguugcagcugcugcuacuaguggggcccggaggcugccugaaucgccaggagcucuuccccuucggcccugggcagggggaccuagagcuggaggccggggacgacgugguaucccccucccuggaacugaucggagaacugagcuucuaugaucguacggacaucacgucggucuaugugaguuggggccgggaggggaggaaggccaggcuaugcuggggucgccaguccagagagacagauguggaacuugggcgucgcccuccgggacccgagugcuagcugucccagugaggggcucuccguugaaucugcgcaucuagaggaucgcauugcuugucugucaccccaguagcacucgaaguuuaggguggcaucugccuccgggauccacucaucuaugcgcgcgcccugccaggaucuggggaccucgaguagaguuuuccuucucgauuccgugcgcuucucgccuuccuacugggacaggucccaguacccugcagcucaauggccagaguuggguuguauccugugagcgcuccuagggacucugccgauggcaagcuagaaaggacagaggaacccuccugcuccgccccagaguuucaguggacagccccugcaucugugugcguggguucuggcuacgucuuggcagagauuuugcucucuuaguugggcugguuucagaguacagaggucaggacugagaacgcagggcgccccggugauccaauuuccuguggcugagggugucacccaggggccccagaugaggagcgggacuucaugaccuuuuagcucccuugaaccuccccagugcuggcagggccugggagcgcuguuagccuggucaagcccuuucgugcugcuccggcacaccauguggauuugauauaaagccugcgugcauuccacaaguguguguguguggggggacuacacagacggcgggggaguggcuauucucucagccuggccugggcagauagcauggggcaacacccacgugcagcuugucagcuuugccuagaaagaaugggucacacccacaaagaacucuuacccuuugcuggcuaguugcccuggccccaccgugggaagcccggagaagccuauagacuuuuagcaugcuuugaaauacacacaaugaaauccuccaccuuaccaaagaaaacaacgugguggaaaaaaaaaaaacacacacacaacauauuaaagcauauacaccaauuuuauguaguauugaggcuucuccaucuuucccagcaaccgcacucccccacccccacccccguuagggauguguuagggaggaguuaggaaucaaaaccaggacuuccugcaugacagauaagaacucuaccaacugcacuauauacuggccccucuuguuuccuuuuaaaccacacuauguguaguggaagcuggagcaauggguuugguaacuauuaaaaaggguggaucugagaagugaucugaaguguaucaauagugucugucagauuccacacgaggcgagaauaugaguaggggccauagugguacuugccugaaaucccacacuugggagguaaggcuaggaaguucuggagucaggccagccuggacuguggaguuugucuuuaaaagccaggaaauagccugugaggugacucacuggguaaaaggcacuuuauuugucaauccugacaaccuaauuucauacccccaucccuaggacccacauaguggaagaaaaaaaccugacucauccaaguuauccuguguguccccucacuccuccuaauuuuaaaaacuccccaaacaagcaaagcaccagaccaaacaagccagacagagcuaggggucaagggccugauuuaacucuggugccggaagcccccaaggaaaccagauggagaguauccugugucuagcagacacucaagcuucaagcuaacagucugggagaggaaggaaggcuggagaccuugguuuacaaagggaaagaguaaauaaauacauacauggacuggagguggugguguaggcgugcacucucagcaccgaggagggaggaguaagaggaucucggguuugaguuugaggauauccugggguacaagaaacucucucaguaagcaaacagaauuaagauaauuuuagaguucugaaaauaacagcuauccuugauaaugcuccaaagaggcaaucucccaaguguggcccacggaccucuggggucaaggaauucagaagauggaggugauuuuaaggaauauuaaguuuauugcuuuugucuuuuuccccuuauguguauuuuauguauaugggaguuugccugcacguaugucugagcaccacauauguguagugccagaagaggguaacagacuccccgcugggacuggggauccuaucucuguguugggaauggaaccuggguuaaauguucuuaacugcugacccaucucaucucuccagcccguuacuuauuuuacuaagcauugugaugaugaugacgaugacuaugaugaugcaucugggcacaugugugugcauguguacauauggguacauguguggagccuagagggcgggugaccuuaggaauggguuuucuucuguuguuaugagcugcagggaugggauuuagguaacucaagacuucaggcugugagacaagcugugccaucuugcugaccccaauggcuuuuagacuuuaguugcucaggaauguaugauggaguucacuacgggaugcaugauacccacaugucuguucccacaggcaaacgaagaagcaucuaucugccuuccauauaguuggacaucagguugauuugcagacacacacgugaaggaaagucucaucucuucauauacuucaugauguguauuuuuaaaaagauuuauuuauuaauuuauuuaauguauaugaguacacuguugcugucuucagacacaccagaagagggcgucagaucccauuacagaugauuguaggccacuaugugguugcugggaauugaacucaggaccuguggaagagcagucagugcuaucucucaagcccucuccaaauguauuuuugguuggaacuauaaucaccugcauuaaaauaaugcuguuuuuguucacacgugacaaauucauuauuaaaguguuuuaaguauuuaacuugaucuuugcuuccccuuuccauacgauuaaauguugauuauggucuugggggaaucuucaaaacugaaauguucaaagggcuccagaagucaaaauucccgagggcugaucauaaauauauaaaaucaagacauugaguauaaagacaggaaggacgcauuguugggaaugucuucuggaagaggcaggugccauguuggauacuagcgcccuccugugguccucaucagaaucccucccugcuucaugaugugugaguccccagaggaaugguccugaacggucaucauuagaguccagccaauaaaaccagucauucaccagaucccacgcaggggcugagccccauccagagcacuaaagcacuagaaauuucagagccuugcugcccugguccaugaaccuuaaacucccugggugagaguuuuugaaaacuaugguaaaguuguuccaaggaaugaaaacauuuccugccuuugccuggaacguugucuccguugguaugcuugcugucauguugacuggccacccucacugggcguguaaggcaaugagugauuucuaggacaugauuuuagugaugauuaaauuacuugcccaugagucauaaagauggauaagcaaguuagauaugacuuaauauuuuauucaaaaaaccuuccauacaguugggaauagaauaucuuuagcaacaaaaagauugugggcuaaaaagcuugcccugcaaccgugaggacugggguuugauuccccagaacccaggggagaaaaggcaggaguagcaugcagcaagccugcaaucucagcacuuugcagaggcaaagccagaggauuccugggucuugcugguccguguuucuagcccaaucagcaaacccaagguucagugacagacacugucucaaaaaguaaggaggaaagugacagaacaagacaacugauacagacaucuggcuuccaaacgcacaggaccaugugccugcacagacaugcauauauauguacacacagaaauuuaucguauauaguauauagguguauacucacgugcaugaacacauaugagcacacacaaccuucuaguuguucaugggcaauacugcuuaacuuacugccucacaggaccuucaggacugcuaucugaagcugcucgggauguuccacccucagggccucuggcccaggaaggaagauggcgauuuuagccugucuuaagccuugagcauccagcuuccgccugggacugcgaggagaagcacgagcuccucauuucccccagguuucccagugguugagcaaugacugggguugaaucucagaauccaagguuauuaauuccaccagggacugaaauauaauugacuaauuauagugaccaacuuuuuuucauuuuucuuuuuuuuauuggauauuuucuuuauuuacauuucaaauguuauucccuuuccugguuuccccuccuaaaacccccuaauccucuccccucuuccccugcuccccaacccacccacuccugcuuccuggcccuggcauuccccuauaccggggcauagaaccuucacaggaccaagggccucuccucccauugaugaccaacuaagccauccucugcuacauaugcagcuagagccaugacucccaccauauguuuucuuugguuggugguuuagucccggggagcucugggaguacuggcuaguucauauuguuguuccuccuaggaggcugcaaaccccuucagcuccuuggguccuuucucuggcuccuucauuggggacccugugcuuaggccaauggauggcugugagcauccauuucuguauuagucaggcacuggcagagccucucaggagacagcuauaucaggcuccugucagcaagcuccuguuggcauccacaauagugucuggguuugaugguuguuuaugggauggauccccagguggggcagucuuuggauggugaccaacuucuaauugaagccaaaucauuauucugauaaaguagcagauuaauggaauggagaaguuugagaaaaauuguccccagacuaauuuuauuugggauuuucaauacuuuuucuuuugcauggugguacaagccuguaauaaugccaucacuccaagagacaucacgccaaccugugcugcauagugaguccaaagauagccuggacuaaagagugaaauaaagacucauugcuauuauuuuuaguaaccugaugguuaauuuaauugcgcuuacuuucucaggacauuaguaccauuuuuauuuugaaucagggucucuuguggcuuagacuggcuuugaacucccaaugugucuaccaaggauugaauuccugauccuuuugccucuaugucuugaaugguaguauuacagguaugcacugccauauuuacuuuauguagugcuagggucucaacccuuggaucuuaugcaugcuaggcaaacauucuacuaacugagcauauauucccagccccaucuguguguguguguguguguguguguguguguguacauguauaugcaauacuccaauguuaagcucaacuauccauucauucuauagauauuauuauuuucaucaucauuauuuuguuuauugacagggucucgcuacauagcccugacugccuggaacucacuauguagaccaggcuggcuuggaacucacagagaucuaucugccuuugccuccuaaaugcugggaucaaagguguguacccagcuuuaauuaacuucuuagugugcugggcgcaaucugaggcuggugauagacugaaaacaagaccagccuuccaugcccacagugucaugucaugagagaggugacauucagccaaugaucacacugauaauaggacuguuaccacaugccgugcugcauccucugaggcagaaguucauguuggaacaauuuggagcagggcccaagcuaguggagcagucuagaaauguuccccaucauagcugcagcuacgaugguggagauuggcuuugggaaguguaagagacagggaggggcaugguucagauauggagauauugcuccucaugaaacccagucaagagccaggaauggagguugcucauacaggcugcagucaccgugcuuauaacaggccuugggucccagccagcagagcuccaugcuuuucauuuggaguugaugaacuucauacuguuuucagugugucugcaccggucuggccugccucuuagcugucaugcuauagccugcccuccuaguguggccucuauacucaugccuucuuucccucucugcacccauuccauguagaucuuuuauaauuuuuuauuuuauuaguuauuauuacugucuguguuugucugcaugugguaugcaugugugauuguagguaagcuaguaccacugaguggaggagaggucagaggcuacuuuauggaguccaucccccuuuccacugugggcuccagggauuuuugaacucacaucaccaggcuuguguagcaaaggauuuuacuuccauggccccaucuagguauuggcacuucuuuucuaucuggaacaacacacaugcugucucccagagguaccccauccugcugcuagcucucaggccucaugcauccuuuccaagaggguuccauauuugcccacuccuugaggcaugcuggaaagaugugaacaaaugucugaucuccagauguggccccuauaagagacaaaagaaaugauuccacccaagucuagcacagcaaaccaaccauuuuggggguugcuuacagacacacggguuacuaaaaaaucagucauuaaaaagcccaccuaacaugggcagucacaaaaacuguauccauagagcuucugcacagcuugcagacugcuucauagaagagucucugcacagcaauuguuuacugugcauauaagcuuagggaugggcgucuagugagucuuguaaguuuccugaacuugcugaaccuuguaaguuuuaagaaugaaacguuuuauuugggaggauauuuugggaaggaauaccuugguucuuccuuugcuugcugcccugucuucacaguuaaucugagcccuauggggacagggcucuacugucauaugacagucauuuuccaacacucagguguguguguggacagguggccauagugagugcuguggagcuaagcaauacacaaaugacugcuggacucuuacuuauuuuuucacuuuagucuauaaagcaagggagucacaugacauuucuaaguaagcuagugacaugguguguguguguguguguguguguguguguguguguguuugcaacaguauaggaaacaugggcuguaugggauaguuuauguauagacaacaugacaaugauauggauaccuggcauggaucaagaugacuggugauagacauggggugggagcauaagucaacaaaagauggcugacacuggaugucuggggaaccucaaaguaaucagagauguaaacuguuauauaaacuauuccauucggaauguugccuuuguguaggcuuuguauaaauacggccuugaggucaggagacugugucuuugccuugucuucaccagccugucuaugugucugucugucguccaguguguucaccucacuguggcuugucaggucuguaugccuaugccugucuguuuguggcuuaugugugccuggauaucugcaggagaucacaugccuacugagugguccuugugauggccccuugccaggagugauuaguguaugcugcauuugccugugacuagggacacccucuucaauggccugacccccuggaacccugcucuuuucccaacacagaggucaguaugaaccuggaaucuaccaguuggcuagacuggcuggcucgggagcuccaggaauccugcggucuccaccgcccagagcugggguuacuggcacgggcuuuuagguaggugcuaggaaucugaacgcagguccucaugaaaacauggcagaugcuuugcuguugggccaucuccccagccucuagcauuauuuucuucagcaaauaagauagcauaggagucaaagaagcagagagaaccuguaaaagagacuccagagaauguuaauccugguuggagccugauuaaaacaaucuggcugcacaaagaccucuuccagacaaacugcaauuuucuuuuucuuucuugcuguguugagagucaaacacagggccucacaguuuaacugcucaaaaugcuggcagguaggauacuaggguauccaggauuucauuuaaaauacuccccccaaaaagcagagcauggcggcccaugccuguaaucccagcauucaggagguagaggcaagaggauugcugcaaguuuaaagccagucugggcuaugugaugagaccucaucccaaagccaaacauaacaacuaccaccaaaugcucccugcccucaaaguaacuucaaagaaaacauaaagauagguugaagaaauucuagccaguuuacauggccugacuuacauggcucuggcaggccuugcccuuuucccuaacccccucugccuugcuaaaaacuguuagauuauauucauaaagcuagccagcaaggucuguucccuuauuuggcuauuuccuccuccugaggcugacuaccaagguccagccaucaaaauauugaagaccagcaaucaaaagcuaccuuugguucaccuaauuaacauuuccaauuaaaauugaacaccucauucugacucggaguuucccccuuugccuuuauaaacuaucauuuuaugggccacaucuggccuacaucugucuccucucuauccauuaccuagaggcagucauuuguccucuaggacaaauuccccuuccccuugcucccuuccccuucuuccugguccuuuaucuuggcugccuuugucucuuaaucucugcucccucugagacaaacagaucuccuuugugcugagaacguggucuuggguguccugagcugacacacauguauggcaggaacagaagaaaauacaaaugauagugugcuaggaauugcaagagcuauugauggaugggugugugcuugggaggggguugggguaaguuuacauucuagguugaaaauuccccuaaacaguaguguuuuacaaaaauguuuuugaaaaacuauucugccacccaccuggaaagaggaacuuuagaggguggagagguggggaguggcuagaagccuguugccagggucaagguaggggguguggugggguaaggucaaugguugagccagacucugugcugauggaaacagaacacuuguuaguacugugugcauuugauauucuccgcagcccugggagggguucaggcaggagcugugcgguccauaguugcagagcaggaaacauacaaggucaagggcgugaccaugguugucuuuuucagcccccagcccagucuuccuuacaucaugauugagugccaucccccucccucccucccucccucccucccucccucccucccucccucccucccucccaacaccccuucuugucucauuagcucuuguuuugagcccuagucuacaggguuuggggccacagugaggagugacaugcagugugauccugccgcuuaugaugcucacagcugcacaacuacugaacacacuuaguucuuggucccugaauguucacuuaacuuccuuccuccuccuccuccuccuccuuuuucuuucuuuucucucucucucucucucccucccucccucccucucucuuuccuucuuucuuuuuucuuucuccgaacacauaaaguuucaaacacauaaagaggcaagaggcaccaugacucuuguggacaccacaccaugacagugacacuuuagucuauaaagcaagggagucacaugacauugcuaaccuuuuccaauguucauucccagccaggguggauuaauuccauacuuauuucacggaaguauccagaauaaacuguguucuucaugauauaucagcagcaaauagcaccuguguaccugcucuugugggugacuccguuggcucuugaaaugggagccagucaggggcuugguugagguguugguagagagagaucucuauugagagaagaguugauuaaucuggcugugauugggcaaaccuuuaauccuuuaaucccagcacuggggaggcagaggcaggcaguugucuucaguagauguuguuccaggacagccagaguuacauagugagacugucacaaacaacaacaacaacaacccaaaaccagagagagagagagacagagacagagagagacagagacagagacagagacagagagacagagagagaaagaggaacuaugagcuacuggaccaucuaccugguaggugccuucucacagacaaggacuuuggcagcaugaaaccagucugaccuuccuggucaccuggucucaagaucuuucuccaguuuuguaaaucucaagaacagcagugauuacugcugucaaaggucauuguuuccucucccaauuuuuuaaucuuuguaugggcaccauggcacacauguggagaucagaggacagggugggaguugucaccuuccaugcuguuuaaggcagggucucuugguuguuuaccacugugugcaccaggcuagcuggcugugaacuucuuggguguucucucucucuuucuuucuuucuuucuuucuuucuuucuuucuuucuuucuuucuuucuuucuuuuuuucuuucuauuuuauuuuuuauuagauauuuucuuuauuuacauuucaaauguuauccccuuuccuaguuuccccuccgaaaauccccuauccccucccccugcuccucaacccacccacuucugcuuccuggcccuggcauuccccuacgcuggggcauagagccuucacaggaccaagggccucuccucccauugaugaccuacuaggccauccucugcuacauauauagcuagagcuacaaguuccacuauguguuuucuuugauugaugguuuaauuccaaggagcucucugcggguauugguuaguucauauugauguuccuccuauggggcuucagaccccuuuugcucccuggguauuucucugacuccuucauuggggaccuuguguucuguccaauguaugacugugagcauccacuucuguauuugccaggcacuggcagagccucgcaggagacagcuauaucaggcucuugucagcaagcucuuguuggcaucugccuagugacuggguuuggugguuguuuaugggguggauccccaaguggggcagucucuggauggucauuccuucaggcucugcucugaacuuuuucucugcaacuccuuccauggguauuuuguuccccauucuaagaaggaacaaaguauccacacuuuggucuuccuucuucaugaguuucauguguuuugcaaauuguaucuuggguauucuaaguuucugggcuaauauccacuuaccagugagugcauaucauguguucucuuuugugauuggguuaccucacucaggaugauauccuucagauccauccauuugucuaacaauuucauaaauucauuguuuuuuguuuuugauuuuuuuuuuguuuuuuuuuguuuuuuuuuuugagacaggguuucucuguguagcacuggcuguccugaaauucacuuuguagaccaggcuggccuugaacucagaaaucugccugccucugccucccaagugcugggauuaaaggcgugcgccaccaaugcccaacaaauucauuguuuuaaauagcugaauaguacuccauuguguaaauguaccacauuuucuguauccauuccucuguugagggacaucugaguucuaugagcuucuggcuauuauaaauaaggcugcuaugaacauaguggaacauguguccuucuuacaaguuggaacauuuucuggguauaugucuugggcauuuucuaucucugcuucccgucuugccauaggaaccuggguuugcagacaugcuaccacuacauggcuuuguguggguucugggaucugaauucaggcuuucagguuuguguguucaguucuuugaucacugaacccucuccccaguggcccucuccucuucuccuuauucuuguugcugaugaguuuuuaaaagauuuauuauauucuuguguguguguguguguguguaugcguaugcaugcgcgugcacgugcgcgcgcgcgugcgcuacugaaugcaguuacccucagaggccagaagaggguggcuggaguuacagcuagguaugagcuuccugacauggcuucugagaauuacacuuuacaguaucagugugugcucuuaaccacugagccaucucucuaaccuuaugugcagcuccgauauguuacuugggggacagauuggaaggaguggccguccagagaaggaccagagucagcugaugcucaguauugagcuuuguauacuaagagagggagagaucaggauuuuaaauauguauauuuuuuuaagcuuuuguuuuaaggggugaucccagccuucaaaugcugggauuacaugagagaguuaguacacucaguuugagaauuugcguuuugauauugaguuucaaagaaacaccaccaacaaaagaugaacaaaaaccaucaucaucaucaucaacaaaacccaaaccaaaccaaauacauagaaccccucccucccaagagcaacacaaaccauuauacuaauaccacaccuauccagaucaguaguuccuuaccaccaaguuaugcucaagcugcuuaaaaauucuucaauaucuaggggguggggugcgagccuuuagucccagcacucaggaagcagagucagacagaccucuaagaguucaagcauccugguucuucagagcaaguuccaggacagccagagauacacagaguuuuucugccuugaauaaaacuaaaaacaaaacaaaacaaaauaaacaaaaccacacacaagaaaaaaaaucaaagaaaaaaauucuugaauauucccaaagcugccuuuuacaagccuuauuaagccagagauucagaaacgagcucacaggacaauuguugugucuuccccuuuguucacucuuguuaaagaaucacugccuuuuguccuguagaauguucuaggucugcauuccacuguuucuuuguccuaaaguuuaacuuguuauuccauuaugguauuuccuggaaauggugauuggauccuauucugaaagcauucagguuaaacugaauacuuuauccuuuagauugggaagcacugaggagagaguucagggcucuagugcuuguccagcaugcaugaggcucuugguucaagucccauuuccacaaaaaacccaaaauaaagcaauaaaauuauuuugugagcuagcaauacacucaauguuucauuuuuaaagagcuuucuaacacagugaaaagugaaguuuugacuaagcuguggcuggcaagcuacagcggucccccugcugucucaggggugaccccuuuaaaccugacaccagguuauaggcaggaucugccaggcccagcuuuuuauguggugcuggggaucagaacuaagguccucauguuugugcaccaaacacuuggcccacugagcccucuucugagcccuguguaccucuuucuucccuuguuuuauguaucccugacaacccuuaauaguuuuuguuuguuuugguuuuuuugagacacagucucauucuagaguccagccuggccugggauuuacuguguagccuagaauggcuucaaauucauggcaaugcuuaugccccagcauccuaaguauuugagccaguaugauugacuuccaauuuuuaaaaaagauuuauuuauuuuauguauauaacuacacuguacuguacagaugcuugugagccaucauguugugguugcugagaauugaacucaggaccacucgcucuggcccugcuugcuccaguccaaagauuuauuauuacauguaaguacacuguagcuaucuucagauacaucagaaaagggcgucagaucucauuacagauaguugugagccaacaugcacuugcugggauuugaacucaggaccaucagaacagcagucagugcucuuaaacauugagccaucucuccagcccccucauuuuuuuuaaguuacagcuuuauugagauagaguucaugugcagaaaaauucauauugccuccucccuuuugagauaugaguaucagguagcccagacuggcauuuaauucaccauguacccgcagcuggcuuugaacuccugaucuuccugcaucuaccuucuaagugcuaggauucuguaauccuacuacaccugucaaaaacuugcccuuuuaaaaaaaauauaugugguuugggucagugagguggcucagccaguaggggcucuugccaucaagacugacaaacugaaaccacaugauggggggaaagaauugacuucugaaaauuguccuuugaccuccacaggcauccauggcacaugagugccccccucaauaaacaaaguguaugccaaggaagguuuggugacacacuauguugaucugagcacacagaaggcugaggaaggaggaagggguugacaccaucuugggcuauacaaggagucucuguuuuaaaaaacuaagcaaaaauaaaaauccaguggcuuuuagcuuagagaaugacacagccacuguagaugucuauucuagaagguuuucaucagccugagggcaaguucugugucuaacagucacuuuugguuucuccucccggaaccccagucuauuuucuccauggauguccccuucuggacauuugagaaaaauggguuauauagccuuuugugggugacaccugcuacagcacgguguuugcagaaucguccaugcuguagaauuguacaugggguuuacucuuguguuuggauucuaauuaauuuugacacaaacuagaguuuuuuggagaaagggaaccuuaguugaggaauugucuccaucagguuggccuaugggaaugucuugauuaugggcacuuucuugauuaaugauugaugugggagggcccacuggaagugguccugaguugcacaagaaagcaaacugagcaagccacggggaggaaaccaguaauuaauauucuugcauggucucugcuuuaguuccugccuccagauuucagccuugaguucaugccaagauuuuccuuagggccugacugugaucccuaccuguaagccaaaugaacucuuucuuucccauggcacuuugguuaugauguuuaucaccuaauuaggacagcauccuuaucaccauauuaauuuaauugcuuacaguuuuugagacagggacuuauauacuccuggugguuguccuugaacuccaguauguacguaguuaaggauaaccuugaagccuuguucuucugccuucaccucucaggugaugacaucgcaggcaugaagcagaagugaaacugucuagggaacagaaaagacuaaggggugagaggcgggaggguagcagggcuuuggggggggcaauaugcucaaaaucuguuacaaacaugcuggaaauagccuugugcaaccuugcaugaaaaauaaugcaaaaagagccuuuucuuauuggcuguguuuuccaccccccccaccccccccggggguggggauccuggaaagacaagaaguauaaagcaucaaguguggagcucuugcccccucgauguugaagcuugaauuaaggaccucuuguaggaacaggcucccagguacgguccuggugucuguacccuaguguuggggaagcacacagcuuugccuagagauuagggcuugcacagggccuuuccuuucuucccuggucuucuagaggcagaaggauagagguaacaagucaccccuccccucccccccagguuaauuuguuuuguuuuauguguaugaacauuuugccuuccuguauguaugugcaccauaugaaugucuggugccuaugaaggcgagaagauagcaucagauccccugaaacuggacuuuaagaugauugugagccauugugugggugcugggaaccagacucagguccuuuggaagagcaggcagugccuuuaucugcugaggcauuucccaguguccagucaucucuucuuugaugguuaagauuuaaagaccuugacucuucagcuuuugaguuucauucuguggcccagguugggaggcacucacuguguagcccaugcgggucuugaagucauaguguucaucuugccucaucuucccuagugggggcguuuacagaggcgcacccccacgccuggccagcaauauuugugucagaagauuauccucgguagagacucucgaagaagugaugagcaagcuaucgaaaaucucucauuagacaaaacuggguuaaguuggaaaaaaccaaaccaaaccaaauggugaccguaaccuggggcugucccugucuuuauuugguaaucccuuuguuucuauuucuaauuuaagucagagccauuuucucuggcucauguguuaauggaaaacauuugcaaucuggaguacuggagugcucugcacuugcagugucuggccucaggcaagugaaaagcugaaguucauuuuccccccucaagccaagagugaggggggacacucuacccaccucacgagguuuaaugaauugucagagcaauaacugcuucagacaggaagguaaaguaguuggaguuuuuaggguaaaggccagagcuuuggcagcccaacuagugaagcucggccaccugucuugauauaccaacuaagaccaauaauggcaaaaggcaacuaggagauuuguucaauguggccauguugagacucagagggguagauaaagggaacuagggaccucauguugggcuacuggcuuccauacagaaggaauuagggcaagaagugugcauagcuaagcagucuggucuugguauaggcuccuuuaucaucaucucaacucuggauacucaaaggugguccugaagaaguacuuauugcuagguuguucugaggaaguacuuauugcuagguaguccugaagaagaacuuauugcuagguggucccaaagaaguucuuauugcuugaggggacaaaauauucuuagggagaugcucacuucugcuccaggguacagccucacccucauggauaaucaucuucaucugagagugaaugaaggcuauauugagacguucuucucugggaacugaugguggcugcagguuuaggaugagggccuaugccugugcuuugagccuugaaggggaaugaguuggaucauggagcagagucaagcaguuaugagccaaagugaaggacacagacaugaaaugaggaccagggugguaggcuuuccuucugcuucugaugaccuugaggguccaggugaggagucagugcucuugggcauuugaagggucuaaguaccugugcucagguggacagucaggccccagguuuaccucugaaaucaauguccaccucuguuauaaauagguuuggauauuuccuagacuugguuuuuccaugcuuuuucuuuucaugggcccuucccauuuuccagcuguuucuaguuggaaacaugacaucccuccccucagcacaaccuccucuuuuaugccccaugucccuaaacuaagcagcuacauaaaaacagaaagaugucuggguaugcauccugcagaugugagcugcugcuucacccaguggcugugugaacauguuaagcuaagggcuugucaguucuccgcuacauaugugugaauagcagacuuguaauggaaugcccauuauguuaaacguuuacaaaugugcacagccauaggaaaggaccucacacucagcacacacuccagacacguuuguucccuugccauuauuuauuguaaauucucggagccugaguucccaccaucucccacccagggaguuugcuuucuucaaguuucauugucuacccgugcagccauuuguguuucucugcugcucuguuucuuauuugggucuaccucaagcauuccacugccucaagcauuccacuguucuggagaaggccucucccucgaggauuguaggcugcccuggggacugccacuuguugcauuuaagaugcaugucucuucgguguauuuauguggaaucugacaugauuuccuuccauugacugucugcaaagaccguucccagugauuccccaugucugaauguucacauuaauguuggaaaagagacagggaaugcuuuuaaaacaggaagcacccuuccauuccaaguggcucugaccaccuccucugcaguugaguugaaacaauuagaccuaagugauuccagcuguugcucauguagggugugugugugugugugugugugugugugugugugugugugauauaauugacauggguuuuuccagggcacgugaugaaaagccaggugguuugguguaugugaggaugagagaguuaaaucuugcaguggcaauaucugaauucucuagggcaguaucugcguugguccacaugcuggaaguggaugguuuucagugaauucguuuuuacucuguaguacaaagucaucaaauauguuucuuaggcaauguuuugugaguuugaguuaaguugucacuggaauuuucagggaaagagggcuccaggagucccccaaacccaaggcacccaucuacaauaaauagaagagauuuaguaaugcuaaaagguagagaaaagagguucacucaacguggccacacuugggggaggggcagauaaaggguacuguggcccucuacuuucuaggugcugaugugagcuuuagauucaacagagaaagagagcagggagcaggaguucugugauuuaacaaugccaaugugggugugagcuugcugaucaugguauucaccuugguucugugaggugguccaagucuuuaagaaggagucagucuaguuccuaccagauguuuacuccugcuccagccauggauagcaacccuccucuagggcaugggacuagggguugggcagggcccugucccaagaggguuugcuacuguggaaauucagaagaacgcaagaggaaagguuaccgauauugacuuggucuccauaucuucaggcagaguauggacaaaugaaagcaaaaagggccaggcuucuauucauuuaguuaaucugugauaacuaagugacuguuuccauaauaauauaacaaccuuaauuauuauucugugauucagguggauuuucucaaaaacauguucaaacuaggguauuuguguuuuguuguuugcuuaaaaaaaucuuuguguguauguguucauauauguguguucauauguaugaaugggguacauggaugccaugguacacaugaaaucaggacagccucagguaugggaccucacuucccagcuugcuugagauagagcucuuguucaacacuguaugugcuagacuagcuugcugcccagagagcuuccagagauuuucccaucuccucccugcaggagugcccaugugacaggcacuuuacucuucaguccugcuuuggguuuagugugagagggucucauguagcugaggcuagccuagaacucucuauguagcuguggcuggcuuugaacuucugcuccuccucuguuuacccuccuacguccuggaauuacaggugcacaccuguuucaugcagugcuggagguuaaggccagggcuuggugcaugguaggcaaaccuucuaccaacugagcuauagccucagacuuuagcacagauaugguggacacaacauuggugucugcugcacaaugcuuuuguuaauauuagauuuucucuagacucuggagcaguucuggaaugccacaggauugugugacuuuugauggacuuuaaucaauaggcauugcuuuugccagagccuucugcucauuggcacaggacaaguaacaugccuaauucuggggcuggguggugaggagggaggccuggcuggguaagaugccaagcagcagugcucaccucuuguuuaauuuugcuucuguuguuugugcuuugggugccagggccccaaaauuuaccgcaagacuaaugucaaggaacacuucuucacguuugcuugcuuguuuguuuguuucagccuuacauuuaaguccuuaauccauuuacaguuaauuuuuugugggugccauaaaauaaggaguccauccuuauuacuuuaaaugggcaaaugcaguuucccuggcacugcucauugaagagaaugcccugucccaugguguguucuuggcaggcuugacugugucuguuuagguuuauggcuaccccccuuuccgccgcccauuaccccacuucuucgugggccucugagucccugugugguccaugggccccacauguuugucagcuugguuaggaagcuugaugguguucaucauuucacaguuuauacgucauauuuauaugcuucuuuggguccaguauaccucauuguagcugggaaacaaaacaaucaaagaccagggccaacuccugacugaucuuuaauguugguuuaucuacuugcccugauuucuaaacaauccugcucauuaucauuguugugaggcaguuuccucuggggcugucacagcucuugccuucauugagcaaggacuuacagaauaucuggccaugccaaauaacaagcaaaacaauccaggcauaguuaagucuaugguagucacauuuccuuguagaaagaaucauuuuuuuuucagucuauuacugcccuaucugaguggaacaaauauuucuuguuuuugcuuuuugagacaagguuucucuauguagcccccugcccccacacaccaacuguucuagaacuugcucuguagaccagauuggccucaaacucacagugaucugccugccucugccuccugaaugcugggauuaaaggcgugugcuaccacugccuggcuuuaguuucuauauuuuuuaaaagguuuacuuuuuagccugguauggcagugcauaccuuugaccccagcauucgggagacagaggugaguggaccucagugaguucucacucauacugacccacagugaguucuagaccagcucggguccugucucaaaaaaauauuuuuauuaucuuuaauuauguguaugaguauguaucuauauguggauaugugcacaugagugcaggugccccugguguccagagguaucaggugcccuggaacuggagcuacagguagccguuagcugccugacauaaaugcugaaacuaaacuuuggguccucuggaaaagcagcauauccuuguaaccacuaagccaugucuccagcccuuuguuauuauuuuaaaauacggaacacuuuagcuugucaugucaucuuuagggcaugcuaaucucuguauuuuaguacaugugcugcagaagggaacauucuuggaaaaguuuuuuuuuuuaauuagguguuuuauuuuuuaauuaaauguuuaauacuaaauuaauguuuaauuaaauguuaaaugauuuaauuaaauuauuauuauuacacuuacgcguguguaugagugcauugccacagcacacauauggagaccagaggagaccacuugugggaguguuuccuucccuuccaccuuguggguucuacagaugggacugauguccucugacuuggcagcaaguaaaugccuuuagucacagagcacucuuaccugcccaugaauacauuuuccuuuauguguccucgggaaaagcuacacaauacuuaccucuuuggaggaacuaagcuuauuuuagaaaaguuccaaacauuaaaaaauaaaacagagugaacucccacauccccauuaccgagcuucgacaaauaucagccucugacuaacauugcuucauuuauagcccagaugucugucgcauucccuucuccgccccaaacuggguuauuuuaaagcaaauuuuaagcauucuauuuccuuguaaauauuuuggaaugugucucaaaaagacccuuuuaaaaaauagcaaaacaagaagaucacaauuacaucuaaauacuguaaucuguaaucccuuucccuccuucuggcucuggcugucuguguguccccccccuccccccgcccccacccugcugcccacccuccccucccacccccaacaaugucuggcuguguagccuuggcuauccuggaacucgcuauauagaucaggcuggcuuugaacucaaagggacccaccugccucucccccugagagucaaaacacuuagcuuguuguuguuguuguuguuguuucuuuuucagugagaggcuuaaaucagaaucuagucaaacuguacuucauguauauacauccuucuuaggaccuucuuucuuuuuaaagacagcacacacuggccuguaacucuguagcaggagaugucucugaacaacugauuuuccugacuccagcgcccaguggaugggauuaucacacccagugcaugcagugccuggaacccuguaaaugaagccucaccaaguggguucccuugcacucugagggacuauagggcugcccuucucuggucugugugauucaguggggcucacuccaggcacguccaaaguagccugcgugcacagaucuugucccugcccuguacuguggaggaagucaagaagcuggaggggacauuaggugauguauaagcuuuggaacuguagugaugacuaagacagagggucacugacccuugguuucugagugcauagggcaagggccuacaaacagggcuuaagggaacaggaggcagagguagugugggaggaggagugaaguuugaggaggagccugugaaaggcaccuguggugguggaggagacucugaguagcugcuugaaggacuggguggaccagucaagggagcccaggugucagcacugggaaugcugggacuguagggaaggagaaaggcaaaggaacaaaaccagcagcugacucaggccuguaaucacaucaugugggagauggaggcaggaggacaggaguucaaggucauccuuagcuacuuauuuaguuucaggcuagcccucuccaaaacaaaaacaacaaaacaacaagccaaagccaagauacuuuccaagugucccaguugcuacaggugggagaaugcagccauggccagcugcaugguuccuuccgacuggguggggagcuucaugccugacagggggagacauuguuccaccaagcuggcuauucuuugacacauuuccaaaaauaaaaagcuuaaagggagaagccugaaguuaggaaucaucagaaaccgagugauuuagcccccuuauagcaccucucucggaguuuggcuuucuucguucucacagaugucugaguugaaggucaaacgggcugaaggaacagcuuucccaguaauaauaccaaggagaguuaugugaucuggcgucaaauaggcacccaagguccuugcaugaaaauugauuucuaaggcaagcauuccuugugaaaauagagucaguccagugcccagauuccaaagaauagauggauguuggaugauuugaaugucuuuggaaaauagccuuguggaaaggagcugucuauauguggucuccgcaggaucgcuuccuaccagcagccagucacugccaaugucuggugugugcuugagaaagugagcgguuucccacgcucccccaucacagcaguugggauguuugugcuggaggagguuagaugcugugaacugggcugcaggaggcaucuugccugacucccaucccugcagacugucaauuuauucuggaagaaucuuacuguugccaagugauggaaaauauguuacuugagguaaaacuaauagccugugacauuuauaaaaagagaugguuuuaggacaggggaauguagcacaguagguagagggcuugccugacauacacaaaguccugggugccauucccucacaugguauaaauugaaagugauaguguaugccuguaaucauagcccuugugggguaaaggcaggaaggucagaaguucaaggucagaaggcuggaaguggcuuagccccugagugugaagcccuaaagucaauucucaggacuccuuuaauuaauuaauuaauuaauuaauuaauuaauuaaauuuauugauuaauuaaaaauaaaugaugcuuuuguuaaguuccaaagcucuagguuuuuuguuuguuuuguuuuguuuuguuuuguuuguuuguuuuuuaccagccuagguuggaaucagcuccaccaucucuaaccuuauuaucauguucuggggaaugaaagcuaugucuccaaauaaauauauaaaguggaaagcaacccgaccucuggcuuccauauacccucucagacacacgacagugacaauacuuuuuaaaaacuagaagagauucugagaacucuauacaugccaugauuaagcuggccuugaacucaugauguagcaaaggcugaccuugaguuccuccuguccccaccuucccagugccagcauauacuaccaugcucaguuuauacacugcuggcaauugagcccaaggccgcguguagccaggcaggaauucuacugagagcugcaguccugagauagcugaccuugaagucaagaucuuugggucagaauuccagugauguuauuuauauauggugacuuuggacaaguuaauugcuuuacuuaauuuuccuacuagagaaauauggguaccggugacaccuagccuucugguguuuucccaaagauuagaugcuaccuacaaaguggugaacuguuaaugcuguuaggugguauuuuaugcacuaagcuagucacaguaguuaucaacaguaugcagguuuaccucuuaacacauucauuuaaucaucuguguuagccuucccuuccuuuggacuuuggguuccuuuaaaguggggcuguauccagcucucucugguaccaagagugguauaacacugacccaguguggaagcccuugcagaguuaauuagucauuuggauaauguuggcagucaacaaaucucuguugcucucacuauuuuggucaggaggacacagaagggaaaggagauauuugagagacugcccguauuugacacacuugacaugaagcacccugcaucauguucuaagauucuugucuaccauauccuucauacccccaccccaccugcguaucauguuggugguuuugccagucagacuuaucacuuucucccauucuguuuauuuuguguuccacgggcaacugcaacaguauccggugagggagagaucacuugcuguguuaguuacaucugugucuuuguaucuguucuaaccacuugauagcaacaacugaauggaggaaaggcugguuuauuuuggcucaugguucuggugagcuuuuaucccaucauaguggggaagguaucguggagcaucgugaagcugcacagucugugugaugagacccuguggcagaggcuguucacaugauagcugauuagagcacagagagcaaggcgggagcuaggagcaaaggccuguucuugguggucuccuucagucagacaggcuccagugguggcucaugaucccacagccucucaaaauaguaccaccagcuggaaaauuuguagagauuguuuuaaaaucgaacccuaacauucccuuaaggaguucaucuuugcauucucucuaaccacacucgguuccuuacaggucaccacaaaugguaucaucgccaugagcgaacccccagccacagaauaccaucccggaaccuucccacccagcuucggcucaguagcgccuuuccuggcugacuuggacacaaccgauggccuggggaauguguauuaucgagaagacuuauccccguucauuauucagauggcagcagaguauguccagagaggcuucccggaggucucuuuccagcccacuaguguggugguugucacuugggaaucuguggccccuuauggagggcccagcagcagcccugccgaggaaggcaaggugagugcaccccacauggagaugcagguaucuggucugguauguugacuguagucuuugcgcuuguuccaauggacaacaugccuauccuguugcucaagacaggaagucuagagcaaaguccagugaaauuugccuguugcaugcaggucagcaaacuccagaugcuuaucuguagggcugucugaaucacuucugugacugucugauguugagaaagccagguauuugaggagauugcuccauggcaaacauaugccugggaaauaguaccuguguuccuucuuuaauugagaaagagugggacgauagcuucuaauuauagagaaguuauuaauaggaaaugcuagauaucaagguucugaucaacgugccccuccugaguggagaaaaguccuuucguaaagaagcugccuuacugacacuuaauggaacgauccccaaacucuuagccuuaucuccucuuaucacugaccuccaugggacacauagcauuccacagaacacauuuuggagaggccuguggugggucugcauaucucauaugcuuugcaaaauuggaagauugccugacccaaggauacucagcucuugccugccucuugggacuaaccuaauaagacuccauauacccucuucagcaguuguaucaaacuguuuuuuuuuuaagauauauuucauuuuuaaaaaaagauuuauuucuuauuaaaaauaaguacacuguagcugucuucagacagcaccagaagaggggggucagaucucauuaugggugguugugagccaccaugugguugcugggauuugaacucaggaccuucagaagagcagucagugcucuuaacuacuuagccaucucuccaguccuauaucaagcucuuauauuugccugaagcauaccuuuuccuuuguucugguauguuuugccucacugucguuugucuuugacaugaccuccuccugauuguaaacccaggcccuccugugaagccuugaccaucacgggcuucccaagaacuaccccuacccuacccaacacaggauucuuccucauuugaccuacauguagcacgcugcacgcaucucuguuacaacaucuguccucagauuuaggcuauauuugucuauagauccaccucucuguguagacggcacagucucaauuguaggaaagugagguggagugcugcuggcucuccccuguccuuucuacaaggaacccagugaacagcaugcuuugagaguaugguuguauugcuagaaacugacuuuuaacucaucuucacagagaaacacguuccaggcuguucuggccuccucaaauuccagcuccuaugccauuuuccuuuauccugaagauggucuacaguucuuuacaacauucucgaagaaggaugaaagccaaguaccugcugugguugguuucagcaaaggucuaguaggauuucuauggaagagcaacggagccuauaacauauuugccaaugacagagaaucaauugaaaauuuggcuaaguaugcauauucuuuauuuguuuuucuucauuagauuccccuuaauuauauuauuauauuguuuuaccaaacaaaauguaguaaguauuaaauuaccuaaaaauguucuuauagauuuaaauuuuauagagagauauuuaaauggugaaacuguauuuuuuuccugaugaaucuuagggaauuuauuuagcaugaagaggucuuuuguuuauuuucaucuuuauuuguauguauuagcauuuugcaucauaugcaugcagugccuguggagacuagaaacacauuggauccccugggacugaaauuacagaugguucugagccaccacauggaagcugggaauugaacccagagggucucucuggaggacuuaccaaugcucuuaauuucugagcugucucucuagccccaguaguguguuauuuagagugcaccuucaugcaaaacugucucuacuguguccucugaguuugaagucagaaauaauggaaauuuaaaccugucuccugccaggaaccuaaacuaagugugguuuuccuccacacugaugcagaacaguucuuuacugcacgcagugaagccucguuguaauguuaguguagagaagcaagagauaacaggauauuauacaaaagagagggauagccaagauuauuggcuuuuuguuuuguuuagguauuuugagacaggaucucauauagcccaggcuguccccaaacuuucuacauagagaaggauggaugaccuugaaccagagauucuucagcccccaccuccaaggugcugggguuacagguguaagacaucaugccuggucccagacugguuuuuaagaguuaaaaaucuuacaacucccaauauucuuuagccuaauccccuuuccccauuuugucuucuguaacuccagcucagcuccaagggaucugaucucccucuuuggccacucugggaacuugcauguacauguacauacaaauauagacauacacauacaucuauauaugcauacauacacacacacacacacacacacauauauauauauacaugcacacacacacacauauauauauguauauauauauauauauauauacacaugcacacauacacacacacacauauauauacauaaauaaauaauaaaauucauccuaaagcgaagcaaaguaaaacaaaagaaaaucccccaaacacaacaggacuagagaaacgguucaguuggcacaagaccugacuacuauuuccauacccccauaaaaagccagacacgguggugucugcuuauaaauccaaccuugggaaguugagauggaugggccccuggcauuuugccagccauucuugucuacuuugugaaccccagggcagugagguacccugucuuaaaaacaaaacaauaggccagggccuagcaaacacauaaguggaugcucacagucagcuauuggauggaucacagggcccccaauggaggagcuagagaaaguauccaaggagcuaaagagaucugcaacccuguagguacaacaacauaauaaacuaaccaguaccccggagcucuugacucuagcugcauauguaucaaaagauggccuaguaggccaucacuggaaagagaggcccauuggacaagcaaacuuuauaugccccaguacaggggaacaccagugcccaaaagugggaauggauggguaggggagugggggggaggguaugggugacuuuugggauagcauuggaaauguaauugaggaaaauauguaauaaaagaaaagaaauucaaacaacauguaacaaaaaacaauauuuaaggaagugagauaagagagauaaccugcuggccagauagcaguagucuugcugagaaaaugagucauauugggcuucuuguuuuaguugcuugucuguguuagccaucucuagaauguagaugugaaaacagcucuuuugaucuuguaaucuaauaucaauucuaauucuaguugcuuuagcuauuucuuguucacaauuuauaaauuauugauuuaauaaaauguuuuauguguuuguguaaaaaaacaaaacaaaacaaaacaaaaucaacaaaacaaaacaaauaaacaaaaaccaagguagccaggcaagguggugcaucucuuuagucccagcacuagggaggcagaagcaggcagaucucugugaguuugagaccagccuggacuacaaauuuaguuuuaggacaguuaggacugguacacagagaaauucugucucaaaaaacaaaaaucaaaccaaccaaccaaccaaaaaccccaaaccaaaaaaauuaaguagguuuuacuucaugcaauaaaaagaacauaguggugaaaugacucucuggucccucaugagacagggcauauaaacugugaauaguacaagcuggaggcauugagaguguuugguguccugggacccacccuagaggguaagcucuucaugguguugugucuauuuagauucagucucacuaaauagucccugccuguaugaguucuuggauaaccacccauggcauugcugcccuccuggacagcagcccuugccaaggguagacacaugccacaccuuucagauggacauagguuacugaucuccuccugccugcuugguaagugggggcugcuugugggcuguggccuauucucaagaugccuuccuugccucuaggagcagcaacgcugggcaccaggguguguggguguuugagauuggaaguccugcuaccgccaagggcguggugucugcagaugugaaccuggaccuggacgacgauggagcagacuaugaagaugaagauuaugaccuaguaaccucucaccuuggccuggaggauguagccacucccucccccucccacaguccaagaaggggauacccugacccacacaauguaccuaggauccucucuccuggcuaugaggcuacagagagaccccguggaguccccacugagaggaccagaucuuuccagcugccagcggagagguucccucagcaucacccccaggucauugauguggaugaaguagaggaaacaggaguugguaagacauccauuuuacgaguuggaacauguauuugccugcuugguuucuagacaggaguuggcuaguguagggugggucaugugccccaugaggugacuuuaugggggcggggcauauagccugagggagcagagacugaaugcuuucacaggagagcaaugggugcuuaggccccaugacuucucagugacccagugaucuuuuaggauuagagauuugguuuuggacacggugggaguaugccucauuucaugauuucucauaauguauucuauuuuaaagagagucagggccagggagagauggcuuaacagguaaagguacucaugacuuaaguuugaccuucugaagcccacauaguagaaggagagguaugacucccucaaacuguccucuaacacagacagacagacagacagacagauggauagauggacagacagagagauuuauuucuuuuuauaagacagggucucauuuaugugguuuggauggccugggauuuaacauagacuuggcuggcuuugaacucauggagauccggaugcuuuugcuucccaggcacuaccauaaucugcuuaauacaguuuguucuuuuaaaaugucauuguuggcugggcuguggcagcacacaccuuuaaucccagcacuugggaggcagaggcagguugaucucugugacuugaggacagccuggucuauagagugaguuccaggacagccagggauacgcagagaaacccugucuccaaacccaaaccccaaaccgaaaagaucacuguugagugcuguuagcccaacacugaagaggcagaagcaggagaaucaguuucuagccugggauacaguaagauccugucucaaaaacuaaaagaccuugaauauuuuggaacucaagugucuucuuugugacuucugagauguguucacccaccugaaaaaacauucuagaaacuccguuggcucuuuaugcugcuuuucuuucacauuuuuuucuuuuugguuuuggaauucaagcagcugauuauuuuuccuccugucaguugcaguugcuuucuaaagaauacucucucucucucucucauacacacacacacacacacacacacacacacacacacacacacacaucaaaucucucuuaaaauguaguuuuauacaaugugguaucuccuucuccuucugaguuaugguuuuuccaggguagcccuagccuugaacucagaucugccugccucugucuucugaaugcugggauuagaggugugaaccacuacgcaugcacugcacagugugauauauucuaaccauauuuccuacauuuugaggaaaauuacuugagcauucuuuaaguauuauaagaaguucucaaaaugugccuuuauuuuucaugagauacauacacagagagagagagagagagagagagagagagagagagagagagagagagagagagagagacagagagagagagagagagagagagagagagagagacagagagaggggcacaaugguuaguuucaauugucaacuugauacaauauagaaucaccuggaaagauugucagagaaagcugucuacaucagguugaccugugggcaugucugugguugccuaauugccuugauggauguaggaagacccagacuucuaaugagcugcauccuucuacgguuugggguguugacuugaauaagaguacagaaagcuggcugagcaguaggcaugcaugcauuaauuccuuucuuaaaauguaaccugucagcuaugaccugacugacuucuuuaaguuucugacuuguauaauggaguuauaagacagauaaacccucuuccccacuaaguugcuuuuugccaguuuuuuauuuuguuuuguuuuuguagacgugguuucucuguauagccgugauugucuuggaucucccucuguaguccaggcuggccuugaacucacagagaucugcugccucugccucuccagugcugagauuaaagugugugccaauacugcccagcguuugucagaaauuuuuaaaucauagaaagaggaagaaaaauaggacaccaauugagacuauuuuaaaaagauuuacuuauuuuuauuuucuguguauguguguuuuaccugcauguauguaugugcauuccuggugcccagcgaguccagaaaaagucaucagauucccuggaccuggaauuacagaugguuguguguugccaugcagguguuaggacuugaaccuggauccucaaagagcagcaagggcucuuaaccacugagccaucucuccagcucccaucaggacucuaaaugagauccgcggagccuuuaagccuuuaaauguaucucauaggacccuuuucucuuucuacuaagagguuacuguaaaacuucuuagaaacguuuaguccauucuuccuacuaagucaugcuaacucaugcugauuucuccuuucuuguucugauggaccucauggccauagucauuacugucugucuguccauacugagaacccagaaugggcaacauggggauuuaugaucaccacugagccacaggagugaccacgaugcuauuccauggaaugaugguuucgugggcuccagccuuauaccucacaaacgcugcucucuggaauuagagaagaggagggacuuccccugacuuccccaccagcagcauccagccucugguucuguuauugucuauguuugcuuacagauguuaaguuuugagccuuaucuuuuucccucuacccuuccuaaauaucugaagcgaucauuuauggaacugucacauuuguuuacucccaacaacaaaugguggugacagucacagaagcccagacuucaacucaaaguguaucugugacagauggcuuuuuuuuuuuuuuuuuuggucccuuucccaaguuauuucacuguguuuauuagaaacaucagcugucugaggccuacaguaacauucugguguuguuuaaaugguugcccucagauacacggaacacagcagacccaucaaugggggauugcuggcuggaucuuaugcaaucacaaaaccucggguuuacucaggugccuuuugguucagucaugacucaucuuuguacacacuggaaguuccaaguacuugcagccaauagaaucuaccugaggaugcauuucaucuugaccuucacucaugaagucaauuauaaacaggauuauuguuguuucuagaaggucacuccucuugagauuuugaacuucauuccaaacgaauuugcucuagcuagaucauuaaguuuaaugggcagguuugcaagucuaauaaaacaaacuugggugguggaaaucuaaaccagagagggauuuuuuugagucuuuggucaaaugauccuagaagagauguaaucgaaggauuguuucugauuggcuguuuuuaaaauuuuauuuauuuauuuauuuuuauuuuuuaaagauuuauuuaucuauuauuuguaaguacauuguaguugucuucagacacaccagaagagggcgucaaaucucauuacggaugguugugagccaccaugugguugcugggauuugaacucaggaccuuuggaagagcagucagugcucuuaaccgcugagccaucucaccagcccccuaaauuuuauuuuuauuuuggagauuauaaaauaauuacaucauuucccccuuucuuuucucccuccaaagccuccauguuuauacuccccccuuacucucuuucaaauuuauggccucuuuuucuuaaauuguuguuguuguuguuguuguuguugguggugguggugguggugguggugguguguguguguguguguguguguguauuuuuauaaugaucaacuuuugaguauauauaugaaauacaugcacacacauacucacauauaucuguggcaauuuuuaagcaugauuucucagcuucuuuuagacuuguuuacaucggugaucugaguuauagagccuuaucuuaauccaaauggccacacucaugccaugggcuuuaguuugcugugguuggcuuggccccuugaaggucuuagguagaugcgaguccauuuggcucaaggacaccuguguggaaaugccucucaguugagaaccugcaaagcuuugacagguuugcuuuuguuuuuuccaaacaguauucagcuacaacacagguucccagcagacuugugccaacaauagacaccagugcuccgugcaugcagagugcagagacuaugcuacuggcuucugcugcagguguguggccaacuacacaggcaauggcagacagugcguggcagaagguaagguacuguuccugcacguuuucagcuucacagagaaggacaagaguggcuuugggucuuggagcuuguuuauagauguguccuuugcccuggucucuggaaugugcaguuuuuaaugaugucaucucuguuacauucccuguggacauuccucccaggauauacucuuuuuuuuccucccccauuuuccuucacucauagcuuugucucuggaguccacucuguucguuguuugcuuuugagacaccaucuugcuauguagccugugcugaccucagacuugagauucuccaucugaagagugaaugaggggcugcacuuaugcaccccacacuuggcuugagucucuagcucugagugcauugcuuguagaucucucucucuccuuucucuccuuccuucccuuuuccuucuucccccuccccccagcucugucccucucuaucuggcuuagaccagggucuguaguaggcucagguuuuccauugccucuaccuucuccucauguccccgaaacuacaucaugcuugaggugaagaugacaggguguugcccucagugcuagcuugucggacucagcgugcauccagccccaaagcggguucugugauagcugagguuagcuuugaccucuguccccaaaggccuggcuagucacuaugcccacacagucagaggacucuuuuguguaagucuaagggucuuugucacagacauuggagaccuuuggggcuauaaauuagaaugaauuaaagugacagaaccuuguauuuggccauugucucuucagaugccaccaaguugcaucauuugacacaagcuaccuucacgugggggcuucaguugcuuuguaaaaucugacuaacuaaaaccuaguuggagaaguagguuccguuuccagacuccuuacccuugcuauccugaaaucaguuauuuuaauuugccacacacacacacaaaauuguuuccuucugggucauaauuaaggagaguaagauuuguuuuauuuucaucccuccucagcaaugaaccaacaggcaguuuagaugucauauuaauuuaggagcauguuuuuaacauuaaacugguuuuuauuuccuuccaaauuuugucaccccagggguggggugcuuuuaaguauuugugcuaggcuuggccuuuauacccuuugcccuaggaaaagcuuccaaauuccacauggaaguguauucccucccucccucccucccucccucccucccucccucccucccucccucccccccuuccuccuccccucccuccuccguucaucccuggguacuggguauugagucuagcacccugugcuucccaggcaagcacucuaccaccggggccauuuccucgaccucaaagcauauucuuuuuuuuuuuuuaauauuuuuuauuauuacguauuuuccucaauuacauuuagaauucuaucccaaaagucccccauacccucccuacccacccauucccauuuuuggcccuggcauuccccuguacuggggcguauaagguuugcaaguccaaugggccucucuuuccagugauggccaacuaggccaucuuuugauacauaugcagcuagagucaagagcuccgggguacugguuaguucauaauguuguaccuacaggguugcagaucucuuuagcuccuuggauacuuucucuagcuccuccauugggggcgcugugcucgggccacuuagcucuccucucucccauaucagagcuaaaaaugcuaagcaaacuggcauugagcucaggugugacaaacugcucagcuacacaucuugacauuuuguacacacccuguaauugcuuugggguugaaauauuuguuggauuuugcuacuuaauuuuuuuuuuuaauguaggcaugcauuuuuauacagguaccucaugccuauaauccuaacacuggggagacuggggcaggggauggcuguacguuugaauuccaggccagcuagggcuacugaaugagagagacccugacuccaauaaccaggggggagaaaggccagcguagagucuggcagaagcgcuuuauuugccuuucuuaacuuggcuuccuuuguuguuucuguaauguucuuggaaugcauuuccccccccccccccgcccccauuaaccugcaaggggucauaggauccccaguguaaugacacaguggaagugcagaguuacuucaugucagauauguccugauuggucagugaucucauuuagcagcuuuccucagagaauagauaacguccaggaauaugaacaugugucugggaggaggggauggaggccauacuucugaucagucacaaccuagaaaaauaaauaugauauaucaugugaggcuaaugggguggaguuugguggcaaacucaaucuccugugccagaagagaaaggaaaaaccugcaaagaauguaauucugugucagacuucagcaaggcaaggugaccuuaauuugaccuuuuacuuacuucuuccuucaguuuuuuuuucuuauuuuguaguauaauucucaugccugugugugugcuugugugugucugugugugcauguguaugugugccuguguguguaugccucugugugugugccuguguguguguggcugugugugcauggcuguguguaugccucuguguguguguaguguuuguaugugcacacauguggaugccagugguccacauuagguguuuuccucucuugcucuccacuuacucuuuugagaugggucucucacugaaccucaagcuuaccagcuggugaagcugaucagccagccccaaggguccucucgucuuuccucuccauccuagugcugaacuuacaaggguacauugccacaccaggcucuuuauaugcugggguccuuaugcuuauguagugcugggacucuuaaugucugugaugcacauuugugggugugguuuuuauucugucuguuaucagucaugugggagagacgagagguguuaggaucccgaggccccuggugcacagugguggguaccuagcauucugcccauuaguagccacaugcaacagaggcaggggcauugggauauccaggcuuauggcacacaaucacaaguauuucccacagcaaugccaccucuuugcuuuccuaaugaacagacacauuccccucuuuggaagguaggggaaagcuaucuucaccuuguuccuuuguuucuggcccaggcucuccacaacgggucaauggcaaggugaagggaaggaucuucguggggagcagccagguccccgugguguuugagaacacugaccugcacuccuauguggugaugaaccacgggcgcucuuacacagccaucagcaccaucccugaaaccgucggcuacucucugcucccccuggcacccauuggaggcaucaucggauggauguuugcaguggagcaggauggguucaagaauggguuuagcaucacugguaauugacauucccaauuagaauaaaugggcuacauagucaugggagagaucugagaaugaauggguuuggagcucugucugcagacaccuggaagcauuucauuuguggacaggggcccucuaguucuuccucagaaauaaggaccaggagaaauucauguauagcauauucauuaaaggagaccauauagaauuauauuuugguggaggaaugguuucuugauggggauuuagaagcccccauguuuggugcugaggaggaaacauagcugcugaagugcuugucuugcaagcauaaggaccuguauccauuuccuggaagccacggagagagccagguaugauggcauguacugaugauaccagccuuaggaaagcagagacaggaaaaaucuccaaggcugaccucuggcugccacacauacccauacacauagguauagccccacacccacaaccaugcacacgucccuucaccccuauguccaaaaugcagucaugcacacaaaccugagcauacagauacacccucacacauacaaacuugcagagaccugcacacaaacauagaaaggccuccaagguugaacaagaguuaccaacuccugcaucucauccaucugaaaggggccuaaccucuucauaucuccagggaaaagagccugccacuucuagcugguaaaucuaacuugaucaacaccauccucuugaguaccaggaaccuuuggaggcucuccgaggccaugcccuguaagggaaggcugagucuuuugugaaugugugggcggaucacugaggggaucucaacuugagguuacagugucuucuuccuguucuuccaaggucaacuccaaguagaugcuggguggagcccaggguggaggagucuuugccuuaggguuucuauugcuauggugaaauaccaugaccaaaagcaagcuaagugaccaaagcagcuugggggaggaaaggguuaauuuagcuuacauuuccacagcaccauggaagucaggacugaaacucaaacagggcaggaacccagaggcagaagcugauauggaguccauuggagagguccugcucacuggcuugcucuccguggguugcucagccuaccuuuuuauagaacucaggaccacuugcccagggguggcaccauccacaaugggcugucuccucccacauuaaucauuaguuaagaaaauaccauacaggcuugucuauagcccgauuuuauggaggcauuuucucaacuaaggcuccuuccucuccagugacuagcuuuugucaagcuggauaaaacucaucagcauucccaggaccuucacccauuguccugggcugggcacacuagcccugccuccuccuccuccucacuagauuugccuucucccucugcucuuccuucccgaaagcacucccaucaugucacaaguauccacgugucccuucccacaucccuuuagcucuuuucuucccuccucaugcucuccuuucuacuuccauguguucuauaaauacguauuuaaauacauaaugaugaacaugugaauuuaaaucuagauuauggagagauaccacacaacauuuguagcucuaagucuagcucaguuaacaagccaggucacaaugaguuguucgcuugccucucccuucaagaaccuagggccagcaggaggguguacuugcccgaugggagggugacaggccuguuuuacuuuccagggggcgaguuuacccggcaagcugaggugaccuuccuggggcacccaggcaagcugguccugaagcagcaguucagcgguauugaugaacauggacaccugaccaucagcacggagcuggagggccgcgugccgcagauccccuauggagccucggugcacauugagcccuacaccgaacuguaccacuacuccagcucagguaagucccagaccuggagucccagggcaggcggcugccaggcugccugugcccacccacugugaugaccuugaguuccuggggcagucuccugggaucuguaaagggaaacacagaaggcuauucuuuauuuuaaucccuuucucccuaagcacugcagaagacacgcuugaagagaauugaauauaaaaaaagaaaacaagguguauugggacacaucagccauuccugcccuugggaagcugaccuaggccagccugagcuacauagcaaaaaccaaaacacccagaaacuggaguaggaacuaucucaguuggcgagggcuugcuuacauacauugaauguuugaagcccugaguuccgucccuggcacuacauaagcaggucgggugucauaugcccguaguuccagcacuugggaaggggagccaggaagauuagaaauucaugaucauccucagguacacagugaguuuaaggcuagccugggcuacaugagaccaugucuuaaaaaaggaaacaaaaugacauaaaagaacuccacaaaauaagccugaauacaaagauuuaaauauauuuuugcaauuuuccccuagagucuaccaucuauauuaauauuauaugucgccacuauuauauaauucaagauuuuauuauaauguauuuauuuguagucuuuacacuuauuuuccuucuggcgucuguuuggagcugaaaagagugcaagagcuucuaucugcuacuuacucagcuuggcuaguuccuagcacucgcuaccugaauuauagcgcgcgcgcgcgcgcacacacacacacacacacacacacacacacacacacagacagacacacagacacacacacacacacacacacauguacauacguacacacguacacuuaugcacauacacacuuccuucucccuaacuguccucauaggucauugcuuaagugcuucaagcaccucuguccuaagaaaaagaacauuuucuuacacagucccaucaaaauuauuuagaaagucaggauuaucuuuaaaacucuguagcccaaacuugucuccaacugaaagucaaccuccugccucugucucccacaugcugggauuagguuugagccagcacaucuggcuucugguauuuagcauaggaaccucaguauguaaucuuuggccugucauuuccgcuuaagucaauuguacuucauuaucacauccgaucaugaauguuuacugguuacguuaaguggcuuugaaggacucugucccuguccucucgguggucuuccuauucucagaaguauaaauuacacuaguuccccacccacauccccacugaguugaaaugaccuuuugcauggugaauguuggccacauuuccaucuguuguuuguuuguuuguuuguuuaugcugcuagggccugaacugacuccccaggcaaacacugcaaugcugagcuacaucccaagaucuuagucaaauuucugucucuugcaguauuggggauggagcccugggccuugcauacauacuagacaaaugccccaccaccgagcuacacccucagccccucuuuuuuuuuuuuaaauaaaguuuuaguuuuuuauuuuuuaauuaguauuggaugaaaaggagaagaaggauaggaagggacaugacugccccuaggugugguggaagagaaguuuauuuuauagagggaaagcacagucugaggcagagaugucugacagaauccagaguggauucagugccacgugaggagagggaggggggaggggagaugggggagaggaaaaccaggcgcagcaaccaggaggcccacagcuacaaagagaggagguaacauaaaugguuggauuauacagggaagagcagcuggggaaggacagcccagccccugggcugaagaguucagaaaaggggggggggggguaugccagcuuggaggacccaguaacaggacuguagaaacuaagggauguagggagaaccuggcuagugucugcuuugauaugcuaaauagguaccugagccauuugccccggauugaauuuuuuuuaacuuuuuuuuuuuuuuauaauuagguauuuucuucauuuacauguccaguguuaucccaaaagucccccauacccucccccgcccacuccccuacccacccacuuccacuacuugguccugguguuccccuguacugaggcagauaaaguuugcacgaccaaugggccucucuuuccaccgacggccaacuaggccaucuucugauacauaagcagcuagagucaagagcucccggguacugguuaguucauaauguuguuccaccuauaggguugcagaucccuuuagcuccuuggauacuuucucuagcuccuccauuggggguccugugauccauccaauagcugacugugagcauccacuucuguguuugcuaggcuccggcauagccucacaagagacagcucuaucuggguccuuucagcaucaucuugcuggugugugcaauggugucagcguuuggaacguaacacgugugucacuaaguugccuagacugaacuugaacucauccuuguagcuccagcaggccuugaacuugcaguccuccugccucagcuucccaaguagcugggaugcaggccugcaucaucaagccugacuuucugacccuuuccugaggcucaaucccuagaaacagaugcugagucaaacagaaugauguuuaauaaugccagccacuguuaaagcauccuccaggcacguggugccauggccagggcucugcaacucccuucucagggcugggagccugagaaaggagggagagacagcgcugagguccccagacggccuccagccagauggccugcuggcagucagcacauggagcuggaugggagacagcggacacuggccuuuuauuuauccucugucuuucauggcucucauauggagcaggcugcaguagaacucagagauaaaaagggccuuuauacuuaacagagcgggguggggaguggagggcuuuguugccugggcuaauacugguccuuuucugggcaaagaaacuuucuccccucuccuuggcuaagauuugcucuugauaauauuucuaauauuggcugcuacagaacguuccauauuguaucuuuuaauaucacacagagcuauguaaucuaaggugguugggagcaaccacuauuuauugauuccugagugagaaauucuauggaagcuaauccaaaugccgcugauuguauagauuccauguaauuuacaaaugugcccucaucagauucucaccacaguuccuucugcaagagaaacagaggcaaaagcagcuuaguaccagguuggugguuccaagcucagcuggugcguggugggaggaaggaggccagugugccuccuucugagccgcugcucuuucuguuggaccucacuugucucuagaugaugggaaucagcaaguacuaacuaacgccaucccugaugcugcuacaggagaggagaaagcaguccaggcacaaacaaaugguccuguuuaaguugcuccagcaggccugucaucugauuucauuguaggcaggaaccgcucacuacuaauguccucaaggccuuugaugaaguuccucacaucugucugucugucugucugucucccacaccucagugaucacuuccuccuccacccgggaguacacggugauggagccugaucaggacggcgcugcacccucacacacccauauuuaccaguggcgucagaccaucaccuuccaggagugugcccacgaugacgccaggccagcccugcccagcacccagcagcucucuguggacagcguguuuguccuguacaacaaggaggagaggaucuugcgcuaugcccucagcaacuccaucgggccugugagggguaaggaggagggagcucaugcaggcuggacauggcugugcguuugcgcaugcucugcgcccucugcacucauaccugucaaucucugccucuuggauuugggguuuuagucucuuacucucugucuauagaagaaaaggauggucagacgucccgugaaagaaaaaaaugcauggucaucaguggcucuuggcaaacagaccugcuuuuguucauucaaccaaaggccuauucaugggggugucugggcuauuuauucaugagcuaucacagcagaaugcuauccugaugaguucccucacagagccaaccagccaaaggcucuacuacugcuggcucuagugaacauuuuuuuuuuaaauucuauuuaaaauuuaaaacuaaaaacauuauuuuuuuaaaggaccacauugauaauuguucauagugugggauaugagcuaacuaauuucaacaggcgugucuagugagcagugaucacaugagagaaacgggcauguccuucccgaaacgugucauuucucgguguggagaacauuuaaaaucuucucuguuagcuguuuugauguguaauuaauuguuuucaucuuuaguaaccccaccgugccacaaaacaugagaccuagccauccagcagcacccuuggccuguuaaccauccuuuggccuucucccuaccccuccacccuucccuaccucagguagccauuauucaugcuccuucugucaaaucaacauuuuuagcacccacauguaagacccggcaacauucgucuuucugugucugacuuauuuucaugcaacacgaugauuuucaggcucuuccauguagucagaaucaaagguugucauuucuuuucaugggcuaaauaguauucuacaguguauagacauauuaguugcuuuucuguuucugugauaaaauaccaggaucaacuuaugaaagagaaagauaauauuaccuuaggguucuagagagaagccaucuguaauugugggggagggguggcagcaagcagcuggaacaggaagcggagaggaugucuuuagccacaaacaugaagcagaaaggguuaccuggaaguugggccaggauguaaagucaagguuuucacugguaacuuucuuccuccagcaagccaccucccaaagacuccacaaccuccuuaaaccacguuaccaacuggugaccaauuauucaaauacaugggccuacggggaacauuucccuucuaauauauauaugaaggguauagcuugguggucccauuguaguacaacacagagggcccugguccccauuacucuguucuuuuacaguaguggcuuacucccuguggcagcagggcuucuggaagguucuugaacacugugucucccuucacagauggcuccccugaugcccuucagaauccaugcuacauuggcacccaugggugugacagcaaugcugccugucgcccuggcccuggaacacaguucaccugcgaaugcuccaucggcuuccgaggagacgggcagacuugcuaugguacugcuuuggggucugcugugugaggugcuggcauaucaggcugggaggaagccuccagguucuguaaaccagaaagcuggguguauguaacaagaaugaaugugcugagugugugacauggaaacauaccaugacaggcauaccugaauuguuuaugcuuuauguauaaccacuugcuaucuccucgguaaugucaggggguucugucccuuucaucaucagcccuaaccuauuucucagcaauagagcaaaguuucugguuugguuuuauuuuuacuuuaagauagggucuccuugagaaucccagguuggccucaaacugaaggucucccagccucugccuaccagguggugggauuagagguauacauagccuggcuguuuucaacuguuucuaaaugugcaguucagugcuauucaacacacucacacuguugugaaguugugacagucacccuuugcuuggaucccucuuaucuuguacagucaacuguguucauuagagcacagcgcccaguacacgguggugcaucccagggagugcuccuguuaagagacacagaugcucuccgcucccugugacuuuguauacucggccacugucccuggaaauccugggccagcuuuguccaugcaugugcuugcuuuugucuguggucagucauuguccuagaauauuagccuaguggaauguggagcuguccugagucaggcucccugcuguucugaguugccagaugagccucaguguuaaugcaucuggacgugaggauuuugacgggaaaucacauuaagcaucuggauuugcguguuguuuuaacccagggagauuccugagagaggaacuagggugaaccucugugguucaagucuguggggggagauagaugacccgugacaugcaaagcgaggcugguuuuagcuaacugucucucagugagcuucccauguaauugggaagagacuguuuugggguugggguggaucucagagcuuagugauuugccugggguucacaucacaaugucacucacauacccuucaaauuguaauccagaguagcagcaucagcuaauauuucagggaauauuuuugaguuucuagaaagcauuccacaugucaauaaucuccacaaaggguaaggcauuuauaaaagaaauaacuuguagaaaauguaccaagacuagucacugugggggaaaaaaaaaucaaaggauuaaccuagaacuggugagauggcugcuguccgagucucauagcccaaguucacaucccagcacccauguccaaagcuggaugugggagcauacaccuguacucccaacacuccuacagcaagaugggaggcagagagaaccacuggguagcucaagggcaagcuaagccagaguacacggcacagcaaaaacaacagagagacccugucucagcugacucccuaaaguuguccugugacuuccacaugcaugcagaggccugugugcacgcgcacgcgcacacgcacacacuacauaccacacaacaaugacaacaacaacaauuaaaaaguaauuccaaacagugugugggacaaaucugugaucccagcaccaaggauugugaguuugagggcagccugggguacaugaagauaccugguuuaaaaaaaauuuuuuuuaauaauaaaaauaaauaauucaugauuuuccuauuuauauaaaagggguuccccucuuuucagaaaggauguugaccagauguugaaaaauccuuuucaaacagauguuaugggguacuaugaacagaugguugccauaguuaccaggcuacaauguccaucaacaaaggguuaaggucauggacucaguuaaaucagaaaggauuuaaaucacacaugaggaacaauuuacaaacuguaaagaccaugagaucuuaguggggacacugggagggucuugucccuagagaaacaguguuguccagccuggcuuauccuuacagaccugauugugugggagcaguccuccuggaccccacucugccaagguccugcugaccugcuguggccucugcuacucuugcauaacaugucuuccaugucuguagauguucccagcaagaaaggggcuuggacaaguucccuucgugacuuggcccuggcuuucagauggaaagcugauguucucuucugccgcucuguuuggucugggucuucagaccgcagcccagcacagggguccagccaccugcugugagagcucugggagcaauacagagcacaggcgauaggugugacagauugugcucuaugcgugggagcaggggcuggcggaggggggcagaacccccaucuucaacccuggcuccagcccaugcuguucucuacccauccaaaguccacugucuaagauccuaaaucuugaacuguacacacacacacacacacacacacacacacacacuaaauaaguaacuaaaaauucucaauuggccauaaguuguccagcuuuucuuuauaaucauaacugcagaaagguaguuuauuuuaaagauuugcuuacuuuuacucugggaaccaaaccuggauccuugcaagagcagacuucugcuucuuccaauguguuuuugucauaccuugguaacucauucagcaggaaacacacacacaucacuuagaaaaagcaaacugaggguuggauccuaaguuauguaaagggcaaaaaccaauaucuauucuauauuacuuuagguauguagaaaagugugucuucaaauggaucucuucucugaggagaauguuuucuauuugucuauguuccaugagguuuaaaaacucugccuuuuuaucgacaacuuacugcagauauugaugaguguucagagcagccuucccgcugugggaaccaugcggucugcaacaaccucccaggaaccuuccgcugcgaguguguagagggcuaccacuucucagacaggggaacauguguggguaagugcugcaagaaaaucuccuggggaagcuagcucuaugggaaaggccccguuacagguuuugauccugguggggaagcagauaccaguuccugcggacagagaggggcugguuacaaggggcaugagaagaccuccuuagacagucguggcugccaggaucaaagaguguccuuauaaaauauacacuaccacaugcuggcgauacaucaucccaccugcugucagcuuucuguggugcuugcuucuuauacauuugcucggcccauuuucagcauacauuuaauggcaauugaagcuguuaggcuucauucucugugucauuagcagccauggaauucauggccgagcaccuuuauguucuuagcugucuuagauugaauucuaccugaguuacaucagaagggauaucccacuugguagcauuccguuuauagucuuaauuuaauaaaccacaagccaaaacauagcuuuuaaggcuuccuaggcuacauugauuuuauuaauucauuaggccaauuauguucuugauugauguugauaaggaagauacugggccagucaagaagaacaaaguuuuugaaaugcccccccccuccacuuaacauuggcguauuauuuccaugacauuuuuuuaauguuuuuuguuuuguuuuguuuuguuuuuugagacaggguuucucuguguagcccaggcuguccuggaacucacuuuguagaccaggcuggccucgaacucagaaauccgccugccucugcuucccaagugcugggauuaaaggcgugcgccaccaccgccuggcucauuuuuuuuuuuuuugaaacagggucucaugauaugaucauaggucagccucaaacucacuguguagucaagagugaccuugaaguuaucuccccacucuacccucuaggacaccggaaugacgggcauguaucaccaugcccaguuuauucaguacuggggauggaaccuauagccucauacacucucagcaagcacucccccuacccuuuaugcccaguccaaguuccaagaacugaagcucaaagauucuuggagauucccagaucuacaggcuaacaugaugaacagggcaugcaugucugcaugagucaaaacagaaaccaacugugccagucauuguccugucccugugugcucccugacuguuuacuguguaguacacauggguucucuuugcucugucacagagcuuggaugaggagcuaaggucuggaugagguggugucuguagggcgggagggaacaggcaguucucaugauuugagugggaaccaaacaucugugcacccaggaggccagcccugcauugcacagagcugagauuuuagcuugcuguguugaaacuauuuuuuuuuuucugucuuagcagagaacaucaguuuucuuggccugacuuuucuuucccugugagguuugcucugagggagguucuaaaguuugcuuuuaaggcaacaacacucauuggcucaauaugggugguggaagaguuagaccucacugagaucuaaccugugaucuauaugaaggaggcagguuggccugagccugcccauuuccuaaggccacacucacuggagagcagggguggggugggggugagccacuggggcugugucaaugucuucucccagacaucaguucucagcaagaaaaacaaccucccaggccuuagcacuccaucuucaaaacgaggcgauuggacaugaucauuuuuuaaagcauguggagcccuuggaggugccucaaggagcugccuaggagagcacagaugagucacaagccaauccuuguccucgucccuguccagccuuccguuugucuauagaucaaauucugcauaaucuguuugaauaaaggauuccacugcucaaaaacaaaccaggccugcaacccucugucauuucagcuacuugggaggcuaaggugggguuggugaucacaguucaagguuuccuuggccuacagaguaaauucauccugggcuagagaugcagcucauugguagaacacuucaagagcaugaaaccagguucaaugguaggagaggugacugcauggaaugguauggucuggacccaggcagaauccagacauuguccccuucucaaaguaccacugagccaaaucacugauguguagagagcuuggaaggauagcugccugcucugagacuuucuucuaaaggcacacauucauuucuuuguucuuaagcugccgaggaccaacgucccaucaacuacugugaaacuggucuccacaacugugauaucccccagcgagcccagugcaucuauaugggugguuccuccuacaccugcuccugucugccuggcuucucuggggauggcagagccugccgagguaugugguaguuccagauuuccuuguauacccugaaacgggggucuggguaguacuuacugcaugcuaauugucaacacacccuguauauaaggaacaugugcuccuuuugugccauuggacaagaggguggccuuuucuaucuugccagcaacuggaacuaugcauuuucuuggaugguuguccucaugugggaccuguuuagcucucccugacuccaaggcagcaguuagauagcugcucuuuccugggaacggaggcugucuuguuuuuaaaaacacaaacaguccuugcuugugaagagcuuaacauccaucuuuguauguaaaggguuugcucuuaccuguguaagaagcgaaauucccaguuugaagacagagcagaaaugacaucauagaaguuuuccaggcuugagaucagccuauaguuagcugccaggggacuuguaauaguaauuaacagcauaacuuagggcucuugguuugcaaaauuauacaacauuuauacugaacccauugcauuuaguucagcaaagacuucagagauucugucucucuauuguugacuguauaacuuuucucuguaaacacucaagaguucuaggcacuccuuauuacaauaaagaaagaacaucugacagugcaaauuuucccuuuucuaaguucgauguuuccugaaaacauuauugucacgugaaacacauuuguaaauguacuagauagaaguuaggguaugagugucucaaaaauuaacauuuagugaguuuaaagucccuggucucuaauuagaagcagauuuacauagauuugaguguguggauuaaauuauuguaucaagcacaaauucuggaagcaaucacauggucucugggccuguggcuguuuugcagacguggaugaaugccagcacagccgaugucaccccgaugccuucugcuacaacacaccaggcucuuucacaugucagugcaagccuggcuaucagggggauggcuuccgaugcaugcccggagguaagauggggguguuaagaguugauggccuauugauguguucauaagcuuugaugaccuggggaggaggggcucugaggaagugguccauggaaaguuuucagaguucuguacaauggagauuagaccacaggccuuagugcagaagugcauaguacacagcuuucggggauacuucaaaggacccaaagccaugcuggaauuuuagauuguauugguuccuagguaccggagucagcagcacaggaucaaaacgggcacugagcuuuauuuaccagaggacuguagagaaacagagccaagagaauauauguguauauauguguacacacacacacccauccacacacacacacacacacacacacuuauaagaaauugaaucuuggggcuggagagauggcucagcaauuaagaguaccgacugcucuuccagagguccugaguucaauucccagcaaccacaugguggcucacaaccaucuguaaugguuaaccucuucugguguaucuaaagagagcaaugguguacucacauacauaaaauaaauaaaucuuuaaaaaaaagaaauugaaucuuaucauuuugaagacugucaaacccuagcaucuguuuucaggaagcagggaacccaagaaagccaauaccauuuaguucaggugugaaggccauagaaccaagaaagcguauguucgaauuccaguccagaagcuaguagccuugugaccuagaaaaggcuuauguuugguuugaucaaaaacauaggaaacaaaugauuucugguuuggaggcuaucagacagaaacaaucuuucucuuucucuuucucuuucucuuucucuuucucuuucucuuucucuuucucugucucugucucugucucugucucugucucugucucugucucccugucucccugucucucuguuugucugucucucuauccccuccccccucauaggucuuacuauguagcccuaguuguccuggagcuccauauguaaacuagacuggccuugaacucacagagauccuccuaacucucagaaugcugggaucaaagucgugugcuaccaugucugggcaagaguucucuuuauucagaagaggagcaaguuugucuguguucuguuuaugucuuuacaugacuggaugaggccagaaagaacaauguacauagaaugucaaccuuaauaaugccauccagaaacaggaugaugugaccaaaugucuggucuagccacauggacauaagaucaacagaagccugggaguguuggggaauggaauguaugauggggagaugggaugaagggcccaagauggggggagguuuaacuaaaguauggaauguuuuacaucaccuguuacugaccugaauaugcagccuugggaauugcugcuuaccugagacuugaguggccccuccuuggcauguaggcaucccagaagccucaagccagguuagguuugagacuaggaacuggucagacucucaggaaacacuguugaacaaaugcucauagauggcugccagcuauacagaaccuacuaggcauacccagugucuguguuugucaguuuucagcugagggaacaaaauacccaagacaucaacuugaagaagggaaguuuuguuuugggucacggugucagaucauugucgagguuguugcuuugggcuggggugaggcagaaccucaugguggggagcacggagcaaagcugaggaccucacuggcagcuaagaagcaagaagagagugggaguguggugagguggcucagcaggcagagugcuugcugccucgagucuggcaaccugagcuugauccccugaagacauggugggaggaaagacucucacaaguuguucuuugugcucucucacaugggcuugcaugugugcaugaacacacacacacacacacacacacacacacacacugcuuuaaaaaaaaucacugcuaaaggagaagagggccaccuucuguuucugaaauuacagguuguggcuauagcucugcccacagauuuugaugggagggacacauaaagaagcaguccuggccacuagagcugagugagguguuccagcugcuguuaaaacagccagcauucagcauuucugugggcugcuuucacaucuccaguucaaagagaaacagaugucuaaguuuuuguuucgauuuuuuagaaagucugacuccuugcccuaucuuuaaggcucuguuuacuaaacagaaacagaucuagacuuguagucugggauguggcgaugggacacagauaaugucaauaagggccaucugcuaagauggcuuauuuauuuaauguuguucucagaagaaagccaacauccaguuauauacccaagggggcaugcccuagaaauaaauguacaagaauguuuauguaucauuuauaauaaaaaaaaacaaucuaaauaucuaaugucuuagucaggguuucuauuccugcacaaacaucaugaccaagaagcaguuggggaggaaaggguuuauucagcuuacacuuccacauugcuguuuaucaucaaggaaguuaggacuggaacucaagcaggucaggaagcaggagcugaugcagaggccauggagggauguucuuuacuggcuugcuuccccuggcuuguucagcuugcucucuuauagaacccaagacuaccagcccagagcacuaauugagaaaaugccuuacagcuggaucuuguggaggcaucuccccaacugaagcuccuuucucuaugauaacuccagccugugucaaguugacaccucaaaccagccaguacaucuagcaacaagaagaauggaaagaugaauuuuaguuuaaauuguacuaugaaguaacaggcaacagccaaaacaaauggacuguagcaauagauaaaccucaaaagauaauguugaaauacauuacaaaagguuuuacacacacacacacacacacacacacauugaauaaguguguuuuguuuaucuguuugguuuuguuguagaaaggggauauagccuagugguagaguguuugccuagcauaugugaggucccagcuucaauccccaacacagaugaagaagaggggaaagaggaagaggacucauugcaggggagggaacuuuaggagguaaggcuggagaucauagguuauuggagggagcgcuggaacgccagcuccuucuuauucuugcuuuuuuuuuuuuaauuagguauuuuccucauuuacauuuucaaugcuauccaaaaagucccccauacccaccccccaauccccuacccacccacucccccuuuuuggcccuggcguuccccuguacuggggcauauaaaguuugcaaguccaauggaccucucaucuugcuuuuuggucaccaugacgugacucaucuuccucuaccaugaauuccccuccaugaagcuaugcaucaccacagacgcaaagacaaacaguaagccucuccuuuguuuccauaacaaccacuucuccaccccccugaacucccugagaaaugauucucaucuucccucccaccuacaugcucugaggccuuucaugguucucggcucauggcaguuuccagugaguguuuauaacacacuuaaagcagauaagcagucugaggaucccccagggcuuuggucugggaagaaguuaugucauuucccacaguggcagcagcagcacagagaacagaagccauugccuuuccugguguuuaaugccuuuuucuguucccucucauuaucugccuuuuccuuguugccuauucauugccucuuccugagcuucccucccauccagcauccuugggcucacauugggcagaaguuugacacauucacgaguagacaccuaagguuuuuauuguaauugguguucuucggaaauagcuagggacuucagguuuaggaccauguuggagacauuguauucuguccuuuuaaauucucauucugggaaccauagccaugcagggcagaugcgucuguucagcagcuagugaugucccaaagccaagaaagaaugggcaccauucauggcauccaccuuacucuauucacagaucugugucauggguugugauagagucuguguagucaaugggagcagcugggcccuaccaggagcucacacuguauaggaagcaagugaauggguggcaccccugcacauaauuucccuccgaguaguagacacaggcuucccauugcucugacagagagacuuggcucuucuucuucuucuucuucuucuucuucuucuucuucuucuucuucuucuucuucuucuucuucuucuucuucuucuucuccuccuccuccuccuccuccuccuccuccuccuccuccuccuucuucuucuucuuccuccucuuccucuuccucuuccucuuccucuuccucuuccucuuccucuucuucuucuucuucuucuucuucuucuuccucuuccucuuccucuuccucuucuucuucuucguaucuguguguuuugagacaggguuucucuguauagcccuggcuguccuggaacccacuuuauagaccaggauggccucgaacucagaaaucugccugccucugccucccaagugcugggauuaaaggcguacgccuccaccgcccgacugacuuggcacuucuuagcuaugcccucucuccuacuccagggcugcacuggccauucauucgacagcaucacaaaugugaccaagagaacaaauagcaugcaaauccaggaaccauaaauggacugccucuccuuuuuccucauuuccucucauucucuuucuugccaucucaagaaaagccaccccagacuuccuguuugcuuucagauguaucaagggaccauucguuccuucucacagcugagccagacagaagaaauaguuugucugauaaucauuuuaccaaccagaaauaaacucagaaaaagugaccucuugacucuauuguccccacccuaucuaccagacccuugaugcaaaauucccuaggguguuaauccucguacccuuggcuacuccugcuaccuguuugccagacuacggauucauuuguggaaaucugugagaacacaucauguuuuauaaacacucuguucuucaaguucuauuuccugacuuagaguugagguuuuucuuuccuuauacguucaagauaauccuaaaaguuuuacagucuauuccagacgauuugaacuuuugaaugucuaacaggauaucaacacaaaagccugucugcuacauaaaaugaaaucgcccucgcucucuuaaaugcccugcuuggaggcuggggccauagcucaguugguaaaauguaaaaagaagaggaguuuagucucuagaacuugcauuuagaaacuggacacauuugugcucaaaacuguagagcugaggaagcagagacaggcggauccuaggcagaaagccucaugccaaggagucugccacaaaaauaaccgaggaacaccgaagacugacaucuggccucuucauacauguacacaacuguauucacacacacaugcacaaucccaugcagacauacacucagaaguuucugcuuaguuggagacaccuagaacaucaacccacuguagcuggaaaagugguuaaggacagaaauacugaaaagaaauacugaggacuucuggggacuuucagaccacuucacuggguguguuaagaaaguaagaauaugauugugcuuuuucauugaugugauaauaugcucaagaaaaccaacuuaagaaaggguuuaucucggcucauagcuugaggggaugcaggccaucauaaugggaaggcacagcaauaggaguagaaagcagcuggccacucuuggucugcagucaagaagcagaggggugaccucacauacccagcucucuaggagccuaccucauggugccacuuacauucaggguaggcuuaaccuccucagcuaauucuuucuggaagcacccucccuggcaugggucuccuagugauuccaaauccagucacacugacaaugaagauucacagccaucgugguauuauugugcucacugugugggauccagccugacugaugggaagguggaugcagaaacucaaggccaaaaggaacagaggggcuggaucaggaauccacaggcuucaguuguaauuugcaacgagucacuuccagugcugugacucugaaggaauuccuuaaucucuuugaguuuuagguucuuccauugguguuaaaacuaaauuccuauccuaaugggcauuagauggaaacuggagcaaugacuagaguuaagaguacuuccugcucuuacagaggacgugaauucuguuuccagcacccaccugucaaucauggcucaugaccaccuguaacuccagauccaggggauagaauacccucuuuuuaccucagggggcacacauacuaugcucucacauagacauuacauauauacauauaaaugggcauuaggagacauauauguagacauggaaauagcugguauggaacuucuaaaacccugaacaaaucuaagguugagaaaguaaguaaguuuuauauccaauagaauacaaaaaucaacauuuugauucuaaucagauggcuagauggcucguucuuauuuuugcuuggaucuuccuacaucaaguauuuuacuuuuuuuuuuuuuaacacuauccucagagauaaaagaaaagugcacucagcccuuuucuuacuaggcucaacaaacacguuuuugccauauuagcaguuucugaucaagggggcaauuguguuaggccagccagcaugagaacuggccauucagaugagacaccaaguaccuuagcuguauuucccuugaagucauugugucugccuuguguaggccagagcacaaaugaacaucuucaggcuccauccacauguguugucuuguaguucccagcuauaaaagaauaccaaaggcuggugauaauaaagaccugaaaucgaguugccuugggauucuggaagcugagagguacacgguuaaauggugagggccuucuugccacaucaaaacauggagagaggcucagaugguugacuuaaggagcaaugcccuagagccaagauugguaacuauuauccccacaggccaacaugcccucacccccaacuagccagguuucucuguguagaccuagcuguccaggaacuaacucucuuuguagacuagacuaguccagaacucacagagaucugccuaccucugucucuaccgugcugaguuuaaaggcaagagcaccacaccgggcuuguaaauaaaguuuuauuguccauuaauuugcacaucaagcaugccuucucccacucugacaucauggaauuagguaguuguaccagucaguguugguacauaaagccagaaaguuggccaagcucuaagagcuguuuaaucacgaucccccagccacccuaacagaccugagugcacuccugugcucucuuguguucuccugcccacuggagagagacucuucugugugucuccuugcuccaugucucuggcugugguucccugauggcaggccugaagaucguugugugucuacccaaccuaggugcauuuccucaguaaaggcagagaagagccagucuccauccugugagagccccacguccgcccaggagccagagaacagcuccuucagucaugggacccuagagucucuggucuuagauaccuuggguaccaccuggaagguuugagagcucaccuaaaacacuaaacccagcauggggauggugguugagaaguccuuccugcaggaaauuagugccucaacacaguuucugaggauugaucaggcaauggaaaggggguucagcugggaaguuaaggggggcuucacacaaagaccaacucauggaaggaagaagcucuaacacuuggauaaauguagcucucagcaauaguagcauggagaauggaugccucucaaugucucucugagauuuaugcuucaggggugaccacucuaauggccccccaugguggcuugacuucagagaaugucaaacccagcuguagcucugcacguuuaggaguuguuuauucuaugucaaguuuuauuuugcuugagacagauuguucuugaacuucuaauccucuugcauuagcauucucccaagugcugagaucucagguuuacuccaucacccaacuuccuaagcuucuuguacagcgguauuucccagcuuuggaaucugagcuguagaguuuagacaccaggcuucauggcagacaugggccuuuacuagggggaaacaugcagaaacuggugagugucucaugaucuuuggucuccaaacucuuuggcuuggacucaauguagaucauauggagcuugagaggguaaaagaagagcuuaagauuaacuuaacauaccuuagaacagaguccagggccauccaucaguggaaacaugguugaaaacuauggggcuuuucuguaaggugcaguauuguccaguuguugaaagaaagggaggauugaggggccugagugcacuccugugcucuuuuguguucuccacaguggggaugggccugggugaucugcuaagagaaggaagucagaggccgggccacguguccuaugaucucacugguaugaaauauacagaauggggacauccacagaaaagauggagauugggagcuuuuaggguggggaggaagaagagaagaagacauggauggaagcaucuucucucgaggcaugagguuuccuuuuuaggaugaugaaaugguucagauaaaaccagccauagcuggucaucacugugaaugugccaaaugccacacaauugcucacuuaacauaguuccuuuuauuuuaagucuguuuugccuuauuuuuuuuuuaauuucaaaagaacuguguaggaaagaaaaucuacauguauaaaugauauuuugauuuuuuuucaaaggcaggauauuacuacauagacaaggcuggucuugaaaucagagaaauccauguguuucugccucuccauauuaggauuuaaggcaugugccaucaugcauggcaugguguagcuuuuaaaaaucauaagucuuuuuuuuuuuuuugagagaaggucaagcuagucaugaacucauggcugaagaugaccuugaacuucugagccaaggauucauuguaugguaugcaagcauucuuaucaacuaagcuacaucccugguucucauaaaugguguuuuaaguuucaaaagaaaaaugaauaaaaagccagugauggcagguuaccuuugugguccaaguuugacaaguagcauuugggaacaccauguuuggcacaaaugacacucugcuugucucugacagaggugagcaaaacccggugucaacuggaacgagagcacauccuuggagcagccggcggggcagaugcacagcggcccacccugcaggggauguuuguaccucagugugaugaauauggacacuauguacccacccagugucaccacagcacuggcuacugcugguguguggaccgagauggucgggagcuggaggguagccguaccccaccugggaugaggcccccguguaaguagacagcuguuacauagacaaguggaugugcugccuggucucuguucacaugcucccaacucucccucugccaccuuuugcccagguggucauguuucugcuuaugaggucugaggaugccccaucccauagcaaugggcaggugcccucccugauagcuuucuccauucaguguuaaagauaaugucacucccugaagacagagguauuggugcuauugcuccaaguguugcuuuggcucucaugccagcccaacauccagccagaacauaaauaaccaagucauuguguaagauggagcaaagcuccugcuuuaccccacuggaccuuuguacuaaacuuauguucugcccugucuucuuuguaaaugccccuugacuggcugaaggcauucugucucuggaaguuucagacagaaaauggauauugugugguuggcuaugcuguuugaauauaauaaaugugacaauggauaugggugauauguagaugggugcaugagcacauauacacauaucuucauaugcacauguauguguaccugugugcucacacaugggugcauggaugugucugcaugcuugagcauuagauugcaccugugcauuuaugauauucacaacccucauucauuaauaucucuugcccucuaggucugaguacaguggcuccuccuauucaccagggaccaguaguaccuacagcugucaucccccugccuccagggacacacuuacucuuugcucagacuggaaagauugaacgccugccccuggagagaaacaccaugaagaagacagaagccaaggccuuucuccauaucccugugaguaucagcugaauagcucuggugacagucccaguaauaggggccuggcuaccaagauaguuaauggcuauauauaauauaauaguauaauagaauaccaagauaauuaauguaauauaauacaauauaauuuaauauuagugugguuaauaucuauguauaauauaauauaaaauauaauguagcauaauaccaagauaguauaauaaaagacaauauaauaucaagauaguuaauaacuaaguauacuagaguauauaauguaugauaucaauauaguaugacacaacaacuauaauaccaacauaguuaauagcuauguauaauauaauauuauaccaagcuaguaguuauauuuguaaucuaauauaauacaguauccauuuguaaauauaaugucauucuuucuugauuauaguagaucucaaagucagggagauuugaguuccuuucuuagacuguuuggacuauuuuagauauuuauuuuauuuuauauuuucuaggcagucucauucuauagaucaggcaagucuugaacauguuauugcagucaaagccagcuuugaaaucuuggcuucuaccuucuggguucugagauuacagacaugagcagccacacugcugcuguuguuguuguucacauguucauguaauauuuaaaauaaacuucuuguuccauuagaaaaacagcaacaauaacaacaacaaaaacccagccagccacgaguuguaguucacaccuuuaaucucugcacucaggaggcaaaucucugugaguucaggccagcuuggucuccauagcgaguuccaggccaggcaauguuacguguaaaauccaacaacaauuaaaaaaaaaaaaaagcagacccaaacaaguugguaacuuuaacaaaggagacacugggucacugaaaccaucacuaagaggaacugaugucuuagcaguauuaaacuguagaauccauucaugugaucuugcucuuucuaauuacccaggucaucuuuaauuucaccuguuaaugcuuugcaguacucaccgucgguucuugugcauuugugggcuggaaagaaaggucaaaggugaaaggcacuugcugcuuuuuagggacaauucacuugguucccaacacccaaguacugucaguucaugggcuccggugacuccagcuccaggggacccaacacucucuucuguccuccaagggcacaaauacagacacauaagcauacacauauagacagaaguaaaaaagaugaaaaaaugaaaaucaagcuggagagaaauauguaugcacacauacauacaugugugcaagugcaaacacauguuuuuagacaagaguuuuuuuuucugaacuauauaguuucuacaauucaauaauuaaaaaugugaauggacaaaacauuuauuucauuuaaaauacuaucugagauguauacgcaagcacugggaaagaucaagguaacacuaguuagugauuuuuuugaacuauauaguuuuuauaauucaauaauuaaggauaugaauaaaaacauauuuauuugaaauacuaucugaggauguauaugcaagcacaugggaaagaucaagguaacacuagcuagugauuuuuuucugaacuagauaguuuuuauaauucaauaauuaaggauaugaauggacaaagcauauuuacuuuauuuaaaauacugccugaggauguaugucacaugggaagauucaaggccacacuagcuaguggguaagcugcucucaaucacugguauuacuuccaaggcaaaagucaucauuggacuggccuuugacugcguggacaaggugguuuacuggacagacaucagcgagccuuccauugggagagccagccuccacgguggagagccaaccaccaucauucgacaagguaggcaagcaaacguugcuccucuuggguguugcuucuagcagcccacgcugcucuugguaggaagugaggaguggagaguaagccgcuucgcucguucauauguucgcuaggaagcaggucuuuugccucuucacucuguccuuuucaucuccucugaaguuuuccauaggccaguugagucauuaaaccagggacuuucuggcugagguuaagucucaggauaauuaaacugaaacaaggcagaggccugugcccuuucucuggaagcuuacaugguccaccuuugugcaucauaaaaccaaacucaacauucuauuucuuccuuuagcuucuaaaccugcacuggcuucucacagagugcucuaccgugugcugcauggggguuuaaucaaaggcaguggauggaaggaauaguccagaaacccacuauauugacggauacucacccaaaaguugaagauuauuuauuuuauuuuugagaugggauuucaugggaaccaugcuacccucauuaaguagcuguggauggccuugagcucauaaucuuccugcuuucugccuccuccaugucaggauuauguucaugcaucaccacucaguuugcuuaguuaauugaauuaauaugucagucuaacauucucccaauugagcuacuuuggcuacuauuuacuuuaaaccaauguuuggcagccuuacguagucugcaacuccugcuuuucuugccucuuucucucuggcccugggguauaacuguguaucaccacacccaaaucugaaaguagagucuauuccccaaggcaauguuaaagaguuauuucaaaauacagcaucuuugguagggguaguuucuuuucccuaccuuaacacaucucuccucucccuaguucucacuuggaauccaacuagccaggaucaacucucacagagaauucuguuuugcuuaauaugauaaaguauauuuugugucgacagagccuaacuuaaacauuuaaccuuaucuaacgugccugcuugaauaaagaaaucuguaacauuuuaauaccuucauucaauaaauaaagaauagccaggcccucuguuguaggcuugucauuccagcuauuugagaggcugagggaucacaaguucuaggucaguuggggcagcuuguaagaccuuaucucaaauaaaaaguuacaagagggcugagggacauagcuuagugcuagagccuuuguguagcaugugcaaggcccuggguucaaucuucaguuaaaaaacaaaaaacauuuuacacaaaaagguccccaguacugaaaugguuaagaaauuugaguggcuucagucgugacucaucagauuugggaauagauuugcucagaagguauugucaugcuguaugaagcucugcuuccucuacaaagcauucagcuucuaacuuagcagcccccuagcaguuaauauucuauaagcauccaccccuuggccauuucucccccuccuugcuuccuuuuuagagauaacacaucaggaaucaagcugaggcugacugaaacaccccuggcuuugcacuuggcucuugaaucccuuuuuggaaagccagugggcuguuuaaaugaucuugguucgccuucagucucugguuuaugaagagaacuuugaaaaugccuuuuacccgcucgguuggaaauguuguugcuguuaucugauuucaaauccuaguggaagaggggaauaggucacugucugcuauuuccuguugcuuuuggcaccagaaaucagccaagggaccuuuaagcacagugagagcuguaagaagccaaaacugacugacugugaaagaacacagaaucagccaaacaucuugacugaaacugacuuccagagaguuucuggggguucuugagacaugggguucuucuccuccugacaccuccuuacuagguaucauacucauuuuuuuuuuucacacagcaauaaaggaaaaccuauucucuugccaucuccuuguucagcaacauaggcgaguaugugugugugcgcacgugugcccucagugguuugagaucaggaccagcauuguguagaaggugccagugugacauaaauuccugacaggcuuccucuggaugcucggugaagauacuggacaacucccaucccugcagcaguaggagcuggucagggaaccccacaggaugugcucauuccaaagucucccccaacugagugguuucuggugugcguguguguguguguguguguguguguguguguguguguguguguguguguguguauucugucugaaagccacggggagcuccugggagacaauuucauuguucugaggccucuuauggugugggaaagagcuuaauacuugaaagaucucuucuuuggauaugaauaauaaaccauaugaacauuuuauuuaucugaaucacuguccucugguugggcuccugucaggggcuugugcgugguuuguguguguauguguggguuggagcuguacacacacacauauauaugcaugucaguaucaggcaaauaccacaaucacuccccccacuccuacugucccccgcuuugaaacagggucucuuacugaaccuagagcucaucaauugcacuacccugggcagccaaacagccccagagauccucuugucugugcuugcccaaggcugggauuacaagugccuuugccacaccuggcuuuucuguggugcuggaauugaacuuggauacucaugcuuacacagcaaacgccuuacccacggauccaucuccuuaacccccgacagaaccucugcagucccuacaccauucucuguucuaggaaaggcugagacgagagcuugacuugcuuguauauggaugagagggugcaggggugauuuucucaaaugcuugaugccugggguagcacagccugguucccuuccuacuuacacuccagccaagcuaaacaacacccaguccucugguuaggacagggggagaaucucaggaaugccaauaaauccuacaaugucauuucguauuuuuuagcuuacagugacuuguauggaauauugguuucacagugccaaucugugucuugauugcuguugcaaucaagugggauguauaauuuguagucaucaaacggcuccuuuuuacccuucauauuuguauuuaaguacuaagagugugaucagcaguaucauucccugaaaugccucccuguccuguaauugcuaaggaagaaagaucuaccuuccauccucacuuaagacuccgugucuccuguuugucuuagauaagcucuggcuucucuaccuccuuccucaucucacugagggccacucccucacucucacggucucuggccauauaaaauuaaucacagcccaccucaagccgcuugcagucuucuuuauaccugaaaacacuuaugcaagauccuuauuugauaaacucucguugguccuucaggaacuagcuuccacuuccccagaacccuucccuggugaacucaagcugauucugcaucugcaccugcccauagaaaccagaccccaguuugaauggugguuggcugugggcuucuuaauggacagggcucuaucuuugucauagugacucuccugguucccagugugguacccaaaggaugagugaggaugguugaauuuguuacuugaaaaauugaucaucuuauaaugguaagaauuucacauucccauuugguuucucaagguuugaccaccauguggaagacaacugaauaaucagagaacucuuaggcugggauaugacccaauauuugcuuccuuccagaucuuggaagcccugaaggcauugcccuugaccaucuuggucgaaccaucuucuggacggacucucaguuggaucgaauagaaguugcaaagauggauggcacccagcgccgagugcuguuugacacggguuuggugaaucccagaggcauugugacagaccccguaagaggguauguuugccuacaugugugucuggcuuuuuuuguuuguuuguuuguuuuguuuuuagucucuggcuuuucuggaugaucuuuggugagguucuaaugccagccuugcucuccugagccguuucauucaugcaagauaaaacagagucuaccagccgaugagaugcuggcacacucagcacagugcugacaccuugccauguuccaguuucacaauucugucaagaaacuuuguagggugacagcucagaaguugaguaaucucuagauagauggaaugugaacuaacacuucaauugcaugaaugcuguagaguguuggguuggccuaaccacgcccccagcacuccuuguuggagcagcuguggcuugagcaucauggggggauucuucggccuauugcagcuuucucucuuuucaucguauggcaagcucucagucuuacaucccaggccccagcuccuagagaccauuuccuuagagacaguaucccuuguguugaggccauuccacuaccucgugcacagcagacaucucuaccacucucugcugguguuugaaucuugcuuuaggcaaaucacauugcuccacugucgccucccgaauagguuuaucacccaggcaauuacuguuagugacguccagcccacaguuuaugugucuguauguguauuugguaacagaccuguguaucauuccucagucauuguccaccauguuuugagcaggaugccucacuagccuguaccucccccaaguagugcaggcuaucuagccagagagacccagagauccccaucuccuucccagcacugggaucacagcccucaguccccacucucagaguuuuguuuuguuuuguuuuguuuugaacacagugcugggaauugaacccaggcccucacuuugcccauugaguuuuuucaagguacuacaaaggaacuauuaaaggauaccuguuaguuacagauagcccaauuugagcgaagagccaaguaacccuaaaauccacccuaguaccucaggaucucacuuagcugaugaucaccuuuacagcguucucaagaucuugcuucuucuuucuacuuggauaucucuuucaggaaccuuuauuggacagauuggaacagagacaaucccaaaauugagacuucucacauggauggcaccaaccggaggauucucgcacaggacaaccugggcuugcccaauggucugaccuuugaugcauucucaucucagcuuugcuggguggaugcagguaacauggagccugagaucauccacacauagcucuucacugucuuauucuucuugcucuagaguuggcaaaucucacccacugccucuuucugucuggcaaauaagcucagaacaaaauuuacauuguuaaauguuaccauuuuaaguguuauaaauaccuggugguaucaugcuugcuuuugccuuuuggccugcagaaccugaaauaauugcuauauggcucaauaaaaaaugguugacuccuauuuuggugggagguuacugagaauugcauauaugcuauauuuucagagguaauagugcauucugaauagagucccugauguggcccugcuucagcucugcagguugucccucaggcuugagaugagauggggagaaagaccaagaagggccauccuucaucucucucuaugaaagucuauaacugaguaccuucucugccccacaacuaaguaggacaaagaguagggugugaaagcuuacauguguauagaagccugugauagcauccaugcuggaauuaguggcaggcuagucccaugcugaucaguccgaguucuucagugccccaacuuuggggagaaagguucuaaagagacuuagaagggagggacuuaaacaaaagccagaagauggcagggccucuccugagacaaaggaaugggaaggccagcacaggcugccauuucucuguccugggcuccccucuccucaguuagggccaggugugggugccagaacucagguggguguaggcugaugaaagggaaaagacagaaaacagagacagaacgccaaugcugaagagcccgcccucuguguucuccaggacaugccauugaaacacugaauuccccccauccuugucuuuuagacucuuguuuucugacacaaaggacccauuucuugcgugaacaaugaccaacuuguauuugcuucacacaggcacccauagggcagaaugccugaacccagcucagcccggcagacgcaaaguucucgaagggcuccaguauccuuucgcugugacuagcuaugggaagaauuuguacuacacagacuggaagacguauguaggcugccgucaugcuggcugggccaaacuaugcccuucccuuugucucuauggaggucuuugccucuugucuuuucuccugacuguugacccuccagugaucccccuuuguccuggcugucagauauggaggaggguagaggaagagggcugucuaaucuuagagggaacagaggagccauuuaucauacccaaaccugggccuuccugagcuaccuggggucacauggcuggaggucucuuugauuaugucauaccucuacaucaauguaguuuuuaaacugcaauauuuucacagcuguuucuggaucagaccguccucaaauggagggucacaccaaggaaguagcuggcuaagagaggcuauaugucaccuggaauuuagagcagaggggagaguuagauuguuuuggcccuuuuuuaaaaaagccagugaacuacuggcuugacccagccuagggggagggagaaacagauccacagagagcaagaccaccaugucuuuuccaagccacagaagaggcugccugaccccauggagaacaucagaugcaugugcacucccugugcuuuugugcuuugcaggaauucagugauugccauggaccuugcuauauccaaagagauggauaccuuccacccacacaagcagacccggcuauauggcaucaccaucgcccugucccaguguccccaagguaacauccaugcugcugaauggaggucaacacucagagucucuaagagaaucaggguggccuaaguacauccaugggccugcuuccuauagguaucucagccuggauaucccuuccugaaggauucuuggauuuucccaccucaaggaacuuaaucuagaaccuccuuauagacauacccagagguguauuucuguugugauucuaccaacuugauaaucaagauuaucacacaccuccaagucaggaauacauguacuugccugucuuauuuaugauaaagaaacaaacagcagcucaacuuggcuccuugagcccacaaggagguaaauggggagccugcuguagguaccaagucagucagagguaagacuaugaugcugauuuccaucuuuuccaggccacaauuacugcucagugaauaaugguggauguacccaccucugcuugcccacuccagggagcaggaccugccgauguccugacaacacccugggaguugacugcauugaacggaaaugaugucaagaauuccuuguucccucuccaaguauuucauaguaacacucuacuugaagugacuugauccagacugaaaaguguccugcaguggaaugaccaccaggcccagaucuagccuagccugagcucucacaaccucuccuuaaccuucccuagaacaauuaccuuuagcucaguaaugggaaaaucucuacccuaacaugagggcaggacacacacacacacacacacacccuuugaucucagucuuuagacaaguuuauaaaguucuggauaaaaagccaaggguagugguacaugccugcaacccuagcacuugggaggcagaggcaggagaaucaggaguucaaggccaauuaucuugucuguauagcaggguuuagaaauaacccgaguuacgugagucccuuccaaaaaaaaaaucaggauaaaaauuauguguccauucuagagccauaggacuucuuccuaauucuagacucucccaugguaagcagagccuuagcgaccuaaggaggcuacuucuugguggcauuacaaacucagauauuacccaguuucucaacauaccacccagauccagcuuaggcaaggucauacuuuuucucuugguuaugcucccaucuaacuacucuccuguuguauaccuucauucugcccaagacugcuuucagugccuucucugccauaugaucaaaacccaaccauauuccagggauucaugguauuugguagaugguaaaaagcaaccccucccaaauuacaaaguccuggcauuucagcaguggccauugauaaucacauagguaagucaaggaaaaguccugagagagggauuugaagucaagauguuugaagauaggagauuauuaucuugaugugucuugaauuguagcaaauucuucuucuuugccaaaguaccuguauuaguuucuggucuaugacgucaugggaaucuucagcccacuccugguaccaguuuucaagucuucucauggagagucaucuggagcucagguugggguaggacuuugacaaaguaguguccagucauagucccucaccuuuagaauugugucucuguuucucccucucucuguggcccuuucugacuagauccucaucugaagacacaaucuaggaagaucuaguugggcauuucuaguagugguucggauccuuauuugaucaucaguauaguuugagggacuguugcugccuuccauguuucugucugugauuuguuucaaaaauauccgcuggccagaugcauagcuacucuccugucuguuuugaggugucuguguuauugauuccauucuagggacaacaguauaaacuuaguaaucauuuguucuuuucuuuuuaaaaaacaaaacaacccuuguccccucucucuuccuucuaucuacuauuaucuaucaccuaucucucuacuuaucugucaucuaucucuaucuaucuccuguuuuccacugcuuccuagacacucaaaggauuaauaauuuuggauuggaagucaagcaucagaaguucgguuugcaugguguaaggugagggcacagacaagacucaggcagaacuauuacaagugguggauaaggauggagaacagggauggaaaaucccagaagaaacagcaguggagaggcuuaaaggcagcuaaaacuaaaagccuuaaacaacuucagagaaaaguggcacauuugccaaaagaauguuuauccuugaagacauaaaagaacuuggccugauguuuuucuuggggaacagagcccccuaccuccuuuucuucuacuuucacuguacucagcccccaacccuaucuccuaccuccaccucgaccugcuuacauuggacugggaaucuaaauugggagggagucuuuacuuaaauaauuggaauuuaaaucacaaaguuuagggaacgugugacucuuucaugcacccucauaaaguaccccuaguuuuuuuugucauguuccucaugauauauaucuuuuauaacuuuuauucauuuuuacuagauuccuucuaaaauguuuuacaugguaaauuguuaagcuguggaaaccacugaaggugcuuauuaaugguucuccagauguauacaaguauuggaugauuccucaaguuuacagcuguacaaauauuagugcagaaaaaaaauaauuaaaauacaacuguuaaaaauaaaaucuuauuuugauguguuu

SEQ ID NO: 6894 - RNA, 74733 nt, Mus musculus
aaacacaucaaaauaagauuuuauuuuuaacaguuguauuuuaauuauuuuuuuucugcacuaauauuuguacagcuguaaacuugaggaaucauccaauacuuguauacaucuggagaaccauuaauaagcaccuucagugguuuccacagcuuaacaauuuaccauguaaaacauuuuagaaggaaucuaguaaaaaugaauaaaaguuauaaaagauauauaucaugaggaacaugacaaaaaaaacuagggguacuuuaugagggugcaugaaagagucacacguucccuaaacuuugugauuuaaauuccaauuauuuaaguaaagacucccucccaauuuagauucccaguccaauguaagcaggucgagguggagguaggagauaggguugggggcugaguacagugaaaguagaagaaaaggagguagggggcucuguuccccaagaaaaacaucaggccaaguucuuuuaugucuucaaggauaaacauucuuuuggcaaaugugccacuuuucucugaaguuguuuaaggcuuuuaguuuuagcugccuuuaagccucuccacugcuguuucuucugggauuuuccaucccuguucuccauccuuauccaccacuuguaauaguucugccugagucuugucugugcccucaccuuacaccaugcaaaccgaacuucugaugcuugacuuccaauccaaaauuauuaauccuuugagugucuaggaagcaguggaaaacaggagauagauagagauagaugacagauaaguagagagauaggugauagauaauaguagauagaaggaagagagaggggacaaggguuguuuuguuuuuuaaaaagaaaagaacaaaugauuacuaaguuuauacuguugucccuagaauggaaucaauaacacagacaccucaaaacagacaggagaguagcuaugcaucuggccagcggauauuuuugaaacaaaucacagacagaaacauggaaggcagcaacagucccucaaacuauacugaugaucaaauaaggauccgaaccacuacuagaaaugcccaacuagaucuuccuagauugugucuucagaugaggaucuagucagaaagggccacagagagagggagaaacagagacacaauucuaaaggugagggacuaugacuggacacuacuuugucaaaguccuaccccaaccugagcuccagaugacucuccaugagaagacuugaaaacugguaccaggagugggcugaagauucccaugacgucauagaccagaaacuaauacagguacuuuggcaaagaagaagaauuugcuacaauucaagacacaucaagauaauaaucuccuaucuucaaacaucuugacuucaaaucccucucucaggacuuuuccuugacuuaccuaugugauuaucaauggccacugcugaaaugccaggacuuuguaauuugggagggguugcuuuuuaccaucuaccaaauaccaugaaucccuggaauaugguuggguuuugaucauauggcagagaaggcacugaaagcagucuugggcagaaugaagguauacaacaggagaguaguuagaugggagcauaaccaagagaaaaaguaugaccuugccuaagcuggaucugggugguauguugagaaacuggguaauaucugaguuuguaaugccaccaagaaguagccuccuuaggucgcuaaggcucugcuuaccaugggagagucuagaauuaggaagaaguccuauggcucuagaauggacacauaauuuuuauccugauuuuuuuuuuggaagggacucacguaacucggguuauuucuaaacccugcuauacagacaagauaauuggccuugaacuccugauucuccugccucugccucccaagugcuaggguugcaggcauguaccacuacccuuggcuuuuuauccagaacuuuauaaacuugucuaaagacugagaucaaaggguguguguguguguguguguguccugcccucauguuaggguagagauuuucccauuacugagcuaaagguaauuguucuagggaagguuaaggagagguugugagagcucaggcuaggcuagaucugggccugguggucauuccacugcaggacacuuuucagucuggaucaagucacuucaaguagaguguuacuaugaaauacuuggagagggaacaaggaauucuugacaucauuuccguucaaugcagucaacucccaggguguugucaggacaucggcagguccugcucccuggagugggcaagcagagguggguacauccaccauuauucacugagcaguaauuguggccuggaaaagauggaaaucagcaucauagucuuaccucugacugacuugguaccuacagcaggcuccccauuuaccuccuugugggcucaaggagccaaguugagcugcuguuuguuucuuuaucauaaauaagacaggcaaguacauguauuccugacuuggaggugugugauaaucuugauuaucaaguugguagaaucacaacagaaauacaccucuggguaugucuauaaggagguucuagauuaaguuccuugaggugggaaaauccaagaauccuucaggaagggauauccaggcugagauaccuauaggaagcaggcccauggauguacuuaggccacccugauucucuuagagacucugaguguugaccuccauucagcagcauggauguuaccuuggggacacugggacagggcgauggugaugccauauagccgggucugcuuguguggguggaagguauccaucucuuuggauauagcaagguccauggcaaucacugaauuccugcaaagcacaaaagcacagggagugcacaugcaucugauguucuccauggggucaggcagccucuucuguggcuuggaaaagacaugguggucuugcucucuguggaucuguuucucccucccccuaggcugggucaagccaguaguucacuggcuuuuuuaaaaaagggccaaaacaaucuaacucuccccucugcucuaaauuccaggugacauauagccucucuuagccagcuacuuccuuggugugacccuccauuugaggacggucugauccagaaacagcugugaaaauauugcaguuuaaaaacuacauugauguagagguaugacauaaucaaagagaccuccagccaugugaccccagguagcucaggaaggcccagguuuggguaugauaaauggcuccucuguucccucuaagauuagacagcccucuuccucuacccuccuccauaucugacagccaggacaaagggggaucacuggagggucaacagucaggagaaaagacaagaggcaaagaccuccauagagacaaagggaagggcauaguuuggcccagccagcaugacggcagccuacauacgucuuccagucuguguaguacaaauucuucccauagcuagucacagcgaaaggauacuggagcccuucgagaacuuugcgucugccgggcugagcuggguucaggcauucugcccuaugggugccugugugaagcaaauacaaguuggucauuguucacgcaagaaauggguccuuugugucagaaaacaagagucuaaaagacaaggauggggggaauucaguguuucaauggcauguccuggagaacacagagggcgggcucuucagcauuggcguucugucucuguuuucugucuuuucccuuucaucagccuacacccaccugaguucuggcacccacaccuggcccuaacugaggagaggggagcccaggacagagaaauggcagccugugcuggccuucccauuccuuugucucaggagaggcccugccaucuucuggcuuuuguuuaagucccucccuucuaagucucuuuagaaccuuucuccccaaaguuggggcacugaagaacucggacugaucagcaugggacuagccugccacuaauuccagcauggaugcuaucacaggcuucuauacacauguaagcuuucacacccuacucuuuguccuacuuaguuguggggcagagaagguacucaguuauagacuuucauagagagagaugaaggauggcccuucuuggucuuucuccccaucucaucucaagccugagggacaaccugcagagcugaagcagggccacaucagggacucuauucagaaugcacuauuaccucugaaaauauagcauauaugcaauucucaguaaccucccaccaaaauaggagucaaccauuuuuuauugagccauauagcaauuauuucagguucugcaggccaaaaggcaaaagcaagcaugauaccaccagguauuuauaacacuuaaaaugguaacauuuaacaauguaaauuuuguucugagcuuauuugccagacagaaagaggcagugggugagauuugccaacucuagagcaagaagaauaagacagugaagagcuauguguggaugaucucaggcuccauguuaccugcauccacccagcaaagcugagaugagaaugcaucaaaggucagaccauugggcaagcccagguuguccugugcgagaauccuccgguuggugccauccaugugagaagucucaauuuugggauugucucuguuccaaucuguccaauaaagguuccugaaagagauauccaaguagaaagaagaagcaagaucuugagaacgcuguaaaggugaucaucagcuaagugagauccugagguacuaggguggauuuuaggguuacuuggcucuucgcucaaauugggcuaucuguaacuaacagguauccuuuaauaguuccuuuguaguaccuugaaaaaacucaaugggcaaagugagggccuggguucaauucccagcacuguguucaaaacaaaacaaaacaaaacaaaacucugagaguggggacugagggcugugaucccagugcugggaaggagauggggaucucugggucucucuggcuagauagccugcacuacuugggggagguacaggcuagugaggcauccugcucaaaacaugguggacaaugacugaggaaugauacacaggucuguuaccaaauacacauacagacacauaaacugugggcuggacgucacuaacaguaauugccugggugauaaaccuauucgggaggcgacaguggagcaaugugauuugccuaaagcaagauucaaacaccagcagagagugguagagaugucugcugugcacgagguaguggaauggccucaacacaagggauacugucucuaaggaaauggucucuaggagcuggggccugggauguaagacugagagcuugccauacgaugaaaagagagaaagcugcaauaggccgaagaauccccccaugaugcucaagccacagcugcuccaacaaggagugcugggggcgugguuaggccaacccaacacucuacagcauucaugcaauugaaguguuaguucacauuccaucuaucuagagauuacucaacuucugagcugucacccuacaaaguuucuugacagaauugugaaacuggaacauggcaaggugucagcacugugcugagugugccagcaucucaucggcugguagacucuguuuuaucuugcaugaaugaaacggcucaggagagcaaggcuggcauuagaaccucaccaaagaucauccagaaaagccagagacuaaaaacaaaacaaacaaacaaacaaaaaaagccagacacacauguaggcaaacauacccucuuacggggucugucacaaugccucugggauucaccaaacccgugucaaacagcacucggcgcugggugccauccaucuuugcaacuucuauucgauccaacugagaguccguccagaagaugguucgaccaagauggucaagggcaaugccuucagggcuuccaagaucuggaaggaagcaaauauugggucauaucccagccuaagaguucucugauuauucaguugucuuccacaugguggucaaaccuugagaaaccaaaugggaaugugaaauucuuaccauuauaagaugaucaauuuuucaaguaacaaauucaaccauccucacucauccuuuggguaccacacugggaaccaggagagucacuaugacaaagauagagcccuguccauuaagaagcccacagccaaccaccauucaaacuggggucugguuucuaugggcaggugcagaugcagaaucagcuugaguucaccagggaaggguucuggggaaguggaagcuaguuccugaaggaccaacgagaguuuaucaaauaaggaucuugcauaaguguuuucagguauaaagaagacugcaagcggcuugaggugggcugugauuaauuuuauauggccagagaccgugagagugagggaguggcccucagugagaugaggaaggagguagagaagccagagcuuaucuaagacaaacaggagacacggagucuuaagugaggauggaagguagaucuuucuuccuuagcaauuacaggacagggaggcauuucagggaaugauacugcugaucacacucuuaguacuuaaauacaaauaugaaggguaaaaaggagccguuugaugacuacaaauuauacaucccacuugauugcaacagcaaucaagacacagauuggcacugugaaaccaauauuccauacaagucacuguaagcuaaaaaauacgaaaugacauuguaggauuuauuggcauuccugagauucucccccuguccuaaccagaggacuggguguuguuuagcuuggcuggaguguaaguaggaagggaaccaggcugugcuaccccaggcaucaagcauuugagaaaaucaccccugcacccucucauccauauacaagcaagucaagcucucgucucagccuuuccuagaacagagaaugguguagggacugcagagguucugucggggguuaaggagauggauccguggguaaggcguuugcuguguaagcaugaguauccaaguucaauuccagcaccacagaaaagccagguguggcaaaggcacuuguaaucccagccuugggcaagcacagacaagaggaucucuggggcuguuuggcugcccaggguagugcaauugaugagcucuagguucaguaagagacccuguuucaaagcgggggacaguaggaguggggggagugauugugguauuugccugauacugacaugcauauauauguguguguguacagcuccaacccacacauacacacacaaaccacgcacaagccccugacaggagcccaaccagaggacagugauucagauaaauaaaauguucauaugguuuauuauucauauccaaagaagagaucuuucaaguauuaagcucuuucccacaccauaagaggccucagaacaaugaaauugucucccaggagcuccccguggcuuucagacagaauacacacacacacacacacacacacacacacacacacacacacacacacacacacgcacaccagaaaccacucaguugggggagacuuuggaaugagcacauccugugggguucccugaccagcuccuacugcugcagggaugggaguuguccaguaucuucaccgagcauccagaggaagccugucaggaauuuaugucacacuggcaccuucuacacaaugcugguccugaucucaaaccacugagggcacacgugcgcacacacacauacucgccuauguugcugaacaaggagauggcaagagaauagguuuuccuuuauugcugugugaaaaaaaaaaaugaguaugauaccuaguaaggaggugucaggaggagaagaaccccaugucucaagaacccccagaaacucucuggaagucaguuucagucaagauguuuggcugauucuguguucuuucacagucagucaguuuuggcuucuuacagcucucacugugcuuaaaggucccuuggcugauuucuggugccaaaagcaacaggaaauagcagacagugaccuauuccccucuuccacuaggauuugaaaucagauaacagcaacaacauuuccaaccgagcggguaaaaggcauuuucaaaguucucuucauaaaccagagacugaaggcgaaccaagaucauuuaaacagcccacuggcuuuccaaaaagggauucaagagccaagugcaaagccagggguguuucagucagccucagcuugauuccugauguguuaucucuaaaaaggaagcaaggagggggagaaauggccaagggguggaugcuuauagaauauuaacugcuagggggcugcuaaguuagaagcugaaugcuuuguagaggaagcagagcuucauacagcaugacaauaccuucugagcaaaucuauucccaaaucugaugagucacgacugaagccacucaaauuucuuaaccauuucaguacuggggaccuuuuuguguaaaauguuuuuuguuuuuuaacugaagauugaacccagggccuugcacaugcuacacaaaggcucuagcacuaagcuaugucccucagcccucuuguaacuuuuuauuugagauaaggucuuacaagcugccccaacugaccuagaacuugugaucccucagccucucaaauagcuggaaugacaagccuacaacagagggccuggcuauucuuuauuuauugaaugaagguauuaaaauguuacagauuucuuuauucaagcaggcacguuagauaagguuaaauguuuaaguuaggcucugucgacacaaaauauacuuuaucauauuaagcaaaacagaauucucugugagaguugauccuggcuaguuggauuccaagugagaacuagggagaggagagauguguuaagguagggaaaagaaacuaccccuaccaaagaugcuguauuuugaaauaacucuuuaacauugccuuggggaauagacucuacuuucagauuuggguguggugauacacaguuauaccccagggccagagagaaagaggcaagaaaagcaggaguugcagacuacguaaggcugccaaacauugguuuaaaguaaauaguagccaaaguagcucaauugggagaauguuagacugacauauuaauucaauuaacuaagcaaacugaguggugaugcaugaacauaauccugacauggaggaggcagaaagcaggaagauuaugagcucaaggccauccacagcuacuuaaugaggguagcaugguucccaugaaaucccaucucaaaaauaaaauaaauaaucuucaacuuuugggugaguauccgucaauauaguggguuucuggacuauuccuuccauccacugccuuugauuaaacccccaugcagcacacgguagagcacucugugagaagccagugcagguuuagaagcuaaaggaagaaauagaauguugaguuugguuuuaugaugcacaaagguggaccauguaagcuuccagagaaagggcacaggccucugccuuguuucaguuuaauuauccugagacuuaaccucagccagaaagucccugguuuaaugacucaacuggccuauggaaaacuucagaggagaugaaaaggacagagugaagaggcaaaagaccugcuuccuagcgaacauaugaacgagcgaagcggcuuacucuccacuccucacuuccuaccaagagcagcgugggcugcuagaagcaacacccaagaggagcaacguuugcuugccuaccuugucgaaugauggugguuggcucuccaccguggaggcuggcucucccaauggaaggcucgcugaugucuguccaguaaaccaccuuguccacgcagucaaaggccaguccaaugaugacuuuugccuuggaaguaauaccagugauugagagcagcuuacccacuagcuaguguggccuugaaucuucccaugugacauacauccucaggcaguauuuuaaauaaaguaaauaugcuuuguccauucauauccuuaauuauugaauuauaaaaacuaucuaguucagaaaaaaaucacuagcuaguguuaccuugaucuuucccaugugcuugcauauacauccucagauaguauuucaaauaaauauguuuuuauucauauccuuaauuauugaauuauaaaaacuauauaguucaaaaaaaucacuaacuaguguuaccuugaucuuucccagugcuugcguauacaucucagauaguauuuuaaaugaaauaaauguuuuguccauucacauuuuuaauuauugaauuguagaaacuauauaguucagaaaaaaaaacucuugucuaaaaacauguguuugcacuugcacacauguauguaugugugcauacauauuucucuccagcuugauuuucauuuuuucaucuuuuuuacuucugucuauauguguaugcuuaugugucuguauuugugcccuuggaggacagaagagaguguuggguccccuggagcuggagucaccggagcccaugaacugacaguacuuggguguugggaaccaagugaauugucccuaaaaagcagcaagugccuuucaccuuugaccuuucuuuccagcccacaaaugcacaagaaccgacggugaguacugcaaagcauuaacaggugaaauuaaagaugaccuggguaauuagaaagagcaagaucacaugaauggauucuacaguuuaauacugcuaagacaucaguuccucuuagugaugguuucagugacccagugucuccuuuguuaaaguuaccaacuuguuugggucugcuuuuuuuuuuuuuuaauuguuguuggauuuuacacguaacauugccuggccuggaacucgcuauggagaccaagcuggccugaacucacagagauuugccuccugagugcagagauuaaaggugugaacuacaacucguggcuggcuggguuuuuguuguuguuauuguugcuguuuuucuaauggaacaagaaguuuauuuuaaauauuacaugaacaugugaacaacaacaacagcagcaguguggcugcucaugucuguaaucucagaacccagaagguagaagccaagauuucaaagcuggcuuugacugcaauaacauguucaagacuugccugaucuauagaaugagacugccuagaaaauauaaaauaaaauaaauaucuaaaauaguccaaacagucuaagaaaggaacucaaaucucccugacuuugagaucuacuauaaucaagaaagaaugacauuauauuuacaaauggauacuguauuauauuagauuacaaauauaacuacuagcuugguauaauauuauauuauacauagcuauuaacuauguugguauuauaguuguugugucauacuauauugauaucauacauuauauacucuaguauacuuaguuauuaacuaucuugauauuauauugucuuuuauuauacuaucuugguauuaugcuacauuauauuuuauauuauauuauacauagauauuaaccacacuaauauuaaauuauauuguauuauauuacauuaauuaucuugguauucuauuauacuauuauauuauauauagccauuaacuaucuugguagccaggccccuauuacugggacugucaccagagcuauucagcugauacucacagggauauggagaaaggccuuggcuucugucuucuucaugguguuucucuccaggggcaggcguucaaucuuuccagucugagcaaagaguaagugugucccuggaggcagggggaugacagcuguagguacuacuggucccuggugaauaggaggagccacuguacucagaccuagagggcaagagauauuaaugaaugaggguugugaauaucauaaaugcacaggugcaaucuaaugcucaagcaugcagacacauccaugcacccaugugugagcacacagguacacauacaugugcauaugaagauauguguauaugugcucaugcacccaucuacauaucacccauauccauugucacauuuauuauauucaaacagcauagccaaccacacaauauccauuuucugucugaaacuuccagagacagaaugccuucagccagucaaggggcauuuacaaagaagacagggcagaacauaaguuuaguacaaagguccagugggguaaagcaggagcuuugcuccaucuuacacaaugacuugguuauuuauguucuggcuggauguugggcuggcaugagagccaaagcaacacuuggagcaauagcaccaauaccucugucuucagggagugacauuaucuuuaacacugaauggagaaagcuaucagggagggcaccugcccauugcuaugggauggggcauccucagaccucauaagcagaaacaugaccaccugggcaaaagguggcagagggagaguugggagcaugugaacagagaccaggcagcacauccacuugucuauguaacagcugucuacuuacacgggggccucaucccaggugggguacggcuacccuccagcucccgaccaucucgguccacacaccagcaguagccagugcuguggugacacuggguggguacauaguguccauauucaucacacugagguacaaacauccccugcagggugggccgcugugcaucugccccgccggcugcuccaaggaugugcucucguuccaguugacaccggguuuugcucaccucugucagagacaagcagagugucauuugugccaaacaugguguucccaaaugcuacuugucaaacuuggaccacaaagguaaccugccaucacuggcuuuuuauucauuuuucuuuugaaacuuaaaacaccauuuaugagaaccagggauguagcuuaguugauaagaaugcuugcauaccauacaaugaauccuuggcucagaaguucaaggucaucuucagccaugaguucaugacuagcuugaccuucucucaaaaaaaaaaaaaagacuuaugauuuuuaaaagcuacaccaugccaugcaugauggcacaugccuuaaauccuaauauggagaggcagaaacacauggauuucucugauuucaagaccagccuugucuauguaguaauauccugccuuugaaaaaaaaucaaaauaucauuuauacauguagauuuucuuuccuacacaguucuuuugaaauuaaaaaaaaaauaaggcaaaacagacuuaaaauaaaaggaacuauguuaagugagcaauuguguggcauuuggcacauucacagugaugaccagcuauggcugguuuuaucugaaccauuucaucauccuaaaaaggaaaccucaugccucgagagaagaugcuuccauccaugucuucuucucuucuuccuccccacccuaaaagcucccaaucuccaucuuuucuguggauguccccauucuguauauuucauaccagugagaucauaggacacguggcccggccucugacuuccuucucuuagcagaucacccaggcccauccccacuguggagaacacaaaagagcacaggagugcacucaggccccucaauccucccuuucuuucaacaacuggacaauacugcaccuuacagaaaagccccauaguuuucaaccauguuuccacugauggauggcccuggacucuguucuaagguauguuaaguuaaucuuaagcucuucuuuuacccucucaagcuccauaugaucuacauugaguccaagccaaagaguuuggagaccaaagaucaugagacacucaccaguuucugcauguuucccccuaguaaaggcccaugucugccaugaagccuggugucuaaacucuacagcucagauuccaaagcugggaaauaccgcuguacaagaagcuuaggaaguugggugauggaguaaaccugagaucucagcacuugggagaaugcuaaugcaagaggauuagaaguucaagaacaaucugucucaagcaaaauaaaacuugacauagaauaaacaacuccuaaacgugcagagcuacagcuggguuugacauucucugaagucaagccaccauggggggccauuagaguggucaccccugaagcauaaaucucagagagacauugagaggcauccauucuccaugcuacuauugcugagagcuacauuuauccaaguguuagagcuucuuccuuccaugaguuggucuuugugugaagccccccuuaacuucccagcugaacccccuuuccauugccugaucaauccucagaaacuguguugaggcacuaauuuccugcaggaaggacuucucaaccaccauccccaugcuggguuuaguguuuuaggugagcucucaaaccuuccaggugguacccaagguaucuaagaccagagacucuagggucccaugacugaaggagcuguucucuggcuccugggcggacguggggcucucacaggauggagacuggcucuucucugccuuuacugaggaaaugcaccuagguuggguagacacacaacgaucuucaggccugccaucagggaaccacagccagagacauggagcaaggagacacacagaagagucucucuccagugggcaggagaacacaagagagcacaggagugcacucaggucuguuaggguggcugggggaucgugauuaaacagcucuuagagcuuggccaacuuucuggcuuuauguaccaacacugacugguacaacuaccuaauuccaugaugucagagugggagaaggcaugcuugaugugcaaauuaauggacaauaaaacuuuauuuacaagcccgguguggugcucuugccuuuaaacucagcacgguagagacagagguaggcagaucucugugaguucuggacuagucuagucuacaaagagaguuaguuccuggacagcuaggucuacacagagaaaccuggcuaguugggggugagggcauguuggccuguggggauaauaguuaccaaucuuggcucuagggcauugcuccuuaagucaaccaucugagccucucuccauguuuugauguggcaagaaggcccucaccauuuaaccguguaccucucagcuuccagaaucccaaggcaacucgauuucaggucuuuauuaucaccagccuuugguauucuuuuauagcugggaacuacaagacaacacauguggauggagccugaagauguucauuugugcucuggccuacacaaggcagacacaaugacuucaagggaaauacagcuaagguacuuggugucucaucugaauggccaguucucaugcuggcuggccuaacacaauugcccccuugaucagaaacugcuaauauggcaaaaacguguuuguugagccuaguaagaaaagggcugagugcacuuuucuuuuaucucugaggauaguguuaaaaaaaaaaaaaguaaaauacuugauguaggaagauccaagcaaaaauaagaacgagccaucuagccaucugauuagaaucaaaauguugauuuuuguauucuauuggauauaaaacuuacuuacuuucucaaccuuagauuuguucaggguuuuagaaguuccauaccagcuauuuccaugucuacauauaugucuccuaaugcccauuuauauguauauauguaaugucuaugugagagcauaguaugugugcccccugagguaaaaagaggguauucuauccccuggaucuggaguuacagguggucaugagccaugauugacaggugggugcuggaaacagaauucacguccucuguaagagcaggaaguacucuuaacucuagucauugcuccaguuuccaucuaaugcccauuaggauaggaauuuaguuuuaacaccaauggaagaaccuaaaacucaaagagauuaaggaauuccuucagagucacagcacuggaagugacucguugcaaauuacaacugaagccuguggauuccugauccagccccucuguuccuuuuggccuugaguuucugcauccaccuucccaucagucaggcuggaucccacacagugagcacaauaauaccacgauggcugugaaucuucauugucagugugacuggauuuggaaucacuaggagacccaugccagggagggugcuuccagaaagaauuagcugaggagguuaagccuacccugaauguaaguggcaccaugagguaggcuccuagagagcuggguaugugaggucaccccucugcuucuugacugcagaccaagaguggccagcugcuuucuacuccuauugcugugccuucccauuaugauggccugcauccccucaagcuaugagccgagauaaacccuuucuuaaguugguuuucuugagcauauuaucacaucaaugaaaaagcacaaucauauucuuacuuucuuaacacacccagugaaguggucugaaaguccccagaaguccucaguauuucuuuucaguauuucuguccuuaaccacuuuuccagcuacaguggguugauguucuaggugucuccaacuaagcagaaacuucugaguguaugucugcaugggauugugcaugugugugugaauacaguuguguacauguaugaagaggccagaugucagucuucgguguuccucgguuauuuuuguggcagacuccuuggcaugaggcuuucugccuaggauccgccugucucugcuuccucagcucuacaguuuugagcacaaauguguccaguuucuaaaugcaaguucuagagacuaaacuccucuucuuuuuacauuuuaccaacugagcuauggccccagccuccaagcagggcauuuaagagagcgagggcgauuucauuuuauguagcagacaggcuuuuguguugauauccuguuagacauucaaaaguucaaaucgucuggaauagacuguaaaacuuuuaggauuaucuugaacguauaaggaaagaaaaaccucaacucuaagucaggaaauagaacuugaagaacagaguguuuauaaaacaugauguguucucacagauuuccacaaaugaauccguagucuggcaaacagguagcaggaguagccaaggguacgaggauuaacacccuagggaauuuugcaucaagggucugguagauaggguggggacaauagagucaagaggucacuuuuucugaguuuauuucugguugguaaaaugauuaucagacaaacuauuucuucugucuggcucagcugugagaaggaacgaauggucccuugauacaucugaaagcaaacaggaagucugggguggcuuuucuugagauggcaagaaagagaaugagaggaaaugaggaaaaaggagaggcaguccauuuaugguuccuggauuugcaugcuauuuguucucuuggucacauuugugaugcugucgaaugaauggccagugcagcccuggaguaggagagagggcauagcuaagaagugccaagucagucgggcgguggaggcguacgccuuuaaucccagcacuugggaggcagaggcaggcagauuucugaguucgaggccauccuggucuauaaaguggguuccaggacagccagggcuauacagagaaacccugucucaaaacacacagauacgaagaagaagaagaggaagaggaagaggaagaggaagaagaagaagaagaagaagaagaagaagaggaagaggaagaggaagaggaagaggaagaggaagaggaagaggaggaagaagaagaagaaggaggaggaggaggaggaggaggaggaggaggaggaggaggagaagaagaagaagaagaagaagaagaagaagaagaagaagaagaagaagaagaagaagaagaagaagaagaagaagaagagccaagucucucugucagagcaaugggaagccugugucuacuacucggagggaaauuaugugcaggggugccacccauucacuugcuuccuauacagugugagcuccugguagggcccagcugcucccauugacuacacagacucuaucacaacccaugacacagaucugugaauagaguaagguggaugccaugaauggugcccauucuuucuuggcuuugggacaucacuagcugcugaacagacgcaucugcccugcauggcuaugguucccagaaugagaauuuaaaaggacagaauacaaugucuccaacaugguccuaaaccugaagucccuagcuauuuccgaagaacaccaauuacaauaaaaaccuuaggugucuacucgugaaugugucaaacuucugcccaaugugagcccaaggaugcuggaugggagggaagcucaggaagaggcaaugaauaggcaacaaggaaaaggcagauaaugagagggaacagaaaaaggcauuaaacaccaggaaaggcaauggcuucuguucucugugcugcugcugccacugugggaaaugacauaacuucuucccagaccaaagcccugggggauccucagacugcuuaucugcuuuaaguguguuauaaacacucacuggaaacugccaugagccgagaaccaugaaaggccucagagcauguaggugggagggaagaugagaaucauuucucagggaguucagggggguggagaagugguuguuauggaaacaaaggagaggcuuacuguuugucuuugcgucuguggugaugcauagcuucauggaggggaauucaugguagaggaagaugagucacgucauggugaccaaaaagcaagaugagagguccauuggacuugcaaacuuuauaugccccaguacaggggaacgccagggccaaaaagggggaguggguggguaggggauugggggguggguaugggggacuuuuuggauagcauugaaaauguaaaugaggaaaauaccuaauuaaaaaaaaaaaagcaagaauaagaaggagcuggcguuccagcgcucccuccaauaaccuaugaucuccagccuuaccuccuaaaguucccuccccugcaaugaguccucuuccucuuuccccucuucuucaucuguguuggggauugaagcugggaccucacauaugcuaggcaaacacucuaccacuaggcuauauccccuuucuacaacaaaaccaaacagauaaacaaaacacacuuauucaauguguguguguguguguguguguguguaaaaccuuuuguaauguauuucaacauuaucuuuugagguuuaucuauugcuacaguccauuuguuuuggcuguugccuguuacuucauaguacaauuuaaacuaaaauucaucuuuccauucuucuuguugcuagauguacuggcugguuugaggugucaacuugacacaggcuggaguuaucauagagaaaggagcuucaguuggggagaugccuccacaagauccagcuguaaggcauuuucucaauuagugcucugggcugguagucuuggguucuauaagagagcaagcugaacaagccaggggaagcaagccaguaaagaacaucccuccauggccucugcaucagcuccugcuuccugaccugcuugaguuccaguccuaacuuccuugaugauaaacagcaauguggaaguguaagcugaauaaacccuuuccuccccaacugcuucuuggucaugauguuugugcaggaauagaaacccugacuaagacauuagauauuuagauuguuuuuuuuuauuauaaaugauacauaaacauucuuguacauuuauuucuagggcaugcccccuuggguauauaacuggauguuggcuuucuucugagaacaacauuaaauaaauaagccaucuuagcagauggcccuuauugacauuaucugugucccaucgccacaucccagacuacaagucuagaucuguuucuguuuaguaaacagagccuuaaagauagggcaaggagucagacuuucuaaaaaaucgaaacaaaaacuuagacaucuguuucucuuugaacuggagaugugaaagcagcccacagaaaugcugaaugcuggcuguuuuaacagcagcuggaacaccucacucagcucuaguggccaggacugcuucuuuaugugucccucccaucaaaaucugugggcagagcuauagccacaaccuguaauuucagaaacagaagguggcccucuucuccuuuagcagugauuuuuuuuaaagcaguguguguguguguguguguguguguguguguguucaugcacacaugcaagcccaugugagagagcacaaagaacaacuugugagagucuuuccucccaccaugucuucaggggaucaagcucagguugccagacucgaggcagcaagcacucugccugcugagccaccucaccacacucccacucucuucuugcuucuuagcugccagugagguccucagcuuugcuccgugcuccccaccaugagguucugccucaccccagcccaaagcaacaaccucgacaaugaucugacaccgugacccaaaacaaaacuucccuucuucaaguugaugucuuggguauuuuguucccucagcugaaaacugacaaacacagacacuggguaugccuaguagguucuguauagcuggcagccaucuaugagcauuuguucaacaguguuuccugagagucugaccaguuccuagucucaaaccuaaccuggcuugaggcuucugggaugccuacaugccaaggaggggccacucaagucucagguaagcagcaauucccaaggcugcauauucaggucaguaacaggugauguaaaacauuccauacuuuaguuaaaccuccccccaucuugggcccuucaucccaucuccccaucauacauuccauuccccaacacucccaggcuucuguugaucuuauguccauguggcuagaccagacauuuggucacaucauccuguuucuggauggcauuauuaagguugacauucuauguacauuguucuuucuggccucauccagucauguaaagacauaaacagaacacagacaaacuugcuccucuucugaauaaagagaacucuugcccagacaugguagcacacgacuuugaucccagcauucugagaguuaggaggaucucugugaguucaaggccagucuaguuuacauauggagcuccaggacaacuagggcuacauaguaagaccuaugaggggggaggggauagagagacagacaaacagagagacagggagacagggagacagagacagagacagagacagagacagagacagagacagagaaagagaaagagaaagagaaagagaaagagaaagagaaagagaaagagaaagauuguuucugucugauagccuccaaaccagaaaucauuuguuuccuauguuuuugaucaaaccaaacauaagccuuuucuaggucacaaggcuacuagcuucuggacuggaauucgaacauacgcuuucuugguucuauggccuucacaccugaacuaaaugguauuggcuuucuuggguucccugcuuccugaaaacagaugcuaggguuugacagucuucaaaaugauaagauucaauuucuuuuuuuuaaagauuuauuuauuuuauguaugugaguacaccauugcucucuuuagauacaccagaagagguuaaccauuacagaugguugugagccaccaugugguugcugggaauugaacucaggaccucuggaagagcagucgguacucuuaauugcugagccaucucuccagccccaagauucaauuucuuauaaguguguguguguguguguguguguggauggguguguguguguacacauauauacacauauauucucuuggcucuguuucucuacaguccucugguaaauaaagcucagugcccguuuugauccugugcugcugacuccgguaccuaggaaccaauacaaucuaaaauuccagcauggcuuuggguccuuugaaguauccccgaaagcuguguacuaugcacuucugcacuaaggccuguggucuaaucuccauuguacagaacucugaaaacuuuccauggaccacuuccucagagccccuccuccccaggucaucaaagcuuaugaacacaucaauaggccaucaacucuuaacacccccaucuuaccuccgggcaugcaucggaagccaucccccugauagccaggcuugcacugacaugugaaagagccugguguguuguagcagaaggcaucggggugacaucggcugugcuggcauucauccacgucugcaaaacagccacaggcccagagaccaugugauugcuuccagaauuugugcuugauacaauaauuuaauccacacacucaaaucuauguaaaucugcuucuaauuagagaccagggacuuuaaacucacuaaauguuaauuuuugagacacucauacccuaacuucuaucuaguacauuuacaaauguguuucacgugacaauaauguuuucaggaaacaucgaacuuagaaaagggaaaauuugcacugucagauguucuuucuuuauuguaauaaggagugccuagaacucuugaguguuuacagagaaaaguuauacagucaacaauagagagacagaaucucugaagucuuugcugaacuaaaugcaauggguucaguauaaauguuguauaauuuugcaaaccaagagcccuaaguuaugcuguuaauuacuauuacaaguccccuggcagcuaacuauaggcugaucucaagccuggaaaacuucuaugaugucauuucugcucugucuucaaacugggaauuucgcuucuuacacagguaagagcaaacccuuuacauacaaagauggauguuaagcucuucacaagcaaggacuguuuguguuuuuaaaaacaagacagccuccguucccaggaaagagcagcuaucuaacugcugccuuggagucagggagagcuaaacaggucccacaugaggacaaccauccaagaaaaugcauaguuccaguugcuggcaagauagaaaaggccacccucuuguccaauggcacaaaaggagcacauguuccuuauauacaggguguguugacaauuagcaugcaguaaguacuacccagacccccguuucaggguauacaaggaaaucuggaacuaccacauaccucggcaggcucugccauccccagagaagccaggcagacaggagcagguguaggaggaaccacccauauagaugcacugggcucgcugggggauaucacaguuguggagaccaguuucacaguaguugaugggacguugguccucggcagcuuaagaacaaagaaaugaaugugugccuuuagaagaaagucucagagcaggcagcuauccuuccaagcucucuacacaucagugauuuggcucagugguacuuugagaaggggacaaugucuggauucugccuggguccagaccauaccauuccaugcagucaccucuccuaccauugaaccugguuucaugcucuugaaguguucuaccaaugagcugcaucucuagcccaggaugaauuuacucuguaggccaaggaaaccuugaacugugaucaccaaccccaccuuagccucccaaguagcugaaaugacagaggguugcaggccugguuuguuuuugagcaguggaauccuuuauucaaacagauuaugcagaauuugaucuauagacaaacggaaggcuggacagggacgaggacaaggauuggcuugugacucaucugugcucuccuaggcagcuccuugaggcaccuccaagggcuccacaugcuuuaaaaaaugaucauguccaaucgccucguuuugaagauggagugcuaaggccugggagguuguuuuucuugcugagaacugaugucugggagaagacauugacacagccccaguggcucacccccaccccaccccugcucuccagugaguguggccuuaggaaaugggcaggcucaggccaaccugccuccuucauauagaucacagguuagaucucagugaggucuaacucuuccaccacccauauugagccaaugaguguuguugccuuaaaagcaaacuuuagaaccucccucagagcaaaccucacagggaaagaaaagucaggccaagaaaacugauguucucugcuaagacagaaaaaaaaaaauaguuucaacacagcaagcuaaaaucucagcucugugcaaugcagggcuggccuccugggugcacagauguuugguucccacucaaaucaugagaacugccuguucccucccgcccuacagacaccaccucauccagaccuuagcuccucauccaagcucugugacagagcaaagagaacccauguguacuacacaguaaacagucagggagcacacagggacaggacaaugacuggcacaguugguuucuguuuugacucaugcagacaugcaugcccuguucaucauguuagccuguagaucugggaaucuccaagaaucuuugagcuucaguucuuggaacuuggacugggcauaaaggguagggggagugcuugcugagaguguaugaggcuauagguuccauccccaguacugaauaaacugggcauggugauacaugcccgucauuccgguguccuagaggguagaguggggagauaacuucaaggucacucuugacuacacagugaguuugaggcugaccuaugaucauaucaugagacccuguuucaaaaaaaaaaaaaaugagccaggcggugguggcgcacgccuuuaaucccagcacuugggaagcagaggcaggcggauuucugaguucgaggccagccuggucuacaaagugaguuccaggacagccugggcuacacagagaaacccugucucaaaaaacaaaacaaaacaaaacaaaaaacauuaaaaaaaugucauggaaauaauacgccaauguuaaguggagggggggggcauuucaaaaacuuuguucuucuugacuggcccaguaucuuccuuaucaacaucaaucaagaacauaauuggccuaaugaauuaauaaaaucaauguagccuaggaagccuuaaaagcuauguuuuggcuugugguuuauuaaauuaagacuauaaacggaaugcuaccaagugggauaucccuucugauguaacucagguagaauucaaucuaagacagcuaagaacauaaaggugcucggccaugaauuccauggcugcuaaugacacagagaaugaagccuaacagcuucaauugccauuaaauguaugcugaaaaugggccgagcaaauguauaagaagcaagcaccacagaaagcugacagcaggugggaugauguaucgccagcaugugguaguguauauuuuauaaggacacucuuugauccuggcagccacgacugucuaaggaggucuucucaugccccuuguaaccagccccucucuguccgcaggaacugguaucugcuuccccaccaggaucaaaaccuguaacggggccuuucccauagagcuagcuuccccaggagauuuucuugcagcacuuacccacacauguuccccugucugagaagugguagcccucuacacacucgcagcggaagguuccugggagguuguugcagaccgcaugguucccacagcgggaaggcugcucugaacacucaucaauaucugcaguaaguugucgauaaaaaggcagaguuuuuaaaccucauggaacauagacaaauagaaaacauucuccucagagaagagauccauuugaagacacacuuuucuacauaccuaaaguaauauagaauagauauugguuuuugcccuuuacauaacuuaggauccaacccucaguuugcuuuuucuaagugauguguguguguuuccugcugaaugaguuaccaagguaugacaaaaacacauuggaagaagcagaagucugcucuugcaaggauccagguuugguucccagaguaaaaguaagcaaaucuuuaaaauaaacuaccuuucugcaguuaugauuauaaagaaaagcuggacaacuuauggccaauugagaauuuuuaguuacuuauuuaguguguguguguguguguguguguguguguguguacaguucaagauuuaggaucuuagacaguggacuuuggauggguagagaacagcaugggcuggagccaggguugaagauggggguucugccccccuccgccagccccugcucccacgcauagagcacaaucugucacaccuaucgccugugcucuguauugcucccagagcucucacagcagguggcuggaccccugugcugggcugcggucugaagacccagaccaaacagagcggcagaagagaacaucagcuuuccaucugaaagccagggccaagucacgaagggaacuuguccaagccccuuucuugcugggaacaucuacagacauggaagacauguuaugcaagaguagcagaggccacagcaggucagcaggaccuuggcagagugggguccaggaggacugcucccacacaaucaggucuguaaggauaagccaggcuggacaacacuguuucucuagggacaagacccucccaguguccccacuaagaucucauggucuuuacaguuuguaaauuguuccucaugugugauuuaaauccuuucugauuuaacugaguccaugaccuuaacccuuuguugauggacauuguagccugguaacuauggcaaccaucuguucauaguaccccauaacaucuguuugaaaaggauuuuucaacaucuggucaacauccuuucugaaaagaggggaaccccuuuuauauaaauaggaaaaucaugaauuauuuauuuuuauuauuaaaaaaaauuuuuuuuaaaccagguaucuucauguaccccaggcugcccucaaacucacaauccuuggugcugggaucacagauuugucccacacacuguuuggaauuacuuuuuaauuguuguuguugucauuguugugugguauguagugugugcgugugcgcgugcgcgugcacacaggccucugcaugcauguggaagucacaggacaacuuuagggagucagcugagacagggucucucuguuguuuuugcugugccguguacucuggcuuagcuugcccuugagcuacccagugguucucucugccucccaucuugcuguaggaguguugggaguacagguguaugcucccacauccagcuuuggacaugggugcugggaugugaacuugggcuaugagacucggacagcagccaucucaccaguucuagguuaauccuuugauuuuuuuuucccccacagugacuagucuugguacauuuucuacaaguuauuucuuuuauaaaugccuuacccuuuguggagauuauugacauguggaaugcuuucuagaaacucaaaaauauucccugaaauauuagcugaugcugcuacucuggauuacaauuugaaggguaugugagugacauugugaugugaaccccaggcaaaucacuaagcucugagauccaccccaaccccaaaacagucucuucccaauuacaugggaagcucacugagagacaguuagcuaaaaccagccucgcuuugcaugucacgggucaucuaucuccccccacagacuugaaccacagagguucacccuaguuccucucucaggaaucucccuggguuaaaacaacacgcaaauccagaugcuuaaugugauuucccgucaaaauccucacguccagaugcauuaacacugaggcucaucuggcaacucagaacagcagggagccugacucaggacagcuccacauuccacuaggcuaauauucuaggacaaugacugaccacagacaaaagcaagcacaugcauggacaaagcuggcccaggauuuccagggacaguggccgaguauacaaagucacagggagcggagagcaucugugucucuuaacaggagcacucccugggaugcaccaccguguacugggcgcugugcucuaaugaacacaguugacuguacaagauaagagggauccaagcaaagggugacugucacaacuucacaacagugugaguguguugaauagcacugaacugcacauuuagaaacaguugaaaacagccaggcuauguauaccucuaaucccaccaccugguaggcagaggcugggagaccuucaguuugaggccaaccugggauucucaaggagacccuaucuuaaaguaaaaauaaaaccaaaccagaaacuuugcucuauugcugagaaauagguuagggcugaugaugaaagggacagaacccccugacauuaccgaggagauagcaagugguuauacauaaagcauaaacaauucagguaugccugucaugguauguuuccaugucacacacucagcacauucauucuuguuacauacacccagcuuucugguuuacagaaccuggaggcuuccucccagccugauaugccagcaccucacacagcagaccccaaagcaguaccauagcaagucugcccgucuccucggaagccgauggagcauucgcaggugaacuguguuccagggccagggcgacaggcagcauugcugucacacccaugggugccaauguagcauggauucugaagggcaucaggggagccaucugugaagggagacacaguguucaagaaccuuccagaagcccugcugccacagggaguaagccacuacuguaaaagaacagaguaauggggaccagggcccucuguguuguacuacaaugggaccaccaagcuauacccuucauauauauauuagaagggaaauguuccccguaggcccauguauuugaauaauuggucaccaguugguaacgugguuuaaggagguuguggagucuuugggagguggcuugcuggaggaagaaaguuaccagugaaaaccuugacuuuacauccuggcccaacuuccagguaacccuuucugcuucauguuuguggcuaaagacauccucuccgcuuccuguuccagcugcuugcugccaccccucccccacaauuacagauggcuucucucuagaacccuaagguaauauuaucuuucucuuucauaaguugauccugguauuuuaucacagaaacagaaaagcaacuaauaugucuauacacuguagaauacuauuuagcccaugaaaagaaaugacaaccuuugauucugacuacauggaagagccugaaaaucaucguguugcaugaaaauaagucagacacagaaagacgaauguugccgggucuuacaugugggugcuaaaaauguugauuugacagaaggagcaugaauaauggcuaccugagguagggaaggguggagggguagggagaaggccaaaggaugguuaacaggccaagggugcugcuggauggcuaggucucauguuuuguggcacggugggguuacuaaagaugaaaacaauuaauuacacaucaaaacagcuaacagagaagauuuuaaauguucuccacaccgagaaaugacacguuucgggaaggacaugcccguuucucucaugugaucacugcucacuagacacgccuguugaaauuaguuagcucauaucccacacuaugaacaauuaucaaugugguccuuuaaaaaaauaauguuuuuaguuuuaaauuuuaaauagaauuuaaaaaaaaaauguucacuagagccagcaguaguagagccuuuggcugguuggcucugugagggaacucaucaggauagcauucugcugugauagcucaugaauaaauagcccagacacccccaugaauaggccuuugguugaaugaacaaaagcaggucuguuugccaagagccacugaugaccaugcauuuuuuucuuucacgggacgucugaccauccuuuucuucuauagacagagaguaagagacuaaaaccccaaauccaagaggcagagauugacagguaugagugcagagggcgcagagcaugcgcaaacgcacagccauguccagccugcaugagcucccuccuccuuaccccucacaggcccgauggaguugcugagggcauagcgcaagauccucuccuccuuguuguacaggacaaacacgcuguccacagagagcugcugggugcugggcagggcuggccuggcgucaucgugggcacacuccuggaaggugauggucugacgccacugguaaauaugggugugugagggugcagcgccguccugaucaggcuccaucaccguguacucccggguggaggaggaagugaucacugaggugugggagacagacagacagacagacagaugugaggaacuucaucaaaggccuugaggacauuaguagugagcgguuccugccuacaaugaaaucagaugacaggccugcuggagcaacuuaaacaggaccauuuguuugugccuggacugcuuucuccucuccuguagcagcaucagggauggcguuaguuaguacuugcugauucccaucaucuagagacaagugagguccaacagaaagagcagcggcucagaaggaggcacacuggccuccuuccucccaccacgcaccagcugagcuuggaaccaccaaccugguacuaagcugcuuuugccucuguuucucuugcagaaggaacuguggugagaaucugaugagggcacauuuguaaauuacauggaaucuauacaaucagcggcauuuggauuagcuuccauagaauuucucacucaggaaucaauaaauagugguugcucccaaccaccuuagauuacauagcucugugugauauuaaaagauacaauauggaacguucuguagcagccaauauuagaaauauuaucaagagcaaaucuuagccaaggagaggggagaaaguuucuuugcccagaaaaggaccaguauuagcccaggcaacaaagcccuccacuccccaccccgcucuguuaaguauaaaggcccuuuuuaucucugaguucuacugcagccugcuccauaugagagccaugaaagacagaggauaaauaaaaggccaguguccgcugucucccauccagcuccaugugcugacugccagcaggccaucuggcuggaggccgucuggggaccucagcgcugucucucccuccuuucucaggcucccagcccugagaagggaguugcagagcccuggccauggcaccacgugccuggaggaugcuuuaacaguggcuggcauuauuaaacaucauucuguuugacucagcaucuguuucuagggauugagccucaggaaagggucagaaagucaggcuugaugaugcaggccugcaucccagcuacuugggaagcugaggcaggaggacugcaaguucaaggccugcuggagcuacaaggaugaguucaaguucagucuaggcaacuuagugacacacguguuacguuccaaacgcugacaccauugcacacaccagcaagaugaugcugaaaggacccagauagagcugucucuugugaggcuaugccggagccuagcaaacacagaaguggaugcucacagucagcuauuggauggaucacaggacccccaauggaggagcuagagaaaguauccaaggagcuaaagggaucugcaacccuauagguggaacaacauuaugaacuaaccaguacccgggagcucuugacucuagcugcuuauguaucagaagauggccuaguuggccgucgguggaaagagaggcccauuggucgugcaaacuuuaucugccucaguacaggggaacaccaggaccaaguaguggaaguggguggguaggggagugggcgggggaggguaugggggacuuuugggauaacacuggacauguaaaugaagaaaauaccuaauuauaaaaaaaaaaaaaaguuaaaaaaaauucaauccggggcaaauggcucagguaccuauuuagcauaucaaagcagacacuagccagguucucccuacaucccuuaguuucuacaguccuguuacuggguccuccaagcuggcauacccccccccccccuuuucugaacucuucagcccaggggcugggcuguccuuccccagcugcucuucccuguauaauccaaccauuuauguuaccuccucucuuuguagcugugggccuccugguugcugcgccugguuuuccucucccccaucuccccuccccccucccucuccucacguggcacugaauccacucuggauucugucagacaucucugccucagacugugcuuucccucuauaaaauaaacuucucuuccaccacaccuaggggcagucaugucccuuccuauccuucuucuccuuuucauccaauacuaauuaaaaaauaaaaaacuaaaacuuuauuuaaaaaaaaaaaagaggggcugaggguguagcucggugguggggcauuugucuaguauguaugcaaggcccagggcuccauccccaauacugcaagagacagaaauuugacuaagaucuugggauguagcucagcauugcaguguuugccuggggagucaguucaggcccuagcagcauaaacaaacaaacaaacaaacaacagauggaaauguggccaacauucaccaugcaaaaggucauuucaacucaguggggauguggguggggaacuaguguaauuuauacuucugagaauaggaagaccaccgagaggacagggacagaguccuucaaagccacuuaacguaaccaguaaacauucaugaucggaugugauaaugaaguacaauugacuuaagcggaaaugacaggccaaagauuacauacugagguuccuaugcuaaauaccagaagccagaugugcuggcucaaaccuaaucccagcaugugggagacagaggcaggagguugacuuucaguuggagacaaguuugggcuacagaguuuuaaagauaauccugacuuucuaaauaauuuugaugggacuguguaagaaaauguucuuuuucuuaggacagaggugcuugaagcacuuaagcaaugaccuaugaggacaguuagggagaaggaaguguguaugugcauaaguguacguguguacguauguacaugugugugugugugugugugugucugugugucugucugugugugugugugugugugugugugugugugugugugcgcgcgcgcgcgcgcuauaauucagguagcgagugcuaggaacuagccaagcugaguaaguagcagauagaagcucuugcacucuuuucagcuccaaacagacgccagaaggaaaauaaguguaaagacuacaaauaaauacauuauaauaaaaucuugaauuauauaauaguggcgacauauaauauuaauauagaugguagacucuaggggaaaauugcaaaaauauauuuaaaucuuuguauucaggcuuauuuuguggaguucuuuuaugucauuuuguuuccuuuuuuaagacauggucucauguagcccaggcuagccuuaaacucacuguguaccugaggaugaucaugaauuucuaaucuuccuggcuccccuucccaagugcuggaacuacgggcauaugacacccgaccugcuuauguagugccagggacggaacucagggcuucaaacauucaauguauguaagcaagcccucgccaacugagauaguuccuacuccaguuucuggguguuuugguuuuugcuauguagcucaggcuggccuaggucagcuucccaagggcaggaauggcugaugugucccaauacaccuuguuuucuuuuuuuauauucaauucucuucaagcgugucuucugcagugcuuagggagaaagggauuaaaauaaagaauagccuucuguguuucccuuuacagaucccaggagacugccccaggaacucaaggucaucacagugggugggcacaggcagccuggcagccgccugcccugggacuccaggucugggacuuaccugagcuggaguagugguacaguucgguguagggcucaaugugcaccgaggcuccauaggggaucugcggcacgcggcccuccagcuccgugcugauggucagguguccauguucaucaauaccgcugaacugcugcuucaggaccagcuugccugggugccccaggaaggucaccucagcuugccggguaaacucgcccccuggaaaguaaaacaggccugucacccucccaucgggcaaguacacccuccugcuggcccuagguucuugaagggagaggcaagcgaacaacucauugugaccuggcuuguuaacugagcuagacuuagagcuacaaauguugugugguaucucuccauaaucuagauuuaaauucacauguucaucauuauguauuuaaauacguauuuauagaacacauggaaguagaaaggagagcaugaggagggaagaaaagagcuaaagggaugugggaagggacacguggauacuugugacaugaugggagugcuuucgggaaggaagagcagagggagaaggcaaaucuagugaggaggaggaggaggcagggcuagugugcccagcccaggacaaugggugaagguccugggaaugcugaugaguuuuauccagcuugacaaaagcuagucacuggagaggaaggagccuuaguugagaaaaugccuccauaaaaucgggcuauagacaagccuguaugguauuuucuuaacuaaugauuaaugugggaggagacagcccauuguggauggugccaccccugggcaagugguccugaguucuauaaaaagguaggcugagcaacccacggagagcaagccagugagcaggaccucuccaauggacuccauaucagcuucugccucuggguuccugcccuguuugaguuucaguccugacuuccauggugcuguggaaauguaagcuaaauuaacccuuuccucccccaagcugcuuuggucacuuagcuugcuuuuggucaugguauuucaccauagcaauagaaacccuaaggcaaagacuccuccacccugggcuccacccagcaucuacuuggaguugaccuuggaagaacaggaagaagacacuguaaccucaaguugagauccccucagugauccgcccacacauucacaaaagacucagccuucccuuacagggcauggccucggagagccuccaaagguuccugguacucaagaggaugguguugaucaaguuagauuuaccagcuagaaguggcaggcucuuuucccuggagauaugaagagguuaggccccuuucagauggaugagaugcaggaguugguaacucuuguucaaccuuggaggccuuucuauguuugugugcaggucucugcaaguuuguaugugugaggguguaucuguaugcucagguuugugugcaugacugcauuuuggacauaggggugaagggacgugugcaugguuguggguguggggcuauaccuauguguauggguauguguggcagccagaggucagccuuggagauuuuuccugucucugcuuuccuaaggcugguaucaucaguacaugccaucauaccuggcucucuccguggcuuccaggaaauggauacagguccuuaugcuugcaagacaagcacuucagcagcuauguuuccuccucagcaccaaacaugggggcuucuaaauccccaucaagaaaccauuccuccaccaaaauauaauucuauauggucuccuuuaaugaauaugcuauacaugaauuucuccugguccuuauuucugaggaagaacuagagggccccuguccacaaaugaaaugcuuccaggugucugcagacagagcuccaaacccauucauucucagaucucucccaugacuauguagcccauuuauucuaauugggaaugucaauuaccagugaugcuaaacccauucuugaacccauccugcuccacugcaaacauccauccgaugaugccuccaaugggugccagggggagcagagaguagccgacgguuucagggauggugcugauggcuguguaagagcgcccgugguucaucaccacauaggagugcaggucaguguucucaaacaccacggggaccuggcugcuccccacgaagauccuucccuucaccuugccauugacccguuguggagagccugggccagaaacaaaggaacaaggugaagauagcuuuccccuaccuuccaaagaggggaaugugucuguucauuaggaaagcaaagagguggcauugcugugggaaauacuugugauugugugccauaagccuggauaucccaaugccccugccucuguugcauguggcuacuaaugggcagaaugcuagguacccaccacugugcaccaggggccucgggauccuaacaccucucgucucucccacaugacugauaacagacagaauaaaaaccacacccacaaaugugcaucacagacauuaagagucccagcacuacauaagcauaaggaccccagcauauaaagagccugguguggcaauguacccuuguaaguucagcacuaggauggagaggaaagacgagaggacccuuggggcuggcugaucagcuucaccagcugguaagcuugagguucagugagagacccaucucaaaagaguaaguggagagcaagagaggaaaacaccuaauguggaccacuggcauccacaugugugcacauacaaacacuacacacacacagaggcauacacacagccaugcacacacagccacacacacacaggcacacacacagaggcauacacacacaggcacacauacacaugcacacacagacacacacaagcacacacacaggcaugagaauuauacuacaaaauaagaaaaaaaaacugaaggaagaaguaaguaaaaggucaaauuaaggucaccuugccuugcugaagucugacacagaauuacauucuuugcagguuuuuccuuucucuucuggcacaggagauugaguuugccaccaaacuccaccccauuagccucacaugauauaucauauuuauuuuucuagguugugacugaucagaaguauggccuccauccccuccucccagacacauguucauauuccuggacguuaucuauucucugaggaaagcugcuaaaugagaucacugaccaaucaggacauaucugacaugaaguaacucugcacuuccacugugucauuacacuggggauccuaugaccccuugcagguuaaugggggcggggggggggggggaaaugcauuccaagaacauuacagaaacaacaaaggaagccaaguuaagaaaggcaaauaaagcgcuucugccagacucuacgcuggccuuucuccccccugguuauuggagucagggucucucucauucaguagcccuagcuggccuggaauucaaacguacagccauccccugccccagucuccccaguguuaggauuauaggcaugagguaccuguauaaaaaugcaugccuacauuaaaaaaaaaaauuaaguagcaaaauccaacaaauauuucaaccccaaagcaauuacaggguguguacaaaaugucaagauguguagcugagcaguuugucacaccugagcucaaugccaguuugcuuagcauuuuuagcucugauaugggagagaggagagcuaaguggcccgagcacagcgcccccaauggaggagcuagagaaaguauccaaggagcuaaagagaucugcaacccuguagguacaacauuaugaacuaaccaguaccccggagcucuugacucuagcugcauauguaucaaaagauggccuaguuggccaucacuggaaagagaggcccauuggacuugcaaaccuuauacgccccaguacaggggaaugccagggccaaaaaugggaauggguggguagggaggguaugggggacuuuugggauagaauucuaaauguaauugaggaaaauacguaauaauaaaaaauauuaaaaaaaaaaaaagaauaugcuuugaggucgaggaaauggccccggugguagagugcuugccugggaagcacagggugcuagacucaauacccaguacccagggaugaacggaggagggaggggaggaggaagggggggagggagggagggagggagggagggagggagggagggagggagggagggaauacacuuccauguggaauuuggaagcuuuuccuagggcaaaggguauaaaggccaagccuagcacaaauacuuaaaagcaccccaccccuggggugacaaaauuuggaaggaaauaaaaaccaguuuaauguuaaaaacaugcuccuaaauuaauaugacaucuaaacugccuguugguucauugcugaggagggaugaaaauaaaacaaaucuuacucuccuuaauuaugacccagaaggaaacaauuuuguguguguguguggcaaauuaaaauaacugauuucaggauagcaaggguaaggagucuggaaacggaaccuacuucuccaacuagguuuuaguuagucagauuuuacaaagcaacugaagcccccacgugaagguagcuugugucaaaugaugcaacuugguggcaucugaagagacaauggccaaauacaagguucugucacuuuaauucauucuaauuuauagccccaaaggucuccaaugucugugacaaagacccuuagacuuacacaaaagaguccucugacugugugggcauagugacuagccaggccuuuggggacagaggucaaagcuaaccucagcuaucacagaacccgcuuuggggcuggaugcacgcugaguccgacaagcuagcacugagggcaacacccugucaucuucaccucaagcaugauguaguuucggggacaugaggagaagguagaggcaauggaaaaccugagccuacuacagacccuggucuaagccagauagagagggacagagcuggggggagggggaagaaggaaaagggaaggaaggagagaaaggagagagagagaucuacaagcaaugcacucagagcuagagacucaagccaaguguggggugcauaagugcagccccucauucacucuucagauggagaaucucaagucugaggucagcacaggcuacauagcaagauggugucucaaaagcaaacaacgaacagaguggacuccagagacaaagcuaugagugaaggaaaaugggggaggaaaaaaaagaguauauccugggaggaauguccacagggaauguaacagagaugacaucauuaaaaacugcacauuccagagaccagggcaaaggacacaucuauaaacaagcuccaagacccaaagccacucuuguccuucucugugaagcugaaaacgugcaggaacaguaccuuaccuucugccacgcacugucugccauugccuguguaguuggccacacaccugcagcagaagccaguagcauagucucugcacucugcaugcacggagcacuggugucuauuguuggcacaagucugcugggaaccuguguuguagcugaauacuguuuggaaaaaacaaaagcaaaccugucaaagcuuugcagguucucaacugagaggcauuuccacacagguguccuugagccaaauggacucgcaucuaccuaagaccuucaaggggccaagccaaccacagcaaacuaaagcccauggcaugaguguggccauuuggauuaagauaaggcucuauaacucagaucaccgauguaaacaagucuaaaagaagcugagaaaucaugcuuaaaaauugccacagauauaugugaguaugugugugcauguauuucauauauauacucaaaaguugaucauuauaaaaauacacacacacacacacacacacacaccaccaccaccaccaccaccaccaccaacaacaacaacaacaacaacaacaauuuaagaaaaagaggccauaaauuugaaagagaguaaggggggaguauaaacauggaggcuuuggagggagaaaagaaagggggaaaugauguaauuauuuuauaaucuccaaaauaaaaauaaaauuuagggggcuggugagauggcucagcgguuaagagcacugacugcucuuccaaagguccugaguucaaaucccagcaaccacaugguggcucacaaccauccguaaugagauuugacgcccucuucuggugugucugaagacaacuacaauguacuuacaaauaauagauaaauaaaucuuuaaaaaauaaaaauaaauaaauaaauaaaauuuuaaaaacagccaaucagaaacaauccuucgauuacaucucuucuaggaucauuugaccaaagacucaaaaaaaucccucucugguuuagauuuccaccacccaaguuuguuuuauuagacuugcaaaccugcccauuaaacuuaaugaucuagcuagagcaaauucguuuggaaugaaguucaaaaucucaagaggagugaccuucuagaaacaacaauaauccuguuuauaauugacuucaugagugaaggucaagaugaaaugcauccucagguagauucuauuggcugcaaguacuuggaacuuccaguguguacaaagaugagucaugacugaaccaaaaggcaccugaguaaacccgagguuuugugauugcauaagauccagccagcaaucccccauugaugggucugcuguguuccguguaucugagggcaaccauuuaaacaacaccagaauguuacuguaggccucagacagcugauguuucuaauaaacacagugaaauaacuugggaaagggaccaaaaaaaaaaaaaaaaaagccaucugucacagauacacuuugaguugaagucugggcuucugugacugucaccaccauuuguuguugggaguaaacaaaugugacaguuccauaaaugaucgcuucagauauuuaggaaggguagagggaaaaagauaaggcucaaaacuuaacaucuguaagcaaacauagacaauaacagaaccagaggcuggaugcugcugguggggaagucaggggaagucccuccucuucucuaauuccagagagcagcguuugugagguauaaggcuggagcccacgaaaccaucauuccauggaauagcaucguggucacuccuguggcucaguggugaucauaaauccccauguugcccauucuggguucucaguauggacagacagacaguaaugacuauggccaugagguccaucagaacaagaaaggagaaaucagcaugaguuagcaugacuuaguaggaagaauggacuaaacguuucuaagaaguuuuacaguaaccucuuaguagaaagagaaaaggguccuaugagauacauuuaaaggcuuaaaggcuccgcggaucucauuuagaguccugaugggagcuggagagauggcucagugguuaagagcccuugcugcucuuugaggauccagguucaaguccuaacaccugcauggcaacacacaaccaucuguaauuccagguccagggaaucugaugacuuuuucuggacucgcugggcaccaggaaugcacauacauacaugcagguaaaacacacauacacagaaaauaaaaauaaguaaaucuuuuuaaaauagucucaauugguguccuauuuuucuuccucuuucuaugauuuaaaaauuucugacaaacgcugggcaguauuggcacacacuuuaaucucagcacuggagaggcagaggcagcagaucucugugaguucaaggccagccuggacuacagagggagauccaagacaaucacggcuauacagagaaaccacgucuacaaaaacaaaacaaaauaaaaaacuggcaaaaagcaacuuaguggggaagaggguuuaucugucuuauaacuccauuauacaagucagaaacuuaaagaagucagucaggucauagcugacagguuacauuuuaagaaaggaauuaaugcaugcaugccuacugcucagccagcuuucuguacucuuauucaagucaacaccccaaaccguagaaggaugcagcucauuagaagucugggucuuccuacauccaucaaggcaauuaggcaaccacagacaugcccacaggucaaccugauguagacagcuuucucugacaaucuuuccaggugauucuauauuguaucaaguugacaauugaaacuaaccauugugccccucucucugucucucucucucucucucucucucucucucucucugucucucucucucucucucucucucucucucucucucucucucucucucucucucucucuguguauguaucucaugaaaaauaaaggcacauuuugagaacuucuuauaauacuuaaagaaugcucaaguaauuuuccucaaaauguaggaaauaugguuagaauauaucacacugugcagugcaugcguagugguucacaccucuaaucccagcauucagaagacagaggcaggcagaucugaguucaaggcuagggcuacccuggaaaaaccauaacucagaaggagaaggagauaccacauuguauaaaacuacauuuuaagagagauuugauguguguguguguguguguguguguguguguguguguguguguguaugagagagagagagagaguauucuuuagaaagcaacugcaacugacaggaggaaaaauaaucagcugcuugaauuccaaaaccaaaaagaaaaaaaugugaaagaaaagcagcauaaagagccaacggaguuucuagaauguuuuuucaggugggugaacacaucucagaagucacaaagaagacacuugaguuccaaaauauucaaggucuuuuaguuuuugagacaggaucuuacuguaucccaggcuagaaacugauucuccugcuucugccucuucaguguugggcuaacagcacucaacagugaucuuuucgguuugggguuuggguuuggagacaggguuucucugcguaucccuggcuguccuggaacucacucuauagaccaggcuguccucaagucacagagaucaaccugccucugccucccaagugcugggauuaaaggugugugcugccacagcccagccaacaaugacauuuuaaaagaacaaacuguauuaagcagauuaugguagugccugggaagcaaaagcauccggaucuccaugaguucaaagccagccaagucuauguuaaaucccaggccauccaaaccacauaaaugagacccugucuuauaaaaagaaauaaaucucucugucuguccaucuauccaucugucugucugucugucugucuguguuagaggacaguuugagggagucauaccucuccuucuacuaugugggcuucagaaggucaaacuuaagucaugaguaccuuuaccuguuaagccaucucucccuggcccugacucucuuuaaaauagaauacauuaugagaaaucaugaaaugaggcauacucccaccguguccaaaaccaaaucucuaauccuaaaagaucacugggucacugagaagucauggggccuaagcacccauugcucuccugugaaagcauucagucucugcucccucaggcuauaugccccgcccccauaaagucaccucauggggcacaugacccacccuacacuagccaacuccugucuagaaaccaagcaggcaaauacauguuccaacucguaaaauggaugucuuaccaacuccuguuuccucuacuucauccacaucaaugaccugggggugaugcugagggaaccucuccgcuggcagcuggaaagaucugguccucucaguggggacuccacggggucucucuguagccucauagccaggagagaggauccuagguacauugugugggucaggguauccccuucuuggacugugggagggggagggaguggcuacauccuccaggccaaggugagagguuacuaggucauaaucuucaucuucauagucugcuccaucgucguccagguccagguucacaucugcagacaccacgcccuuggcgguagcaggacuuccaaucucaaacacccacacacccuggugcccagcguugcugcuccuagaggcaaggaaggcaucuugagaauaggccacagcccacaagcagcccccacuuaccaagcaggcaggaggagaucaguaaccuauguccaucugaaagguguggcaugugucuacccuuggcaagggcugcuguccaggagggcagcaaugccaugggugguuauccaagaacucauacaggcagggacuauuuagugagacugaaucuaaauagacacaacaccaugaagagcuuacccucuagggugggucccaggacaccaaacacucucaaugccuccagcuuguacuauucacaguuuauaugcccugucucaugagggaccagagagucauuucaccacuauguucuuuuuauugcaugaaguaaaaccuacuuaauuuuuuugguuugggguuuuugguugguugguugguuugauuuuuguuuuuugagacagaauuucucuguguaccaguccuaacuguccuaaaacuaaauuuguaguccaggcuggucucaaacucacagagaucugccugcuucugccucccuagugcugggacuaaagagaugcaccaccuugccuggcuaccuugguuuuuguuuauuuguuuuguuuuguugauuuuguuuuguuuuguuuuguuuuuuuacacaaacacauaaaacauuuuauuaaaucaauaauuuauaaauugugaacaagaaauagcuaaagcaacuagaauuagaauugauauuagauuacaagaucaaaagagcuguuuucacaucuacauucuagagauggcuaacacagacaagcaacuaaaacaagaagcccaauaugacucauuuucucagcaagacuacugcuaucuggccagcagguuaucucucuuaucucacuuccuuaaauauuguuuuuuguuacauguuguuugaauuucuuuucuuuuauuacauauuuuccucaauuacauuuccaaugcuaucccaaaagucacccauacccucccccccacuccccuacccauccauucccacuuuugggcacugguguuccccuguacuggggcauauaaaguuugcuuguccaaugggccucucuuuccagugauggccuacuaggccaucuuuugauacauaugcagcuagagucaagagcuccgggguacugguuaguuuauuauguuguuguaccuacaggguugcagaucucuuuagcuccuuggauacuuucucuagcuccuccauugggggcccugugauccauccaauagcugacugugagcauccacuuauguguuugcuaggcccuggccuauuguuuuguuuuuaagacaggguaccucacugcccugggguucacaaaguagacaagaauggcuggcaaaaugccaggggcccauccaucucaacuucccaagguuggauuuauaagcagacaccaccgugucuggcuuuuuauggggguauggaaauaguagucaggucuugugccaacugaaccguuucucuaguccuguuguguuugggggauuuucuuuuguuuuacuuugcuucgcuuuaggaugaauuuuauuauuuauuuauguauauauauguguguguguguaugugugcauguguauauauauauauauauauauacauauauauaugugugugugugugcauguauauauauauauguguguguguguguguguguguauguaugcauauauagauguauguguaugucuauauuuguauguacauguacaugcaaguucccagaguggccaaagagggagaucagaucccuuggagcugagcuggaguuacagaagacaaaauggggaaaggggauuaggcuaaagaauauugggaguuguaagauuuuuaacucuuaaaaaccagucugggaccaggcaugaugucuuacaccuguaaccccagcaccuuggaggugggggcugaagaaucucugguucaaggucauccauccuucucuauguagaaaguuuggggacagccugggcuauaugagauccugucucaaaauaccuaaacaaaacaaaaagccaauaaucuuggcuaucccucucuuuuguauaauauccuguuaucucuugcuucucuacacuaacauuacaacgaggcuucacugcgugcaguaaagaacuguucugcaucaguguggaggaaaaccacacuuaguuuagguuccuggcaggagacagguuuaaauuuccauuauuucugacuucaaacucagaggacacaguagagacaguuuugcaugaaggugcacucuaaauaacacacuacuggggcuagagagacagcucagaaauuaagagcauugguaaguccuccagagagacccucuggguucaauucccagcuuccaugugguggcucagaaccaucuguaauuucagucccaggggauccaauguguuucuagucuccacaggcacugcaugcauaugaugcaaaaugcuaauacauacaaauaaagaugaaaauaaacaaaagaccucuucaugcuaaauaaauucccuaagauucaucaggaaaaaaauacaguuucaccauuuaaauaucucucuauaaaauuuaaaucuauaagaacauuuuuagguaauuuaauacuuacuacauuuuguuugguaaaacaauauaauaauauaauuaaggggaaucuaaugaagaaaaacaaauaaagaauaugcauacuuagccaaauuuucaauugauucucugucauuggcaaauauguuauaggcuccguugcucuuccauagaaauccuacuagaccuuugcugaaaccaaccacagcagguacuuggcuuucauccuucuucgagaauguuguaaagaacuguagaccaucuucaggauaaaggaaaauggcauaggagcuggaauuugaggaggccagaacagccuggaacguguuucucugugaagaugaguuaaaagucaguuucuagcaauacaaccauacucucaaagcaugcuguucacuggguuccuuguagaaaggacaggggagagccagcagcacuccaccucacuuuccuacaauugagacugugccgucuacacagagagguggaucuauagacaaauauagccuaaaucugaggacagauguuguaacagagaugcgugcagcgugcuacauguaggucaaaugaggaagaauccuguguuggguaggguagggguaguucuugggaagcccgugauggucaaggcuucacaggagggccuggguuuacaaucaggaggaggucaugucaaagacaaacgacagugaggcaaaacauaccagaacaaaggaaaagguaugcuucaggcaaauauaagagcuugauauaggacuggagagauggcuaaguaguuaagagcacugacugcucuucugaagguccugaguucaaaucccagcaaccacaugguggcucacaaccacccauaaugagaucugaccccccucuucuggugcugucugaagacagcuacaguguacuuauuuuuaauaagaaauaaaucuuuuuuuaaaaaugaaauauaucuuaaaaaaaaaacaguuugauacaacugcugaagaggguauauggagucuuauuagguuagucccaagaggcaggcaagagcugaguauccuugggucaggcaaucuuccaauuuugcaaagcauaugagauaugcagacccaccacaggccucuccaaaauguguucuguggaaugcuaugugucccauggaggucagugauaagaggagauaaggcuaagaguuuggggaucguuccauuaagugucaguaaggcagcuucuuuacgaaaggacuuuucuccacucaggaggggcacguugaucagaaccuugauaucuagcauuuccuauuaauaacuucucuauaauuagaagcuaucgucccacucuuucucaauuaaagaaggaacacagguacuauuucccaggcauauguuugccauggagcaaucuccucaaauaccuggcuuucucaacaucagacagucacagaagugauucagacagcccuacagauaagcaucuggaguuugcugaccugcaugcaacaggcaaauuucacuggacuuugcucuagacuuccugucuugagcaacaggauaggcauguuguccauuggaacaagcgcaaagacuacagucaacauaccagaccagauaccugcaucuccauguggggugcacucaccuugccuuccucggcagggcugcugcugggcccuccauaaggggccacagauucccaagugacaaccaccacacuagugggcuggaaagagaccuccgggaagccucucuggacauacucugcugccaucugaauaaugaacggggauaagucuucucgauaauacacauuccccaggccaucgguuguguccaagucagccaggaaaggcgcuacugagccgaagcugggugggaagguuccgggaugguauucuguggcuggggguucgcucauggcgaugauaccauuuguggugaccuguaaggaaccgagugugguuagagagaaugcaaagaugaacuccuuaagggaauguuaggguucgauuuuaaaacaaucucuacaaauuuuccagcuggugguacuauuuugagaggcugugggaucaugagccaccacuggagccugucugacugaaggagaccaccaagaacaggccuuugcuccuagcucccgccuugcucucugugcucuaaucagcuaucaugugaacagccucugccacagggucucaucacacagacugugcagcuucacgaugcuccacgauaccuuccccacuaugaugggauaaaagcucaccagaaccaugagccaaaauaaaccagccuuuccuccauucaguuguugcuaucaagugguuagaacagauacaaagacacagauguaacuaacacagcaagugaucucucccucaccggauacuguugcaguugcccguggaacacaaaauaaacagaaugggagaaagugauaagucugacuggcaaaaccaccaacaugauacgcaggugggguggggguaugaaggauaugguagacaagaaucuuagaacaugaugcagggugcuucaugucaagugugucaaauacgggcagucucucaaauaucuccuuucccuucuguguccuccugaccaaaauagugagagcaacagagauuuguugacugccaacauuauccaaaugacuaauuaacucugcaagggcuuccacacugggucaguguuauaccacucuugguaccagagagagcuggauacagccccacuuuaaaggaacccaaaguccaaaggaagggaaggcuaacacagaugauuaaaugaauguguuaagagguaaaccugcauacuguugauaacuacugugacuagcuuagugcauaaaauaccaccuaacagcauuaacaguucaccacuuuguagguagcaucuaaucuuugggaaaacaccagaaggcuaggugucaccgguacccauauuucucuaguaggaaaauuaaguaaagcaauuaacuuguccaaagucaccauauauaaauaacaucacuggaauucugacccaaagaucuugacuucaaggucagcuaucucaggacugcagcucucaguagaauuccugccuggcuacacgcggccuugggcucaauugccagcaguguauaaacugagcaugguaguauaugcuggcacugggaagguggggacaggaggaacucaaggucagccuuugcuacaucaugaguucaaggccagcuuaaucauggcauguauagaguucucagaaucucuucuaguuuuuaaaaaguauugucacugucgugugucugagaggguauauggaagccagaggucggguugcuuuccacuuuauauauuuauuuggagacauagcuuucauuccccagaacaugauaauaagguuagagaugguggagcugauuccaaccuaggcugguaaaaaacaaacaaacaaaacaaaacaaaacaaaacaaacaaaaaaccuagagcuuuggaacuuaacaaaagcaucauuuauuuuuaauuaaucaauaaauuuaauuaauuaauuaauuaauuaauuaauuaauuaaaggaguccugagaauugacuuuagggcuucacacucaggggcuaagccacuuccagccuucugaccuugaacuucugaccuuccugccuuuaccccacaagggcuaugauuacaggcauacacuaucacuuucaauuuauaccaugugagggaauggcacccaggacuuuguguaugucaggcaagcccucuaccuacugugcuacauuccccuguccuaaaaccaucucuuuuuauaaaugucacaggcuauuaguuuuaccucaaguaacauauuuuccaucacuuggcaacaguaagauucuuccagaauaaauugacagucugcagggaugggagucaggcaagaugccuccugcagcccaguucacagcaucuaaccuccuccagcacaaacaucccaacugcugugaugggggagcgugggaaaccgcucacuuucucaagcacacaccagacauuggcagugacuggcugcugguaggaagcgauccugcggagaccacauauagacagcuccuuuccacaaggcuauuuuccaaagacauucaaaucauccaacauccaucuauucuuuggaaucugggcacuggacugacucuauuuucacaaggaaugcuugccuuagaaaucaauuuucaugcaaggaccuugggugccuauuugacgccagaucacauaacucuccuugguauuauuacugggaaagcuguuccuucagcccguuugaccuucaacucagacaucugugagaacgaagaaagccaaacuccgagagaggugcuauaagggggcuaaaucacucgguuucugaugauuccuaacuucaggcuucucccuuuaagcuuuuuauuuuuggaaaugugucaaagaauagccagcuugguggaacaaugucucccccugucaggcaugaagcuccccacccagucggaaggaaccaugcagcuggccauggcugcauucucccaccuguagcaacugggacacuuggaaaguaucuuggcuuuggcuuguuguuuuguuguuuuuguuuuggagagggcuagccugaaacuaaauaaguagcuaaggaugaccuugaacuccuguccuccugccuccaucucccacaugaugugauuacaggccugagucagcugcugguuuuguuccuuugccuuucuccuucccuacagucccagcauucccagugcugacaccugggcucccuugacugguccacccaguccuucaagcagcuacucagagucuccuccaccaccacaggugccuuucacaggcuccuccucaaacuucacuccuccucccacacuaccucugccuccuguucccuuaagcccuguuuguaggcccuugcccuaugcacucagaaaccaagggucagugacccucugucuuagucaucacuacaguuccaaagcuuauacaucaccuaauguccccuccagcuucuugacuuccuccacaguacagggcagggacaagaucugugcacgcaggcuacuuuggacgugccuggagugagccccacugaaucacacagaccagagaagggcagcccuauagucccucagagugcaagggaacccacuuggugaggcuucauuuacaggguuccaggcacugcaugcacugggugugauaaucccauccacugggcgcuggagucaggaaaaucaguuguucagagacaucuccugcuacagaguuacaggccagugugugcugucuuuaaaaagaaagaagguccuaagaaggauguauauacaugaaguacaguuugacuagauucugauuuaagccucucacugaaaaagaaacaacaacaacaacaacaacaagcuaaguguuuugacucucagggggagaggcaggugggucccuuugaguucaaagccagccugaucuauauagcgaguuccaggauagccaaggcuacacagccagacauuguugggggugggaggggagggugggcagcagggugggggcggggggaggggggggacacacagacagccagagccagaaggagggaaagggauuacagauuacaguauuuagauguaauugugaucuucuuguuuugcuauuuuuuaaaagggucuuuuugagacacauuccaaaauauuuacaaggaaauagaaugcuuaaaauuugcuuuaaaauaacccaguuuggggcggagaagggaaugcgacagacaucugggcuauaaaugaagcaauguuagucagaggcugauauuugucgaagcucgguaauggggaugugggaguucacucuguuuuauuuuuuaauguuuggaacuuuucuaaaauaagcuuaguuccuccaaagagguaaguauuguguagcuuuucccgaggacacauaaaggaaaauguauucaugggcagguaagagugcucugugacuaaaggcauuuacuugcugccaagucagaggacaucagucccaucuguagaacccacaagguggaagggaaggaaacacucccacaaguggucuccucuggucuccauaugugugcuguggcaaugcacucauacacacgcguaaguguaauaauaauaauuuaauuaaaucauuuaacauuuaauuaaacauuaauuuaguauuaaacauuuaauuaaaaaauaaaacaccuaauuaaaaaaaaaaacuuuuccaagaauguucccuucugcagcacauguacuaaaauacagagauuagcaugcccuaaagaugacaugacaagcuaaaguguuccguauuuuaaaauaauaacaaagggcuggagacauggcuuagugguuacaaggauaugcugcuuuuccagaggacccaaaguuuaguuucagcauuuaugucaggcagcuaacggcuaccuguagcuccaguuccagggcaccugauaccucuggacaccaggggcaccugcacucaugugcacauauccacauauagauacauacucauacacauaauuaaagauaauaaaaauauuuuuuugagacaggacccgagcuggucuagaacucacugugggucaguaugagugagaacucacugagguccacucaccucugucucccgaaugcuggggucaaagguaugcacugccauaccaggcuaaaaaguaaaccuuuuaaaaaauauagaaacuaaagccaggcagugguagcacacgccuuuaaucccagcauucaggaggcagaggcaggcagaucacugugaguuugaggccaaucuggucuacagagcaaguucuagaacaguuggugugugggggcagggggcuacauagagaaaccuugucucaaaaagcaaaaacaagaaauauuuguuccacucagauagggcaguaauagacugaaaaaaaaaugauucuuucuacaaggaaaugugacuaccauagacuuaacuaugccuggauuguuuugcuuguuauuuggcauggccagauauucuguaaguccuugcucaaugaaggcaagagcugugacagccccagaggaaacugccucacaacaaugauaaugagcaggauuguuuagaaaucagggcaaguagauaaaccaacauuaaagaucagucaggaguuggcccuggucuuugauuguuuuguuucccagcuacaaugagguauacuggacccaaagaagcauauaaauaugacguauaaacugugaaaugaugaacaccaucaagcuuccuaaccaagcugacaaacauguggggcccauggaccacacagggacucagaggcccacgaagaagugggguaaugggcggcggaaagggggguagccauaaaccuaaacagacacagucaagccugccaagaacacaccaugggacagggcauucucuucaaugagcagugccagggaaacugcauuugcccauuuaaaguaauaaggauggacuccuuauuuuauggcacccacaaaaaauuaacuguaaauggauuaaggacuuaaauguaaggcugaaacaaacaaacaagcaagcaaacgugaagaaguguuccuugacauuagucuugcgguaaauuuuggggcccuggcacccaaagcacaaacaacagaagcaaaauuaaacaagaggugagcacugcugcuuggcaucuuacccagccaggccucccuccucaccacccagccccagaauuaggcauguuacuuguccugugccaaugagcagaaggcucuggcaaaagcaaugccuauugauuaaaguccaucaaaagucacacaauccuguggcauuccagaacugcuccagagucuagagaaaaucuaauauuaacaaaagcauugugcagcagacaccaauguuguguccaccauaucugugcuaaagucugaggcuauagcucaguugguagaagguuugccuaccaugcaccaagcccuggccuuaaccuccagcacugcaugaaacaggugugcaccuguaauuccaggacguaggaggguaaacagaggaggagcagaaguucaaagccagccacagcuacauagagaguucuaggcuagccucagcuacaugagacccucucacacuaaacccaaagcaggacugaagaguaaagugccugucacaugggcacuccugcagggaggagaugggaaaaucucuggaagcucucugggcagcaagcuagucuagcacauacaguguugaacaagagcucuaucucaagcaagcugggaagugaggucccauaccugaggcuguccugauuucauguguaccauggcauccauguaccccauucauacauaugaacacacauauaugaacacauacacacaaagauuuuuuuaagcaaacaacaaaacacaaauacccuaguuugaacauguuuuugagaaaauccaccugaaucacagaauaauaauuaagguuguuauauuauuauggaaacagucacuuaguuaucacagauuaacuaaaugaauagaagccuggcccuuuuugcuuucauuuguccauacucugccugaagauauggagaccaagucaauaucgguaaccuuuccucuugcguucuucugaauuuccacaguagcaaacccucuugggacagggcccugcccaaccccuagucccaugcccuagaggaggguugcuauccauggcuggagcaggaguaaacaucugguaggaacuagacugacuccuucuuaaagacuuggaccaccucacagaaccaaggugaauaccaugaucagcaagcucacacccacauuggcauuguuaaaucacagaacuccugcucccugcucucuuucucuguugaaucuaaagcucacaucagcaccuagaaaguagagggccacaguacccuuuaucugccccucccccaaguguggccacguugagugaaccucuuuucucuaccuuuuagcauuacuaaaucucuucuauuuauuguagaugggugccuuggguuugggggacuccuggagcccucuuucccugaaaauuccagugacaacuuaacucaaacucacaaaacauugccuaagaaacauauuugaugacuuuguacuacagaguaaaaacgaauucacugaaaaccauccacuuccagcauguggaccaacgcagauacugcccuagagaauucagauauugccacugcaagauuuaacucucucauccucacauacaccaaaccaccuggcuuuucaucacgugcccuggaaaaacccaugucaauuauaucacacacacacacacacacacacacacacacacacacacacccuacaugagcaacagcuggaaucacuuaggucuaauuguuucaacucaacugcagaggagguggucagagccacuuggaauggaagggugcuuccuguuuuaaaagcauucccugucucuuuuccaacauuaaugugaacauucagacauggggaaucacugggaacggucuuugcagacagucaauggaaggaaaucaugucagauuccacauaaauacaccgaagagacaugcaucuuaaaugcaacaaguggcaguccccagggcagccuacaauccucgagggagaggccuucuccagaacaguggaaugcuugaggcaguggaaugcuugagguagacccaaauaagaaacagagcagcagagaaacacaaauggcugcacggguagacaaugaaacuugaagaaagcaaacucccugggugggagauggugggaacucaggcuccgagaauuuacaauaaauaauggcaagggaacaaacgugucuggagugugugcugagugugagguccuuuccuauggcugugcacauuuguaaacguuuaacauaaugggcauuccauuacaagucugcuauucacacauauguagcggagaacugacaagcccuuagcuuaacauguucacacagccacugggugaagcagcagcucacaucugcaggaugcauacccagacaucuuucuguuuuuauguagcugcuuaguuuagggacauggggcauaaaagaggagguugugcugaggggagggaugucauguuuccaacuagaaacagcuggaaaaugggaagggcccaugaaaagaaaaagcauggaaaaaccaagucuaggaaauauccaaaccuauuuauaacagagguggacauugauuucagagguaaaccuggggccugacuguccaccugagcacagguacuuagacccuucaaaugcccaagagcacugacuccucaccuggacccucaaggucaucagaagcagaaggaaagccuaccacccugguccucauuucaugucuguguccuucacuuuggcucauaacugcuugacucugcuccaugauccaacucauuccccuucaaggcucaaagcacaggcauaggcccucauccuaaaccugcagccaccaucaguucccagagaagaacgucucaauauagccuucauucacucucagaugaagaugauuauccaugagggugaggcuguacccuggagcagaagugagcaucucccuaagaauauuuuguccccucaagcaauaagaacuucuuugggaccaccuagcaauaaguucuucuucaggacuaccuagcaauaaguacuuccucagaacaaccuagcaauaaguacuucuucaggaccaccuuugaguauccagaguugagaugaugauaaaggagccuauaccaagaccagacugcuuagcuaugcacacuucuugcccuaauuccuucuguauggaagccaguagcccaacaugaggucccuaguucccuuuaucuaccccucugagucucaacauggccacauugaacaaaucuccuaguugccuuuugccauuauuggucuuaguugguauaucaagacagguggccgagcuucacuaguugggcugccaaagcucuggccuuuacccuaaaaacuccaacuacuuuaccuuccugucugaagcaguuauugcucugacaauucauuaaaccucgugagguggguagaguguccccccucacucuuggcuugaggggggaaaaugaacuucagcuuuucacuugccugaggccagacacugcaagugcagagcacuccaguacuccagauugcaaauguuuuccauuaacacaugagccagagaaaauggcucugacuuaaauuagaaauagaaacaaagggauuaccaaauaaagacagggacagccccagguuacggucaccauuugguuugguuugguuuuuuccaacuuaacccaguuuugucuaaugagagauuuucgauagcuugcucaucacuucuucgagagucucuaccgaggauaaucuucugacacaaauauugcuggccaggcgugggggugcgccucuguaaacgcccccacuagggaagaugaggcaagaugaacacuaugacuucaagacccgcaugggcuacacagugagugccucccaaccugggccacagaaugaaacucaaaagcugaagagucaaggucuuuaaaucuuaaccaucaaagaagagaugacuggacacugggaaaugccucagcagauaaaggcacugccugcucuuccaaaggaccugagucugguucccagcacccacacaauggcucacaaucaucuuaaaguccaguuucaggggaucugaugcuaucuucucgccuucauaggcaccagacauucauauggugcacauacauacaggaaggcaaaauguucauacacauaaaacaaaacaaauuaaccugggggggaggggaggggugacuuguuaccucuauccuucugccucuagaagaccagggaagaaaggaaaggcccugugcaagcccuaaucucuaggcaaagcugugugcuuccccaacacuaggguacagacaccaggaccguaccugggagccuguuccuacaagagguccuuaauucaagcuucaacaucgagggggcaagagcuccacacuugaugcuuuauacuucuugucuuuccaggauccccacccccggggggggugggggggguggaaaacacagccaauaagaaaaggcucuuuuugcauuauuuuucaugcaagguugcacaaggcuauuuccagcauguuuguaacagauuuugagcauauugccccccccaaagcccugcuacccucccgccucucaccccuuagucuuuucuguucccuagacaguuucacuucugcuucaugccugcgaugucaucaccugagaggugaaggcagaagaacaaggcuucaagguuauccuuaacuacguacauacuggaguucaaggacaaccaccaggaguauauaagucccugucucaaaaacuguaagcaauuaaauuaauauggugauaaggaugcuguccuaauuaggugauaaacaucauaaccaaagugccaugggaaagaaagaguucauuuggcuuacagguagggaucacagucaggcccuaaggaaaaucuuggcaugaacucaaggcugaaaucuggaggcaggaacuaaagcagagaccaugcaagaauauuaauuacugguuuccuccccguggcuugcucaguuugcuuucuugugcaacucaggaccacuuccagugggcccucccacaucaaucauuaaucaagaaagugcccauaaucaagacauucccauaggccaaccugauggagacaauuccucaacuaagguucccuuucuccaaaaaacucuaguuugugucaaaauuaauuagaauccaaacacaagaguaaaccccauguacaauucuacagcauggacgauucugcaaacaccgugcuguagcaggugucacccacaaaaggcuauauaacccauuuuucucaaauguccagaaggggacauccauggagaaaauagacugggguuccgggaggagaaaccaaaagugacuguuagacacagaacuugcccucaggcugaugaaaaccuucuagaauagacaucuacaguggcugugucauucucuaagcuaaaagccacuggauuuuuauuuuugcuuaguuuuuuaaaacagagacuccuuguauagcccaagauggugucaaccccuuccuccuuccucagccuucugugugcucagaucaacauagugugucaccaaaccuuccuuggcauacacuuuguuuauugaggggggcacucaugugccauggaugccuguggaggucaaaggacaauuuucagaagucaauucuuuccccccaucaugugguuucaguuugucagucuugauggcaagagccccuacuggcugagccaccucacugacccaaaccacauauauuuuuuuuaaaagggcaaguuuuugacagguguaguaggauuacagaauccuagcacuuagaagguagaugcaggaagaucaggaguucaaagccagcugcggguacauggugaauuaaaugccagucugggcuaccugauacucauaucucaaaagggaggaggcaauaugaauuuuucugcacaugaacucuaucucaauaaagcuguaacuuaaaaaaaaugagggggcuggagagauggcucaauguuuaagagcacugacugcuguucugaugguccugaguucaaaucccagcaagugcauguuggcucacaacuaucuguaaugagaucugacgcccuuuucugauguaucugaagauagcuacaguguacuuacauguaauaauaaaucuuuggacuggagcaagcagggccagagcgagugguccugaguucaauucucagcaaccacaacaugauggcucacaagcaucuguacaguacaguguaguuauauacauaaaauaaauaaaucuuuuuuaaaaauuggaagucaaucauacuggcucaaauacuuaggaugcuggggcauaagcauugccaugaauuugaagccauucuaggcuacacaguaaaucccaggccaggcuggacucuagaaugagacugugucucaaaaaaaccaaaacaaacaaaaacuauuaaggguugucagggauacauaaaacaagggaagaaagagguacacagggcucagaagagggcucagugggccaaguguuuggugcacaaacaugaggaccuuaguucugauccccagcaccacauaaaaagcugggccuggcagauccugccuauaaccuggugucagguuuaaaggggucaccccugagacagcagggggaccgcuguagcuugccagccacagcuuagucaaaacuucacuuuucacuguguuagaaagcucuuuaaaaaugaaacauugaguguauugcuagcucacaaaauaauuuuauugcuuuauuuuggguuuuuuguggaaaugggacuugaaccaagagccucaugcaugcuggacaagcacuagagcccugaacucucuccucagugcuucccaaucuaaaggauaaaguauucaguuuaaccugaaugcuuucagaauaggauccaaucaccauuuccaggaaauaccauaauggaauaacaaguuaaacuuuaggacaaagaaacaguggaaugcagaccuagaacauucuacaggacaaaaggcagugauucuuuaacaagagugaacaaaggggaagacacaacaauuguccugugagcucguuucugaaucucuggcuuaauaaggcuuguaaaaggcagcuuugggaauauucaagaauuuuuuucuuugauuuuuuuucuugugugugguuuuguuuauuuuguuuuguuuuguuuuuaguuuuauucaaggcagaaaaacucuguguaucucuggcuguccuggaacuugcucugaagaaccaggaugcuugaacucuuagaggucugucugacucugcuuccugagugcugggacuaaaggcucgcaccccacccccuagauauugaagaauuuuuaagcagcuugagcauaacuuggugguaaggaacuacugaucuggauaggugugguauuaguauaaugguuuguguugcucuugggagggagggguucuauguauuugguuugguuuggguuuuguugaugaugaugaugaugguuuuuguucaucuuuuguuggugguguuucuuugaaacucaauaucaaaacgcaaauucucaaacugaguguacuaacucucucauguaaucccagcauuugaaggcugggaucaccccuuaaaacaaaagcuuaaaaaaauauacauauuuaaaauccugaucucucccucucuuaguauacaaagcucaauacugagcaucagcugacucugguccuucucuggacggccacuccuuccaaucugucccccaaguaacauaucggagcugcacauaagguuagagagauggcucagugguuaagagcacacacugauacuguaaaguguaauucucagaagccaugucaggaagcucauaccuagcuguaacuccagccacccucuucuggccucugaggguaacugcauucaguagcgcacgcgcgcgcgcacgugcacgcgcaugcauacgcauacacacacacacacacacacaagaauauaauaaaucuuuuaaaaacucaucagcaacaagaauaaggagaagaggagagggccacuggggagaggguucagugaucaaagaacugaacacacaaaccugaaagccugaauucagaucccagaacccacacaaagccauguagugguagcaugucugcaaacccagguuccuauggcaagacgggaagcagagauagaaaaugcccaagacauauacccagaaaauguuccaacuuguaagaaggacacauguuccacuauguucauagcagccuuauuuauaauagccagaagcucauagaacucagaugucccucaacagaggaauggauacagaaaaugugguacauuuacacaauggaguacuauucagcuauuuaaaacaaugaauuuguugggcauugguggcgcacgccuuuaaucccagcacuugggaggcagaggcaggcagauuucugaguucaaggccagccuggucuacaaagugaauuucaggacagccagugcuacacagagaaacccugucucaaaaaaaaaaacaaaaaaaaacaaaaaaaaaaucaaaaacaaaaaacaaugaauuuaugaaauuguuagacaaauggauggaucugaaggauaucauccugagugagguaacccaaucacaaaagagaacacaugauaugcacucacugguaaguggauauuagcccagaaacuuagaauacccaagauacaauuugcaaaacacaugaaacucaugaagaaggaagaccaaaguguggauacuuuguuccuucuuagaauggggaacaaaauacccauggaaggaguugcagagaaaaaguucagagcagagccugaaggaaugaccauccagagacugccccacuuggggauccaccccauaaacaaccaccaaacccagucacuaggcagaugccaacaagagcuugcugacaagagccugauauagcugucuccugcgaggcucugccagugccuggcaaauacagaaguggaugcucacagucauacauuggacagaacacaagguccccaaugaaggagucagagaaauacccagggagcaaaaggggucugaagccccauaggaggaacaucaauaugaacuaaccaauacccgcagagagcuccuuggaauuaaaccaucaaucaaagaaaacacauaguggaacuuguagcucuagcuauauauguagcagaggauggccuaguaggucaucaaugggaggagaggcccuugguccugugaaggcucuaugccccagcguaggggaaugccagggccaggaagcagaaguggguggguugaggagcagggggaggggauaggggauuuucggaggggaaacuaggaaaggggauaacauuugaaauguaaauaaagaaaauaucuaauaaaaaauaaaauagaaagaaaaaaagaaagaaagaaagaaagaaagaaagaaagaaagaaagaaagaaagaaagaaagagagagagaacacccaagaaguucacagccagcuagccuggugcacacagugguaaacaaccaagagacccugccuuaaacagcauggaaggugacaacucccacccuguccucugaucuccacaugugugccauggugcccauacaaagauuaaaaaauugggagaggaaacaaugaccuuugacagcaguaaucacugcuguucuugagauuuacaaaacuggagaaagaucuugagaccaggugaccaggaaggucagacugguuucaugcugccaaaguccuugucugugagaaggcaccuaccagguagaugguccaguagcucauaguuccucuuucucucucugucucucugucucugucucugucucugucucucucugucucugucucucucucucucugguuuuggguuguuguuguuguuguuugugacagucucacuauguaacucuggcuguccuggaacaacaucuacugaagacaacugccugccucugccuccccagugcugggauuaaaggauuaaagguuugcccaaucacagccagauuaaucaacucuucucucaauagagaucucucucuaccaacaccucaaccaagccccugacuggcucccauuucaagagccaacggagucacccacaagagcagguacacaggugcuauuugcugcugauauaucaugaagaacacaguuuauucuggauacuuccgugaaauaaguauggaauuaauccacccuggcugggaaugaacauuggaaaagguuagcaaugucaugugacucccuugcuuuauagacuaaagugucacugucauggugugguguccacaagagucauggugccucuugccucuuuauguguuugaaacuuuauguguucggagaaagaaaaaagaaagaaggaaagagagagggagggagggagggagagagagagagagagaaaagaaagaaaaaggaggaggaggaggaggaggaaggaaguuaagugaacauucagggaccaagaacuaaguguguucaguaguugugcagcugugagcaucauaagcggcaggaucacacugcaugucacuccucacuguggccccaaacccuguagacuagggcucaaaacaagagcuaaugagacaagaagggguguugggagggagggagggagggagggagggagggagggagggagggagggagggagggggauggcacucaaucaugauguaaggaagacugggcugggggcugaaaaagacaaccauggucacgcccuugaccuuguauguuuccugcucugcaacuauggaccgcacagcuccugccugaaccccucccagggcugcggagaauaucaaaugcacacaguacuaacaaguguucuguuuccaucagcacagagucuggcucaaccauugaccuuaccccaccacacccccuaccuugacccuggcaacaggcuucuagccacuccccaccucuccacccucuaaaguuccucuuuccagguggguggcagaauaguuuuucaaaaacauuuuuguaaaacacuacuguuuaggggaauuuucaaccuagaauguaaacuuaccccaacccccucccaagcacacacccauccaucaauagcucuugcaauuccuagcacacuaucauuuguauuuucuucuguuccugccauacaugugugucagcucaggacacccaagaccacguucucagcacaaaggagaucuguuugucucagagggagcagagauuaagagacaaaggcagccaagauaaaggaccaggaagaaggggaagggagcaaggggaaggggaauuuguccuagaggacaaaugacugccucuagguaauggauagagaggagacagauguaggccagauguggcccauaaaaugauaguuuauaaaggcaaagggggaaacuccgagucagaaugagguguucaauuuuaauuggaaauguuaauuaggugaaccaaagguagcuuuugauugcuggucuucaauauuuugauggcuggaccuugguagucagccucaggaggaggaaauagccaaauaagggaacagaccuugcuggcuagcuuuaugaauauaaucuaacaguuuuuagcaaggcagaggggguuagggaaaagggcaaggccugccagagccauguaagucaggccauguaaacuggcuagaauuucuucaaccuaucuuuauguuuucuuugaaguuacuuugagggcagggagcauuuggugguaguuguuauguuuggcuuugggaugaggucucaucacauagcccagacuggcuuuaaacuugcagcaauccucuugccucuaccuccugaaugcugggauuacaggcaugggccgccaugcucugcuuuuuggggggaguauuuuaaaugaaauccuggauacccuaguauccuaccugccagcauuuugagcaguuaaacugugaggcccuguguuugacucucaacacagcaagaaagaaaaagaaaauugcaguuugucuggaagaggucuuugugcagccagauuguuuuaaucaggcuccaaccaggauuaacauucucuggagucucuuuuacagguucucucugcuucuuugacuccuaugcuaucuuauuugcugaagaaaauaaugcuagaggcuggggagauggcccaacagcaaagcaucugccauguuuucaugaggaccugcguucagauuccuagcaccuaccuaaaagcccgugccaguaaccccagcucugggcgguggagaccgcaggauuccuggagcucccgagccagccagucuagccaacugguagauuccagguucauacugaccucuguguugggaaaagagcaggguuccagggggucaggccauugaagagggugucccuagucacaggcaaaugcagcauacacuaaucacuccuggcaaggggccaucacaaggaccacucaguaggcaugugaucuccugcagauauccaggcacacauaagccacaaacagacaggcauaggcauacagaccugacaagccacagugaggugaacacacuggacgacagacagacacauagacaggcuggugaagacaaggcaaagacacagucuccugaccucaaggccguauuuauacaaagccuacacaaaggcaacauuccgaauggaauaguuuauauaacaguuuacaucucugauuacuuugagguuccccagacauccagugucagccaucuuuuguugacuuaugcucccaccccaugucuaucaccagucaucuugauccaugccagguauccauaucauugucauguugucuauacauaaacuaucccauacagcccauguuuccuauacuguugcaaacacacacacacacacacacacacacacacacacacaccaugucacuagcuuacuuagaaaugucaugugacucccuugcuuuauagacuaaagugaaaaaauaaguaagaguccagcagucauuuguguauugcuuagcuccacagcacucacuauggccaccuguccacacacacaccugaguguuggaaaaugacugucauaugacaguagagcccuguccccauagggcucagauuaacugugaagacagggcagcaagcaaaggaagaaccaagguauuccuucccaaaauauccucccaaauaaaacguuucauucuuaaaacuuacaagguucagcaaguucaggaaacuuacaagacucacuagacgcccaucccuaagcuuauaugcacaguaaacaauugcugugcagagacucuucuaugaagcagucugcaagcugugcagaagcucuauggauacaguuuuugugacugcccauguuaggugggcuuuuuaaugacugauuuuuuaguaacccgugugucuguaagcaacccccaaaaugguugguuugcugugcuagacuuggguggaaucauuucuuuugucucuuauaggggccacaucuggagaucagacauuuguucacaucuuuccagcaugccucaaggagugggcaaauauggaacccucuuggaaaggaugcaugaggccugagagcuagcagcaggaugggguaccucugggagacagcauguguguuguuccagauagaaaagaagugccaauaccuagauggggccauggaaguaaaauccuuugcuacacaagccuggugaugugaguucaaaaaucccuggagcccacaguggaaagggggauggacuccauaaaguagccucugaccucuccuccacucagugguacuagcuuaccuacaaucacacaugcauaccacaugcagacaaacacagacaguaauaauaacuaauaaaauaaaaaauuauaaaagaucuacauggaaugggugcagagagggaaagaaggcaugaguauagaggccacacuaggagggcaggcuauagcaugacagcuaagaggcaggccagaccggugcagacacacugaaaacaguaugaaguucaucaacuccaaaugaaaagcauggagcucugcuggcugggacccaaggccuguuauaagcacggugacugcagccuguaugagcaaccuccauuccuggcucuugacuggguuucaugaggagcaauaucuccauaucugaaccaugccccucccugucucuuacacuucccaaagccaaucuccaccaucguagcugcagcuaugauggggaacauuucuagacugcuccacuagcuugggcccugcuccaaauuguuccaacaugaacuucugccucagaggaugcagcacggcaugugguaacaguccuauuaucagugugaucauuggcugaaugucaccucucucaugacaugacacugugggcauggaaggcuggucuuguuuucagucuaucaccagccucagauugcgcccagcacacuaagaaguuaauuaaagcuggguacacaccuuugaucccagcauuuaggaggcaaaggcagauagaucucugugaguuccaagccagccuggucuacauagugaguuccaggcagucagggcuauguagcgagacccugucaauaaacaaaauaaugaugaugaaaauaauaauaucuauagaaugaauggauaguugagcuuaacauuggaguauugcauauacauguacacacacacacacacacacacacacacacacagauggggcugggaauauaugcucaguuaguagaauguuugccuagcaugcauaagauccaaggguugagacccuagcacuacauaaaguaaauauggcagugcauaccuguaauacuaccauucaagacauagaggcaaaaggaucaggaauucaauccuugguagacacauugggaguucaaagccagucuaagccacaagagacccugauucaaaauaaaaaugguacuaauguccugagaaaguaagcgcaauuaaauuaaccaucagguuacuaaaaauaauagcaaugagucuuuauuucacucuuuaguccaggcuaucuuuggacucacuaugcagcacagguuggcgugaugucucuuggagugauggcauuauuacaggcuuguaccaccaugcaaaagaaaaaguauugaaaaucccaaauaaaauuagucuggggacaauuuuucucaaacuucuccauuccauuaaucugcuacuuuaucagaauaaugauuuggcuucaauuagaaguuggucaccauccaaagacugccccaccuggggauccaucccauaaacaaccaucaaacccagacacuauuguggaugccaacaggagcuugcugacaggagccugauauagcugucuccugagaggcucugccagugccugacuaauacagaaauggaugcucacagccauccauuggccuaagcacaggguccccaaugaaggagccagagaaaggacccaaggagcugaagggguuugcagccuccuaggaggaacaacaauaugaacuagccaguacucccagagcuccccgggacuaaaccaccaaccaaagaaaacauauggugggagucauggcucuagcugcauauguagcagaggauggcuuaguuggucaucaaugggaggagaggcccuugguccugugaagguucuaugccccgguauaggggaaugccagggccaggaagcaggaguggguggguuggggagcaggggaagaggggagaggauuaggggguuuuaggaggggaaaccaggaaagggaauaacauuugaaauguaaauaaagaaaauauccaauaaaaaaaagaaaaaugaaaaaaaguuggucacuauaauuagucaauuauauuucagucccugguggaauuaauaaccuuggauucugagauucaaccccagucauugcucaaccacugggaaaccugggggaaaugaggagcucgugcuucuccucgcagucccaggcggaagcuggaugcucaaggcuuaagacaggcuaaaaucgccaucuuccuuccugggccagaggcccugaggguggaacaucccgagcagcuucagauagcaguccugaagguccugugaggcaguaaguuaagcaguauugcccaugaacaacuagaagguugugugugcucauauguguucaugcacgugaguauacaccuauauacuauauacgauaaauuucuguguguacauauauaugcaugucugugcaggcacaugguccugugcguuuggaagccagaugucuguaucaguugucuuguucugucacuuuccuccuuacuuuuugagacagugucugucacugaaccuuggguuugcugauugggcuagaaacacggaccagcaagacccaggaauccucuggcuuugccucugcaaagugcugagauugcaggcuugcugcaugcuacuccugccuuuucuccccuggguucuggggaaucaaaccccaguccucacgguugcagggcaagcuuuuuagcccacaaucuuuuuguugcuaaagauauucuauucccaacuguauggaagguuuuuugaauaaaauauuaagucauaucuaacuugcuuauccaucuuuaugacucaugggcaaguaauuuaaucaucacuaaaaucauguccuagaaaucacucauugccuuacacgcccagugaggguggccagucaacaugacagcaagcauaccaacggagacaacguuccaggcaaaggcaggaaauguuuucauuccuuggaacaacuuuaccauaguuuucaaaaacucucacccagggaguuuaagguucauggaccagggcagcaaggcucugaaauuucuagugcuuuagugcucuggauggggcucagccccugcgugggaucuggugaaugacugguuuuauuggcuggacucuaaugaugaccguucaggaccauuccucuggggacucacacaucaugaagcagggagggauucugaugaggaccacaggagggcgcuaguauccaacauggcaccugccucuuccagaagacauucccaacaaugcguccuuccugucuuuauacucaaugucuugauuuuauauauuuaugaucagcccucgggaauuuugacuucuggagcccuuugaacauuucaguuuugaagauucccccaagaccauaaucaacauuuaaucguauggaaaggggaagcaaagaucaaguuaaauacuuaaaacacuuuaauaaugaauuugucacgugugaacaaaaacagcauuauuuuaaugcaggugauuauaguuccaaccaaaaauacauuuggagagggcuugagagauagcacugacugcucuuccacagguccugaguucaauucccagcaaccacauaguggccuacaaucaucuguaaugggaucugacgcccucuucuggugugucugaagacagcaacaguguacucauauacauuaaauaaauuaauaaauaaaucuuuuuaaaaauacacaucaugaaguauaugaagagaugagacuuuccuucacgugugugucugcaaaucaaccugauguccaacuauauggaaggcagauagaugcuucuucguuugccugugggaacagacauguggguaucaugcaucccguagugaacuccaucauacauuccugagcaacuaaagucuaaaagccauuggggucagcaagauggcacagcuugucucacagccugaagucuugaguuaccuaaaucccaucccugcagcucauaacaacagaagaaaacccauuccuaaggucacccgcccucuaggcuccacacauguacccauauguacacaugcacacacaugugcccagaugcaucaucauagucaucgucaucaucaucacaaugcuuaguaaaauaaguaacgggcuggagagaugagaugggucagcaguuaagaacauuuaacccagguuccauucccaacacagagauaggauccccagucccagcggggagucuguuacccucuucuggcacuacacauauguggugcucagacauacgugcaggcaaacucccauauacauaaaauacacauaaggggaaaaagacaaaagcaauaaacuuaauauuccuuaaaaucaccuccaucuucugaauuccuugaccccagagguccgugggccacacuugggagauugccucuuuggagcauuaucaaggauagcuguuauuuucagaacucuaaaauuaucuuaauucuguuugcuuacugagagaguuucuuguaccccaggauauccucaaacucaaacccgagauccucuuacuccucccuccucggugcugagagugcacgccuacaccaccaccuccaguccauguauguauuuauuuacucuuucccuuuguaaaccaaggucuccagccuuccuuccucucccagacuguuagcuugaagcuugagugucugcuagacacaggauacucuccaucugguuuccuugggggcuuccggcaccagaguuaaaucaggcccuugaccccuagcucugucuggcuuguuuggucuggugcuuugcuuguuuggggaguuuuuaaaauuaggaggagugaggggacacacaggauaacuuggaugagucagguuuuuuucuuccacuauguggguccuagggauggggguaugaaauuagguugucaggauugacaaauaaagugccuuuuacccagugagucaccucacaggcuauuuccuggcuuuuaaagacaaacuccacaguccaggcuggccugacuccagaacuuccuagccuuaccucccaagugugggauuucaggcaaguaccacuauggccccuacucauauucucgccucguguggaaucugacagacacuauugauacacuucagaucacuucucagauccacccuuuuuaauaguuaccaaacccauugcuccagcuuccacuacacauagugugguuuaaaaggaaacaagaggggccaguauauagugcaguugguagaguucuuaucugucaugcaggaaguccugguuuugauuccuaacuccucccuaacacaucccuaacgggggugggggugggggagugcgguugcugggaaagauggagaagccucaauacuacauaaaauugguguauaugcuuuaauauguuguguguguguuuuuuuuuuuuccaccacguuguuuucuuugguaagguggaggauuucauuguguguauuucaaagcaugcuaaaagucuauaggcuucuccgggcuucccacgguggggccagggcaacuagccagcaaaggguaagaguucuuugugggugugacccauucuuucuaggcaaagcugacaagcugcacguggguguugccccaugcuaucugcccaggccaggcugagagaauagccacucccccgccgucuguguaguccccccacacacacacacuuguggaaugcacgcaggcuuuauaucaaauccacauggugugccggagcagcacgaaagggcuugaccaggcuaacagcgcucccaggcccugccagcacuggggagguucaagggagcuaaaaggucaugaagucccgcuccucaucuggggccccugggugacacccucagccacaggaaauuggaucaccggggcgcccugcguucucaguccugaccucuguacucugaaaccagcccaacuaagagagcaaaaucucugccaagacguagccagaacccacgcacacagaugcaggggcuguccacugaaacucuggggcggagcaggaggguuccucuguccuuucuagcuugccaucggcagagucccuaggagcgcucacaggauacaacccaacucuggccauugagcugcaggguacugggaccugucccaguaggaaggcgagaagcgcacggaaucgagaaggaaaacucuacucgagguccccagauccuggcagggcgcgcgcauagaugaguggaucccggaggcagaugccacccuaaacuucgagugcuacuggggugacagacaagcaaugcgauccucuagaugcgcagauucaacggagagccccucacugggacagcuagcacucgggucccggagggcgacgcccaaguuccacaucugucucucuggacuggcgaccccagcauagccuggccuuccuccccucccggccccaacucacauagaccgacgugauguccguacgaucauagaagcucaguucuccgaucaguuccagggagggggauaccacgucguccccggccuccagcucuaggucccccugcccagggccgaaggggaagagcuccuggcgauucaggcagccuccgggccccacuaguagcagcagcugcaacagcgcccacguccacaucgcccaacuacagccgcucgcguccagcauguuucccaacuguggucccacaaucccggcgguuuagcagcucaggcggaggaggcgcagauauaacccuacgccccuccgcagucccuccucaccucccgccucccgucguccccaccccuggaaauggggaggagaaccgaggggcuaug

SEQ ID NO: 6895 - RNA, 8065 nt, Mus musculus
uauuacguauuuuccucaauuacauuuagaauucuaucccaaaagucccccauacccucccuacccacccauucccauuuuuggcccuggcauuccccuguacuggggcguauaagguuugcaaguccaaugggccucucuuuccagugauggccaacuaggccaucuuuugauacauaugcagcuagagucaagagcuccgggguacugguuaguucauaauguuguaccuacaggguugcagaucucuuuagcuccuuggauacuuucucuagcuccuccauugggggcgcugugcucgggccacuuagcucuccucucucccauaucagagcuaaaaaugcuaagcaaacuggcauugagcucaggugugacaaacugcucagcuacacaucuugacauuuuguacacacccuguaauugcuuugggguugaaauauuuguuggauuuugcuacuuaauuuuuuuuuuuaauguaggcaugcauuuuuauacagguaccucaugccuauaauccuaacacuggggagacuggggcaggggauggcuguacguuugaauuccaggccagcuagggcuacugaaugagagagacccugacuccaauaaccaggggggagaaaggccagcguagagucuggcagaagcgcuuuauuugccuuucuuaacuuggcuuccuuuguuguuucuguaauguucuuggaaugcauuuccccccccccccccgcccccauuaaccugcaaggggucauaggauccccaguguaaugacacaguggaagugcagaguuacuucaugucagauauguccugauuggucagugaucucauuuagcagcuuuccucagagaauagauaacguccaggaauaugaacaugugucugggaggaggggauggaggccauacuucugaucagucacaaccuagaaaaauaaauaugauauaucaugugaggcuaaugggguggaguuugguggcaaacucaaucuccugugccagaagagaaaggaaaaaccugcaaagaauguaauucugugucagacuucagcaaggcaaggugaccuuaauuugaccuuuuacuuacuucuuccuucaguuuuuuuuucuuauuuuguaguauaauucucaugccugugugugugcuugugugugucugugugugcauguguaugugugccuguguguguaugccucugugugugugccuguguguguguggcugugugugcauggcuguguguaugccucuguguguguguaguguuuguaugugcacacauguggaugccagugguccacauuagguguuuuccucucuugcucuccacuuacucuuuugagaugggucucucacugaaccucaagcuuaccagcuggugaagcugaucagccagccccaaggguccucucgucuuuccucuccauccuagugcugaacuuacaaggguacauugccacaccaggcucuuuauaugcugggguccuuaugcuuauguagugcugggacucuuaaugucugugaugcacauuugugggugugguuuuuauucugucuguuaucagucaugugggagagacgagagguguuaggaucccgaggccccuggugcacagugguggguaccuagcauucugcccauuaguagccacaugcaacagaggcaggggcauugggauauccaggcuuauggcacacaaucacaaguauuucccacagcaaugccaccucuuugcuuuccuaaugaacagacacauuccccucuuuggaagguaggggaaagcuaucuucaccuuguuccuuuguuucuggcccaggcucuccacaacgggucaauggcaaggugaagggaaggaucuucguggggagcagccagguccccgugguguuugagaacacugaccugcacuccuauguggugaugaaccacgggcgcucuuacacagccaucagcaccaucccugaaaccgucggcuacucucugcucccccuggcacccauuggaggcaucaucggauggauguuugcaguggagcaggauggguucaagaauggguuuagcaucacugguaauugacauucccaauuagaauaaaugggcuacauagucaugggagagaucugagaaugaauggguuuggagcucugucugcagacaccuggaagcauuucauuuguggacaggggcccucuaguucuuccucagaaauaaggaccaggagaaauucauguauagcauauucauuaaaggagaccauauagaauuauauuuugguggaggaaugguuucuugauggggauuuagaagcccccauguuuggugcugaggaggaaacauagcugcugaagugcuugucuugcaagcauaaggaccuguauccauuuccuggaagccacggagagagccagguaugauggcauguacugaugauaccagccuuaggaaagcagagacaggaaaaaucuccaaggcugaccucuggcugccacacauacccauacacauagguauagccccacacccacaaccaugcacacgucccuucaccccuauguccaaaaugcagucaugcacacaaaccugagcauacagauacacccucacacauacaaacuugcagagaccugcacacaaacauagaaaggccuccaagguugaacaagaguuaccaacuccugcaucucauccaucugaaaggggccuaaccucuucauaucuccagggaaaagagccugccacuucuagcugguaaaucuaacuugaucaacaccauccucuugaguaccaggaaccuuuggaggcucuccgaggccaugcccuguaagggaaggcugagucuuuugugaaugugugggcggaucacugaggggaucucaacuugagguuacagugucuucuuccuguucuuccaaggucaacuccaaguagaugcuggguggagcccaggguggaggagucuuugccuuaggguuucuauugcuauggugaaauaccaugaccaaaagcaagcuaagugaccaaagcagcuugggggaggaaaggguuaauuuagcuuacauuuccacagcaccauggaagucaggacugaaacucaaacagggcaggaacccagaggcagaagcugauauggaguccauuggagagguccugcucacuggcuugcucuccguggguugcucagccuaccuuuuuauagaacucaggaccacuugcccagggguggcaccauccacaaugggcugucuccucccacauuaaucauuaguuaagaaaauaccauacaggcuugucuauagcccgauuuuauggaggcauuuucucaacuaaggcuccuuccucuccagugacuagcuuuugucaagcuggauaaaacucaucagcauucccaggaccuucacccauuguccugggcugggcacacuagcccugccuccuccuccuccucacuagauuugccuucucccucugcucuuccuucccgaaagcacucccaucaugucacaaguauccacgugucccuucccacaucccuuuagcucuuuucuucccuccucaugcucuccuuucuacuuccauguguucuauaaauacguauuuaaauacauaaugaugaacaugugaauuuaaaucuagauuauggagagauaccacacaacauuuguagcucuaagucuagcucaguuaacaagccaggucacaaugaguuguucgcuugccucucccuucaagaaccuagggccagcaggaggguguacuugcccgaugggagggugacaggccuguuuuacuuuccagggggcgaguuuacccggcaagcugaggugaccuuccuggggcacccaggcaagcugguccugaagcagcaguucagcgguauugaugaacauggacaccugaccaucagcacggagcuggagggccgcgugccgcagauccccuauggagccucggugcacauugagcccuacaccgaacuguaccacuacuccagcucagguaagucccagaccuggagucccagggcaggcggcugccaggcugccugugcccacccacugugaugaccuugaguuccuggggcagucuccugggaucuguaaagggaaacacagaaggcuauucuuuauuuuaaucccuuucucccuaagcacugcagaagacacgcuugaagagaauugaauauaaaaaaagaaaacaagguguauugggacacaucagccauuccugcccuugggaagcugaccuaggccagccugagcuacauagcaaaaaccaaaacacccagaaacuggaguaggaacuaucucaguuggcgagggcuugcuuacauacauugaauguuugaagcccugaguuccgucccuggcacuacauaagcaggucgggugucauaugcccguaguuccagcacuugggaaggggagccaggaagauuagaaauucaugaucauccucagguacacagugaguuuaaggcuagccugggcuacaugagaccaugucuuaaaaaaggaaacaaaaugacauaaaagaacuccacaaaauaagccugaauacaaagauuuaaauauauuuuugcaauuuuccccuagagucuaccaucuauauuaauauuauaugucgccacuauuauauaauucaagauuuuauuauaauguauuuauuuguagucuuuacacuuauuuuccuucuggcgucuguuuggagcugaaaagagugcaagagcuucuaucugcuacuuacucagcuuggcuaguuccuagcacucgcuaccugaauuauagcgcgcgcgcgcgcgcacacacacacacacacacacacacacacacacacacagacagacacacagacacacacacacacacacacacauguacauacguacacacguacacuuaugcacauacacacuuccuucucccuaacuguccucauaggucauugcuuaagugcuucaagcaccucuguccuaagaaaaagaacauuuucuuacacagucccaucaaaauuauuuagaaagucaggauuaucuuuaaaacucuguagcccaaacuugucuccaacugaaagucaaccuccugccucugucucccacaugcugggauuagguuugagccagcacaucuggcuucugguauuuagcauaggaaccucaguauguaaucuuuggccugucauuuccgcuuaagucaauuguacuucauuaucacauccgaucaugaauguuuacugguuacguuaaguggcuuugaaggacucugucccuguccucucgguggucuuccuauucucagaaguauaaauuacacuaguuccccacccacauccccacugaguugaaaugaccuuuugcauggugaauguuggccacauuuccaucuguuguuuguuuguuuguuuguuuaugcugcuagggccugaacugacuccccaggcaaacacugcaaugcugagcuacaucccaagaucuuagucaaauuucugucucuugcaguauuggggauggagcccugggccuugcauacauacuagacaaaugccccaccaccgagcuacacccucagccccucuuuuuuuuuuuuaaauaaaguuuuaguuuuuuauuuuuuaauuaguauuggaugaaaaggagaagaaggauaggaagggacaugacugccccuaggugugguggaagagaaguuuauuuuauagagggaaagcacagucugaggcagagaugucugacagaauccagaguggauucagugccacgugaggagagggaggggggaggggagaugggggagaggaaaaccaggcgcagcaaccaggaggcccacagcuacaaagagaggagguaacauaaaugguuggauuauacagggaagagcagcuggggaaggacagcccagccccugggcugaagaguucagaaaaggggggggggggguaugccagcuuggaggacccaguaacaggacuguagaaacuaagggauguagggagaaccuggcuagugucugcuuugauaugcuaaauagguaccugagccauuugccccggauugaauuuuuuuuaacuuuuuuuuuuuuuuauaauuagguauuuucuucauuuacauguccaguguuaucccaaaagucccccauacccucccccgcccacuccccuacccacccacuuccacuacuugguccugguguuccccuguacugaggcagauaaaguuugcacgaccaaugggccucucuuuccaccgacggccaacuaggccaucuucugauacauaagcagcuagagucaagagcucccggguacugguuaguucauaauguuguuccaccuauaggguugcagaucccuuuagcuccuuggauacuuucucuagcuccuccauuggggguccugugauccauccaauagcugacugugagcauccacuucuguguuugcuaggcuccggcauagccucacaagagacagcucuaucuggguccuuucagcaucaucuugcuggugugugcaauggugucagcguuuggaacguaacacgugugucacuaaguugccuagacugaacuugaacucauccuuguagcuccagcaggccuugaacuugcaguccuccugccucagcuucccaaguagcugggaugcaggccugcaucaucaagccugacuuucugacccuuuccugaggcucaaucccuagaaacagaugcugagucaaacagaaugauguuuaauaaugccagccacuguuaaagcauccuccaggcacguggugccauggccagggcucugcaacucccuucucagggcugggagccugagaaaggagggagagacagcgcugagguccccagacggccuccagccagauggccugcuggcagucagcacauggagcuggaugggagacagcggacacuggccuuuuauuuauccucugucuuucauggcucucauauggagcaggcugcaguagaacucagagauaaaaagggccuuuauacuuaacagagcgggguggggaguggagggcuuuguugccugggcuaauacugguccuuuucugggcaaagaaacuuucuccccucuccuuggcuaagauuugcucuugauaauauuucuaauauuggcugcuacagaacguuccauauuguaucuuuuaauaucacacagagcuauguaaucuaaggugguugggagcaaccacuauuuauugauuccugagugagaaauucuauggaagcuaauccaaaugccgcugauuguauagauuccauguaauuuacaaaugugcccucaucagauucucaccacaguuccuucugcaagagaaacagaggcaaaagcagcuuaguaccagguuggugguuccaagcucagcuggugcguggugggaggaaggaggccagugugccuccuucugagccgcugcucuuucuguuggaccucacuugucucuagaugaugggaaucagcaaguacuaacuaacgccaucccugaugcugcuacaggagaggagaaagcaguccaggcacaaacaaaugguccuguuuaaguugcuccagcaggccugucaucugauuucauuguaggcaggaaccgcucacuacuaauguccucaaggccuuugaugaaguuccucacaucugucugucugucugucugucucccacaccucagugaucacuuccuccuccacccgggaguacacggugauggagccugaucaggacggcgcugcacccucacacacccauauuuaccaguggcgucagaccaucaccuuccaggagugugcccacgaugacgccaggccagcccugcccagcacccagcagcucucuguggacagcguguuuguccuguacaacaaggaggagaggaucuugcgcuaugcccucagcaacuccaucgggccugugagggguaaggaggagggagcucaugcaggcuggacauggcugugcguuugcgcaugcucugcgcccucugcacucauaccugucaaucucugccucuuggauuugggguuuuagucucuuacucucugucuauagaagaaaaggaug

SEQ ID NO: 6896 - RNA, 2157 nt, Mus musculus
caaaaguaguuuguuuguuuuuuuuuucauugugaaaaagucuuuauuuuaagaaaaaaauuuaguuaacaaaaaauuuaacaaguuucacuuagcaaaauacacccaaaaggaaaucacaguacaaagaaagcuuuaagucaaggccucaccaauuccuacaguauuaguauuguuucucaauucucaaaacuaacuuuuaaaaagcuuaaacuuaaccuaaagauuuuaaaugaaaauauaaacuagaaugaacaugagaaaugcuucucuuuugcaucagggaucuagcaccuuuggguucuccagaaaaguacauauccccaguguguucacuguggugugcuuaaagauccacucaacauacuuaaacuacuuaacucagauaacaucacucuuaaguauacuaccaaaaauguuaauugagaaaagcggaagaaaauaguuuuaguuuacucaauauuacaugcuagaagaaaaguuugcaugagaaacacugaagagguaauuuuuuaauccagauuucacaaacucauggugcaaagugggucccccagcuuccucuagaguuauaaacugcucuugacugcuuauuggcugccugugaaauuuucugauugaaauaacucaaauguuccuacaguacuaaucauauccacccaugcuguucugaccgcuguagccggcccuguaacagccacucacugacuggcucuccaggccacuguaaguugccugggcagcugacacacccaugcccugcaucaccaggcugcuauaagccccacugcuggccccuguuguucaggaggaguccuacguaucuguguuacauguuggucuuguccuuggacauagcugccacugcuucuucaugaguagcaaacucaacaucagcuucucccgucacucuuccaucaggaccaaucucaauaugaacucucacaggguugaguggagagaagaaguuguaaaugucguucuccguugcuuuguagggcagcccucucauguggacgcaguggccgguggugcucugcacugugaacucgcugucuccauaucuguggucauacauuccugagagacaauagcugaggucucucccaaacaggucaguggugaagccauagccaucacugaggccacuguauucuucauagcccccauagccugaacuauaggcaccagaccucauccuauccagaccugccuguuucacaaugccaauguaccuccgggcugugccaggccugucauaaggcccaggccuuugcacagacauaaacuucagagguggaucugaguaugaucuaacuuccuccugacugcucuuaaacacuucaauauaccugugcccuauucucuccuugugcuucccuaaagcuuucucagcuaacucuuguaaggcaaacugaaugaaggccuccccuguaaucuugccuuccggguccacagguagugugaucccauuuggcacaauuuccaacccugagaagaacugaacgauuucuuccuuugugcauccaaaugggaguccccgaagccucacaaagccaucauuggcacugucggcgcuguuuggaccacugugcuucaacacccaauccaucucgguucugugugacuugaacaccucaauauaccggugucccaugcuuucccugucuuuuuucagagccaauuuuacaucaucuucugacucaaguucaacaaaagccucaccacucugccugccuucucuaguauaaaugaaaugaacaccugcgaccccaucaugaauugugcagucggagaggaaguuuuguacguccucaauugagcaggaccaggguaggacacggaguuugacuacauagccuucaccucccucagggcccagcaucauggacacuugacagggcugaugucacacaagcuugggcaauuuuuuguagcuuaaagaaccaccacagaugccuucuguaggaaacacuuaauggaagguaacaaguuuuccaggggaggaagguagaagugacuucuauauucaguaaggaacgcggcuuacaaacucaaacuccacccgacgccuuaaaaacgcagagggcuccggggaaaguccaggugcaucuuuuuguucucaaccuucaggaagacgaggcgcaguccuucaaa

SEQ ID NO: 6897 - RNA, 782 nt, Mus musculus
uugucauucuuuuuuuuuuauguauguauguauguauguauguauguauguauguauguauguauguuguuuguuuguuuaauguagcccuuguugggcuagaaccugauuuguagaucugagcucaacucagagaucuuugucagagugcagggauuaaacacaugugccaucacucccagcaaaggcuauucuaugcaacacuacuuuagaagaaucaccaacuuuguauuguuuaucacuguacuuaaaaagaaggcuguguuugaagaaauaaucuaugaaacaaggucguugaaccucuuuugggugaaggucuuagucacuguucuauuguugugaagagauaccauggccaaagcaauucuuauaaaugaaagcauuuaauuuggggaucugcuuacaguuucagucagucuguuaucagcuaguaggaacauagugucacucauggcccuggaguaguggcuuagaacuguguccugaucuguaggcagcagauucggucuggcaugagguucuaaaaccucaaaguccacuccagugacacacuuccuccaacaaggccacaccuccaaauucuaauuuugucaaagaauugcacucccuggugacuaaggauucagauauaugagccuagagggucauucuuauuuaaaccaccacagugagguaguucaguacuaaugguaagcuguuagaugguguggaaauuuuuuugaaacuugccaguugcuuaauagaaauuguaaauugggaauaaacauuucagcaguguuuua

SEQ ID NO: 6898 - RNA, 1796 nt, Mus musculus
uuuuuuuuuuuuuuuuuuuuuuuuuuuuuuuuuuccucuuuuugaguuuggggcucuguagaggcuuggcuuuuauuuucuaaguuccugucuuucauaugaaugaaaauguaaccaguguuguaugagagguggaaccuuuuuguuugucacagauguacaaccuguaugaaauagugaaaagugagugucuuagggcaaagugaaguuuuuagggaaagcauauaucugucuuguuguuggguaugacuggaggaaagcuuuagguuaacugauaaauguauacugcacaauacauuuggaagcugaauacauuuggaauaaauguuguaaucuguuaguuccuguugugaugucuggcacaucuuaaauucucaguaaauguuugucugaaagggagguacugaguugaagaugucaauauguuuuuguuuuucuuaauuuucauuuucuguguaaaaaaaacuuuucuuuuugaagagaaaaaaaggaaggaaggaaguagguagguaagucaggugugagggugcgugacuguuuccacuucccauugguggaaggaggaucaguaguucaaggacagccuggguuagaggcuagccuggucuacauauugaguuggagggcaacaagucuacaggaaacuguuguccccaacaaauaaucaaaauaacaauuaaaaauaaauauguuggaaacuuuagccuuaaaaguuucaugguuuuaaacaaauucuacuuuuguguguaucuguaacugcuuuuaauauaaagguacuuuuuacuaguaauguuuaaaacaguuguuaaacuuucaacuuuauaaagaaacuuucuaauuuuagcuuaggaaguuugggguaaucuauucuuacuaaucucuaguacuaaaauauugcccccaagggcuggagagguagcucagugguuaagaaccuacugcucuuuguagauaggaguuggguucccagcaccuauaacuccagcuuuaagagaucuaaccuccucucaccuccacuucuugcagcauuuauuuacauagucucacacacacacauaaguaaaaauaauaaacauaaaucuuaaaaaaagaaguuuccacuagguguaauggcacaccccuuuaauugucagcacucaggagguagaggcuacagaccuuaguggguuugaggccagacuaagcugcauagugagacugucaaagaaaaaaaauaaaaugaaggaaagcuguuugguguugaguauaucaggcucaauuuugugugugaaaacaguuuuauguagcuuguguacguguguguguguguguguguguguguguguguauguguguaaaugacauuugagcuacagagugauuuuaugcugucuguuaaaucuuaucaaacaaauuuuacuuugaagcaaguuuuaaguuugaauuauuugucuuaacuacuaaugucacuaagaauuuuauugugucaguauauugagauaaugauaagcuuuugucuuaaagucauuaaauguagaaaagucuaaauguagaaaagcaguuucccuauuguacaaccuucaaaaaccaauuuacacaaagcauaguuaugacuagugugucugucuggagaucuuguagucugugagaacugugucuugucacauaaaagcagucugcuuugggauuugugcugccgucgcuguggacacugcuguuggguagagguugcuggugucauguuuuuuucuuuucugacaaaauauuaacauuuauuuauuuguguguguguauacacuugaaugaggucauagaac

SEQ ID NO: 6899 - RNA, 3985 nt, Mus musculus
cugggaguuggaguuuuuggaucacagcggucuuugacccuugcgcaugcgcaagaggggccugcgcaugcucugagcgaggaggcggggaagugggcggacuuaacgcaugcgcucagcccgcgucccgcucugucuugagaagaucauggcuccuucguugcugcugcuuucacuaccauggccggugcgucccggaccgcuccagaggugcugggagcugcuacaacggcaacugcagcagagcuggagucgcuuugucaguccuccgugggguccguaaggagagaguucguggaaagaggguuggugagggcuuccggguuguagcgugguuuuugguugguugauugguucguuauuuuauuuguuuguuuguuuauugguuauuuauuuauuuauuuauuuauuuauuuauuuauuuauuuauuuauugaaacugucaccguagccaggguggucuagaacucacuguauagcccaggcuagcuucguauuuauuuauuuauuuauuuauuuauugaaacugucaccguagccaggguggucuagaacucacuguguagcccaggcuagcuucgagcuccugguaucuugggcguuaaauuugagauugcuguauuauuuacaguguaucgcaaaagugauaaugcccagucugaacagagauauauuuuauuauaucucaagcgcagcauaauaaauaauugucuccauguucuaccugagauaaucauuucaguccauucguugucuaauaggccugugcuuggacaguuuauguagugguaagaaguccuaagaauugaacgaacguucgcaagucugaagaacauaagaaaggguaaagaagugaucuaagcaauuuagaaaaacaaaggugaaacacuugauaaucucauaaauaauaaaucuuuucuuagaacacagguuaagauuaaauauuaaggaaaaauuuaauggcuuuaggaaccuaccagguuuaaagaaaaaggaccuaacuggaucaggauagugugguacagaugaccauuguagucaucucagugaugugagugaauguagggagucucgggauuagauuacuuguacacuacuuauuacugaacugcagugucccggauuauauacggaggaaaugcuuaguagaguagccuggcugcuuugguagcuugcaauaagaaagcauuccaguugaaguauuuuaaauugccuuuuauaugagcuuuaguauauuuuaauagcuggggauuauuacuaauguuuguuguguuuaacauucaaaacuauuuaugucaggccagccauauggcucaguaguaaaggaccuuguugcuaagucucaggaccuggguccuagccccauggccaguaugacguaaggagagaacuaacucugaaagcuguccucugaccuuacaugugcacauauacucacaaacacauauaauuuauagguguguauauuuagugacacuacacauguugacuguuaaaggaaauaguggcuguauucauuuaggaacuccgaguugauucggcaucucuguuuuguuuuauagcaccagcauuagccguccagagaccauccauccucacagagcuagcacaugauacuugugaaaauaaagagaauuccagcuuuuuagauaguaucuuuuggauggcagcucccaaaaacagacgcaccaucgaaguuaaccgauguaggagaagaaacccucaaaagcuuauuaaaauuaagguaaugugugaacggguguaggugugugcacauacacacucucuuccacaagucuaacacugaauagcccgguauuguauuuguguagcagagaaaaccagccuuauaauagucuuagcaucuuguuuggcucaucauggauagauacguaaucuaauucuuccuuaauguuuuaagauacucuuaaugaaucaucccauugcuuagaugggcuccuuguugguuauuauuugaaguuagaggacugauagagcucuuaauucaaaagucaaaugagaucauuacaaacaauucugaaaaaaaucuccaaacuucuugacuaugcuuuuaauuguuaauguggaauucacuacacucauauaaugaaaauauucuacucaagcuggagauuagacaaaagaauuugagaauaguuuacccauaggcuauacgaauaaaaauauaccagauugguaaacuugaguuuuaguccuaauuuucuuacuaauuugaacucaguguugcuauuuuuuuuuuuuuuuuuuuuugguuuuccuguuaaaauauauuguugaacuagcuaguauauagucuuauguagcacgaacauucucagaaagcuacaaugucagcauguuagaguucuugcuggugauuauguauuauauugcuuguuauuaauauguuuuucuuuguuuuaaagaacaauauagacauuugcccugaauguggucaccugaagcagaaacauguccuuuguggauauugcuaugagaaaguacgccaggagacgacaaaaaucagacaacaaauaggggcucaagaaggagguccuuucagagcuccuuccguugagacuauggugcuguacacaggagagaaaccaucagaaaaggaucagggcaagaggauuguugaaagaaacauaaagaggccaucuugguucacccagaauugaacuaaaaaauguuaaaaagauaauuucauaguuaggcacuuauuuaaaaucaggagucuucauuuucauguugugccuguuuucaaauuaucaauguauuuuaaaauggauuuuguuaguuguuacuuuuaaaugagguaauuugaagacuguaucaugaauaaacucagcauauuuauguaaaggcucaauggauuaauuuguguauuucuauaaugcuguuggguuuuaauuaagcaguugugucagugagaaaagaauuuagaacagguaugugguacacucauuuguauucaggaguagaagcaggaggauaucuugaauuucaggccagccaggauacaaagugagauucugucucaaaaaaaaaaaaaaacaaaaacaaaaacaaaacaaaacgaaguucuuucuucuuuguuggugcuuuagaacaauuuacuuuuuauggaacaaagugugcuaauuuacuuaaauaauagaaauaaucacauuccauugucgucguagaugcuugugagaaagcaaacccaagauaaaccuuucaaauaaauacccagaguagggccuuuaaaguaccaguuguugaaaauguauauauccugucaaauuuauuuccaaugucuacaccccaccugucccuccuucuauaugcaauugauaacauuuuuuaaauauauuuuuuagugauugugugugugugugugugugugugugugaauuucaaugcaccucagucccacucaucucccuguccucaacccuagcaaccuaucaaugcuggauucuuacugguauuucuuucagauugggucugcaggacuggccucaucaugugcauuaacaguucauagaugggguggugguuggggugggccaacuuaaagcccugaaucugggccuggaugauagcugaguugguuagcccaccagcucucaugcccuuacaccacugaggccaacucucauacccaugccuucagggccagcuccugugcccaugucaccaggaccauucuuaccaagcccccugcucuauuuuauuugaugguccaggugcuggucacucuccccagugcugcagcaggccagcucucgcacacuggucaaacaucugggugucuuccaccugccgacaaugcugguagccaucagggguccucugaauuugauaacauaaguuuugucucucaaugguuuuaaauuggugcuaaggaacucuacugccuuugauuaucauuuguuguuauauuaaaugaauagacugcaacaauuuuucagcuauaauucuuagguagcaguaucau

SEQ ID NO: 6900 - RNA, 15430 nt, Mus musculus
cgggguucgcuaguggcugcuccuccaggcagcaccgggccagcguggaguuggagcuuugugaaguagccaguaaaucagaacgccuccgcuaggugcagagcgcgguggcagcgggccacucugccagugcgguagucggugggaccgaacucuacacucgggaaggggcagucugcgggugcggggccugagcugccgcucgccuccguuggccaggagaccggcagccccacugcagguccuggucccugacauucccuggcaccgagggcugggaucagagauucccggcugcacucacugaacagugauuuuuuuuuuuucuuuccccucccugaauucuuuagcugccaaaagggggggaaaaaucaagagcugcgcuuuuaaacgaaguugcccuugcugguguucaggguaaaaauagaggcggccgcuuggaccagcuuggccccugaguccaggcgucccgcgagccgggcuggagcugcgcauucgggagugaucccuggaaacugccagcaggugcugcucaagguacgguggcaagcugaaaagggacagggccugggugcagggagucuccgcgggaggggcaggaagugaaagagaaaccaaccccgcucagagcugcgcugaccagcgcacgcccugggcccuggaauucagcugggaaacgcugauccucagcccagaauauuccacagaagcauuuuaaccuaccugcuuccuccaccacccccaccuggauuuccauggaggagaggaggcuuucccaaagugguuccagcucugagguugggggagauucagcuacgucauagcugcuagacuggcuuagcagguuggcacuuucagggugucaaaggccaacagggucucagagugacccugugugaggcggccccugcagucagggucuugaacauucuuaugacacacaugcuuaagaaacuacagggaugcuccgaaauaacauucuuuugugaccacugaguuuugauccugaaauuauacaucccacuuuauagauggaaacacugaggcuugaguuuaaauuaggagggcgccccggagcuggggucugauucgggcacuuuucugugccaagccagucuacaaucuacauucgggugcaagugggacuuucccugaaguuaugugugaggcaagaaaugaguuuagaugcucagggauucuuaucaaacagcauggaagugccucucuuccaaagguuuauguucaccccgggguugggguuggaauggaaaugacuaucacugauuaucuuucugucuuugccacccauauuccugucauuuuccccugcaacuuuauuuccuacuucaguucucuuaugcggaucuuagaauacuccuuccccuugccccuccccuucccccacauauagcuagcauccacacuuugaaagcccucaagagagacccuuucacagacagcuccuggugucauaaagaaaccuuccccacuucacaucaggagaccagagccucuacaguuugcuuaugggcacagugaaaaguuuauuuuaugcaucuuaaauccggcacacgaaacaacauaucuggucauauggcuuucauuaguccccaguuuugcacguuuuauccaacuugucauaagaaccuggucagugccuuagcuguacuucgccccgagaacaacagcccuucuucacugugcuuaucggggcauucgucucucucuauguuaucucccugccagugugacccaggcaaaagaaaacccaaaccuaacuuuacuucuauuuuaaggagaguucacuucuuuucauuaaacucauauuuauaguguuuacaaaugauuggacuugaaguucuagcuuuuaaagaaaagaugcagguguguguguguguguguguguguguguguguguguguuacuguuguuuuugcuaguuaggaugggacucaucuaggcaggauacuuaugaaguucacuugcaaaggaagaccauuucccaaguccgaggugauaaaugauguaugaagcaggcauucaauuucaagguguaaauuaauagugugagucaaagcagggagaccaucaccacauggacauacagauuuuccugaaaaaaauauuuuccuauaaucauaauuauaauacuagaauuccuauaaagaacacuaugaauuuucuuugcuguggaaaaaauacggugcuuugcaaauagaaguaacuuuaugaaguaacagaugucuuauguauagacauaaggcugaaccugaaucuaauaagagguguauguaugaauaguaaaaugucaaagcuggacacucuuggagauguguguaugugguucucuuauguuuguaaaggguggacuauuccuagccacaggcuuuacuggcucaggacaucacccagguccugucucagaagccaagagagauuuccauuagauaaugaauuaugaaaugucucacacuggaaaaacgagucaucugcugaugucaugcugauucuaaccaauccuaaacaaagccccagcccuccucuuugagagguaccaaugugugaguguacaacuaaguacuacaguauaaaacuucacagugccaauaccaugaagaggaauucagacagcucugaccucaugagacaagagccggcugacaaaacagaagggacccgaaagguaaugcuuuuaaauucuugcuucugagcucucuacacauuaaaagucaguauggcuaaaaggacuuuuacaacuuuuuggcaccuccauaggcauuguaaauuguaucauuuucuauugugcaggcagguuaauacuguuuuuuaauaguccuagagcaugcaaauagauuguguuuauacaacccacucagcacacauauacaaguacauaugccaaaaagaaaguuauuuuuaagaguuccauuugcaaacaguaaauccagggaacacacacauauucacauacagggagaauccaaacauugauaacuugcucuuauccaaaugcuacuauuaggacucuugaguuguuuagagucauuaaacuuuuagcucuauguuagucugucucguaaaacuuaacugcacuacaaaaugcuccgaguucuguaucuguaacuccaaauaggugggugacguuauuauaacacagagauguucuccugaaccauugugaugcaagugccccuacuucucuccauuuuuuuuaaaugaaaguuuuagguaauauggacagucuuaucaacaacagcagaguccuugguguuucuggagcugggaguccuccuaacccuacaaaggugucagagggcuuauaacugagaaagucuugugcauuguugcuuugggaaaagauagcauuugugugguucagaaaagcauugauaccugucaaaacugaaguuuaaccuagugucaugauuuuaucaacuucuuguauguagaucuuaugcuuguaguucugacaccuauuaaaucuguccuccugaccugcuuuacuucacuagaaugcucugaacauagaaggugucagacagaagggaauguaucuagugagacacuagaggguuuauauguagggaagaagcugggaaaggaggacuguuuuaacagaggacaccuuaaagauacuucugcacaauaaaagacagagaaugaaaagguggugggaagaauuuaaaaaaaaaaaaagaaagaaaaagaaagaaaagccucagaaagaaauuguuuuaaagugcacacuggucuuguucugugaauacuguaauccucaaugaacucagcucugcugguacuuugaggagaaaugacccagccaggcagcccugccguggaugcuacacuauggucaaggcugacaaggggaggugggcaaguagaagaacaaaaugagaguaguucaugccaggggaaaagaauuugccaauauauuuagagauucgugcccuccagaccaguuacucacaucauaagagugcccuguuuuucaugaaaggaugugagaaaagccaaaugaauucugugcuuuaucugugaagccaggacagugggcagugggcuauaauuuuugaauaugugugcauccaggguagagagaugggaaacagggugaguaccuucccugacuguguaaaaugcugcuugcccaagggagcuuccagugcccugcuguggugcccacuuggcaaaagcagaguguauuauaugaccccagacaaaaguucugcugcgcucgcuccaggucccauaagaucucccggcuggcuuaaggacccuggacauuuaaauaugaaugaauggcccaaaugaaugguucuggauucugucaggcagaacaaccagcugucucaggcagccccucugccccagucccagaccccugaccugugcuaccaaucugaggaccucccucagacccacagcaggaucagguggguucuuacuccaggaaagugcaaagccaugggagaugaccuggggacacuuuccuaucuagccaucucagugaauggaaacagugcauuuaauuugcuugccuuucucccuccaaagaaaaaaggugaggcaaggaaaaggauugagcagagaaagaugaaaagaaagagagagagagagagagaaagaaagaaaccccuagacuaaaagugaaccgauuuagaagaauuuauuguagaaaggacuggagugcccccccccccccauucuucagagaauggcaggauuggaagagaggugugugugagggagcaaggagcagcaagaaggcagccugucagaaacgggcugucccuccucccuagucacagcucauacucacagacgcccucccuccucccucucccauucacucacucacuuagggccaaucccucucucucucucucucucucucucucucucucucucucucucucucucucucucccucccucucucucucucuucucucucucucccuucccucccucucacucccuccccuucccuccccucccccucuccuucucucuuccuuucucccucccccucccuugcugucccucuuucucccccuuucccucugucuucucuucccccucucucuuuucucccugucucucccucccauccucucucagucucugucuccccccacccugucucuuccuuccucccucccucucucccucccucccucccucccucucucccucccuccuuccuucucuuuuacucggagacagucagaacucuccucccugacagccacaaaccuacagcacugacugcauucagagagggaaccugcaaacaaaacuucacagaaaacuuuuugcucuuguuccagagaauuugcugaagaggagaaggaaaaaaaaaguccaaaaaaaccugugcgugagggguggggaggaaaagcagggccuuuaaagaaggcaaccacacgacuuuugcugccaggaugcccuugcuuuggcugagaggauuucuguuggcaaguugcuggauuauagugaggaguucccccaccccaggauccgaggggcacggcucagccccggacugcccguccugugcgcuggccacccuuccgaaggauggaccuaacucucagccagagaugguagaggcugucaagaagcacaucuuaaacaugcugcacuugaagaagagacccgaugucacccagccggugcccaaggcggcgcuucucaacgcgaucagaaagcuucauguggguaaagugggggagaacggguauguggagauagaggacgacauuggcaggagggccgaaaugaaugaacucauggagcagaccucggagaucaucaccuuugccgagucaggugggugcuggcauugggagugggggcgggggcggggaaauguauuucguugacaguccuagcaggaacuucuuucccuccagcucaagaguguccggggagguuauuaguuauuaggugguggcgguggcggcggcgccggaguggcagaggagggggaaaggacuucuuugccagggagcccugccccgcaauggcuagcuuacacuugcuaaauaaacucagcgguuacccagagaggaagcucuugggccagucuggagcuggaaagcagucugcuuggggcucccugacugcccugccuaggaaaccagauuugaucaggcagaugaaagcagggcauuuggggguuugggggugcagaggcagcaucuggaccccauccaaaguuuuucugggguaggagugagagagccugggggccgagugcaaaggcacugaugauggcucugucugagaacaaauuuccuuuaaaugucugaucuggggccacauuggagccagacucugggcauauuuauuagugacaaucauuuucaccucuggaaaaccuaccucuaugaaaaacccaccgaagaagcaaagagcaacucguaggguauugaauuagugauuaauuuuggaacacugaaacuuuugcuguuagaacaaaaacaaaauaaaaacagaagcaacgagcgacaucaacaaaaagccagcgaaccuuacccccaacucaauuuuauuuuuuguaaagugacuaacuacuuuuugccaaggaauacaaucuugacaaugggcucucagacccuaugcugaacgacucaauccuuaagaggaaaaacuuucauggauucuaaucauuggcucaggaccacacuaaccuguugcuguggagaaaaauaccuguccaaagcccaggcucgaaacugagaacuccucuccagucaugaggauacagaucuuacugccaaucuguggggaccgggcacacagauguucuaaaaccucuuuacuuucauguuaaaugccaggcuaaggaauaggaucccuugccaaagccauuugaaaggaaugccauuguuuuguuugguggagcauaugggcuagugaagugugugcagggacucccagcauuuuguuuaaaaguuugcugcagcaguauaaacaauuaaggcaacacucaaaauuuccaauccugaaagccuguuaacucagauguucuguuuucaagaaagcugugcaagaccugggcauccuucuuucggggaggggggagaggagacagcuggcuugguggcuucacccacaggaagccuugguaccccaccagcuccuuagacagguuaguucuguccauguccuacuuccuuaacuaguuccuuuuuugacccaguuccccaaaccuuggucauugagacuuuauuuccugagccauauugaggaaagacaggugagaaagaaaaccucuccagcguugguuggugugugagggguggguucccugcuuuaggagauuggcccugguccugacacaaugugacucauauaagacucuauguacaagcuuccccuguguuggccacaacugcaguuucuacuaacuuggaaucaauuguaucaugugacuagguauaugugugacuuccaccauguuuaauggcacaguggauguuagcacucuguccuucccucugacuuacaaggcuuguacagaaaaccuaucacuuggcaguuagagguagggcaaagaauuaggucauuuucguucuuuuuacuucugaccuucucagugcuaauggaucucucacuuaagugggauccugucaguuuugcuucucuguuguuuaguuugagagaaaaugagcuacuauuuacaucagugauucacuggacucacacauugacugaguguaaaauuuauaagaggaaacuccuucuaguccaggaacaugguguuuuuguuacaauugcuuauuuucucaugugagaaguagcacacauugacuucaaguugauuuaauauaauuucacaaaugcaaguaagaucauaguguacaaccuacucuccaaguagcauagggugugacauaagcauguugcuuauucaggaaauauauuuauuaucugauuagcuagagaaaauaugugaaaaugaacuacaaagaucugucuuguuguuuuuggaacaauucuauuuugcuauguaguaacuaacacauuucaagaauagagaagggcaguuuuuuuuuuuuucuuuucuuuauaaccauuuggacaacauagggugcagucaaugacuguuaccuguaaacauacuauagaugugcuuuucaauagcaagaucccugguaugggaauguauguuuuacuuuggccucuucacucaagauuauuagauaaagcugagaaaaacaugagacugaagggacuguaagggcugugguacucugaccuuuuaagugaauuuguccuguguucaggugggaaguauuuugguuuugugaaguugauuugaauugcauuggcuaagcagcagauauucacucucaagcucccugcaaucugucccaauaagugaaauugauuuuauuuuuauaagugucacccaagagugcuucccaaaguuagcauauuuauugcaugacuggccccauaccauuacuccugauuuuucuucagaggaacagcaguaugggagagucaagccaauccagugacuguaacuuaauugucaaugaaauuggccuucucuaccaaugcacugaguuuuuucugcuuuuccuucuuuauaguugaugcucagugaauguauaguaccagccugcuguugcgucugcauagauuguggcauggucagcugcugauuuucacaauuagcuuacuggaguucuugcuacguaggauauagaaacaauagaagugauaccugcaaaaguauauacugcucagguguugucuaaaguagcucccuccccccucguggaggacaccaggaaaagaagauuugaauuagaaaugaggucaccugaagacuacuucuccacacccuaagaaagccaucuccaaaugaaguaaacaccaauagcuccauccccaaccuuucuuuugaccugucuugagaaaccuuuaagguuucacacuuaucugaauuugaaaaagacuggccacaagagggcgcaucccuaaacccucagcuacucugagaaaggcaguuuuguggguacuugaagccccagccuguagcaccuuaaucuugaagaauaucaguuacuuccucccuacauccccaccuuccugcagaguucagguuuuauaggcugggggaugcacagcuaccuuuaagaauacauugagucacagcacugaaagugcugggguccacaugaaaauuccacagcuccaugggcagcagaggagugauacaauucaaaaacaaacaaagcagggcuugggaugugggagaaucaucagcuacagugaugugagcgcagucuuucccuaacaaacaucuuccgucccccccccccccaauucugcuuccuaguuugccugccuuaucaaugcuuuucacaagggacaaaugacaagugacuugcaacagggaggaaaaagagacuauuuauuuaacgucugguaggaacauggaguucagcugcagaggacgcauuuguuucucgcugagaguguggagagaaaccgugggggaaggaugugccaagagaugagcacgggguuuugccuguagaguggguggacugaagugggaauggggagaugucaggggagagaugcaguuuucacauggagaaggagaaccuucccaggcacuucacaugaaaauacuuauuugucuuggcccuucuuacaucaaacuugaguaugaucucuucgcuuuaguucagaaugcuuuaugcuugacucguuccuggguccaacauuaaaaguguaaacguuuugaggaauucuaggaaaaaaaacucuuggguugacucuuuaggguuuuuuuuuucuuuuaauuuauauuaugaaguaagcugcuuguuuuggacauuuaacccuuuacaucauuauuuaaauggaaaaagcaauggauguuaagugacucaggccugaagaguuacaaauaauuaaaaaauggaucccaaggagagguauuaaagcuaaaugguuagacaggauaauuuauacaagcaagcuaauauaccugcaauggcaaaauucucuacuguaggucaaaggaaaaauaaccuuucagaucuuacucgcugccuuccgcagacaccucuggaagccauccagaggccgacuuagugcccgagagaacgcacaggcuguaguguaggcccuucaugcuccugacuguacuguaucuaggcacagggaaacuugaugaagaauggaaaauuuaaguaacacauauuuuacagcagagcugugcuccccucauggcaaguuuaaaugugcacugugaaugccaaggcuuucuacauuaacagagacgucauuauuaccgauuuguaaaagggcagcauauuuuacccaggauguugaugaggaaaaccagacuaauuaagcugaaacuuuauguguauacugauuauuuaauggggaauuaucagauaucccacaaaucugagaggaggacuuuuguguauguggaauuugcauaccuuuuaaguaaaaaggagccuguuuacuuaagccuuggcauaccuucaugaucaagcuagugagaaccccugaaagcaaaagagaauugcuacaaacauccuucuuuuaggcuuauguagacuuucucucaaggucccccaccaggcagcauuucaaugguauucucuauaagguacaaaauuuaucccuacugaguguucugcccauuuucuucugcuuuggugcguguccaccaagcucaugggggcuucggugaugagauauuaucacccacauggguuugcgugggacucugaugcugaguuacucagucagagcaggcuguaugauccaagccuugcucacaagccucaggacaaaaaauagcacagaggaggaaaagaauguuaccagggaguaguuaaugaaagguuacgcgcaagcagcucuagcuggggagcugcggccugguggaggaacccaguacacaccuguacacaccagcgccauguuuuaugccgcagcauugugggaaggcauucauuucaggauuucacagcaccagauacuuaaaucaggucugaaacagaugagaacuugagccuaaacauuucauccuuaagauaucuuucuuccuuuuuccaaaucauuacauguucagcuuggggccuccuggaaacgacauugcaauagaguaauuucucccagguaauagagauaaagggaauagaacaucuacuaauuauauuuuugaucguuauguaacuaacuggagaguuguaauauauuucugaaaccaacagaucugauaaacggucaguccacuucagcuuucguccaucucacccccccaccccucacacacacccucugcaaugaaagcuaagggaaaagaaaaaaaaaugcacugcuuaauaagucacaauacaauagaacuuguaaaauguaccugcgcgugagguagauggaggaagacuugauucucuccucccccuguccuccugggcauacggcaacagcauuuucaugaaauuggaucucaguuuuauuuuuuuuuuucccugauaaaauaucaugcaauacacaaauagcaguuccagaaauggacaccaggagaaggaggggacaggcaugucaauuaguaggggaaaauccaaaugucagaaauaugggggagagaugaagcaagcuagaauggauacaaauacagggagcagaagcuuucggcuggauaauuaaacugcugcauaaaucagugcuccugccucccgugacauacaggcaauggcuugcaguuaauugucagccaagaccagccugaaagucauuuuaugacgacucucugagccuaauguaacaacaccugacagacugagcccccucuaaugagcacucucuuuguacgauccucuugcaggaacacuaaaucauuugcuuccaaguacagccgccugugaagaagggguggggcuaccucacgcauuagaaacuuguucccaugaaauuaggugccauccuguaggcuguguaacaggagcaccuggucucagcccugcuggccaugauaaaaagcagcuccuaugcacugucacuuguucuagcaugccaauuaauccucucuugucccuacugcagcaucugcaguugucagcccaggacaguucaugggaagcccgguguugagcaggucagcaccucuuguuugccuccuuacccucacacccaugcuaaguguggaugggggcaguccagaguuugggaggagguugccugagaccuacugaaccuugccaggcaggaggcaggcaggugcuguuuccuagagaaaaaacagucuccacuggcuucucuaauuuggcugcuacuuuuguuuucucugucugacaccuugagaagcucagaguuuuagaaaggguccugccuagaggcaggaaggaaaaaugaugggaagcuagguggcauuuuuucuaaagguaauagcagaugcaucccauacagcaaaggaaccugaguuguuccaagcccucuuuagccuaucucuccuucucccuaaucucucuggaccccucugcccuucccuccuguaccuuaccacuguaugcucguaaaaacaacaaaccaacaauaaacucccucaaccuuaccaaagggugagauaggauuccacuuucaaaaacuauuaccauguuuuuuuuccucacugguccuugcuuuuauaugcuauggaaucaauaucuccucuuaauuauuuauuuuaacuccuaacaaaaauaugaagucacucagaggaaugccucuacuaccccaucuucuagacagauaacaggggauuuugagaauugaucaauacucuggucauaguuuacagggugggcuagacggagcuggggaucugcaggguaccaugcacagaacagccuuccuuccgcggcagagcauuugaaacugcgcugugcaaagagaaggaaacaucaaggaucuggcucuuuaacuagguagauaugaauaguugcugggauauauucucuuuuaaaagcauauagaaaguggaacaugcuuuugguauugauuuggugcaguuuagaugaacagagguaaaaauaaggaauucagagauaggaguugcuuuuuuucuuuucuuuucuuucuuucuuucuuuuuauguuuuuuuuuuggaguugcuuucuuaauguaaggcaguucaaugcuaauuugcucccauugguuaguaaucaaacaguuacccaccucugcuugguacagcacgacagugaaugggaugcauacggcuuaggccuucagauguccuaaacugaauugguaugagggugagaagggaggaagaggaaagugggguccgauugaauaauuuuugggauaauucaagugggguccaguuggauagcauuguuuugguugcucuggguggcacaggaacagccagugucacuguuauaagugaguugagugcauaaaguucacaggacaaaaauauccaggucacagagacauggaccuauaugaggcguacaguccaaagucaugggaaguuggacuacugcaaagcaacaguuguaacagaggggacagcacaaucagacccaccuuuaggaaagguuucuucaacugcuugauggagccaugacuugagaagggccugacuuaaaaguuuuaagggcccuuugaugaaaagccugcugcuguaaugggguugacagaggaguuaggucagauggugacaggaggaagacaugugucagaaaguauggccgcuacugacccacacauagcuacaguugacaagauuuugggcuucuguggaagaaccuucccugccuugcgcaggcauccaggguuuucuucuuugggcuucuguuuuaggucuuugcagaacugaggucucugcucaaauguccgcguaccauucucauuccgggauuaaacuaaaacaaaggagugaaugaaguggaugcagaaacccaggauuccuucaucagaaagcacggucuacaaacuugccucuguuagucaugucucccaucgcuacccaauccuguauaagugaagcaaggccauaggcaguguagaaagaaauaaacuucauuguguccuaauaaaacugcauucacaggcacuaaaguuugcacuucagguaaaguuaaacauguaaagaaaaauauuauuuuucuucaaucauuuccauacuguaaaacccuucucaacucaguggucacauggaagcagauuuauuucaugcgugggcuauaaauugcugacucuguauugugugcaauagcugauaagauucuuguuccucaaaguuagugauagauguacaauuuaguuaacaaguguucucucucucucucucucucucucucucucucucucucucuuguuuuucucucucuuguguuuuaucuuuaggcacagccaggaagacacugcacuuugagauuuccaaggaaggcagugaccugucaguaguggagcgugcagaaguguggcucuuccugaaaguccccaaggcuaacagaaccaggaccaaagucaccauccgucuauuucagcagcagaagcacccacagggcagcuuggacacgggggaugaggccgaggaaaugggcuuaaagggggagaggagugaacuguugcuaucagagaaaguaguugaugcucggaagaguaccuggcacaucuuuccaguguccagcagcauccagcgccugcuggaccagggaaagaguucccuggacgugcggauugcuugugagcagugccaggagaguggugccagucuagugcuucugggcaagaagaagaagaaagagguggauggagaugggaagaagaaagaugggagugacggagggcuggaagaggaaaaggaacagucacauagaccuuuccucaugcugcaggcuaggcaguccgaagaccacccucaucgcaggcguaggcggggcuuggagugcgacggcaaggucaacauuugcuguaagaaacaguucuuugucagcuucaaggacauuggcuggaaugacuggaucauugcucccucuggcuaucacgccaauuauugugagggggagugcccaagccacauagcaggcaccucuggguccucgcucuccuuccacucaacagucauuaaccacuaccgcaugaggggucacagccccuuugccaaccuuaagucaugcugugugcccaccaagcugagacccauguccaugcuguauuacgaugauggucaaaacaucaucaaaaaggacauucaaaacaugauuguggaggaguguggcugcuccuagagucgccaggucccagagaaaauggaucuagagaguccagagaagacaguggcaaaaugaagaaaaaaauauaagauuuaugaacuaaacaaaacaaccagaaaaauagaaauaauaauaauaaaaaacccacaaaaaaaaaacaaaaac

SEQ ID NO: 6901 - RNA, 76289 nt, Mus musculus
acaguuguaacagaggggacagcacaaucagacccaccuuuaggaaagguuucuucaacugcuugauggagccaugacuugagaagggccugacuuaaaaguuuuaagggcccuuugaugaaaagccugcugcuguaaugggguugacagaggaguuaggucagauggugacaggaggaagacaugugucagaaaguauggccgcuacugacccacacauagcuacaguugacaagauuuugggcuucuguggaagaaccuucccugccuugcgcaggcauccaggguuuucuucuuugggcuucuguuuuaggucuuugcagaacugaggucucugcucaaauguccgcguaccauucucauuccgggauuaaacuaaaacaaaggagugaaugaaguggaugcagaaacccaggauuccuucaucagaaagcacggucuacaaacuugccucuguuagucaugucucccaucgcuacccaauccuguauaagugaagcaaggccauaggcaguguagaaagaaauaaacuucauuguguccuaauaaaacugcauucacaggcacuaaaguuugcacuucagguaaaguuaaacauguaaagaaaaauauuauuuuucuucaaucauuuccauacuguaaaacccuucucaacucaguggucacauggaagcagauuuauuucaugcgugggcuauaaauugcugacucuguauugugugcaauagcugauaagauucuuguuccucaaaguuagugauagauguacaauuuaguuaacaaguguucucucucucucucucucucucucucucucucucucucucuuguuuuucucucucuuguguuuuaucuuuaggcacagccaggaagacacugcacuuugagauuuccaaggaaggcagugaccugucaguaguggagcgugcagaaguguggcucuuccugaaaguccccaaggcuaacagaaccaggaccaaagucaccauccgucuauuucagcagcagaagcacccacagggcagcuuggacacgggggaugaggccgaggaaaugggcuuaaagggggagaggagugaacuguugcuaucagagaaaguaguugaugcucggaagaguaccuggcacaucuuuccaguguccagcagcauccagcgccugcuggaccagggaaagaguucccuggacgugcggauugcuugugagcagugccaggagaguggugccagucuagugcuucugggcaagaagaagaagaaagagguggauggagaugggaagaagaaagaugggagugacggagggcuggaagaggaaaaggaacagucacauagaccuuuccucaugcugcaggcuaggcaguccgaagaccacccucaucgcaggcguaggcggggcuuggagugcgacggcaaggucaacauuugcuguaagaaacaguucuuugucagcuucaaggacauuggcuggaaugacuggaucauugcucccucuggcuaucacgccaauuauugugagggggagugcccaagccacauagcaggcaccucuggguccucgcucuccuuccacucaacagucauuaaccacuaccgcaugaggggucacagccccuuugccaaccuuaagucaugcugugugcccaccaagcugagacccauguccaugcuguauuacgaugauggucaaaacaucaucaaaaaggacauucaaaacaugauuguggaggaguguggcugcuccuagagucgccaggucccagagaaaauggaucuagagaguccagagaagacaguggcaaaaugaagaaaaaaauauaagauuuaugaacuaaacaaaacaaccagaaaaauagaaauaauaauaauaaaaaacccacaaaaaaaaaacaaaaacaaaaaucaaaaacuaaacugaaaacaagaccuaaugaaacagaugaaggaagauguggaaaaauauccuaaggcagggcucagagaugaagcaguaaaggagacagggauuggggggggggaggggggagaagagagaaugguguaccuucauuucuuccaaaaccaaacugauugcaucaguuuuauccaaacuggguauuguccucucuccugccucuugcgguucccuugcgagccuggaagucuacuugucuauucugcaguaauguggguuagcacaacccaaauaauaaugucuagaaagccaugaguuuuaaagggccagucccacccacuuacccagguuauaaguaugucuaugugacacuaucucuguguauuucaacacacacacacacacacacacacucacacacacacacacacacacacacacacacacacacgcccccccacacacacacacacucacacacacacacacacacacacacacacacacacacacacucacacacacacacacacacacacacgcccacacacacaaacacagagguguuuccacacaccacaugcauacacauacugguaaaagaacaauucugugcagguggucacauuuucuuuucuguaccacuuuugccaccagacaaaaccaacauaaaacauugagaacaagaguggaaagaaugaaagaccaagggaagaagaauaccaaguuacauuucguuaaggugcuuuugauccuagaacuaugcaaccuaauagguuugaaacuguuuaccugaaagaggacaaaaagagagacuuuuuuguauuggaaguaaccugauuaauuuuuauuuucuucaaggagagauacuugaaaggaauauguuuguccaucuguuggauucaaacauuucuauauuuuguaaauguuguuuuuuuuaucguuuacuauuugcacuacgaugguguuugaccugucuaauccuuauuuaacaaguauuuucuuugggugggggugggggugggguuuaagagcugcacuucaugugagcuauaaaagaacugcuacagcacacaaaauagcuauuuuuauuauuauaauuauaauuauuauuauuauuuuguaccuuaaaaauagacacauacaccaaagacauuugugugagccuuuaaacagucugucugugguugguauuguucaccaucaaugagucagggguacagauuuaagguugaguuagguagauuguguucaggcuuaaaagaccugagagguuuggguuuugacucuuuuacauccaugaaacaggacauuucauacuggauguacaguaguguacacuguuggauuaucaaguucaaauucaugagacuacaugcuuguauguguauauauacauugcuugugcauaugcauaucuguauguauauauacauguauuguaccauguccauacacauuuuaagcacuucaggcugucauuuuaaaaauguucuuaaaacaaugaauguuugugugcaaaacacaguauuuuuaagaaggauaagugauagauuuuuuuuuuucuugcuuuuacucuguaguacguggguacauuucaaauguuaggauggggaaagacugaaaaucccagugaguauccagccaggcccucuuuaaauguacaggaugaaauccccucuuucauauccccccugcucccuacaaguuauccccuguggggaaaaaugggauguuacuuuaaaaacaaaaugggcugauuuuuucaacuuauauuuauuauuuauuggaaucaaucuuaaaucagaaacauuuuuggaaaaaaucuuuaggcuagaauaauuuuuugaauaguguuauuacuacuuaaauaauaaaauaagcaggaaaguauuuaagacagugagaguuaagggagagagcacucaggagccagggaguuguacaaaucucuaauauucuauuuugcagccaaaaaacuugcuguguauguuuguacuuuuucagaggcaaaacugaaaagauugucuuacgaauaucaaaauacacacuuaacccaaguuccuaauuuaacccaguguuggcuugucuaaaacagcuaaucaguuauucauuuacauauuuaaaauauagagccuuauuuuuacggacuuguuugaaguuugaaaaacuuuauaaaagugaaaaacucuaauugaaaaaaaaucuauauuccucaguauuuuguaaaauauugaagcuuuuagcauuaagucaguccauagauuaaagucauuguaggaaaaugaaauacaaaggagaaauuaaaucuuaaaaaagcugguuuaacucuuaaaaaaauaaacuaacucaauauguauuaaauauaccgucaauauaccuuaucacauuaggcuguguguaggcaaacuacuuuagucuuguuacugggcaaacauauuuacuguguuccaggggcccucccugucuuaugcaggaaaugcauguacugcauaagaaaugaauuauaauuaaggucuaaugaccuugaagaucucgcaugcgaggacagauggcauguugaggacacagaggugagguggauguccagguucagcuuugccaauuuuugugaaaaaccuuuagcgcccucugaacuguuucuuuaguauuggagcuaaugccgaggccuagagaaauagugggcaagagaucuaacugugccauaucagagaugaucuagaccaugggaagagcaggauuuauguaacuacuaauuauaguucucauucaucugagaugaaucugcaaucuucuuaagcccuuuaaauucuagauguuuugaggguaagcuuggguuuaauuaguagccauaguaauuaaaucuagaaagaaaugaaauuccacaggacaguguauuuacuggagaccaagugacuugguugucacauaaaccucaucagaacucaucaaauuuguauggccuugcaauagaauuuaaauugcuaauauuuuaacaauauuagauauuguuaacaauuuagaaaacaugaagucuugugaacuggucuuucuacauaagugcuuaauccaaaauuugaaaagccuuuaaugcuuaagaucuuaguuucuucauggugugcuuucccuaguguuaaaguggcucugucuggucuccccacuuucucuaggauaauucuuaaauaccugcccacacaaguucuagaugcucugaagagcauuuguaguuaguaucucuuuaauacuuguaagcuucauugacacuuuuccuucccaaaauaagucaaauuucagcacagcaauggggauuuucuuaucuuagaagaccagccaauucuauguucauuuaagauugauuccacacuccauuuucaaggagaggccuuguguuuucuuaaaaggcagaauaaguaaaauugggagcuaugccagacugaacgcaagacgugacuuugugauuccagaacaaacaugccucaguuauaguaacaugcauucaaaugauugugucacuugaaaaauaugauuuccugugggccuuuuggcaacuucucuuuuuaguaucgagaaaaauguaaucaccccaaaacccgcauaagugugacuuguagaugugggcaggagguugggggauggacauuguauguguuuaaauuaaacccuguaucacugagaagcuauuggaggggucagagauaaugaaugcauagaugcuguucacaucuucaagagcaaaagcaaaucacgugucucagcuauauuauuauuuauuuuuaugcauaaagugaaucauuucuucuguauuaauuuucagugggguuugcccucuauuuaaaugcuuugaaaaacagugcauugacaaugguugauauuuuucuuuaaaagaaaaauauaauuaugaaagccaagauaaucugaaaucuguuuugaucuaaaacuuuuuauguuaugugguugauguuguuuguuuguuuuuuauuuuuauuuugugaguuccuuugcauacuacaugcaauucuuuaaccaaugucuggcuaauguaauuaaaguuguuaauuuauaugagugcauuucaacuaugucaaugguuucuuaauauuuauuuuguagaagugcugguaauuuuuuauuuacgauauguuuaaagagauaacgguuggauauguuuucauguguuuauagcagaaguuauuuauuucuauuccauuccagcggauauucugauguuugcgaggcaugcagucaauacuuuguacaguuaguaggcaguauucagcaaugcccgauagcuucuuuggccuuauguuaaauaaaaagaccuguuugggauguauuuuuuauuuuuguucuuugucuacuuguuuuucaagaucgauuuucacauauaucacuauaaauuuauaggugguaauuugguuucuacuguaacuuuccagaaaugagaacuaugggauagaguacaaagcacugagugagagaaguucaguagaggaguaucuauuuauauuaucaugguugaagcuacaaggcuuaccuuguauuuauuuuguucuucuucuuuuuuuucuucuccaauuguagugucggucccuuauaagaaauacauacucuuuaccuuucucuccacuuuucuacuuucucucccucuuccuuuuugucuggaaaauugggaauauguggauuaauucaagucagagaggaauaugcaugugaaugaaacauacuucccucuuguacaguucaaggauaaggucuaucauugugagucuaucaucuugacuaagacaggcacuucgaauagcuagucgcaucacaacuucagaggggaaaugaggaaaauggauaacauuugaaauguaaauaaagaaaauaucuaauacaaaagaaaaaagaaaaaagggagaguaaugaaugcauguaugcucaccugcucauuugugcucagcucaauuucuccacucuuacacaguuugagacccuccuuccuccugccacagggaaucacaaaauaaauccccaaccccagugacuuauacaugaauuaucacugcaaauuuuauauagagaccaucuuaaucuagggaaaaaauccuguaacuuaaaaagaaauguugguaauaugcaaacacacacacacauguuagguaacagagacugugucaucuucacaccccaaaccauguccacugugguuucagcuuuugugauagaacaauugcauuuggaggcacugccaauaagggguagaauagugagugcuuagauuccuucuccagucaaaagaccucugcuauuucugcaaugcugcagcugaguguucucuuuggcucuugaaaagaaaggauguuagcuccagagucuccaugaaucccucucuagcuuuccuuaauuguuaugcaauuagugauuacaguaagaagaauagcaaaagggaaauguuuacccacaagcaaagugccacugaacaguuucaagacuggaaauguacaauugccucacucugugaugucuaauuucauaaaagcuguguuccaaagaguuuagauucaucaaguacacaccagagaaauauuuuccuuguagaagacauggcaacuaagauggagagguggauugggaaauauuaggacaacugauugagcacacaugauaaagagccagcccccuuuuugguccccucaggaagaaggggaaaugcuggucacuauucagugucugucagaagggagcagaaaagccaccccuggccagagcuaauuugcugcuguauuucuuccugucgugcugcuggccugccugcaucauagugauguugggcacacaauguucucacacaaauaccauaauguggcaacaaaagcucccacagaauccgcccuucauuaaugaaguugucucaacacaguggaguaucaaggcuaagcugugugaaaagcgcaguacucgugggauagaaauggucauuaaggcaaaacuuuuccauuguuaaagaaagaaaaaaaaagacaggaaagaaaaaagacaaaaaaagacaagcuuugcuaauguaugccagaagcagacaggccuaaggcagaggaugagaaagcacccagcuucaaaguggguauugugcuuccacugcuaguccuuugaagcccggcaucaaacuccucuaaauggaaccagcgaagcuucugccauugaucucaacaacaaauguuuguguuucauggucaauuuguuuaucccucaaagacuuuuaguaaugcugucauaaaauagacagccucuugaugauaaaacuaauuuuccacaugaauaaucauauccuaaacauuacagagucaccaccucaaugugauggcuggagucuguagcauaccuuuaggagcuggcuaucauuaugcaaaguguuaugggacucacaagucagaaaucaaccaauguuuaacguucaaaauaaugaauauauacuagcuuuuacuggaccgugggauagcaaguaccaccaggguguucauauuuguauugcuaguggagaucucuaaaaugguuuuauuuugacaguuugggucaguauaagaaguggagccaguccaaguaugcaugggugaguggaagggaggacuuaguaacuacaggcaagguuugggaacagaucacagaagcuaaggaagcauauuguccacgggugaggcugugcaccacauauacccaaaguucuuaacacguuucagaauacuuuuaagcaauauacaaacacuagcucuacuuuuucaaauguguacuuuggccaccacuuaacagaugaggaaauugugauagaaucccccaauaucaaauaugagggguacgacagagcuggggcagagccaaggacagaauacaccccuccuguuuuccacuaccaacccaacaacuguguggcuauugcuucucauuuagugaguucacaaaaacaaauucuugucuuccuucugauucuacacgcauguuauauauguacaagugcuacagucaacuacuuacugggcugcagguaccaaguaguacaguggugagaauggaagaauacuggaccaauaggcaggaaauaaaggauuucuugccuccaucagucauaacucugcuauaucagauugcauugauuucuaugggcugcaaugucuacaucuacagaaagggcuguguuugaucccuugaaguguauuucaucguuaggaugccaaaauccaaggucguuggacauggacuaaacauaucuuucagccauagcucccaaauacaucucccucuaaaauaaauuauuucuacaaucauauauaauaauuagauauugugaugguuuguagauacuuggcccagggaguggcacuguugggagguauggccuuguugaaguaggugugucacugugggcaugggcuuaggacccucaucccagcugccuggaaguuagucucuucauagcagcuuucagauaaagauauagaacucucagcucugccuguacugugccugccuggauacugccaugcuccugcuuugaugauaauggacggaaccacugaauauauaggccacuucaaauuaaauguuguccuuauaagaguugccuuggccaugguaucuguucacagaaguaaaacccuaacuaggacagauaguacuuuccaaucuacuaauguuuuaauuauuaauuaaauuaguaauucaauuacuaaugcuaauuuuuuaaugucccuguauuuuuaaauacuagcaacagcacuaaaauacuuaauuuaauuauuugcuguaggaaaaaauuguaaaaaguacucaaaaaaguuguucaccaauugccuuaaaauuacacacauuacuccuuuuuaaguuaaauugucaaaaauuaaaauuuaauuuacaaaucuccccauauccuuucuuccuuccaauccuuccuguguacccaugcugaaaaucauggucucuuuuucuuugauuguuauuguuaaacacacacauacacacacacgccaauaauacaccaauaucuaucuaucuaucuaucuaucuaucuaucuaucuaucuaucuaucuaucuaugacuaaaaauauacaacacaauuagucuauuuaguguuaccuguauguauugugauagaauuccccaauaucaaauaugagggguacgacagagcuggggcucugauacauaugugcauauguauaaaaaucauauacauaaugaccacuuuauacuagauaacuauuuauggugcuuauuacugagaugauuauuugucucucccaacauuccugauuugccuauaguuuuuuuuuuuuuaaauggggccccaugaaauuucccuuuucauauuagcaugucuguugguguuuucguuguucaggucuuguuuaggcaaauauauuguugaaguaccaugaauguugucauuucuaugagacauaauuucacaccagguuuucugguccccuggucccacucuuuuucgcuauucccugaaccuuaggugcugcuguuguauuauagauguauccauuguagaugggugccccacuacacuuugaccugaugugauuuuuauuuaauggucucuggcuauugcaaagaaaaguuguuuuuuguuuuauguuuuuuuuuuuuaaugaggggugagagcuauaauuaccuguggguacaagaauauuuaaacuguaguuaggaauuacucugucuuagugaaguagugguaguugguucuccucuguguuacuagacaucacuagccauggaagguuggcuauguuacgaauacaaggcaugauuucucuccuguugaguaggucuuaagucuaauuugacagcugcugguaacuucuaaccuaugagugcccuuaggguuaucauuguggugguuuguagauaucauagcuggagaagauuguugguugcuuccccuuuuagaaguuugcauagcauuuuccaacauuaugaaagcuaauucccagggaagagacauucaggcuuucaagucagauucagcucagauccucuggguuaugugucugaguccacagugucuuccacaauagggauccaccuacugucaaccucuagaagaaaaccaugggcaauaacaauagccuauauuguuuugagagucucuuggauuccccugaugagcacuuuaaaagguuguuucucauguccggcauuaagguuauuguuaaauaguuuauggcacuuuggaggaguacugucagcacaaaauggaugacuuuaauuauauuauauguauauggaaugauuauauguauuacauauauuuuaaguaaauaaauacuaauuugauucuuuaucucuucagacauucuuagaguuauuuuuccuuccuuucuccucuccuucuguauugacauccuucucccuuccccaauuaaaaucuucccucucauuuuacccauauugcuuucucaaaaagagguugaagcaaaccgauaaaauuuagaaacaugcaaaguaucuuaauucucauuaaggguaaaaaauaugcuuguauuuacuuugaaucucuaaguuugacgauuuuagcuauguucugcacacauuuuauuuaauuuuuuuaaaaauaaaauucuguguguaugaguguuugagugcauguauggauauguacuaugugccuguuugguaauugcugaggucagaaaagggugugugauucucuggaacuguaguuauagaugguuauaagcaacuaccuugguucugggaaacaaaccuaggccuucuggaagagcagccaguccucuuauccacugagcuuucuccugagcccucgcccauacuuacuguucuagaucugucuuccauugcaugggauucgauuucuaccuccucuguuucacuguccauuaagagacuguguuuucuucuucuucuucuucuucuucuucuucuucuucuucuucuucuucuucuucuucuucuucuucuucuucuucuucuucuucuucuucuucuccuucuccuucuccuucuccuccuccuccuccuccuccuccuccuccucuuucuucuucuucuucuucuucuucuucuucuucuucuucuucuucuucuucuucuucuucuucuucuucuucuucuucuucuuccucuuccucuucuccuucuauuguuauguucuaucagucuucauguuacuacuggauuuucucuuuuaauacugaagccaagagagaaauuucaaauggaguguggugcucugccccagucauuuccuauguccauauaauaaucaccuguaaacaucacuaaaaauguucuaauucuucaccugccaggaguuuugaagcaacaugcucagaguaagaucagaaaauauuuauuuugugacauuuuuggaacagugacucaacauuucacacuuuuaagauucuuuaacaagucaauauacuggaaaaccucuaugaaguuaaacuuuugguucauaagaaugugaagguggaccccuuagaaaaacugauaccugucuuacucuauuagugacugaauucuuugaaauuggaaaugucuggguauuucuucugcucagauugucuuuucguacucuccugaguaguauguuaaucaguaugcacugccagucauuuggauuaauccuacuaaggucuggcuguaccccuagccagcagcacuacuggcuguggaaucuuugagugguaaaacuuccugagaaaaaguuaggauucuguggacauaugguggaaucagacauugggaugcuagcaguuuaucucuuuuuuguuuccuaagcacuaugaggagaagagguuauuccaccaacacuacucccacagcacucugcccucccacaaggccuaagucagagaguucugcguacaauagucagaaacuuccaaaacccugagcucaaggcagcccuuuuucuucucagguugauuaccacugucauuugguugcacugacucaaagcuaacuagcacagguagcuuucugucacaaccacaauauagaggcaauuuaucaaagacaagacauaugugcucgccuuuuggaggguuugaucagcucuuggggacuacagacaagaagcacaucuugguggaaacacuagacggaaccaaauaauucaacucauccuucagaaagacaaagacaagaagccaaggaggaaaguccauaaauuaucuaacaaauauaaacaaaucuauagccagcuucugaguaagauggaaggcagauuggaaacuucugucacugaaauggagugugagaaaauaguaaggauaagacacaagaugcucucacacaccaagagccaaggucuguaagugaacuuaacaagcuggaggagacccugguggagaagcagagcaggcagguggaacucguagcccagcagagaaguccugcugccuaacaaagcuucccacuagacaguggcacaacuuagagggaagagcugcuccuuacaaaugcccuaacugcagguugaggcgagagugcagaguagugcaggggcucccagggaacuaccacaccagaaucccaaguacauugagaaagcagaagccaaggacucccaucagacccucgugcucacagugccacauggcgccugcuagacccagaaggaucugagaauaucaccuuuaacucaccacagcuaugcuagcauuucccuuuauaaguacucuuucuauuucuuauauuucugugauucaguuuccacuuaucauguauguuucauggugguuuugcuuuuguuuauguauuguucaguuaggucuuagggcuauuuauuuuuucuuuauucugacuacuucaaaccaugucucauauaugaaccuauucuucuuaugucucuuuuuuucaauuucucauccuuauuaccuucuauuuuuaauucuuuuuuuuuuucuuuuuuuuuuuccauuuuuuauuagguauuuagcucauuuacauuuccaaugcuauaccaaaagucccccuuacccacccacccccacuccccuacccacccacuccccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcucugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacaguacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaaaaauauggaacgcuucacgaauuugcgugucauccuugcgcaggggccaugcuaaucuucucuguaucguuccaauuuuaauauaugugcugccgaagcgagcacuauuuuuaauucuuaacuauaaccuuucaugcauucaacugucucuauaauuuguggagucuuacaauaucccaauagucccuuucuagccacuuuacuauucucaacucuuuucacaguugaccuaauauuuaauacuuaccccaacucuguuuaucuuucuguucuuaaacuuacuaaauaaaaucugaguaugcuacacauugucucuggauaguuaucauucuauaguuauuuaaguuaaugaagaaacuauuauucauuagcuagugugagguuugcguaaagauaauaguaagcagcuaugguugcucuugcaagaaauaauauagaguuuauaccugaaacugcaagcuccuugacugaggaccuguuuuucugaacuacacacucaacucuacaauauccaguuuccacauggacauuguaaauaugucaacugaaagaauauagcugauaaacaauagcaacagcagcaacaacagcauaacacagguugucugcuaugauauuaugugcucaacauaugacagggaagcugaagccaugaauauaaacaauuuuguugucugaaugagaccagcacaauaauaauacaaguuaacgugccaggccaguguggguaggggagaucucauauggucugaucccuagaugaugagcuucagauggucaaugcuugcugagagaauaagagucagucucuucuugauaccucuaucacauauguugacaaccuaagguggacacaugcauauauauguaaaguuaaguguacucagaagauauauguauauauauauauauauauauauauauauccacacacacacauauauauauauuucuaaaaauauauucaauaaaaauagaccaagcaaagaaauaauaucagauguauaaaucccaaaauaguacuguaagaaacacacaaaaaacaagacaagacaauuccugaaagaauuaaguauauaguaauagcaucuagugaaauugaguuagaugaaauccugaagcauugaaaagaguuauuauaaguauguuuaaauaaaucaaugaaaauaaacuccugauugauaacacaaacagaugaaauaaggaaagugacaugaggaauuccacuaagggacauacuaaagaaaagucaguguaaaaugcuucuccagagccaugccugucugccugccgccacacuccuaccgugauggucgugaacuuacucucuaaaauguuaaacauucgcccacauaaaugcuucuuuguauaaguugucuuggucauggugucucuuuacaggaauagaacaguaacuuaaacuugugucuaaauuuccuucugcccuagaaacaugcuagaaaugaauaaaacacaagucaauuuaaaaagcuuugugaaaagacugauagacuggaucaaggagagcuauccuuaucaauagguaaguuaucaauagacuaucugagcuugaaaugaaggaaguggaacaguuaaauaaggacaaagccaaaauacuguaagaaucaguaagacucuugagacaugugcuacucugaaaagauaaacccuccacauaauaggcauauagaaacagacuaacuggucaguugaguagaauggagggcccacauauaaacccacacuacuauagccacuucauuuuuggcaaagaaucuaguaauauacauuggaugggggaaaacauagcaucuucaaaaaugaugcuggucuaacuggauaguuaacauauagaagaauaaaaugugauccucaguccuuaucuugagcaaaacucaguuccacauggaucaacauccuuaauauaauaccugauagccagauucuaaucgaagagaaaguguggaacaugcuuaaacucacugacacagaaaaagacuuccugaucaggaaccuccuggccuauucauuaagacugauaagggaucagaccaugugaaagacuauuaagacugauaagugggcucuugugaaacuaagagcuccugugcagaaaaagacaccaucauuggaagaaaaaagcaguugcauaauggggaaaagucuuuaccaguuauaauuuugacagaggguuaguaucuaggauauagaaagaacuuuaaaaaaguaauuuagaaaaagauccauggucugaugagaaguaugagaauucuguagcauuuggauggaaccaucagguuuaaaaucuauacaaguuuuccuuccaaucugcuucccaacccaggcaagaucagaggcccaaugcccucccuacccuacagucugccugccucucaggagaucuucaguaaccagggagauaggugagacucccuucugccaaaauucccaugccagcugggacacacacagagcccagcugacuccggaccuacccacccugcccaguuccaacuucuuuacagucuuccagcuuccuugcaggcuucuaaaccugggaaagaucagcagccugauauccuccuacauccuacauccuacauccuggcugccuccccagagguuugcaauuaccagggacacagccugccugucuccuaggaggucagcaaucacuuacaccggaggucuaucuuaaacugauacacaauccuucuaguuugcauuuuuauccacaauuugggcagauccugccccuggagcccagagccugccugucucccaggauauucuacuuaaaccagggaugcaggaggccugcucuaaccacagagaaacaggaggucuccuugaccagagaaagcacugacugccucccaggagacuagcucuaacccagguuacauagauuuaccugccuauaaggagaccagcuccagucagaggcacucagggcaguuaauaucagagauaaccagauggugagaggcaagaccaagaacauaagcaacauaacccaaugcauuuugacaucaucagaaaccaauucucccaccagggcaagcucuuaauacccuaacacauacuauaccugccugcgucccaggaggucugcaauaaccagggaaccuaacaugccugaaaugcaagauucuguccuaaaauaucaucuuaugaggaugguagaggccuuuaaggaggauaaaaauaacucccuuaaagaaauauuggaaaacacaggcaaaaagguagaagcccuuaaagaugaaacaaauaaaacccuuaaagaaauacaggaaaauacaaucuagcaggugaaguaauugaacaaaauuguccaagaucuaaaagugaaaauaggaacaauaaagaaaacacaaauggaggcaacccugaagauggacaaccuaugaaagagaucaggagcuacagaugcaagcaucaccaacagaauacaagagauagaagagagaaucucaggcauaaaauauacaauagaugauacugacacaucagucaaagaaaauacaaaguguaaaaagcuccuaaccugaaauauccaggaaauucaggacacaaugauugaaccuaagaauaacaggaauagaagugggcgaagauuuagagcucaaagggccagaaaacauuuucaacaaaaucauagaagaaaacuucccuaaccuaaagaaagagauggccauaaauguacaagaaaccuacagagcaccaaauagauuagaccagaaaaaaaaaaaaaaaacccuuucaccacauaauaauuaguauccaaauuaauaaaaucagaaaugaaaggggagauauaaaaaaacagaaucugaagaaaaaaaaccaaaaacaucagaaccuacuauaaaagcccauacuuaacaaaacuagaaaaucuagaugaaauggaugguuuucccuacagauaccacauaucaaaguuaacucaagaucagguaaacuaaacaguccuauaaccccuaaggaaauaaaaaaaagucauuaaaaucuucccaacuaaauaaaagcccaaagccaaaugguuuuaguguagaauucuaccagacuuucaaagaagagcuaauagcaauacuccuuaaacuaguuccacaaaauagaaacagaauucauucuaugaagcuacaguuacucugauaccuaaaccauacaaagacccaacaaagaaaacuucaggccaauuccacuuaugaauaucuaugcaaaacuacucaauaaaauucuugcaaacugaauucagcaacacaccaaaaccaucauucaccacgaccaaguaggcuucaucccaggaagacagggaugguucaauauacaaaaauccuugagagacuugaggccccagggaagcagaaugcgcggugguguuggggaguacccucuuggaggcaagggggagaaggagugggaugaggaacugugggaggcggaaggguaacggcuggaaaguaaauaaauaaaauaauuuuaaaaauucgacacaaggaaaugauaggguugcucuuauaucaaugauaaacaaacugaaaaagaaaugggcuuuaggggaaggcagcagcacuagauccaagauggcggccaacaggaggcugauccacguggagcuugaagagaucagcaaauuuggaaugaaaaacuuaaucuccgggcugaugaagcuaauuuauugacucggcaagggcuuauuguucuugacaaccauucacaugauaagggagucuucaggauugaaaucaacuuuccagcugaguauccauucaaaccacccaagaucacacuuaaaacaaagaucuaccacccuaacacugaugagaaggggcaggucugucugccagucauuagugcugaaaacuggaagccagccaccaaggcugaccaaguaauccagucccucacagcacuggugaaugacccccagccugagcacccacuccgggcugaccgagcugaagaauacucuaaggaccguagaaaauucugcaagaaugcugaagaguuuacaaagaaauauggggaaaagcgaaguguggacuaaucugccaugagugauuccagcauguuugaacagagacacagagcaguacauucagauaccccgcaaagcaggacucuguggaaauugacacaugccacuaacuggcuucugcuugaggcaguuacuaacuuucuacaguuuucuuaaucaaaaguagucuggguaaccuguaaagaaggauuaaaaaauucagauguucaaaagagagggaaagggagagggagagggagagggagagggagagggagagggagagggagagaaagaaagagagaaagaaagagagaaagaaaggaagaaagaaagaaagaaagaaagaaagaaagaaaggaaggaaggaaggaaggaaggaaggaaggaaggaaggaagaaagaaagaggcuuuaaaaaauaccauggaauuagcuuagccaaagauaugaaagguuucuauaauggaaacuuuaaaagccugaagacaaaaauugagaaagauucacuagaaaaugggagacauuuccauaauuggaaaaagaucauauuguccaaucuacaaaccaaauccaaaaccaaucuacagaguuaauccaauacaaaucacaauuaaagugugcuauuuacauuuacagagucuuaaaguucauggaaacaugaaagaccauaggaagcuaaagagaucuugaaaaaagaaugcuagcaguacauaucacuacacaugaguuaaaguuauacuaccauaguaauaaucaucugauacuuugacaaaaaugaacacauauuucaugaaauagaauaguagauguggguauaaauaccacagaaguacugauuucaaaaaagaugccaaaauacacaugggagagaaaauuucaacaaauaauucugggaaaacuggacaggaaauuaacuucuuaucucucaccuugcaaaacucuccccaaacaaacaaaaauaaucaaacaaacagaaaaacagaacaacuccaaacagaucaagaacuggguaaguccuggaauacugaaacuacuagaggaaaaaguggaauacaugugaagauauagcuauaaagguaauguaaugauuucuagguaagauuuggucacucaggaaauaaagcuaaucaacaguuguuauaaaucucuaucuaucuaucuaucuaucuaucuaucuaucuaucuaucuaaaaagaaccugccauucaaaugaaaagacagccuguagcaugcaggagaaaauauuuccuggauuuauauccaacagaggguaucuagaauauacaaaagaacuaaaaaccaaaauaucaagaaacacaaauccuaauauaaauaggccauaaaacuaaauagaguucaaauggcaccaaaaaaaaaaaaaaaaaaaaaaaagaaacccaaaccaaaccaaaccaaaaacaccuuaaaauguauuuaauguuauuagacaucaggaagaugcaaauuaaagucuuugagaguccauaucaccauagucagaacagguaucaccaagaaaacaaaugauaacacauaccagugagauugcugggaaagagaacacuuauucaauguuaguaggcuucaucccaggaauacagggaugguucaauauacaaaaauccuugagagacuugaggccccagggaagcagaauguccggugguguuggggaguacccucuuggaggcaaggggccuagcaaacacagaaguggaugcucacagucaacuuuuggauggaucacagggcccccaauggagaagcuagagaaaguacccaagaagcuaaagggaucugcaacccuauagguggaacaacauuaugaacuaaccaguaccccggagcucuugacuuuagcugcauauguaucaaaagauggccuagucggccaucacuggaaagagaggcccauuggacuugcaaacuuuauaugccccaguacaggggaacaccagggccaaaaagugggaguggguggguaggggaguuggggggcaggguaugggggauuuuggggguagcauuggaaauguaauugaggaaaauacguaauaaaaaauauuaaaaaaaaaaagcuuaauccgggaugggguggagagagcagaaugcagaaggggcuuauaaugggggcuaagaaacccuaagaaucuacaaagccccuauggaaacacacuauucugcaaacuaauuaaauagugcaauuuaaaauuuuugaauaucuguucccacauggguagacaaugcuuucuccagaaaacaugggugacuaagugaaaaucucagugccacauaugagauagcucuauaugaguuauuggucaaugaagcccuagauauccuuaaaacagcacaaauuguuuccacagcucuugguuacuaaccauaaguagauaugacccuauuguugaagauacaauacagauuguuuguagaacauaaaaaaacucaagcaggaauagccugauaacuuccuccuuucuggcucauuuucacagugcaggcugcugguaucauucagcuugugacuccuucaggcuacaauauugaucuuccaagaaagauaugcccccuggugccauaguggcaugaaggucaugggcguaacccacugcauuaugauuagauuugagaccuguucuauagaagggaauucaagaugauuauuauaaauccauuaaaaaaacauuuuauuuaaaacuuaaugcucaggaggucacaggugugauuuacuaaauguaaauguuaucuaauuacauuccauuauuuauguuucuacccaggaauuguauccauguucucauccuuggccagcagaacuucauugacaguguacagcaauuaagaaagauacucagaacuggucaaaguacugauaauaugccacuuuucggugcucagcccuaaauaggacaucuguaucagugucauaucucagugaauaccauggaacuagugacagaaagacuugaagagcuguaguaugagaaagacugcugcugugagauacugucuucuucaugugauguggugguugcaaucauacacucacugcagucuaugcuagccuuuuucuuaggaucaauccaacaaugucagucauuaauccaguaauuggacccaaugauuuguaaagaaacaacaaggagagaaacugaauguagaaaguagaugugucaagaaacguccaggguacuuaggaagggggaguuaggaauggguaugaacaaaauaugcuccacacauuuauaaaaauugucaaagaaaacacaaaaaaauuugugugcagcauccugcuuacugguaauggucaaaccggacuugagaucuggaguaaguacuaaaccuauuuggucuggguugucccuuuucagcccaggugaucacaacccagcaaugggauugugcacuugauuuuuuuguuuguuuuuuagugacagggucuuacuauauaacucaggaugauuagagauuuauugacgauccuccugccugggccuucagaauacuggagauacagauggaugacacucuaauugucuagauauuuuguuggauaagguauuuuaauccuagaaauacucaggguugaacaaacaauaacucuuaugcuacgucucuggaugauaaggguugcuaucaauagcaccuuaccuccauguguccuguucccaugcacugcagggaugcaucuauugcucaggaauggaucuaaguuuuggcuuuucaucaaucauuaaagcuuauguuuauacccaaauaguuuucuugaauaacccuguuaaaacuauccauucaauucuaaggaggggcauaguguccacacuucagucuucauucuucuugaguuucaugugaguuacagagacaaaguuuggagcugugacgaaaggauggaccaucuagagacugccauauccagggauccaccccauaaucagcuuccaaacgcugacaccauugaauacacuagcaagaauuugcugaaaggacccagauauagcugucucuugugagacuaugccggggccuagcaaacacagaaguggaugcucacagucagcuauuggauggaucaccaggccccaguggaggagcuagagaaaguacccaaggagcuaaagggaucugcaacccuauagguggaacaacauuaugaacuaaccaguacccaggagcucuugacucuagcugcauauguaucaaaagauggccuagucagccaucacuggaaagagaggcccauuggacuugcaaacuuuauaugccccaguacaggggaacaccagggccaaaaagugggaauggguggguaaggaagugggggggguaugggggacuuuugggauagcauuggaaauguaauugaggaaaauacauaauaauaauaauaauaaacuauccauccaaucuuaguccauuucuuauguaacaaggcuuauuguuauauaaauuaaaucagcauuugauuaugaacauaacaaugaaaguaucucauguaaagaauauauuuugccauaauugaagaaaaagccucuaaaugcuguaaaauaauaucaacuguauuaaguuguuaugugaaguagaacuguggccagaagaggaaauaaagacauuuguugcuuguauaguauaaggccacacuuugaggcaaaaugcaaucagggauggcaccagcuguauuuucuaaucauuccauguccaguuuuugacucauugucuggcaauggucauaagaccuuaacuaaaaucuagaaagaauucaucuucucuucauugaccucuugacugucucucaugucucacuuuaaacagaaaagaagaaauuaugcaaaaccuuaccuaguaauuaucugaucuaaacugucagagguuaaacaugauaacgggaggucacauuuacauaaggucagugaauagaacuucuggacaugguaucaguuuccuaacugauaauggugcuaaaucauauaagugaccagagaagaaucagcuaucaaaacauuuucuucuauucaauaaacccagguacugagaaguggaccuuuggaauccaggugaacacucugccuuuggguuaaaucucugcucuuucaaaugguauuuugguuugcuugacagaaaaaagaggaguuccacuuuccacaaccugaaauagccaacauugaacauagcugaguuuuuucacaauugcauugaaaugucuauuuuguaaacuuaguggcuucuucuuagaugggcgguguuguuuguuuucagcugaauucauuuguguuucuuuuaaaauucuguggccuuauggcgacucuucuaccuagucugauaacacaaugccagugaggcaauuggcuuaaguucuguacacacaacccuuccucaguuuugcuuuccugugagaugaaagaucagaguaucccuugucaagcuaauguaaucaaaucugugacugauacccacauguccauaauauagaacagugucugguguucucaguggacugaacacaugcagugaaugggucauuguaugcaguuccagugucucagaaaacuguauacaucuacugccugggucuuuguguggauguucaacauucuccauauacuguguacaaacagugacugccccaugucagccuuuugaaauuuugcuuucacucgucauauuggauccacaguguuauaaauuuagauuuauuucuuuauaaaucuuguuacacuauuuguguugugucacaugaaaacuuguaauaauagggaucauaaucuauuaagaacuaaaauguaaauuaaaugauucuaacauuaaugguaaguaauuuuaaaacuuuuguggcuaaauuagccaugggauuacaugaugauaagacuaaagaacauacauacacaaacccaaauauagaaauggacaacauuuguaaaauuuuauaggaacauuuaaguucuuguuuuugauuaaaagaaucuugcacaguaaauuguaaaagucauacaagaaacaugaugucauccuuuaaucaaagaugcacuuucaaagaaagggcccuggcccuguaucaaaagcuugacgaaugaaucuacagugacauauuuuagguuaagaccaaauguuauggacauaugucauuauguauaauuacccucuucaaccaacuucuuuuccauuaacuaucuaucuucauaucaguaaagaaggcuuugauggcacaucagaacaauggaauaguaugagcaugaaugaucaaguaugugguaggagaugauguucagguauacgaagacaucauaugaugcacaaguccagugaguauagauuaaauacaaaacaauuuaagaguauauuauucacucuagaaaauaacuguucaacaccuugaaguguucaagaguauuagacauugaaaugacacuauuaacaauagaaggugaaaaggcauagagagaacuguugguuucauuuuuccugauuuuuagaguugauuuuacuuuuuuaauauagaagaaucaaugaaaguucccuagucaucauuauucugcuggcuugauagccaagcucugguccagucccacuccaccuugguuucagaaauuuaccucuuggaugauccucuaucagaugacacgugacauuaagguaacucuguaugaucaauagcacaucauagaaagucauuuccaugauuugauuugaaaggaucauugggccuuccuugguguuuuugucuuucugucuaucuuuuaccauucauucugggguaaggcaguuuccaugacaugaaaaaccucuggaggagcucaugugaggaauugauagucguuggacauuuuuuuucugauuuuuuuuuuuuuuugcauuagcuggaacuucuagguuuauuugaauuagaauugaauaagagaaggauuccuuaucucauuguuaaccuuggaaguaagguauuguauauuuuaaaauuaaauaauguuaaaguuugaaaauauauucuaucaaguuaaagaaguucccuucugcucugauuuuucuuuuacaccauugauaaguauugaauuuguuguggaagcuguuggauuuggacacaauucuaauauuuuaucuauuguguugguacugucaucuaucgguuaucagguuucauuuagauucaggucgucucagucuuuguauaaaaauauggagccuggacauuuucauauugugcggugagaugcuuggucuuaguuuuacuuacaaccacaacucuuauguuaaaauaaaaauaauauugagcacagguuuccaguggcacccauauaauacauauacccauauaauacauauaauacauauaauacagcuuucauuugcuugcagcacagauugccacaguugguuuauugcuccugaccuuuacuaaauggagugugaaguaaaggaggaaaaauuaugacaauuagagaugagugaugugagauaaagaauuaaaaaauaaaucacuuaguguuuggucuccugauguaaaggaaacacuggguagggugucucuaccagcagaggaggcaaauacaggcucucaaugagccacgcacaugacuucaaagacaugagcacaccaguuggcaauaaauauuuauaaaugagacugagguauuuagaccauuagccugccacauaugccuuccacacaaugaaauaugaagccuaaaucaugauaaagacaggcagaacaaauaaucgaggggcuaaauuuaggcucggguaaauguucagaugcauuuaaaaauauggaucuauguacacaggcauuucaggcaaaguugagguuuaaaauagucaacagcugcuuccuauuucuuuuguuguuucuuguauauuucucucugcccuuacacucuugcucuauaaucccccaccauguccaauauaaaccaaagcuuuuauauuuugucagacuaugugauaguuuguuaaaaugaggaagaaggacaugacuccaagaagcauaguuguuucaugcuagucagauuucaaacauuuuucagagucgaagcuaaaguuuucccaguuugguguguccuaguagaguuuuuaaucuuacagugaccguucuguccauuuaccuaugaauaucauguacugaggaguuucagaucagaauauaagcucuuaaauuuaaaaaaagguuuaggugaaacauaguuuguuacaaauucuggagucauaacugagacagaggggagcauaagcuaaugagaacagauaauuuacaccaaauaguuaagucugguauccccuccaaaugagauggauagauuuccuaaagacucugaacaucccucuguacguguuauggggaaucauugccucuugaucugggacacuggcuaacuagauuauuuagauggaacagaauaaaccagcaacaucucuagagucaucauuauguuauaggcaagugugcugucuuagguuuucauugcuaggguaaacacugugacaaaagcaacuugggaaagaaaggguuuauguuaucuuacagucuauuaugaagguuagucaggacaggaauucaaggaagaaacuuagaggcaggaacugugaaaaaaaaaagacauggagaaaaaacugauuauauuauugucucuuccuggucacagcuuccuacacacagaaucugagaaaauauaaccagauuauuucaccccaaugaugcugguuucuucuuuuuuaaaaaaaaauuauuagauauuuucuucauuuacauuucaaaugcuacccugaaagucccuuauacccuucuccugcccugcuccccaacccaccugcuccugcuuccuggcacugguauuccccuguauuggggcauauaaucuuugcaagaccaaaaggcuucuccucccaaugauggccgacuaggccaucuuuuuuuuuucuucaauuuuuaauuagauauuuucuucguuuacauuucaaaugcuaucccaaagucccuuauacccucccuccucccugcccugcucccuuacccacccacucccacuucuuggcccuggcauuccccuguacugaugcauauaaaguuugcaaaaccaagaggccgcucuucucaaugauggcugacuaggccaucuuuugcuacauaugcagcuagagacacgagcucugggagcacugcuuagcccugagauccaucccauaaucgcccaccaaaugcagacacuauugcacaugccagcaagauuuugcugaaaggauccugauauagcugucucgugugaggcuaugccugugccuggcaaauacagaaauggaugcucacagucaucuauuggauggaauacagggucccuaauggaggagcuagagaaaguauccaaggagcugaaggggucugcaacccuauagcuggucuuaaucacaacuaauuuuuaaacuccagcuuaccaacaucaauugucccaguaaaucaaagaauucacuuuggggacauuaguaucuucuuaaucacugcucgacauuuacccuaaguugaaagagccaccaauucuucauuuaaaaugucacaugaauggcaccaauagagucuuuaaagaacacucaaacucccccucuggaucuuauguucauaagcuaguccucuauugucuguuccgcucucauuaauuuuucccaaauucucauaacagcucauuaaguucuauacacucaauggauuuuccagccuaaaguuucaaauuccuuccacaaccauugucaaaacaacuuggucagaucugucacaacaaaucuugcuaccaauuucugucuuaguuagguuuccauugcugucauaaauaccaugaccaaaagcaacuugggaauaagggguucacuucaucucaugguuuccagucuaccaugaaaggaugucaggacaagaacuuaaggcaggaacauggagguaagaccugaagcagagacuaggguggaaugcuacugcuuacugucuugcucuuccuggguugcuagguuugauuucuuauacaccucuagacaacugcucaguuguccuaauucagugggauacccuuuccauugucagucaauauaauguuccaugagcuugccuacaaauauuuuuggagguggggggcauuuccuaagcgaugacuccuucccagacauuacuaaguucuugugccagaaucuguaauucuacguuugcauuaaguuuacaaaaaccuagcaacccacaagcacuugguuuagaguuaguuauuuugagauuaauuuucacuguaaugaccuugcaucaguuacuugugauuuuaguacuuuuuuuuccuucuugaaguuuuuuauuuuuauuuuuaaauuagauauuuucuuuauuuacauuucaaauguuaucucuuuuccaaguuuuucccccaaagccccuauccucuacccuucccccuccccccugcuccccaacccacuccugcuuccugguccaggcauuccccuauacuggggcauagaaccuucacaggaccaagggccucuccucccauugaugaccgacuaggccaucaucugcuauauaugaagcuagagacacaagucgcaccauguguuuucuuugauuggugguuuagucccagggagcucugggguuacugguuaguucauauuauuguuccuucuaggggguugcaaaccccuuuagcuccuuguguacuuucuugagguccuucauuggggacccugugcuccaucuaacgaaugacugugaacauccacuucuguauuagucaggcacugacagagccacucuggagaaagcuauaucagucuccugucagcaagcucuuguuggcaucugcaauagugucugggcuuggugguuguuuaugggauggauccccagauggggcagucucuggauggucauaccuucagucucugcucuuaacuuugucucuguaacuccuuccauggguauuuuguuccccuuucuaagaaggaacaaaguaucuacacuuuauuuuuccuucuucuugaguuucauguguuuugcaaauuguauuuuggguauucugagcuucagggcuaauauccacuuaucagugagugcacaucaugcaucuucuuuugugauuugguuaccucacucaggaugauauccacuagauccauccauuugucuaaaaauuucaugaauucauuguuuuuaauagccgaguaguacuccauuguguaaauguaccacauuuuuuguaucuauuccucuguugagggacaucuggguucuuuccagcuucuggcuauuauaaauauggcuucuaugaacauaguggaacauguguccuuauuacaaguuggaacaucuucuggguauaugcccaggagaggcauugcuggaucuuccaguagaacuauguucaauauucugaggaaccaccacacuauaucuagagugguuguaccagcuugcagcugaaacuuagaggagaaaguggggaagagccuugaagauaugggcacagggggaaaauuccugaaaagaacagcaauggcuugugcuguaagaucaagaaccgacaaaugagaccucauaaaauuacaaagcuucuguaagguaaaggacacugucaauaagacaaaacagcaaccaacagauuggggaaagaucuuuaccaaucuaaaaucugauagugggcuaauauccaauauauauaaagaacucaagaaguuggucucuagaaaaccaaauaacacuauuaaagaaugugguacauacagagcuaaacaaagaauucucaguugaggaauaccaaauagcuaagaagcaccccaaaaaauguucaucauccuuaaucaucagggaaaugcaaaucaaaacaacccugagauuccaccucacaccagucagaauggcuaagaugaaaaauucaggugacagcagaugcuggagaggauguggagaaagaggaacacuccuccauuguuguugggauugcaagcuuguacaaccacucuggaaaucagucuggcgguuccucagaaaauuggacauaguacuaccggaggaucccguaauacuucuccugggcauauauccagaagaugucccaacugguaagaggacacaagcuccacuauguacauagcagccuuauuuauaauagccagaagcuggaaagaacucagaugccccucaacagaggaauggauacagaaaacgugguacauuuacacaauggaguacuacucagcuauuaaaaagaaugaauuuaugaaauuccuaggcaaauggauagaccuggagggcaucauccugagugagguaacccaaucacuaaggaacucacacaauauguacucacugagaaguggauauuagcccagaaacuuaggauacccaagauauaagauacaauuugcuaaaugcaugaaacucaagaagaaugaagaccaaaguguggacacuuugccccuucuuagaauugggaacaaaacacccauggaaggaguuacagagacaaaguuuggagcugugaugaaaggauggaccaucuagagacugccauacucggggauccauucuauaaucagcuuccaaacgcugacaccauugcauacacuagcaagauuuugcugaaaggacccagauauagcugucucuugugagacuaucuggggccuagcaaacacagaaguggaugcucacagucagcuaguggauggaucacagggcucccaauggaggagcuagagaaagaacccagggagcuaaagggaucugcaacccuauagguggaacaacaauaugaacuaaccaguaccccggagcucuugacuuuagcugcauauguaucaaaagauggccuagucggccaucacuggaaagagaggcccauuggacuugcaaacuuuauaugccccaguacaggggaacgccagguccaaaaagugggagugggugggggaggguaugggggacuuuuggcauagcauuggaaauguaaaugagaaaaauaccuaauaaaaauauuuuuuuaaaaaaggcagcagguagaaacaguguuuguggaagggacuggaccugacuugaucugauaugaauuuuugaaaccucaagacccaccccacaccacacccauuccaacauagccacaccuccuaaaucuucccaaacaguucuacuaacuggagcaagcauucaaacauaugaaccuaugugggucauccuuauucaaacuccucaaucuagaaguaagcacuuacuuaccuucagacugugggaggcaccaagggcaacaucauuuauuguuaugugagucucuuaacuuguauggcuaacaauuggaaaagaaguuucucaugcccucuauugggauaauuguuagauggucuaugagucuuuggaagagcauuggcauucccagugaaauaacuacauuuaaacaauguauauauacauauagacuuacaugcauuuuaauauaaauaaauauuaaucuguuuuguuaaaccacuagggcauucuuaauauuauuuugaccuccuuccucccucuucuguauugacccuucuuccaguaaaaucuccccaauuuuccccauuucuucuuugaaaucacuuuuauuuucuauuccccugucuaaugcuucucuauuuucauggucaccuuuuacuuuccugcaaucuauaguuacuccugauuauagacuuauaucugaaaauuuggagcuagaaaccauggaagagauagaacacgggaaaccucauucaauauaauauuuucuaguucuauccauuuaccuagaacuuucauuugucuuuaguguuaaaaaguguugcauaguguacaguacuaaauuuucauuguacauuggucauuugaagggcauuuagguuguuacauuccauagccauugugaugagaaagcaauaaacuuggcugagcaaguaucuucaguguaggauauugaauccuuuggguauaugacaagaaguaguauaucugagucauaugguagauugauuuuagcauuuugagauuucuccacacugauuuccagaguggcugaaccaguuugcaaucuaccaauacugcacaagaauuucuuuacccucacauccuuucaugcauuugugguugguuguuuuguugaucuuugcccauugugacugaggaaagauaaaaaaucucagugguuuuugucuuguauuuccuaauugcuaaaaaggguuccagugcuguuugacaggaugcauguccuggccaagguguggaggucuuuugugguauaugcagagauguccaccccaggacagagcacuagaugugggacccaggauagaaguggggauuacaaauggugugugguggagauaaggaucagaaggacucaccagucuaggcuccaggacacaacacauagugcauaguuggacagaaagguacaauguuguuugugagcaaugugaucaagggauggauguguguauguuggaaauaauuuaucuuuuuuguuguaguuucuaagcugcccaaugaagccauucaaaugaguugggaucauuucucauuuaacaaaguuuuaaaugaagucacuaaaguuacuguuuguuuaggaccaaguugaggacuuucuuuuuugcugauauuuaucuacacuaguucaguuuaguagaauugcaaaucccauuagcaaagcccuucacaauccaaccauaguuuauaaauuucgaggcaagaagccuuugauagugcuacacaucuaacucugcaugaucuuuaucuaaagcugacauaauaccacuucuauacauucacuugaauacuuuuauaaucuuaaaaguuuauauuuuguaugugaauauaauuaaaaguuauucuguaauucucucucuuaguauauuaaaccuuucuaucaguuaacagaugaguuuauugaaacaaagaagaacuaggcuguagcuuuaaauaaaagaugaaggcaaaugcccuuggcuuugagcccaccaauuucaucuccaccccaauauuuuguuucaagagcuacuuucucauguauauaaagauuaugguguuaauaaagaagaggauagcuccuucauaggaauauuauauaaaguauaucauguuucaaaaucaauaaugcacuauuguacgaaucauaaacacucaauaagugcuuauuccauuguguuuuuaauuccucucauguauuguuuucagcacaauuuuuggagcuaggaguaucugaagucaauauuuuaaauucuagcuugaauaaaagcuuagaaaaacuuaauaaccuuuuaaaacuagaauuuagaucuuuaagacuugaauuuaaaaaugcaauuuagcacagugaagaaguuaagguaaucauaucuuauggaaagguuuuuaaaagguguuuugggguaacagcaaggaugcucuuuuggaaagagaauuuuauuuguuugguuacucgcuugcuuuauaguguaacauacuaguuuguuuguuuguuuguuuguuuuuucuauuuacuauuuuaaggugauauauggcauccaggaaaauucuucuagagugcucagcaauuaaaauggggaaaguuggauaacagcuaucagaagaugugagugauacccaaauaaaucaaguuucaauagcuuaguaaaauaggaaaccuuauacaacagcagauuaagucuagacaauauguuagagaaacacacuuauuguggagagcuccuagaguaagagccagagacauccagaagauaugcacauccugucaggauucuuaaacaccagagauaugagagugcagucuuaaagaucagaauaaaagcucgguggaguagugucccuagcagguagacacuacuuucuggugcuugaugcuuaccaguuggcacuaggcacaugauggaauagugauaauuguauuucaaagaguccucuacuguuuuagagguuagguaguccgagacccucugugaagcacacuccagccaaucucaagguauacaacaauauacucauuuacaacucaccagaagaauauugcugggcucugaagaacuuugaaucagaacugcuggaaaccuggucagaguucaaguugauaggaaaacuuucccacaagccccgaguaguaugcugccuaauggcaaggacugcauguagacaggcccagaauuuugcaagcagacucuagagagguccugcuaccaaacaagguuccaucuguggagcacugcucacaggccagaccugcauuuuuaagcuaauuuucugaaggaagacauagagaugggacgggaaugcccagugcugugaucagcauuugagacuagacauuccaaggaauucccugggcaucaaggaaagaacacugagggauucuauguagaaucagcaaacaggcuagacaggacucauauacucuauuccacuccagcuccugaccuuguauauuaucccucuguuauuuaauacuacucgauuuaacuuagccagcugucucuguguuguucuguucuuguuacauauuauuauuguuguuguuguuauuauuucuucuccuuucuucccucacuuccuuuuuaacuccuuaugcuuuucuuauuuauuuuucucuuccaaaugacacauaaaugucuagcuugggcggucccuguaucucagucucuugagagcugggaccauuccauaucucugauuguauuuuaucuuaaauuaaaacuauuauuuuacuauuuuauguguuuggguguuuugucugcauuuauuuugugcuugaggccugugaagaagaggacauaacaccuuucuggaacuaaaguuauagacuacaguugugagcuacgaaguagauacuuagaauagaacccaggggucagggagagcaguaaguguucuuaaccauugaagcaucucuccagcguccugauuguauuucuuaagcucucuccuccuuccucauuugguguuauucccacaaacaguugaaugaaacaaaaaugccauuacaggcuguaaaaauggaauuuacuagagagacagaaauacugaagaaaaaccaaacugacauacuggaaaugaagaguuaaguaaauuagauaaaaauucuccuuagaaguuucaacaauaaaauggaccaaaggaaagacaaaaauauuggggcugaagauuagguagagguguuggaacauucagucaaugacaaaaacauaauaauuuuuuuaaaagugagauuagaagaacacaugaggacuaugggacauggaaagaacagagcuuaaucagaggcacagaauaaacacauagcauaauuuuaugcuaaaaacauggggaacauuuucaauaaaaucagauuagaaaaauccccaaauuuagugaccaugauaccuauucagguauagcauuuauauagaagacagaauaaauaaggccagaaaugagucuccuauuaacauacugcaguucaaaugcuaaaaagaccagaaaaaaacuuacugaaagucaugaauacccaagucacauguaaaggugagcauaucagagugacagguguucuuuuaacugaaacuuuaaaauacaggacuuaaaugacaacuaucaacuguggcaacuauccucacuaagauuuuuguaucugaaugacaaagaaaauauuuccaugauaaaauuaggauaaaggaauucaugacuaagccaccaagaccagguaauauauuggaaggaauucuucaggcuaaagagcaagacagacacauugggcggcuacagaaaagacuaaagcaagauagcauaguagucaagaaaggacuaggaaaauaccaaacacuguaaaucaacaaaaugcuucaaauggcuuucaugccacaccuaaaacucugaaaguguuaagcaaaaaguagagaaagcacuuucugaguaggacuuucucaguaaguuucuaggaaauaaaaaaaaauugauaauugauaccucaugaaauuaaacuuugugcagcaaaguggauaauagauccauuuaaaauggaaccuacagaauagcagaaaauuuuugcugguuauacaacaggcagauaauuuaaaucuagaacauauaaguaacuaaacaucuaaagaacaagauaucaaaaaacuccaucaauaaauggacuaaugaaacaaaugaacagaucauucucaaacuuguucugcaagccccaggacccagguuuaaauccucagcaugugaaaagcuaaccuuggcuguguguuacaggaccuauaaguccuguaauguuggugagagacaggaggauuccgaccauucuaaaugaaacagcuagcuuucagcucaguagccaacacuguaucaaagagucagggaguaaaagaagcagaugcuuaacaucuuucucuagccuuccccauggauucauacagguaguagcaccugauuccacacaugcaugcaccaaacacaaauauacccacauacacagaagagaaaauguacaugaccaacaaaccauagaaaguaaguucaauaucaccggcuaucacuaucaagugagacaggacauuaaaaugagauucuguuuuaucccaauuaaaaaugacagccauuuagaaaauaaauaacaagaaauauugaggauguggacaaaagaaagcccuucuguacaucuagguggaaauuaaccuaguucagggacugugguagcuccuugaaaauauuaacaauagguauuuucuaugacuguguguuuccacuccuggcuauuuaucuaaaggauccuagaacaacaccucacugagacacuuccuuauaaauauuuguuucgccacuauucauaauaucuaaauacuggaacgagucaacuacagggaacccaguaaagauaacacagugcacaaacacaaugaaauuuuauuuuuuuaccaugaagaagaauggaaucaugugguuugcagggaaauagaugaaacuagagacagucaucauaagugaaucaagccagucucaaaaaaacccccaaaaaacaaauaucauauguucuuccauaugugcuuccuggauuauauacacauguauguguauaaccauacaaaauguguauagaacauaggaguagaacugucuauaaggacaaaggaaacuaacgagaugugagaugcaggaaggagagcagggaggugugacaagaagauacuaaguguacaguguguaaguguacaaaauguacaaacacauuuaauugacuuaaaagaaaauaauuacagaugagcuuuguaagaacagcugggauacccuggaggaagcccaagugcaggauaagcagagcuauuaacaucugacccugguguccaaguaauuacacagaauagcuuguccaguagaaaugaagugugucagcaucuaggcuggugguguacaaugcacuugggggaaaaugcugcuuucuugaaaauagccaaugagucugagugaaaaggaauuuaaacaguuguacuuuucuauccaaaccauucuguucucaauuaccugaugaagauuuuuuuuuaaguguaacugaguauuuuuuuuuuuugcaucgguauucaaaagugacauugguuugaaguucucucucucucucucucucucucucucucucucucguuuggguccuugugugguuuagguaucagaguaauuguggcuucauagaacuaguuagguaauguucuuucucuuacuauuuuauggaauaguuugagaaaaauuggaaucaggucuucuuggaaggucugguagaauucugcacuaauuucaucuggcccugggcuuuucuuuguugggagguuuuuaaugacuucuuccauuuccuugugcgauaugggccuguuuagauaguuuaccuguucuugauuuaacuuugguaugugguaucugucuagaaaaacauccauuucaucuagguuuucaauuucguugaguauaagcuuuuauaguaggaucugaugaacuuuucuccauuucuguuguuauguuucccuuuucauuucugacauuguuaauuuggauucugccucugggcacuuugguuaguuuagcuagggguuuaucuaucuuguugauucucucaaagaaccagcuucugguuuuguugauucuuuguauuguccucuuuguuucuauuuguuuuauuucagcccugaguuugauuauuuccugccuucuacuccucuuguguguguguuuccuuccuuuugucuuagagcucucaggagugcuguuaaguuuccaguguaagaucucuccaguuucuuuaccagggaacuuagugcuaugaguuuuccucuuaccacuguguucauuguaucccauaaauuuggguaugauauauuggcauuuucauuaaauuccaggaagucuuuaauuucauucuuuauuuauuccuuaaccaaguuaucauugaguaaagagcuguucaguuuccauguguaugugggcuuuccauuguuuuugcuguuauugaagaccagcuuuaggucauggugaucugauaggauguaugguauuauuucaaucuucuuguaucauuuggggguaguuuugugaccaauuauaugguguauuuuguagaagguaccaugaggugcugaaaagaagguguauacuuuuguuuuagggugaaauguucuguagauaucuguuaaacucauuuaguuuauacccucucuuaguguuacugagucucuguuuaguuucuguuucaaugacgugucuaguggugagaaugagguguugaaaucuuccacuauuauuguguggguucaauguguguuuuaagcuucaguaaaaaauuuuuuaugaauguggguacucuugcauuugggacauagguguucagaauugagacuuucucuugguggcuuuuccccuugaggaacaugaaauguccuucuucaucgugcuugacaacuuuugguugaaagucuauuuuauuggauauuaggauggcgacucuugcuuguuuucugggaccauuuguuuggaagaccuuuuuccauccuuuuacucugagauugugucugucuuuguuauugcaaaccaaauccuagaacacaucaaaaccaucauuuaccacgaucaaguaggcuucauuccagugaugcaagguugguuuaauauacgaaaauccauuagcuauauaaacaaacucaaagaaaaaaaaaucucaugaucaucuccuuagagaaaaggcauuagacaaaacacaacaccccuucauguuaaaagucuuugagaaaucuggaauucaaggcccauaccuaaacauaauaaaaacaauuuacugcaaaccaacagccaauaucaaauuaaauggagacauacuugaugcaaucccacugaaaugguggacaaaagaaagaugcccacuuuccccaaaucuauucaauauaguaauggaagugcuagcuagaacaauaagacaacaaagagaucaaggggguacaaauugguaaagaagaaagaaagguaucaccauuugcagaugaugugguaggauacauaagugaccccaaauacucuaccagagaacuucuccaguugauaaacaacuucagcaaagugacuggauuuaaaauuaaguaaaauaaaucaguagcucuccuuuauacaaaugauaaacagguugagaaagaaauuagggaagcaacucccuucacaauagccauaaauacuauaaaauaucuugggguaacucuaacuaaacaaguaguagaucuguaugacaauaacugaaguuauucaagaaagacaucaaaaaaaaaucucagaaaauggagagaucucccaugcuuaugaauugauagaauuaacauaguaaaaauggccauccuaccaaaggcaaucuauagauucaaugcaauccccaucaaaaucacaacacaauucuucaaagaaauggaaagagcaauucuuaaauucaucuggaaaggcaaaauaaacaaacaaacaaacaaaaaacagcauagugaaaacaauucuuaacaauaaaagaguggcugggggaaucaccaucccugaccucaagauuuacuacagagccauagugauaaaaacugcaugguauugguacagaggcagacauguugaucaauagaauagaauugaaaucccagaaauaaaaccacacacuuauggucaguugaucuuugacaaaucaggaucaaagauccugaugccaaaaauauacaaugggaaaaaaaguaagcauuuucaauaaaugguccuagucuaacugacugucuguauguagaagaauaaaacuagauccauauuugucaccuuguacaaaguucaaguccaagugaaucaagggccucaacauaaaaccagauacacugaaucuaauagaaaagaaagugaaaagagccuugaacucauuagcacauggggaaauuuccuaaaaagaacucuaauggcucaugcuauaagaaagaguugguaaaugguaccucaugaagcuggaaagcuucuguaagucaaaugacauagucaauaagauaaauuggcaaccuauagacugggaaaaauauucacuaaccccacaucugauaaagggcuaauauccuaaauauauaaagaacacaagaaguuaaucaccaaaaauucaaacaauucaaucaaaaauugggguauaaaacuaaaccgagauuucacaacugaguaaucuggaauggcugagaagcaccuaaagaaauguucaaaguccuuagugaucagagaaaugcaaaucaaaaugaccccgagauucuaucuuacaccaaucagaauggcuaagaucaaaucuucaggugacaauacauguuggagaggauguggaacaagaggaacacuccuccauugcuggugggauuaaaaacugguacaacuacucuggaaggagaaaaagagagaguggaguugugacauaccaaauuugaauaacuaaucucucucucucucucucucucucucucucucucucucucucucucucucucucucucucucucaucuaucuaucuaucuaucuaucuaucuaucuaucuaucuaucaucugucuaucuaucaucuaucuaucucuauauaucuuuagugaguagagacuauauuggcugguguggaaaaugcaacauauaaacaagugaaaaauuaggugacuaucuucuagggagccaaaggugaugaugauauuguauugggcacaagcuccaagaagagcaaacauugugaaauggccuuagauguucuaacuccguuucccggaaagaaugguggggaauugccaaagagggagguucaguuuaaaugagcuuuuaaaggagcuguaugauuuccuuuauuuucuuucucuuuauucuuuuuucaagugaagcuugaacuggauggaaaagacagcaagagagagagagagggagagagaaagugacagacagauacaaagacagacagagagagagagagagagacagacagacagacagacagacagacagacagagacagacagacagacagacacacacacacacacacacacacacacagagagagagagagagagagagagagagagagagagagagagagagagagagagagagagaguuugacacuggaguuucggguucccccaaacuucccccuugaagagaggugcccaaccgauuuagcauguuggaaaucuaggauccagagagucacaucacccucuuuguuuuggagcccugcaaauauaaucaggaauagucacaugucauuucuuucaggcucauucaaguucggucucucgaagacuggaauucaguauucacuuuccucauuaucauauugggaaaggacucaacgacuuguucucagacuucagacaaaaugcagcagcaaaagaaaaaaccuauaauaguuucuugaaagauuccaggacuucuauagaagagauaacuuuccacagccuuuucaugagaacugagcaucuauccaagagugaugucuccuuugguggaaaucacaccaggauuagaccacagcucauucuuggagaugauggugcuggcuugggccucaguuuuucacagucugugggaauggaaauuggugcucuuguuccuuagacaugaguucucauguuaauaagauaucugaccuauguuacaacugauggaaauuaauggaauacgacauaagacauggcugcuccagauaaaaaucacuauuucaaaacaugaaccaagaauacugacaaucaaaaacauuaugccuuuggaauuuggucgcuguccugacaaaaguuacagucaucugggaaaaugcaaccucaauuucuuccaucagacuggacuguagguaagccugugugggcauuuucaugauuaguugauguaggagggcccaacccauuuuggguagugcugacccugagcaaguaauccuaggugauguaagaaaacagauugaacacaccgugaggaagcuaggaagcaacaucucccccauguucucugcuucaucguuggccucuagauuccucccuucuuuuccugcucuaacucuccuccaugaaggacuacaagcuguacuauuauauauccuuuccaccuggaguugcuucugaucauagcauuuggucuuuuuguuguuguuugauuguuuauuuuguuuaacuguugcaagagaaagcaaacuaaggcauuaggcaugcuguuagaggacuuggagcauagucugugagaagaagcacauggcuugaguuacaggaucuauucucauuucagaaagcacaucugaagaugauaucaagacaccaggacagaaucugaguuucuugcaugcuuuuggagagagaccuucuacuuauuuugucuuguuucuggaauuuuugcaagcuuuaacuguguugaguauuuuccauuagaauuaucaaugucuaacuauaggaagcuuuugcuccagaugaagauucuuaguguuugacauguuauguuaaccuuccauuucagcauuggggaauggaguacacacccuugugugugcuagaacacucugauauggagcuauaguugaguccaugauaaacuuuucaagucaguuaucucccuucuguuuuucuuuuuuaggugucugaaugccuuuccugcuagcgcaaaauaaauacauaugauacagauccuguaucaaucaauaaagcauuuucuggauuuuccuguuuuaaacugaauuuugacuuuccaugauuuucauuguuguuuguuugguugguuuuguuuguuucucauauaaaaacauuuauauaguuuaaaauguuuuuugagccauuugugacuaaaucauggacauuauaaaauuucauccauauauauuuaaaaucugauuuuauuaauauauuuuuuaaauuaauuuuuagaauuucauuacauaaugcauacaauauauuugaccacauucaucucuaccccucccucuaauuccuucaauaacuaccucuuucucuuacccacucucaacucuugccauucuauuauuauaaucccccuuauccaauucuguugcucacauacucauggguguaggacuacccacuggagcaaggucaaugugccaggagccacuucuuuaaacaaacugacuaccccuuccccagaagccauuaacaaucaacagcuccucagcuaaaggugggagcucaugagcuccucccucuccuuuuaugcuagggggcuacuggcuugaucuuguaugaaucuuaugcaggcaaccauaacuacuauuaguucaugacccuagccauccuuucauauccagaagacugguuucacucuuguucucuucaaccucaugaucuuacagucuuuucaucccauuucagggacgauucuugaacuucaagaggcagguucaugaaacacaaauguaaucuagggcugagcacaccagucucuuuuucucugcaccuuggucuccuguggaucucuauauuauuucccauuuacagcaaaaagaguuucuaugauaaggguugagagauacacuaaaauauggguauauaauaaauuaucaggagucaguuuaauauaucuauaagcuauggguauaggauaaaacguuagaacucauuuuaauacuauggccucuccuauggccuaugaacuguuccuccauagacucuuggcccugauaacaagucaauuauacauguaaacucacagaaguugugauagcauucauaagaccuacauaauaucaagcuggacaaaauaucagcauggaguggggagauggucacauagugccacucacuccuacuugaaaugcuauuggaaauggauagcugccaggagaguuaguuugucuuaaagguguggcuucuaguagguuggcaauguucuaauggaaggccacauacccaagaguauauaaguuguacaaauuagacucaggcuaaaaagaggaugauacaaauuagauacauaugaaauggaugguggucugggaggaacuggggaagagguauauaugaccaacauauaaugcacgaaguuuucaguaaaauauuuuuaaaauaaagucaaauaaagaaaacaaaauaaaaaauuaauauaacaugaucaaugugaauuucaggauggagaguucacuacacuuuaggauaaaaugguacaaugugaaucagcuuuucauuaugcaccuaaauuugaaucacccagaccaauacaaauguacuuccuucauuguaaaacagagguuaauguuuuaaauacuaaaaaauagugcuuacaagugaugccaaguuuaaauuaggcuuguuaccacuuauuccuauauuuuacaaguuggaaaaauuugaaguugccacauccucaaguacagugcccaaugcagaaggcacccuaauaaucccauugaaaguaaacauuuuugauagaauguccucagucuuuauagucuucacugggcauuuuagagcaauaccaugucgggguguagcgaccauaaacugcuagugguucugacugagacuuuuaagagauggaaauccacaaccugaauuaaagaacaauaaugaaucuauuccuugaaguggaaauauuacagauaaguauagcaauaugaaccuuccauuauaacaagcucuguuaauuaugugaauuaacagcaucagucuucaugggcacaucuacaacuuucauuggcuauaugguuuaugguccuacuaggagauuuuaacucaaaauaaauucaugugugugucugugugcuaacauaugcucaucauucagccaugugcaaugcacucuuucuucugcaagaaauagcaugugauuggcuaaaaucugaaacacauguuguugccauaauaagauagaguaccaaagaucacuuuacuagugggauuuuagcaaaggucuaggauuuucuaauauguugguauuuuaguacaaagacauagaugcuauggguggguuugacuuagaaguauaacacucauuauuacacagaagcaagucucauaccccuuacaaauuggaaacgccagaauguacaggauuuucauacaucacugaauguauacuagaaaugauuuaugagauccuggugacagggaaaugccaagcucucccauuuccacucaugggacacauuucuagccaauaauauugacauuugcuuacuggucugaguugcacaggagaaugucucuguuucaguaaguuaauugacucucugugguaauuuuucaagccuacaugauaauaccaaagaaagauaccuauaauuugucuuuagaauugagaugacaaauggcuguucuuuggugaaguuuggugaagucucccgggggguuguaaaaucuggaaguugguagugaggcagaaucaggcauaugauaaagaugcugagauaugcucucuaugaagugaacagaagggcacaggagaguuuuaaauccagguuauagaggcagugguucaucuacuuuucucugcaaggccgauguaguuaaaauaauucccucugacaguuugugcuucuccaagauaagcaaagaaauugacacugugaugguugccuauguuaaucugcucuuguaaguggguuuuacaggcgaugagagagacaggcugauugaugaguuacgcguucuaauuuuuucacuugacuugauggaaugccaaggagacuccacugugaggcccugugcagacagcaucuggagaaacauguaaaccuccagagagggugcuaguucaggucauuuucaaacugucuaaugucccagaagccaaauaauuucaugggaaccacugacaugugcaauggaaacgguucuuagggaaacagugaagcccuggaccugggaaccaaauuccacuuuuucucaccucagcuccacuucccucagggcccacugaggcagacuuguaugcugcaugacaaauuauuugaguuugaaaggcuguucauuuaccaugaagaucuggcgggcaugcugacuuagacccaggaaaugaugucacauucuuuugugacuuucucauguuuucuuucuuuuaaaugucuuaucucugacucuugacacuuuuguuuuaaaaguuuggugugcaauuuccccccaaauuauaucauaucauaucuucucuuaaaguuagcuuaggcuuacucuugggaggaagaugcucauaucuuuuguauacacagccauacuggcuacgguugccucauuguccaccauuacgucuucaacccugcuuuuccucuguaaaauuccuuacacauugccuugcccaggaagauuuugugauaugugugugagaaguuguuuuuccuuagucucauggagaauuaaacccuuaaaacuauuuuucauguauuugccuauuuaaaagaguucucucucuuuuaaaguucucucacucucuggaagcccagugcucaugcggcccuuuggcccagaacaaugaguuaucuauacaguccauggucucaacagaaagaaaucuauacuuaauggugugaacagacuucacaggguauaaauugucugugugauugucuaaccuaacuugucaaggacaucaguguccugaagggaacaccugaagggaacacucauucuaggaagagaauguugauggaagagacaucugauuaugcuauuguaaguugucaaaucucucucucucucccucuguuucuuuccucucuccacccucccuuccuccuugccuccaucucuccacugacucucccuuucccauuuauuuucaucaaugguuguuguaaaucggguacuuaaaauccuguugguuguuacugaauauuaaaauuuucaaaacuaaauuucuuacaagaugaaauaagguaaauuacaguugauaaaguuaaucuggaauaauaguaacugaguaauugcugaucuucucugucugguauuuccuuucacuuacuucuuuuggucucagucacaguauguaacagaaaaacaaauaagaaagcaaauuguaggaguuuuucuuuuugcuuccauagaaaacuugcuugcaaauguaggcagcuuaggaguugcuucuaguauauuccaucauguaccacugagcuuuggccgcucgcuguguuuggaaguuguugagggggagcagguucaccauugacguuucacugugagcagagcccugaguuaucgugaugcugccucuuguuaugacaggagucucuguagacagagaaaccacaccuuguggcuuagagagaauccaacuccaaugcucuucugggcagccugauuuuccucaucugugaacauacccuugaaguugaaacugccauggugauuuuauuuuccucccacaccacaaccugagugugguaugcuguuaaguaggcacccuucaggauuuucacuugaaagauaaauccuuggucaaaauugucuuugccugcauggcuuuuucuuucuaauuuguuuuccccacagggaaagaauguguaaugcuggugcuccauugcauguuucuggucaaauggaagaccacagucuuuauccauguuuaagucugggaggaaaaauacuaaaacaaaucuaguaaaaauucuucccuaaacuacuuagauuuguggcuaguacccuccugaaagaauaaugaaguuguucauuaaguguuugguaugcugcuagaaaccggcucugguuccauggcauggcuauguggguaaagaaaaagcuacagaccccugccagaaaacaggcgugacugaccuuucccaugagcagaugugccagcugcugacauccccgcccaacugucugccccaguuucaaaaaugacaccauucaaguuagauuccuuuggguuuggaaggccuuauaggcuaccagaauuccauauuaccuugucugugccauaacuguugcuuugcaugcacccauguaauuauugaguucaucagaagcuaaugaaugauauuuaguuuucugaaauuauggauguggugcuauuuuuuuuauggugaugauucuggguuuguuguuauauaguuaugcacagauuucgaaauacacuucacuacagggcaaaaccuuaacuccuuuuuacuguuuguacugaagcuuucauaagaguauacauggagugauuaucgaacucuauagauuaaggcaaagcacucgacacuaauuauuauguacacauuggagcguacuaaaauuccuuaaaauuacagagcucauucugauuuguagaaacauuugcccaguuuuguuuugcauggugaauuuuauuuccaauuccaauggaaauauuugaacuuccauugauagacuucuaagugucacccugugcacagacacauuagagagcccuuaaagcagaaacagaaugaaauaaacaaaauaucagcuucaaacagaguucuauuuuuguggaguugcugguacagaagcaaaaucuagcuuugccagaacacggcauuuguguguauuuuaauucuccaguuugauuuuugcuagguauuuguaguauauugcauucccaccaggugucauaguaaaaaauauagacaacuaaucuuugaaauggaaagauccaucuuucauccuuuuguccuuuuagcaauguuuuaugcuuuuacccauuagagacuagugcuggugaccuacuuagacauuugggauguguuauagaaugaaugccaacugccuugcugacaaagccagaagacauaugacuccaaaagcacuauuggugguagcgggcauacaaaauaugcuuuaucaaagugugcucuccagaguaagcgaguuuuguggauucccagacuguaagacuauucucuuuugaauguuaucuacaguucagagaaaauucagcuacagcugaaacccugaguucacucaggaaauguggcaguaagaugugagacauguugcuggucccgagccagguucauaggcagaggaacaccagcaacuuaaagguuggaaaugugguuuccauaagaauguucucaaggaaauauguguguuguggauaauugaaaucuauguggaguuuugaaccgaccuugacaaagcccuagaauaauaucuaaguaccacauaauauaaaaacaaugaaugucguuaaauuccuccauccuuccuaggcuuacuucuucuguguucagugucacagacaaccaaaugacaugguuugcuugacugccuucuauucuugauuuuuuuucagcuugagagaugaaauaagacaaauuauuauauaaauauuuuuaaaacgaaucauuuuuuaaccauucaguaccuuuaaaauauacauacaucacauauguucuuuuacaugcguucuuuccuuauaaaacaaaaucaacaaucuuuuucuaaaaacucucaguucaagucacacacaggguagcagaaauuucugccuucagaagaugauaugucauaauggaugcuuuauuaugcacaguucuaauaaauacaaagacaggagcucaaaaagcaaaagagacaaaacaaguaauuuggggaauauuugcaaagcaggucaaguggucuuuccaggcugguuugggcacaguguggccuucgccagcuugcuugccauuuucuuugguauauauaugauuauagcucaaagccccuuuuuuuguuauuugugggagggacguaaucagauuguagcuuuagaacaauuagauguguugaaccucagaaaaccucagacagugagauucguuucucuauaaguauucaaagguuuauggacaugaagcucaucugaacucucuaaaccuguggaguccgccaaguuggcuggaagaacugacaaguuugggcuuuuucccaagccuuccaucacuuucacucugauuccugccagaagucaaacaagaaaaagccuuucuugucguguuuugacaccuccugcucuagugccugcuguaaacucuacauccaaacauuacagcagaucaacugagcauugagaauauacacgggcaaagguucagaggguggcugagagucugagaaagggccacucagccucauguaaauaaugugcuccuagaguaaaugaaagagugacugauccagcucuagcucugcugccugggcccucuuccgugagcuggaugucuucaguagcacagcacugcacauacgaccuguuuaauaggcauucucuaggaccacccaaaaugacaccuuuagcugaaaauuuccuucagaaaauuuccaagaaaaggaaaaggaagacucaucuagcaaguuucuugggucuaaaugcauaucuuucugcagaaguucaauuuaacuguuuuaauucaacuuuguugucuauauaauagaauuucuuccugugugcuucccucucccauuuagcauuuaacacuaauuugucucuuuugauaaauuaaccuguaguauguggcucauaugucaguaaauaagcaaggcauauauagcuacaagcugacuccacuccccaaaauauugcaugcaauuuuaauauuauuuuaauugugguaaaaaauagcaccccagucuugcuuaggcuauucaacaccaaugcagugcacauuuaguuuagauauuauauucaguguuuugaaaacuguaggcuauaauugacaugcucgcagaaucagugcaauaaccuauaguaggauaaacgguaucaguggccuuauacugcacaaguagcuaggguuuggucauuuugcuuuauaaaggugucuaugugugcaaguaucccagucaauguaaaauguuucuucccauggaugauaggaaaaaaacuugacaguaaucaauuuagcuaugggagugauaacuuugagauaacaauaauugauguucgaugagaaaaauauccagguuggcacuccauguugggacuaagggcuuucuaagaaguugguccugcuugcucucucaccaagguagggaagucuugcauaaugcaucccugggauccugaacauaacaccugcuaguacugcaagcuaagcaaucuuuguuccuuauaaauuuccuaauuuauagcaauauauuacagcuauggaaaugaccuagacacuucccguuucccuccuguuccauacaagcauccuuggaacuugggaaucagcugagacuagaagaagaaaaaucaaaucaaauuuugccauguacucucuauguauacuuagacaauauauuuugcuuugauuuccucacuuuuacagugggagaagcagugacuuugaaucaauauuauggagucuggugcuaccuuauagaaauauagacgucacuuucuucuaccuuaggguacuguguagauaucccuaccagcacucaucuagguuggcucauuuauugucugcuuacuuauguccuauaauugaaguucuuggagaucagaaaugucuuccacccauuuuuugucuuuucaauaauaucuaacacauuuauaggcuuauaguggguauucugucaguguagaagaguggacaugauguaauaaccuaacacaggaaucacuuacuggagccuauuaucuacccuuuuguauuucuagcaauaaugcuaugagguuuaguucuugcugucuccaucuccaauaugagauaaccaauucuuacucuuuaauuaauuugcccaaggguacaaauaucugaaacaauggagcuggacugugcagccaguuaggucauugaauaagcgucaagcuauaggccacaccucugacuggaauuuucuuauuuugggguaaguccuuggucaauccugaugcuauuuccaugguuccccacucuacauacaaaacaauccuucuggacaggcacaaacaucuggccaaugggaacuggacaaggcuccaucuggaagcuaucagcaccucucaugggucagcugcaagggauuuuauuucaaaugacccaauacauuuccucugcuucccauucacagacagauucguuggcuacaguguuuugauagauuagggguaaaggucuauucuaauggcaacuuaauuucaaguuaguggguccccaaaugccauuuucucuugucaaagacugugguucccuuuuccagccacaucucuuucugaggccuccauauagcucacguuggucugcaccaugcaaagauucuauuuuuuauauucacuuaaacaauacuaaagaagauugccuccuuagaaaccacuuuucuacuuuaaagauuaagaauuugaugguaaaugcccauucuccuuccuacaaacugacugugggacugagcaguauagagccaguggcugucuugcuccuuugguaaguccuguuacucacaggcucacauuucacacccucuuaagggcaaagggaagguuuagguaggaggguuuagguaguaacacaggaaauucuuugauucuuauuuuucuuucacaacucaagguuauaaguuuagucagauaaucucagcugagggcuuaauaaaacauucuuggaucuuucucuugaagaauuaaaaaaaaucaucagggccagcaauguggauuaagggguaaagacacuugcuagucagacugucgaccugauuuggauucccagaagcuaccugguaaagggaaaagcuaacuucuacaagaugcucucuggcuucacauuugugacuuagcacaugaguggauacacacacugauccucacuuguaugcacacaugcacauacgcacucacauacacucacacaacaaaugagaguuuugguuaaaaaguacauacauuucucgcugcccuuucaccagcaaaacuuaacuugauacucacauuucaguauucagaaacaagacauuaauuucuggagccaggauaacugaaucaaugcaucaauaaagcagaugacuuuucuaagcagccagagauaaucuucagaaaccugaaaacuucugauguaauaggaaaggagaaauacuuuaaggcccaggcauuccauccuuguagcuguuauaguuccaacgcaugauucuuuuuccauauguuuuuuucccuccuaagcaaaguaucaagcauuucugaaaacuaaaauuugcuaacuuuucuauacauccauacauaaaaccauguguuuggucacccaaauaucaaguucuaaaaguaguuuaucugaccccccccaaaaaaucgcauauuuaaaaaauacacuuguauauuugaauuuaauugguccuuggaaaaucuguaguagucuauacacacaacaauaagucuacuuuaaauugucuuuuaagagauuuauuuguuuuuaauuuauguguaugaaugcuuugucuacauucgugucuguggaccacauguguaccaugcccauugaggacagaaguagacauggauccuuugggacuggaguuacaggcaguuuuuuugucauugugugaaggcuggguguucuggaguggaaaccaauacucuuaaccccaaauucuacuauaaaaaaauaaaaagaaaagaaacagacauaugguuacaugauauucaaacaaaauauuugaugaguuuuuaacauguaaaauugcaguauauauaauucaacaguguccaauuaucuuaguuuauuauguagaguuuaaugcagagagauuucugaacugcuuacaucuuagaaguagcuucagcauaugcagggaucaguuguuauaaaugcagaucagggcugacauucaaaugggagucauauucuucaacuacgauuuuccugagcaauauguccuauguuuucuagauaagguguggguuaaacauggggagccgcaucaggcccagagcucagggcucuggucgagggggcacucaggaaguuugcaccccaggccaccgcugggcagccaggggaccuugaacuggagguagggagguugcagucugggauucccacagaacugcugaagaaguuggcucaguaggccuagugucccuaggccuacacagaaggcaacgaccgcagacaccccuggguguugcagaugagcugagaacagacuggggaccuguggcuaggauucagcccagggcugaagggaaaaaggugggaggagggcacuucaaacugagucccucagggaggagagucuggugggcagguugucuugguggagaccauggcugagaacacagagagaccucccuagggagguuagauaagcggcucuugggaggaagaccugcucuauugcauggcuggucccaaagagaagaagcgguccaugauuuuaaggcauuuauuguagaaaggcagaaagagggagagaguagaaaaguagaggccauggccacguggaggugggagaggaaugugaagagaaaggagagcaagggaucgagagacaagaguaagagcaagggaguaagagaaggaagaggggccaagcagcuccuuuuauaguguugccagguaacugugcgaagcauaccuggcuauugccagguaacugugggguggauuccagacagaauaccaggagcuuggggcauugcccuauaugacugauggccacacaacucucucugagguuggggggagcugugggaggcuguagcugcagcaggagucaggggcccaaggagcguggccaaacacuugccauuccuugccugcagaagucaccuaccaggucucuggggcucaaagccuguacucaaccagggaccaugcugccuguucaaagcucaccgccccaugauaaagugccugaaacuuaacacaaacauguugcuucuaguaaauuucuugcugaauaagacuaauuuuagauauacgcuuaauauauuaaauguugccagucugugcuggugcccugagcagaucauggguacuaguaccacacccagucccacaacaccuagaagaagcugacucccaggcaacccaacaugcccaggaucauaggggaggaggccacaucaucugccccaacacagggaauaacugggacuaucuggauccagggacacaggaacccuggccuggccaguggcaaggguuccuuccagucugaacacaugcacugagcagacacugggugcuagcuccacacacagucccacaacucagaggaagcuggauuccuaguuacucuaacacacccagggucauaggaucacaagaucuugggagcuuggccacaccaagaucucaggaucccagaagcagcuugacacccagaagcucuuacacacccaagauaucaggaucacaggauucccagaaucacgggaucacagagauaacuggacucugaggaguucugacacaaccaggaucacaggagggaaaggcuccagucagagacagugagggcagguagcacuagagauaaccauauggugagaggcaagcauaagaauauaagcaacagaagccaagguugcuuggcauuaucagaacccaauucuccuaccauagcaaguccuggauauaccaucacaccaagaaggcaagauucagaucuaaaaucacuucucauaaugaugauagaggacuuuaagaaggacauaaauauaaguauauacaaguagaagcccuuaaaaaggaaacacaaaaauuccauaaagaauuauagaaaaacacaaccagacaggagaaggaauucaacaaaaccauaaaggauauaaaaauagaaauaaaaagaaaucacaaagggagagaauccuggagauagaaaaccuaagaaagaaaucaggagucauagaugcaagcaucaccaacagaauacaagagauagaagaaacuaugucauggguagaagauaccauagaaaacauggacacaacagucaaagaaaauacaaaaugcaaaaagcuccuaagccaaaucauccagcaaauccaggacacaaugagaagaccaaaccuaaggauaauagguauagaagagagugacaauuucuaacuuaaagggccaguaaauaaauuuaacaaaauuauagaagaaaacuuccuuaaccuaaagaaagagauaaccaugaacauacaagaagccuacagaacaccaaauagacuggaaagaaaaggaauuccuccugucacauaauaaucaaaaugucaaaugcacaaaacaaaaaaagaauauuaaaagcaguaaggaaaaaauggucaaguaauguauaaaggcagaccuaucagaauuauaccugacuucucaccagagucuauaaaagccagacgauccugggaaaaugucauacagacccuaagugaacacagaugccagcccaggcuacuauaccuagcaaaacucuuaauuaccauagacagagaaaggaagauauugcauggcaaaaccaaauuuacacaauaucuuuccacaaacccagcccuacaaaggauaauagauggaaaacuccaaugcaaggaggaaaacuacacccuagaaaaagcaagaaaguaaucuucauucaacaaacccaaaagaagauagccauacaaacaugauuccacuuuuaacaaaaauagcaggaagcaacaaucacucuuccuuauuaucucuuaacaucaauggacucaauccccccucccccaaagaagagauagauaacagacuggauacaaaaacaggaaccaucauuuugcugcacacaggaaacguaccucagagacaaagacagacauuagcucagaguaaaagguuggaaaacacuuuuccagcaaaugaucccaagaaacaagcuggaguauccauucuaauauugaauaauauugacuuucaaccaaaaguuaucaaaaaagauaaagaaugacucuucauacuugucaaauaaaaaaaucuaccaagaugaacucacaauugugaacaucuaugcuccaaacgcaaggccacccacauucauacaagaaacuuuacuaaagcucaaagcucacauuguaccucacacaauaauaggggagacuuaaucaccucacucucagcaaugacagauaacagaaacagaaacuaaacaaagacagugaaaauuacagaaguuauaaaccaaguggauuuaacagauauuuauauuaacauuucauccuaaaacaaaagaauacaccuucuucucagcaccucauuguaccuucuccaaaauugaccauauaauuggucacaaaacaguacuaaacagauacaagaagauugaaauaaucccaugcauucuaucagaucaccacauauuaaggcuggucuucaauaacaagaaaaacaacagaaacacaugguagcugaacagugcucuacucaaugauaacuuggucaaggaagaaauaaagaaagaaauuaaagacuuucuagaauuuaauggaaauaaaggaacaucauaccaaacuuauggggcacaaugaaagcagugguaagaggaaaacucauagcucugagugccuccaaaaagaaacugaagagagcuuacacuagcagcuugacagcacaccugaaagcucuggaagaaaaagaagcaaauacacccaagaggaguaaauggcaggaaauaaucaaacucaggacugaaaucaaccaaguagaaacaaaaagagcuaaaaaaauaaauaaauauaaauaaauaaaauaaaaauaaaaauaaaauaaaguagacagcaauauacaaaaaaaaaaaaaaaaucaacaaaaccaggagcugguuuuuugagaaaaucaacagaauagauaaaucauuagccagacuaacuggagggcacagagucaauagccaaauuaauaaaaucagaaaugaaaagggagacauaacaaugaaaaucgauaaaauuaaaaaaagaucaucagaucauacuacaaaagccuauacucaaccaaaaauggaaaaucuggaugaaauggacaauauucuggauagauaucaggugcuaaauuuaaaucaagaucagcuaaacuaccuaaacagucccauaacaccuaaagaaauagaaguagucauuaaaaguuucccaaucaaaaaaaaaaaaaaaaaccagaaaaaaagaaagaaagaaagaaaaauccagguccagaugaguuuaaugcagaauucuaucagaccuucaaagaagaccuaauaucaauacuuuucaaacuagucuacaaaauaaaaacagaaggaaugcuacccaaaucguucuaugaauucacaauuacacuuauaccuaaacuacacaaagacccaacaaaggaagagaagaucagaccaauuucccuuauaaacauugaugaaaaauacucaauaaaauucucacaaaccaaauccaagaacacaucaaaaauagucauucaacaugaucaaguaggcuucaucccagggaugcaggaaugguucaauauauagaaauacaucaauguaaucaacuauauaaacaaaguaaaagaaaaacaccacaugaacauuucauuagaugcugaaaaagcauuugacaaaauucagaauuucuucacauuaaaagucuggaaaagaucaggaauucaagacccauaccuaaacauagcaaaggcaauauacagcaaaccaguagccaacaucaaacuaaguggagagaaacuucaaguaaucccauuaaaaucagggaccauacaagccugcccauucucuccuuaccuaaucuauauauuacuugaaguccuagccagagcaauuagacaagaaaaggucaaaguguuacaaacugaaaaggaagaagucaaaauaucacuauuuguagaugguaugauaguauaauuaagugacccacaaaauccccacaaagaacuccaacccugauaaauaacuuuaacaaaguagccgaauauaaaauuaacucaaacaaaucaguagccuuuuucuacucaaaguauagacaggcugaggaagaaauuagggaaacaacacacuucacaauagucacaaauaauauaaaauaccuugaugugacucuaaccaagcaagugagagaucuguaugacaagaacuucaagucucugaagaaagaaauagaagaagaccuccaaagauggaaagauaucccaugcucuugaauuugcaggauuaauauuccaaaaguggccaucuugaccaaagcaaucuauagauucaaagcaauccccaucaaaauuccaacucaauucuuuacagaguuagaaagagcaauuuucaaauucauuuagaucaacaaaaauccagaguagugaaaacuauucucaaaaauaaaagaacuucugagggaaucaccaugccugaccucaaguuuuauuacagagcauuagugauaaaaagugcauugcauugguacagagacagacagguagagcaauggaauuuaauugaauacccagaaauaaacccauauaccuauggucucuugaucuuugaaaaaggagcuaaaaccauccuguggaaaaaaaagacagcauuuucaacaaauggugcugguucaacugguugucaacauguagaagaaugcaaauugauucauucuuaucucccuguacaaagcucaaacccaaguggaucacgcacuuccacauaaaaccauauacugaaucuaauacaaaagaaaguggggaaaagucucaaacacaugggcacaggggaaaaguuccugaagagaacaccaauggcuuaugcucuaagaucaagaauugacacaugggaccucauaaaauugcaaagcuucuguaaugcaaaggaaacugucaauaggacagaagaacaacuaacagauugggaaaaaagucuuuaccaauucaacauccaauagagggcuaauauccaauauauacaaagaacucaugaagauaaacuccagagaaucaaauaacccuauuaaaaaaugggguauagagcuacaaaaaauuuucaacugaggaauauugaaugccugagaagcaccuaaaaaauguucaacauccuuauucaucaggaaaaugcaaaucaaaacaacccugagauuccaucucacaccagucagaauggcuaagaucaaaaacucaggugacagcaggugcuggagaggauguguagaaagaggaacacuccuccauuguuggugggauugcaaacugguacaaccauuguggaaaucaaucuggcgguuccucagaaacuuggacauaguacuaccugaggaccuagcucuaccacuccugggcauauaccccaaauuuucuccaacauauaacaaggacauauguucuacuacauucauaguagccuuauuuacaauagcuaggggcuagaaagaauccagauuuccuucaacagaggaauggauacagaaaaugugguauauuuaugcaauggaguauuacucagcuauuaaaaacaaauacuucaugaaauucuuaagcaaauggacagaacuagaaaauaucauccugaaugaaguaacccuaucaccaaagaacacacaaggcaugcacucacugcuaaguccaaaagcuuggaauuaguccaaaagcuuggaauacucaacauacaauucacagaccacuucaagcucaagaaggaccaaaaaugugggugcuucgguccuucuuagaaagagggacauuuaaaguguaaauaaaauauccacuaauaaaguaaaaaaaaaaaaaagaauauacuaaauguuuccuagacuucauuaaaaugcucucucucauuccaucuuugcauucauuaauucauucaauauuuauugaaugacuacuaguugucugauacuuugcuagggaccgaacaaccaguggugaacuaagaaggcauuguuguccucaaggaaacuauaucuaaggcauggugggcucacaaauguaaaauugcuaucacacauaguauuuaacuagaggacauagcaaggaaggggaccuaaaauagcaagggggcaggaauauuuucucugagugccuuuucccagaugaacaaaucaccaaaugaaauuuauaacaguucauaaaaguuuagacauauggucaccauguaacccaaagaugcuauucuugggcuauaucagauagacuaaaauauauauucacacaaaguacuucaccuucaugguuacauaguguuuucuugauuacuauaaguaaauaacagugaauagguacaguauuuucauacaauagaguuacuauuuggaagaaagaaaagugaagucuuacauauggaugcagcuugaaaacaugggcuagguaagaaaagccaggcacaaaagagcuuuaggugguaccauuucuuuucacuugugucuggaaaugguaaguucauaaacacggaaaguaaauagguggcugccugggcugugguugguacguugugagcaaugaccaaugacugcuaauggguauggucucuuuuggaaugauguacauguccuagaguccauggugaggacaguugcauaggucuguaagugugcuaaaacaaugcacugacuuguacaugcugaauggcugaauugcaugauguaugaguuauauaucauaaaauuugagcaauacuuuaauauuucaaguagaaaauagaacaaaacaaaaugagaacaauuucaggaaauugaguuaucaaacaggaguccuuuaaucuaagacugugauauauagagggcguuaguuuucuacgucuuguguuucuaggaacucauuuuccuauggaaaaaugauaauaaaacaucaauuauuacagucuaguuauuaugcaugauuucacuugcccagacacuuaaaauuaucaaccagugggccagauuucaucuauguguauuucucacaucuuuuccuguaauaagcagaagagacgaauggggagguuguauaacuuuaaaauauacuagaauauaaacaauggacaauaauuuacaucagauauccaaaagguacauggcagccuuagguugucauugaagcuuucaguaguuuccacugcuguaccaucauggaaggcaaguuggugcuuuguuauuuugauuaaaucuucaaucacuuuucugacguuacaaauaaaaggcauugaaugacacauuuauuuucuuuuaaaaaucacaauuaauuaauuaacuggcuaauuaauuaauugcauauauucaugcaugugcaugagugugagcauaugguaugcauauggaggucugaagacagcuucagagaugugguucuguccuuccacaguggggguucugagaaucuaucucacauggucaggcuuagaagccugugccuucaugugauaagccaucucacuggcccuauuauuucuuguauuaaaaaaagauuacuuauucauuaaaagaacauguguaaugcugaaaaucacaaauguaccaugaaguuaaguccucauggagaagaauguuaucaaaaugcaauacagaggauauggagggaaaauaugccugucuaaaaacucaggaaaaaaucagaaagcuccccaacaguaaccaaacuuucaagguacuuuuacauuuaucuucaacugaaguaggauguagaucuugaacaguuugagucucuguccuagagugugaauguuuuauagagcugagucugacucuuaccaagguuucacagagaugugcucugcauaugaacuuaaaggcagauucucuuugaacuauauuaggaguuuucuuuaugcuggcuuuuuagcagaaaaauguaaauugauuuuccuuaugcuugaaaaagucauccaacaaaaauuuauauaagaucaauacugcaaauuauauaccaccauuaaagcauguuugucuauaguuaauaacaacauguucugcaaugagauucuauuauagcagagaaaaauugcccuugaauuccguuaggauuguugaaugccuguggcaucuuauucuaagagagcaucuggaauucuaguuguucuagugucuugaguccucucucugcuuuugucagaaagcauacauuuuaagaguaaaaguauaguugaaucuauauuuuuauagauuuuugauuugaaagaugagaacagaacuaauauaaaauacugguucuuguugccaacaccaaucccagagaagacugaaacauacaugaggcuaaucguucuugggucuuaacaauuaugagaaauucaucaagcaaaagauaugaaagugagagagucauuggaaagagaagugggauaaguaacaagaugugaguauuaggggaacuuuacucuugagauuuugaaacaagaguuuuauucaagaagagagcccuaggucagcacuauuuccuuccuccacaaaugggugcuuagcagagaaaaguugcucuucaucuucugaauucaagaagagaucccauggagauaaggaaaaggggcagagcaugaggcugauuguagcuugguaaguuuuguccuuggagauuuucuugcaauguuaugaugguaguuccauguuucuccacacccacaaaagaaauaucaucaggagugaggucagugcugacuuggaguacugugucaauguggguucaucagcucugugggcugugcaugacagugugccaauacuggagaugaagcacuauaguugaggugggguaagaaauauacagaagcuuccucaaugaugcugcuaugagccuaaaggagguccucagaacuaaacuguauucaaauuuagggaaaaaaugguucauuucaauaauuuuaguguaguaguuuaauacaaagcucauuaguuuaaauacuguccaaaugcaaaacaggucaauggaaaaaaaucauauuguuucaauaaaaguaggaaaaagauguugaaguugaauguguauuuauaauauuuucaaaguacuagaaaguguuuucuuagguucauucaauuucuuaacauucuaugauaaacaucuauuuuaauuaauacacgugguaggguagauacauauacaugaguacaugugguaugugugugagaugggggagugaagggagaaggaggagggagagaggaagggagaggcagagaagaagaaggaagggagggagagggggagaggaagggguaggagaaggaaggggaggaagaaggggaggaggagagagagggagaggaggaaugagagggggagagggaagagaagggaaggaggaggaggaggaggaggaggggagggaagugagaggaaaaggggagggagaggggaaggaggaggggagguaaaggggaggaggagggagagggagaaagcauggacacugguuuaagcagaaguaaaacuaggaaggccgcuuucaugccuucaugcccacucuugucccauacuuggaagauucugucugaaaccauaagaaaaagaggccugaggacugagaaaaaaagagauggcaguaauuuuuucagacaguacuaucuuguauacaaauccccagugcaguuaacacaguuauauaaaaauaagccaaaaaaaguuaacauaaaaaacaauaauaauaauaacaauaauaauaauaaauagaguagacauaauacccccuucacaaauacuauaaaaauaccuauuaaguaaccuacacaaacaaaagagaaugguugaggaauugagaaaaagcaaaauucuaucaaaagacagcaaagaaacagacucacaaauuucaucaaagacaaaaggaaaguccagguaaauuaauaccuaacugaagacaaaauaccaggauuaguuuugaagcagcuuaaagggucagaugcagauauuugcaccuaaccaauggacagaagcagcugaccccugagguugaauuagggaaggcugaaagaagccgaggagaagggagauccuguaggaggaccagcaaucucaauuaaucuggacccuggagauuucucaaacauuggaccaccaaacagacagcauacaucagcuaauaugaggcccccaacacacauacaguagaggauuucugggucuguauucauucagaaaugaugcaccuaacccucaagagaauggaggccuuagggaguuuagaggucagguggggugggacgugggggcauccacguugaaacugggggugggguggggaggagguguaggaugugggucagagggcagaucaggguuggguggcagcaaaugccagggcccuggaagccauauucagcccuuuaacgaugaaccagcugccaauggaaaagaagaccuacuuaagaacuugcauccuuuacagaggguaaaauuggaaaguuguauaaaaccaacuaucauugccuaaguaaaauguuacucuugaugcucugccuaggaaagcccauaauuuauuuacauuuuggaagauucucuagcuagacuuaauaaaaucgauuaugugucuuauauuucagaauuccuuuccugggacuagaacuuuuuaaaccuugguucauuaaaguuucuguucaaguuuguuucuugcuuccuucugguagcagugaauuagagaaaucuggaaauagguaagaaaauguaauccuguggcagaaugcugggcaaugaacuagagccucauagagaguaagcgugaggcauagaaaaagaauaugguauuaucaaaaggcuacaaacauguucuaaaaugugaccuuuucaucgacacaagacccuguuacuguaaaggggauuuaggaccagacuuugguaucaucaggcuugcuggcuucagaucuagaccugaucaguuacuugcaccacuuaagucuguggauugagaacagaagccaaggccccagcucugaauggaaaucuagcaauguaaauggaguauguagcucagugcuacauaaagugcgugcucaguaagcacaauuuaaaacuuaaaauuggcuucauuugguaacggccaaggugaaacagucacgguuaugucauggcuaucucuauuuuauuccucuacucuaaaugucuucaggauuccaucagacuuguaaaaaucauugaggacuucaaagcaguguuuauaugcauacuacuuaucaacauauaucaaaucacaaguuaaaguugagaagcuuagaguauuuauuagcuuagcuaauauaacaaugaaaaaucaauuauaaccuauaaaaugaaacauuuuuaugaaaaauaaauuucacgaggcaaacuaaacaguacugagaauagcuuuguuuuacauuuuugcaaaucucuugacagaaagcagcuggagccuccugucugcuuaggcaucuaaucugcuacuauacauguuaacaauaugaauguuaauaaaggacccauauuugcugauauaauuggcacaacuuaacugaacucuuuaagcacugaaaguccuucaguucauugugguuauguuucuacuuucaaagauucugauauuuuauugcagucuagaauguaucauuaggcaaugcuauagguagcaaaagaauggauccugaaagucagaaauacaggagcuuuggugaaggaagacaggaccaccagucuuuuacauucagugaguaacagggugaauaucaauggacucucuucuuuaagaaucuauccuugucauccaaacuaaagacccgaacaguucaacuuuaaucauucucuacuggcagaccauuugucaacagccauaaaaauacauaaauaauauacaauauauaaaauguaugugauauguauuuauauauacaaauauauacaaauacaucaauaauauauauuuguauauagauauauaaauaauuuauaacauauauuuaugcauucaaauauauaauauauaaaaugaauauagauauguaaauauaaaauguauauuuuauagaaaauacauagaaaguauauaacuacuauaaauauauaauuacauuauauuacauaucauaauauaauaugcuauauaauuucauaauuaaccauaauaaauuuuauuauauuuuaucuaaaaacauuauauauuaucaacuaauuauaauuaauauauuaauuacccuaauauaauauauaauuaauauauuauauguauugucauaaaaauauauuacuuguacauuuguuauaauuuuccaugugacuugucauuuuuaaacuuaauuuuauuagguuuuguuuggacauuugaaaaucuaauauuuugauuaccuuuuuguuguuuuauauaaugaaagacuguucuuguuaauaucuuuugccguauacauaauguuuucauuuuuauauuuggaaauuagcaucauuuuucauuaggaauuggccacaauaucuaaaaugauaauuuacuuguuuguuuugaaauuauuauguuccuuuaaauaagguaauaaauaugaauuuuccuucuuuauuuugugacuuuauugcuuaaaauacauacaggauuauaauaaauccuuuuuuucuaucuauugacauaguuaauauagcaggaaaagaugauugaaguaagaugggacaugauccucauuaccagcccacuugugagucuguguguguuuccuaugcccaaguacacucucugguugguggaauuuuuaucucucuuucuucugaaaucuauguugcauuacauguuuccuggauuuaguuaagucaaaguggaaguaagauuuuuagaacuuauagacacuaacaucaaaaaauuuuuguauuuucuauaauuuuuuuccauuggccuuauuuuucccagacuuuuuaaagacuuuguuuugugcaccagcaucuccuuuugcucuccauguuugacauaauaauaaaauaaaguauuuuucauacaaaauuuagcuucacgaagaaaaacaucaaugacuugggaaacacaacuccacaaggaaggcuaauccagccaugcaagucuuaggaucaguggguuaauguugagaaagaggagcacuccuucauugcuggugggauugcaagcugguacaaucacccuggaaaucagucuggugguuccucagaaaauuggacauaguacuaccugaggacucaucuauaccacuccuggacauauaccuagaagaugcuucaacauguaauaaggacaaaugcuccacuauguuaauagcagucauaacagaucagguuccccucuuuagcaucugcugucagcugaguuuuugaucuuagccauucugacuggugugagguggaaucucaguguuguuuugauuugcauuucccugaugauuaaggauguugaacauuucuuaaggugcuucucagcucuucgaauuuccucaguugacaauucucuguuuagcucuguuccccauuuuuaauaggauuauuugauucucuauagucuaacuucuugaguucuuuguauguauuagcuauucgcccucugucagauguagaauugguaaauaucuuuccccaaucuuuugguugcucuuuuguccuauugccaguguccuuugccuuacagaagcuuuucaauuuuaugaggucccaugugucaauucuugaucuuagagcauaagccauugguguucuguucaggaacuuuuucucugugcccacguguuugauauuuuccccacuuucucuucuauuagauucaguguaugguuuuauguggaguuccuugauccacuuggauuugagcuuuguacagggguauaagacuguaucaauuugcauucuucuacauguugauggccaguugaaccagcaccauuuguugaaaaugcuaucuuuuuuuccaugggaugguuuuagcuccuuuuucaaagaucaagugaccauagguauguggguuuauuucugggucuugauuucuauuccaucguucuuaauguccacucacugagagugaaguaggagaaugaagccucauaaagcuccuuuuuggauuuggugcuugcugaacagagaaauguuaggcugcaaaaugcuaugucucaguauuuccucuucaauuuggauuuugugugaucaauaugcugacagaccauucaucugugcugaguccuccuugguagggacagugggugugucaugauuucugccccagaauccaaggaaguagggugugggcaauguuugcuguaggcauaaagcuuguuuguauaacaauauauauucucuugcuccuccuuugaggaaaguccucucugucaagguuaaugacuccaagauaaucagaguccaggaggcaaggguaugucuaauggcucagcaagugggaaaaugcugugaccuucaggacagcccuuaaggcuguuugaaagaaugcugaaaacaugaguuaaaaaaauuuaauuucucauaugcaaaauauaaggaagcaauaugaaucauauaaggggcuucaaaggccuagaaaaacagaagcaacugaacuauuagccagcuacucagaaagauaucaaaguacacagauauaaaggcaggcagauuccugaguucaaggucagccagggcagagggaguuuagguccaggcccaaucauggugggaaucauaauggguggggucccacccaacuaguuuaucucugaauucuuuuacaauauuuuaaaaaauaaaugugcuugcugucucuuucuaagaauccagggccuaggcucauggaaugcuaauucaugagaacccugggguaaugacugaauugauauguaaauaaaaaaacugugcuuuugaucugcaaaagauuagcuauuagcuaucaagagaguuuuugaauagcaaaagaaaauugucuggaacagaacaaacacagagagagagagagagagagagagagagagagagagggagagggagaggggaggaagagggaagggaagggaagggaaaggaagaguaauugagcaaucuggacagcugucucgagcagaauauaggccaucagcuuguaaccaacaauuugacuuccaguuauuuguuuugcaaccuucuucagaacuccuuuccaagcugagguugguccuuggcauauccaugguuuccucaaccuuuuguccuuggucaggguuuucagaagcauuagguagguaggaggagaaacaugaggacuacauacaaauuccaauacuuuuacuucuggacacauggcuauuauuauccuuccuaacauugguaucagcuuaagccagggcuacaguacaaguaaaucagggcuucaguuuuaucucccagugaccucuguugcuacacacuauuguuguauacuuccaccgcauugcuuccguauagaacccaagacuaccagcccagagauggucccacccacaaggggcucucccucuugaucacuaauugagaaaaugccugacagcuggaucuuauggaggcacuucuccaacugauaacuccaguuucugucaaguugacacaaaaccagccaguacaauugaccccuugucaacuugauacacaaacauaucacuaguaagccucaacccuuacuuucuuauucauccccaaaaucuaaauaacuuuaaaagucccauagucuuugcaaauucuuaaaauuucaaucucuuuaaaauaucuagucuuuuuuaaaauccaaagucuuuuuacaauuaaaagucucuuaacuaugggcuccacuaaaauacuuccuucugaaagaaccuaguggggaaacccccauucacaucccgaguccgugcgcacccaaggaauuaugagagacagucuugaugcaaacacaugagguaguuuaaugacggagcuccaggcugacacauaucucacacagaagauaguggcuguugaccacgaagcuugaaagcuagggguuuuuauagaaaagggucuggggcugggggaggaauugguauggugucacccaauugguucauuuaaacaucagcaaacuguacaaugggcagcuaaggucuccaacccagguaucuagagucugcagaagucaguagugcccaagaauucucuuacuucccuuaguguaguugggguggggaucugaguuagucuuuuuucuggcuuccuuuagccacugcuucccaucuugaaggguguuucucaaauaaguaacuucagucugacacagcugaaccuuuuuagcugaggcucaguacuccaacucacuuaauucuguccuucuacgaucuucuguugcccagguucccugucuagauccugucuuuucuuucucuccuaccccuguggccaagauucuagucaaauuucuuucuuguauacgauuucuccuguuuucucuuucuucugccucuugccucuuuuucucucucucucucccucccucucucucucuaucccuuccucucuuuccuucacuguuaaccucucuauuugccacugucaucuaucucuccugagucugcugaagcuuugcucuuccuuacagucuaagcucacuucuuucuagacaucuauauacaucugucuucuucauccucucucuuuuucuccucugcacuuucuuacugacuuacccuuucuuuuuucuaacuucugugacgagacccucaucagagccuggcgguuagacuuauagguguuccuuaccuuggguggcugucuaccucgcuggaguuuggaacagacucacuguuagcagcuuagggugggguugcccuagaagagaaaacacguggggcagggaagggagcacagcucucacagcuggcugcacugggccacugauaucucaaagugaaagcacuuuuuuuguuaacaagaggcacucugguacugucaaagccugaagaugggcaggugggauguaggggaaaggggaacauaauuaggcaaguaugaggagcagccagggaacucgcagugcuccuggcuggccacucccacagucucuuucucuucuucccaucuguccuuccauccucccgaggugggagggugggggaggucgccucacgugggcuccggcgggcaggcccccaauggggggaggcccagaaacuggggggggggcgguggagguggugacucuggaugcuagucugcccgucccaagauguggcgggcauuguggcugcucuagggagccugguggggcuggugcagauggacccugcaggucucaccccuccuccccuuucgcccauccagcggguggugaagugcauggcggugguggggcaggcuucccggggaaaccuccgagucaguucccccccuccaccucccugggccacagguuuucauacggugccucgccucagcuggcaccugugcuugccaucuuucuccugggccccagugcaccaggaccgcgugcccgcacagccggcacagccagccucugccgcaguggcgccugcagaacccagaagugaacagcaggcgacccggaagguuugugagucacucugcacugagcucuagccgcacacugccaccauggccuccgccaaagcccuagcugcacgcugccguagcagucgaagccagaaguccccaguccugcccuagucaggccgccaggcuaugggcuggggcugcgccucagagcacaccagcacugccagguccguguguccaggggugcaugggggagcaggccugcccgcaggaaagcagcaccaaauuguuuuucuuaaugaucacugacaaauucuguccuaacgucaguccaaguccacagucagagacaaagggguugacacugucugucccauaacaaaaaaucaggagaaaacagaaaaaaaacaaagacacaagacaacaagacacuaguacgucuaaacacacauguccaugucuggacuuauacagccagccaaaugcgaccucugagggggugagguuccauguccacccacuuccugacaggggucuauuuccacaucaaccuacuuccugacaggggucagauuccacaucaaccccucuucacccguggaacgucuucccaggguugcagccugcgagccuuaggacgucucccucugcagcuacucgguccuuacaggccacaguggcggcugccagauaaucugucucaaauacucucagaggcgccacacuuagacaacagacaacauacaagacuuacacaaacguaccuccaaggggucuuucguaccuccaaggggucuuucgggguuccugggugucgugcagaucucgguggaaccuccaaaugaaagaaccuaguggggaaacccccacucacguccugagguggcgugcacccaaggaaucaugagagaccgucuugaugcaaacacaugagguaguuuaaugauggagcuuugggccuacauguaucucacacagga

SEQ ID NO: 6902 - RNA, 3451 nt, Mus musculus
guuuguccaucuguuggauucaaacauuucuauauuuuguaaauguuguuuuuuuuaucguuuacuauuugcacuacgaugguguuugaccugucuaauccuuauuuaacaaguauuuucuuugggugggggugggggugggguuuaagagcugcacuucaugugagcuauaaaagaacugcuacagcacacaaaauagcuauuuuuauuauuauaauuauaauuauuauuauuauuuuguaccuuaaaaauagacacauacaccaaagacauuugugugagccuuuaaacagucugucugugguugguauuguucaccaucaaugagucagggguacagauuuaagguugaguuagguagauuguguucaggcuuaaaagaccugagagguuuggguuuugacucuuuuacauccaugaaacaggacauuucauacuggauguacaguaguguacacuguuggauuaucaaguucaaauucaugagacuacaugcuuguauguguauauauacauugcuugugcauaugcauaucuguauguauauauacauguauuguaccauguccauacacauuuuaagcacuucaggcugucauuuuaaaaauguucuuaaaacaaugaauguuugugugcaaaacacaguauuuuuaagaaggauaagugauagauuuuuuuuuuucuugcuuuuacucuguaguacguggguacauuucaaauguuaggauggggaaagacugaaaaucccagugaguauccagccaggcccucuuuaaauguacaggaugaaauccccucuuucauauccccccugcucccuacaaguuauccccuguggggaaaaaugggauguuacuuuaaaaacaaaaugggcugauuuuuucaacuuauauuuauuauuuauuggaaucaaucuuaaaucagaaacauuuuuggaaaaaaucuuuaggcuagaauaauuuuuugaauaguguuauuacuacuuaaauaauaaaauaagcaggaaaguauuuaagacagugagaguuaagggagagagcacucaggagccagggaguuguacaaaucucuaauauucuauuuugcagccaaaaaacuugcuguguauguuuguacuuuuucagaggcaaaacugaaaagauugucuuacgaauaucaaaauacacacuuaacccaaguuccuaauuuaacccaguguuggcuugucuaaaacagcuaaucaguuauucauuuacauauuuaaaauauagagccuuauuuuuacggacuuguuugaaguuugaaaaacuuuauaaaagugaaaaacucuaauugaaaaaaaaucuauauuccucaguauuuuguaaaauauugaagcuuuuagcauuaagucaguccauagauuaaagucauuguaggaaaaugaaauacaaaggagaaauuaaaucuuaaaaaagcugguuuaacucuuaaaaaaauaaacuaacucaauauguauuaaauauaccgucaauauaccuuaucacauuaggcuguguguaggcaaacuacuuuagucuuguuacugggcaaacauauuuacuguguuccaggggcccucccugucuuaugcaggaaaugcauguacugcauaagaaaugaauuauaauuaaggucuaaugaccuugaagaucucgcaugcgaggacagauggcauguugaggacacagaggugagguggauguccagguucagcuuugccaauuuuugugaaaaaccuuuagcgcccucugaacuguuucuuuaguauuggagcuaaugccgaggccuagagaaauagugggcaagagaucuaacugugccauaucagagaugaucuagaccaugggaagagcaggauuuauguaacuacuaauuauaguucucauucaucugagaugaaucugcaaucuucuuaagcccuuuaaauucuagauguuuugaggguaagcuuggguuuaauuaguagccauaguaauuaaaucuagaaagaaaugaaauuccacaggacaguguauuuacuggagaccaagugacuugguugucacauaaaccucaucagaacucaucaaauuuguauggccuugcaauagaauuuaaauugcuaauauuuuaacaauauuagauauuguuaacaauuuagaaaacaugaagucuugugaacuggucuuucuacauaagugcuuaauccaaaauuugaaaagccuuuaaugcuuaagaucuuaguuucuucauggugugcuuucccuaguguuaaaguggcucugucuggucuccccacuuucucuaggauaauucuuaaauaccugcccacacaaguucuagaugcucugaagagcauuuguaguuaguaucucuuuaauacuuguaagcuucauugacacuuuuccuucccaaaauaagucaaauuucagcacagcaauggggauuuucuuaucuuagaagaccagccaauucuauguucauuuaagauugauuccacacuccauuuucaaggagaggccuuguguuuucuuaaaaggcagaauaaguaaaauugggagcuaugccagacugaacgcaagacgugacuuugugauuccagaacaaacaugccucaguuauaguaacaugcauucaaaugauugugucacuugaaaaauaugauuuccugugggccuuuuggcaacuucucuuuuuaguaucgagaaaaauguaaucaccccaaaacccgcauaagugugacuuguagaugugggcaggagguugggggauggacauuguauguguuuaaauuaaacccuguaucacugagaagcuauuggaggggucagagauaaugaaugcauagaugcuguucacaucuucaagagcaaaagcaaaucacgugucucagcuauauuauuauuuauuuuuaugcauaaagugaaucauuucuucuguauuaauuuucagugggguuugcccucuauuuaaaugcuuugaaaaacagugcauugacaaugguugauauuuuucuuuaaaagaaaaauauaauuaugaaagccaagauaaucugaaaucuguuuugaucuaaaacuuuuuauguuaugugguugauguuguuuguuuguuuuuuauuuuuauuuugugaguuccuuugcauacuacaugcaauucuuuaaccaaugucuggcuaauguaauuaaaguuguuaauuuauaugagugcauuucaacuaugucaaugguuucuuaauauuuauuuuguagaagugcugguaauuuuuuauuuacgauauguuuaaagagauaacgguuggauauguuuucauguguuuauagcagaaguuauuuauuucuauuccauuccagcggauauucugauguuugcgaggcaugcagucaauacuuuguacaguuaguaggcaguauucagcaaugcccgauagcuucuuuggccuuauguuaaauaaaaagaccuguuugggauguau

SEQ ID NO: 6903 - RNA, 967 nt, Mus musculus
auauucucucccuagaaaaccugaggccaaguccaauggaaaauaagacccuaacauaccaggcagguacaucccauuuccaccaugauuaagagucucuaugaaaucaauaaugaugucuuccucagugucccaaguaccugggacaaaauggaauuucagauguugugaaggugacacugacuccugaggaagaggccugccugaagaagagugcagacucccucuggggaauccaaaaggagcugcaguucuaaaguuugcucaguguccuagcacuucacuguccaggcugcagcaaggguucuauggagaccacacacguuccuucucaucugagcugugguugguacaauugugcuaagguaaugugggugaaaauaucaguucccucagcucuacccugcugucaacuaguacuuguguagugguaaccugguuaguguggcagucccacugucucaaaaacccacugccaacuguaugcagucuuuaauuaccuuauaagccugcugcuuugcugugcugcacacccucaccaaacaugccuaggccgaugaguuccuaguuaaucauuaucuggcuccaguguuuaaguccauuaugcauaucuuaugcauaaauguucuguaagauauuacacauaugugugugugucuguaguauacauugcaaugguauguaaaauguaagaucugcauauugaugauggaaccaaccacucaagugucaugacaaugaaaucaccaaauaaaccuugaacagugcaaaaagaaaaaaaaaaagaaauugauauacagucaaaaacaugucauaucuaaaaauuuuuuaaaaaucauaccauauauaucaccuauaaaaguuaaaucaagaucaguuaagccauuuaaacagauuuacaaccauagugaaauagaagcaguuaaccagaagccucuaacaagaaaaaaaaaaugccaguuauuuu

SEQ ID NO: 6904 - RNA, 4679 nt, Mus musculus
ccugauggcuucaggucucccaguaggccuauagcccuggcuguagcagaccaccuguggggccuuccaacgggggucucuucacaggagcagagaagcuacugaucuguugucaugacugcaguagaucuccugggaggucuucagacuguugggucuucaguggaacagucaagcuguuguccaacugcucugagugcagcagguccucuaggaugggucagaauauggugucuucaugggaacagaccagcuaggagucuuccccagcagaaaagaccaggcagaaagggcaacuaacagcuuucuaaucagacuuaagguucauucaacuaggggaaaucugccugguacuguaaucuuaacuaacuacccauggguagugagaccacaaauaucuguuauauacuaaaacagguauaaacaaguauaauuccugucugcauucuaaauaccuauccuuauauccaaagauaagcauagaucucaugcuucaucaaaggagcucucuuucgcauauuacaaacagcaacaacuagucaaaaucuagggacaacuacaguacaacuccucuaccuaagauucaggaaacaucuuugaagaauaggaagaaagaauguaaaagcuaggagaccagaaagucuccagugagauugugccuucuagcuauggcagggaagcuauacucaugaagucucaacugcauggcagucaaaacaugaugcaaacaguuccaguacuaguugauaucccaauguagaugacagaaauuucauaagcccuaccccuagaugaggaacaacaaguaauuaaaaacugagagaagaauuaaugauccuuaaugaugagccccuaauuauuuauccaguauuagguggcugacccuaugaauauauacaugaagguaccacuaaacagauucaguugauugcauuuauauguuuauuuauuaauagugauauauaacaaugauaguuuaaaagaagaacacugugaauuugggaaggagaaggaaagagcuaagaaagagaagcgguagaagaaagaagaaggaagggaaaauaauggaacuauuaaaauuuuaaauuauauuaugauagagguauguauaugaucaguauguuauauaaaguuuuaaagaauaaaauauaauauuuauaaaaaauguagaaaagcuaccacuuguaaagaauccaucucuuacagagaaaugugucugcuaucaaagaguugaguuccuggcaucuuuuuucauccuaucagcauuauauugcauaucaaacucuagcccuuagaucuuuuauuucauuucuuuuguuugguuguuguuuuguuuuguugagcucauauaucuuaagcugauguuaagcuuacuggguaacuccuauuccuccugccucuagcucugccuaaagcuggaauacaggcaugaauggcuaugacuggcuuauaucccucacaagaaaauaaaaacugauucuuucagaacaaaaaugaaaaaaauuaggaguagauaauauauauugagccaacccacauuggaagguauuacaagaacuggggugcaugaagaagcuucucuuuacaauaaguaaggcagcaaagagagacgaaaguaacaaagccacccaaacaugcuauggcaaaacaaugagcuuauuugacuuacaggugauagguugcuaacaguaaugguagugacuccaaaauagcuguguuaacaaaaaucucaauccagcauggauaaugauugauuucccuauaacugcacacacacacacacauacacacacacacacacacacacacacacacacacacaagauagccuucuauugucuauuuaaucaaggaccuccaaagacaaugaagagaugaggcagaauuacaugcagaugggagagugaaugcgaaugcagaaggaaguagcuggacucuuagguaaagaccuaaugcccacucugucccuccuuuuaugagggaaagucaacagcccaaccuuaagggucucuucauugauuaucacagcuguucugauuaagaugcuuaacaguuauauucaagauagcaguccacaacaacagaaaacgggggauaagaauuguacuuauacaugccauacuucuaauuuugaguuugaggucucaguaauaauagaagcacauguacugcauuguuguaaugucgguuguuuaugcacauuaucaguuuaauucucauaguaagcuuaugaaagaaguacuaugauuauucuauuuuaaaagaaaaaaacaaggcacaaagcaguguaguagucuacccaaaguuacaugccuaauaaguaaauggaugagccaggucugacucagcuagucuggauucaauaguacauuauacacagaaccaaacaauuaauauuucugaaugaucuuguuacuaguaggaccaugauauuugaaaaaaagaagaaauaguguuugagcaucuuuccaauuagauaguuuagguaagcuucccagauacaauugauuauguaauacuuaguguaguacucacucaaaguucucugauuuucuauaaguaugauuuggcuucagucuguaaacacugaaauccaauagauuuuucccauaauuuucaaaucucaguuugauuuacucaaaaaccauauuauaaagcccucuuuguugcagucuuugaguccaacaaaaggaacauuuacaguuccuauuucuuuaaguuagcacuaguaauaugaaaucaaauuggugcuuauuuugcauauaaauccaugagaaaaaacagauuuucaauaaacacaagaacuuugccaauucauuugaaucaagaucaaaugugaaggaacuggaugucaaauuccuuauagcagaaccagguaagauuucaaaaacucauuuacaauaauaugucaaacauauuucuuaccaugaaucauugacucagagaaucaaaagaugcaaaaggugauuaaaagcaacuaaguuauauaugauaaauaaguaaaaauguggagaagcagcacauaguguuaccaugugcuuauuuauuccuaagaugugucuucuuacaucuuaaucaaauauuacuugaguuuuuucaauaacuuaacuccucagaauguauguuuguauaacagugucaguaacaacgauacugagagugauauaacagcuuuuuucauugauuccuuuaauacuuggcagauauuuaguaagcacucuugacagugucauuacucaauaaaugaggaguaaaauuuaagauugaaagucacagagaacauuuucaaaaucaaagagauaaaaagaggaaucugagcugacccuuugauaagauuuagucaggcaaaaacaaggaaagggacuuucuaaguggaaguaauacuaugagugaagucuaaaauaggcaccucauggguguuguugaaugaauaaauaaauuauugaauuaggaugaaaagggaagcaaagcauuguauucaaugaccaggaugucacaguuguacauuaaggugcauugaaaauauuuuuaccugaagacccugcuacaguacuccugguauauacccaaaagaugcuucaccauaccauaaggacacaagcuucacuucauucauaacauccagaaaauggaaacaaccuagauguccuuuaaccaaugaauagauauggaaaauaugguucauuuacauaauugaauacucuucagccauuaaaaacaaagacaucaugaaauuugcaggcaaaugaauggaacuagaaaauaauuauccugaguuaauggacccagacccaauggacaugcauggcauguacucacugauuaguggauauuagucaaaaaguacaagauaccuaugauacacuccauggacccaaagaaacuaaacaagaaggaaggcccaagcaaggaugcuugaaucuucgaagagaggauaaaauagucauaggagggagagggaggaaggaaaaugggugaaagaggagaugagaaugggguuucuggaucagguguggagagagaagauagagagcuacaggaccaggagaaugaauggaagucugcagcuguuggagaguuggggaguugagguuuggacuuuugcucuguauuauagugcuaaaugcuggcccccagggaggagauuaaucugcacuuagacagaaaaaaagugucuguacuauaaugcuaaguaaccuugccccaucccaaguuaucccugauuugugaaucaagaugccuacagccaauagcuuggcagaagagagauaggcagaguuuggguucucaagcuuggggucugagaagaccaggaggugggaggagagaggugagaguaggagaagaugccauggaagaugccauggguuagguaagucaugaauugaugguaaugagggcuggccaauugauuuaagaguugcccagauggaacauggcaaauuauaauuuuggguuauggaugggaaaguagauucuaauccuuuagaugguagauaucugcucagugcuaguacuuauuaaguaaggcuuauuauaaauauaaagguaugugucuuuuaucuaggaauugaaugaucaaagggagugauacccauuugcaauugacuaucaacuacuacagggggaugaaaucucuaagaagucucagagagcaggggugggggagguugccagga

SEQ ID NO: 6905 - RNA, 8217 nt, Mus musculus
ccuugcuucccggaagccuccaagacggauggcccuaccccucugauccgcccucuucggaacccgcacgccccucucccacccucacagccaauaaggccugaugaucgguuuccucucuuccgcuuccgucuucguguacugggggucuccgggaagaccguugacgacugugcucgugcugcggccggagauuuaguuuccccuuuacagucuuuccuccucucagacacgcccaccauucuuccauugagugaccuguuuaccugcccucuugcagaaacuuggugagaucggaaccuuugugcagccggaacuaaggugcgguaguccgcugggagccggaaggguguauaaauagaggaauaccaguuuccuucuggcgguugaucgcagagguuccggugaggcguucggcgugugagcucugcggcuucguuuccugauaugcaccgaccgaauuuucgacccccaacuccuccguaccccagcccggggauaggagguugggguggcggaaauaacuuccggggugcccugggcggggggccgcggccgcccuccccgcgggacggguacgggaguccgcaccacacuccgcccugcgggccccgggcuaggccguacgggagcagccagucuccgcggcacggcggcaacuucucgggggcccgcuucgggucuccguccccgggcggcuacccaggcuccuacuccaggucccccgcggggucccagcaucaguucggcuacuccccagggcagcagcagaccuacccccagguaaagacaauagcuagcguuugccgaacucuuccugugauggcagacgugauacgaaacauucccuuuccguggauuguuuaauccuccgauacuacguuggcccaguuuugcagaugaguaaccugaggcguaaagaaauuaucuaagacuaccauaaguggcggagcucuaguucucuguccacagaaacugcucucagccagcauaccacauucguauacaaacuucuuuaauccuccauuucuucucccacccacccccagagguuuuuauuugguuuuggguuuuuugucauuuauuucagugaauuguccuggauuccuagggggaggacaguaaaugauucccuauuguguaguauggcaccucuagacuguagucuacugccauuuuccuacagaugucccucccuuguuuuugcauccuugcuuuuuuuaaaagaaacaauuauuuuauuucgagccauauuuauaccuacucaaaguucucuugaaggaaaaauagaaaauuugaaauugaggaaacuuccccucuucuccaugagugaauacaagacaggaaguagcuaacaacuuguaucucggugguuuugcaaaauugaauaugcucacccauaugaauccuuaugaguuggaguuaauaagaauagaaaauuuucaugcaauauaaaaguucuagaaauuugaagccuaucagguuaaaaaguaaguuuccaagaagugaauacagugaaccacugcuuguacuggguuuauuuguauuuaauagcugcaggguugguuaucacauuagaaacugaaagguuuuaagaugauagcagacauuucuaaaagagaaauauacaauugguuuuaguaauuuuuaaaagcacuagauuaaagaaauuugcaacugaauauauuggguuucaauugacaacuuuuaaugugauuccccacuaauauuaaacuagaggagaaaguaccaguuaucucuuacuagauguuuuuauuuuuaacugaugauuuuuuuccuaaaggguucuccaaggacaucuacaccauuuggaucagggcgugguagagaaaaaagaaugucuaaugaguuggaaaguuauuuuaagccuucaaugcuugaagacccuugggcuggccuagaaccagugucuguaguggauauaagccaacaguacagcaauacgcaaacauucacaggcaaaaaaggaagauacuuuucuuaauauuucugaaauucaccuggaagcuucaugugucaggaacauccuggacagaacuuuuacuuguguaaaagaguugaacccaaggaugaugacuuugaauaaugauuagcagaccuuugguauaucuccaacuuuaucaaguguugauaacagcggaaaugauaggacaauuuacaguauuuagcuaucugggaguguguaucauagaacacaguuuucauauuugacauuuccaauauaacagacauuuguuuuuuucaauguuuuaaaauaaaacguuuuuugucuuccuaauugugauuuuugugaauauguagaauugcuaaaacaaugcuucaguaaucacuuagacuuugaggguaaauguuuugcaaacuauuuuuuaaugaaaugacaagcuaucuuagacaguuuucuauauauuuauuaauagaaaauaguucuacauccauuuuuuuguauuuuuguuaagauauugaaacuuaaaaucacuggaagucacuuaauaugauuuauacuucuuuauucacaaaaggccagaauaaacuauauauaugcaguucagugcucugcccaaauuucucuauauuuggagcauuguaggcuuacuuucucuugaagcaaaagaaggugguauguugauuuucauugugauaaaaugccaaaggaaaaccaaggagggacuuugguucauaguuucuaaaguuccaguggaaguucagcuggaucuauuaguuggucuugaggugaaucaaaauaugucugcggauauggcaaaagcuguucaccuuuggcaaccaagcugcagaaagacaggaggaggccagggauaagaggagccuuucuagagcaacuuugccugucucuaccucccagugauaacaucaugugacccauuaagguauuaguccacuuaggaaguaaauacccugacaaucucaucacuucccugugaccagacaagccuucaacacaugacccauuugggcagacacuucauauccauaccacaacaaaugacuaauaguaaucucaaaugacuuccaugacaacgaaauaaauauauauuugacuccaucaaaccaaagaagacaaaugauaaugcaaguuuacugugucugagacaguaaggccuaauuaucuugacucauagacacauuuuuuuaauauuuuuuauuagauauuuucuuuauauacauuucaaaugcuaucccgaaaguucccuauacccuccccccagcccugcuccccuacaagaagcucacuccagcuucuuggcccugguguuccccuguacugaggcauauaaaguuugcaagagcaaggggccucucuucccagugauggccgacuaggccaucuucugcuacauaugcagcuagagacacgagcuguggggguacugguuaguucauauuguuguauggacacauuucuaaucugaggaagaguucuaugaacuuuagcuuacuuugccuggcuggaguacaaggaaagggaugcuauguauauauaccuguauuaauagagcuaaaacuuggaggaguauuccugaguuauuuaaagucaagucuugaacaguacaguauguuuaaaaaaauugucgacauucuccaaaaggaaaaugaaauggccauuccaccuagguaagccauaacuauuuguuauugggguggggacccacuggaaggauuuuaugcaaauaaaaccuccacuggagccagagcuuugaaacuuuucuacuaguuauuagcuagauaucccaguuuuaucauguaaaaugaggaaauucauaguacuugucuucauuuaacccuauauucugaguuuuuagaauacugccuauaaaauaacgggcacuaaguaaauguuuaaucaauacaugaauucugguuguaacuguuauauugcucugccuagucucauguguaaagggguuaauagagggauguuauguggcuauuugaaagaaaacguccauacucaacaucuuggguuuuuuuccauauauuuuauauuugauacuuauugaaauucauaaauaaaaaauaacacuugaaaacaauuacuaaacagucucuuagaaaguauguuauuagcaaaaaugaaaaaauuaaagccagacacaauuuuacauggcuguaaucgcagcuacuccagaagcugagcugacucgauuaugaagucaagccagccugggcaauaaugaaguuagggaaaguuuuauguguugcauuuguaccauguuuggaagacauucaaauacaaccuaauguuucauuuuuaaauucuguuaacaucuacuuucaggggucuaucuaaccucugacuuuuuaagaaaaaaaaaaaacuuuguccucagcaaaacugcauacacuauuagucauguauucagaauuagguuuuuaauggaguuuugcuuaguuuuugcauugagauaagcuauguaauccugguuuaccugaaacucacgauguaggucaggccagccuugaacucaaaaagagaucugccugccuuugccuccauagugcugggagugugccaccacacuguauauuuuaagaaggguucuugagcugagcuuaauggugcauaccuuugaucccaacccuucagaugucaggugaauuucuaaauuugaggucagccuagucuauauagugaagucugggacagcaagagcuacauagugagacccuuaguaaaacaaaaacaagaaagaaaagcugaauaacuuuuuagaaaaauguauagaccuuuacaucucauaaauggguuuuaaacaagaguauagucuauauauuagcauugucucuaaaugagauuaugaauucuuuugagguaacguuccaagggauagguaggcaugauaauuuacgaaaauccaaauucagauucuuaauucccaaaacccuacaucauacccuuagaugaacuuaagaugccugugaucaagggaauaacagccauuuccuuauuaaucuuuaucacauuuuacaaaagaaaaagcaagauuuguuuuccaaaaauguacccaacaauauuucaagucccauauguucuuacagaguauuuugcugcuucccuaucgugagagugggucuugaacuuuaucaaacauuuccuacugucuugguuaaaggaguaucacaauuuaauuuuuuuuacuaugaguaaaauguguucauuccagcuguuacauugcauauggaaauguucagaauucagauguuuugucaaguaaaggagaugggaguguugguuuaaugauguuugucuuuuuuuuuuuuuuuuuuuuuuuuggcccuuauuuuaaacacuaguuuucaaaguuaacagccauagucacccuacugugcuuuuauaguuacucuuccugcccagccacauuucuguuuuguuagccggcugucuccuagauguccuucccagcugugaugacccuuuuaaaauucuacaucuaaaugagaauacaguauuuaugcuuuccucguuucacuacuuaaugccauucagaagauuaggugugcuuguaaucccagcaccuggaaagcagagacaguuggaucucuugaggccagcuugggcagccagagcuacauaauaagacuccauccaaaaaaccaaaaaccuauccaggcucacccauuuugccacaaaugacaggauuucaugggguuuugugacugaauaaauaucuugcuaguguguauaugucacaguuucuuuagccauucuucauuuugguaaaaaccuagauagaccaguuucauauuuuuacuauuccuaggaaguuggauaaauggauucuaacuuuuuaaaucaaggauacuuauuuaaucugggguugcauacaugugccauggugcaaauguagaggucaggggacaacuugggggacuugauucucuccuauguggguuccaacucggauuaucuggcuugaagacagccgucaccugcucaagccaccuuacuggccccauugaaucugaaguuuaauugugaaaucaaaagacuuaaaauagcgaguucaacagacuaugaaccuacaaaagaggcuaacagaauaugaggggcuggagagauggcucagcaguuaugagcacuggcugcucucacaaaugugggcuucauacccagcauguauauagcaacucacaauccucuguaauuguagaguaguggcucucaaccuuccuaaugcuguaaaccuugaauacaguuucucacguugugaugaccacacacacacauauaaaauuauuucauuacuacuuuauaacuguaaguuugcuaguuaugaauuguaauguaaauaucugauauacaggauggcugauauauaguucccaugaaagggucaguugauccucccaaagugguugcaacccacauguagaaaaacacugcuuuaucugaucauauacucaugcaggcaaauucaacaagucuuaaaagaaaaccagagaucuuaagcauucugccucaaguucugcuuauucacccagcuucugauaccaacagauaugugcuauuuuuaaauauggucagagaagcuucuuauuacagaguagaaguuaauguagagauccauuagcuauucaagugcugagaauaagggucugugacuacuuaucagcuauagauagaauauguguaguaucaaccaaguucccaaggcucaagaacacugaggaaaauggagaaaggauuuaaaaucagaacggaaggagagugugagacacugaucucuggacauggcauagcugcuacaugcaugaauuuauuacaguguggauaccaguguaagauaaagaauaaaauuguagcauuggagcuggagagaaggcccacuggaagagcauugguugcucuuccaugccaucgcugggauucuuuucccagcagcuauguggcuuauaaccagauguuuuuccaaucccaugggacccuaagcccucuguuggccuccaccaacacuucauucacugugaguguguuuguacaggcaaaacacccgugcacuuaaaauuccaccugggggaguggggagggcucuggguacuucacucagcugaggggcuaaugacaguugaugacuagugagggaaugaaauuauagauaaugauaauggaggauacaaaauacaaaacuuugaaaagucacuuuuuugaggggcaggguuuaguagguuccccaaaucucaguguaagacuucacauaaguaugcauaauuggacuuacugaauuaaaagcaacuuuuaagagacaugaagauaagagauggaaggaaagugaugggagcuagcaggggauggauaaaaaccaagauauaguauaccauguaugagauugucaaaaguaaguuuuucucucuucagucuaccuguuacuguuuacaagaaguaagaggaggaaagaaaauuugguugaccuuuggauugguguugacuuuaaaauaaaacaccaaagccugauucauaaaagagaguuggaaguuggaccucacagaaauaucugcuucaucuggguaguggugacacaugcccuuaaucccagcacucaagaggcagaagcaggcagauuucuaugaguuuaagggccaaccuugucuacagagugaguuccaggauagacaaagcuacauacagagaaacccugucugaaaaaaaccaaaaugaacaaaaggaaaaauaacauacucugcucagugaaagaugcuuaagaaaaugaagacaguuggagauaguaauacaugccucuaaaggcaggggugggaggaugauccuugugaguuugaggccacucugcucuacacgucaauuuccaaccagggcuacauaagcagucucaaucgaacagaaucggaggucaagccaugggcuagaagacacuuucaaaacaacaguguaccauugcauaccuauuacaaugucaaaaaggaaauacugaugacaugcuggccaugguguagugccagcugaagccagaagagagcauuggauucccuggaauaagaguugugggccacuguguugaugcugucaauuguccccuggaaaagcagcuacuguucagaacugcuaagccaucucuccagccacguuugcuguuuuugauuauagaaguuguauuccuaauaaacaguucagaaaaaugguucagcaagaugccucaguggauggccaauaaaugggaaauauaa

SEQ ID NO: 6906 - RNA, 1772 nt, Mus musculus
cucaagcaauacauuuuuuauucuuuaugucauucacucaagauagauguaaguugggaacuuaucucagugacagaauacuucauuagcauucacaaggccaagcucaguuuuuagcaccaacaaaaauuacuuuucaaaaaggaaaauguagcuggaaaaaucuauuaaaauuuuuaaauuugaugucaacagaaggcacuaaaauauaauuugaaaauaaucucagaaaagauuuaaacaaaacgaaggugguaaagagagaguucaguagucugagcacauacugcucuuaggauccaagcuuuguucccagcaccuugugauuccagcuccaagguaucugaugcccucuucuagacauuggcacuugcauucacauacacauauucacaaagagucacacagaguuaaaaaaauaaaauauauuuuaaagcaguaaccauaauuguuacacaaaaagguggagugucaaggcaugauggcacaaauaaucccagcacaugggaggcuugacacaguaagaucacugugugcaggaccauuccugcccauauagaccuagucucaaaacaacuuggcagacaacacaaacuaaacagaagaccaguaauaggggcauacuaaaacagaaucuauaauucauguuuaaauggugaauagauaccaggaacauuuaugugccaaauagcuuaguauaaauauauaagagaaacagaaagcaagaauacaagggaucucaccgguguuuuagaaaagagcaagugaaaauacaguaauuuuaaacaguaagaucaagccaaagaaguaaucagugauuuuaaacauuaaaaugccccuuucaauggggaauagaauaauuacucaauaaaguaggaaauaugaaauugaauaaacaccagaaccaaauaguagaauacauuagaaaauaaaaacuauagauagaugaauagugagagaauggaaguagaaugaggaauuuaagaaaguaaggacaaggaaaaaaugacaagaaguuccagcucaccuaaaggcuaagugaggguuacuggagcuuauaguucaagacuagccugggcaaacacaacuuaaaagaacucgaaagaacaagaaagaauagaucuaccccuaaaacaccccuagaggauauuaauaauaugcuuaaaaacagauauuaacuguauccucaugaugcuaaauguucauuccgacauauugcagaauauauaaauuuucagaaaauggaaauuucccaagauuuauguuagaaacagaaccaugcccaaaugaagaagacacguggaaagaggaaaacuaaaagaauuacucucaaggaaacaggauugucaaguuagaaauaaaacggcuuuaacuucuuuaaucaacaguuaauucuugggacauauauuuuaaauaaaaacagcuuuccaguuguuauucugccaaugaacaugcuaaucaaugccuggcugaguuaaacacagauaccaaauccuaaguauuuagucaauaguacauagcaauauuaaauucuuaaauggauggcuuauaucuuauuauuuguuaucuauuaggacaugguaguguauauuaaaggagagaaucuauaugaacauuguuagaaauuuuaaucugauccuauuacuaacacauuaaguaguuuaucccuaaucuguuuauccaugaagucuaaaacucuaaaaguuagacauucauaaaaucaggaaagauaaaucaacucuauaaacuauuaaaaugauaacuaggcaaua

SEQ ID NO: 6907 - RNA, 1772 nt, Mus musculus
uauugccuaguuaucauuuuaauaguuuauagaguugauuuaucuuuccugauuuuaugaaugucuaacuuuuagaguuuuagacuucauggauaaacagauuagggauaaacuacuuaauguguuaguaauaggaucagauuaaaauuucuaacaauguucauauagauucucuccuuuaauauacacuaccauguccuaauagauaacaaauaauaagauauaagccauccauuuaagaauuuaauauugcuauguacuauugacuaaauacuuaggauuugguaucuguguuuaacucagccaggcauugauuagcauguucauuggcagaauaacaacuggaaagcuguuuuuauuuaaaauauaugucccaagaauuaacuguugauuaaagaaguuaaagccguuuuauuucuaacuugacaauccuguuuccuugagaguaauucuuuuaguuuuccucuuuccacgugucuucuucauuugggcaugguucuguuucuaacauaaaucuugggaaauuuccauuuucugaaaauuuauauauucugcaauaugucggaaugaacauuuagcaucaugaggauacaguuaauaucuguuuuuaagcauauuauuaauauccucuagggguguuuuagggguagaucuauucuuucuuguucuuucgaguucuuuuaaguuguguuugcccaggcuagucuugaacuauaagcuccaguaacccucacuuagccuuuaggugagcuggaacuucuugucauuuuuuccuuguccuuacuuucuuaaauuccucauucuacuuccauucucucacuauucaucuaucuauaguuuuuauuuucuaauguauucuacuauuugguucugguguuuauucaauuucauauuuccuacuuuauugaguaauuauucuauuccccauugaaaggggcauuuuaauguuuaaaaucacugauuacuucuuuggcuugaucuuacuguuuaaaauuacuguauuuucacuugcucuuuucuaaaacaccggugagaucccuuguauucuugcuuucuguuucucuuauauauuuauacuaagcuauuuggcacauaaauguuccugguaucuauucaccauuuaaacaugaauuauagauucuguuuuaguaugccccuauuacuggucuucuguuuaguuuguguugucugccaaguuguuuugagacuaggucuauaugggcaggaaugguccugcacacagugaucuuacugugucaagccucccaugugcugggauuauuugugccaucaugccuugacacuccaccuuuuuguguaacaauuaugguuacugcuuuaaaauauauuuuauuuuuuuaacucugugugacucuuugugaauauguguaugugaaugcaagugccaaugucuagaagagggcaucagauaccuuggagcuggaaucacaaggugcugggaacaaagcuuggauccuaagagcaguaugugcucagacuacugaacucucucuuuaccaccuucguuuuguuuaaaucuuuucugagauuauuuucaaauuauauuuuagugccuucuguugacaucaaauuuaaaaauuuuaauagauuuuuccagcuacauuuuccuuuuugaaaaguaauuuuuguuggugcuaaaaacugagcuuggccuugugaaugcuaaugaaguauucugucacugagauaaguucccaacuuacaucuaucuugagugaaugacauaaagaauaaaaaauguauugcuugag

SEQ ID NO: 6908 - RNA, 91301 nt, Mus musculus
augagaacuacaaacuuauggugaguugagaccuacaguaugcccuuacuacuaugaucaaaauuuuguuugcuuccaucuccgggugaccaugaaauaguuuacuauuaguaacuucuaguaaucuaagaaaaaucacuggagaaguccuuugguaaauggcaggcuuauaaaaugauuucuaguaagagaaccaucuaaauacugugcuaaccagaaaugacguuuuaaugacuugguaucacaaucacugaauguggucuuucuacacaggagccuuuuaguaacugcaaauaugaaaugcaucagcugccaccuucuaguucccuaaauaaacuuuuuuuucuauaaucaaagaaaacaggcuuuucuuguuuuugcuuguccaaacaggugucacuauaacucuggcuggccuccaaucucaauagguaaaacacccuagccucaaacuucuugccccugccucccaaguguuaugaaugcagacauaugccagugugccuggcauacaaguuuuuaagguuuuugaguuuguuagggauuaaaccugggcauuauacuugcuagggcaaauagucauugagcuagcucuagcccuuaaaaaguuacuguuaguccaaauuauuauuaacuuauuagucuggucuaauacuggucacacaauuuuccuagucauaaguugguauugcauaggcaugguaacaggccccuguaauccuaaccguugggagaauuaggagccagugaguauaaggccauccugagcuacaugaagacccaagaaaaagcaauagaauguuaaguguuuacugcagacuuagaugugguguacaagaaccacauaagcaauccagcuaucacaaauaaaccaggcagccucuaagccuuucuucagcugcacuguggagguuaaucauuccauuugggguuacaaguaggucugguucagcuuuaaauaccacagccagcaucccagacaguauauucaaguuccaccuagucugaaaaauaaucagagcaggaguggacucagcaaagucaccaaaaccucacauacaagugcuagccauuucacugagaaacgcauuucucaaaccuugguaauucuuaugaacuaacaauauuuaaguaaguuuguuuccaucagugaauuugugguuuugcuuccucauggagccuuauuucucuguucaaauuuccauuuuuauucacguaagcauagaauauucaaacauuugaugacuagagaagcuaguagacauuaacaaacaagaaauucugccagccucaucuauaugugguuaaauacccucgaugauaagucauuauguauuugcuaacagaaguggaagcuguuaaacaaucacauuccacaaaccauuuaaucaauuaacucucuagaauuauuccuuuaauuuucaguuuaccaacagguaacaauugaagauuugggacauaccgaauuuuccauguaggaaaaauugugaggcagaaaaacuucacaggaagacuguuuuccauaggucaaucuuacguucacuuucuuaucugcagugugacuugauucuacccccuuagaauuuuauuacuuuaagucuuacccaaaauacagacuuuaacuagugauuucccagcucuguucuuaauccaaacucuccgaacugaauuaccaccucucagcacugcauuaauacuucaugagacaucuuucuuguaacaccacccugagucuggacuguccugcagucacuggccuuucuucacuaugguuuaauuggcauccccuuuucuuaaacacaggauauaguuacacagucuuacaaaacacacauuauuagaagaaauaguuccaauuuucuauuucaaagccaauaauuucccugacuucccagccacucucccaacauggauauauauaucugaaauguuuaauuagaaaaacuauccaaacacaagucaauuuuauauaaaauauuuaauuuuuaaaacacagacuauucaugucacauaaauaguuucaauuuuagguuagcugcuuauggccagcagauguaccaaaugugacaaauaauaauuuagauacugucacuuauaggaaagucuaaagcucuaagacucaccauauuaaaauuucagagacuugaauacucuaauuucuaaauuucaaaacauuuuuucacuuccucuacuguuuuauuaaguuguuaguacucuguauucaaauaaaagcaaaauauuuuuucuuccauuaauuuuuuucuuucaccaacaaaauacgaucaaaaaauaaaauggucaacugaaaacucauuuuuaauaggcauaaacuggaaaauuaucuuuaaaauauucugucaccaaacaauaauguuuccugaauguuuguaaaugcagggucacaaaucauauaaagggcaugaagcuaagcugcuuuucauaacaguucuuccuuacuuaguauccaaugggaaagguacuacaacaauugaaauugucagucggcacgcgagggcgguuccccagagucucuuaucuacgaaugaugaaggugaugcuggcuauuuaccuuugguuccuuuucagaaauagaauuuugguuuuuugugugugugugugugugugugugaacguaaacauagugcgacuugacaacaucagaguuauucuuucuugguugauucuaauagaauagcacugcucuaaucuggcagaaauuauaguaaauuucacagaauugaaaggaagagggaagguuuucucuuugaguuuucuguuugcuuuacuaaauuagaucuaggacauguuucuacuuaaguugacauuuucuuaaaauuauauaacuuaaaauaagguguuugccacccuccuucuguggacuucaauacauuuguuauguaccauauguauuuauuuaugaauuguuauacauacuugcuucaaaacuccugcccuccaaauagaaacugggucaguaugacagccagaaagaaaggagcacucuaaaauucucauucagcuacuacuuucaaccacuuaauugauaaaaaaaaguuuuaguacuucccagaaguaacauaagguucugaguucucccuuucuuuuccucuuacaccccuaccaagagaagguaacaguggaagucaacacagccaaaagacaggcagaaagggacagugugacaggcaggcagagggaauggagcuaacagaacugaccaagcaacuccugagagcggagaagcucccugccccgucagcacaguacagacucccuuagaaagacaguggugugaaggcucauuucauccgcagaccuuaagcuuaccuguuaaggcacuuacucaaccccuccccacccuacccauaguuuucauauaaaaaccacuauuucauuugaaugaauuuuccuguauuaugguaaccugaaaaaaacaaaacaaaaauaauguugaccauuuuuuauauaaaacuguugcaucaagagaaagguuguguuuuauuuuucugaaaugagcacaaaguacaccuuucacaauaacacugaaagcaggugcaaagacugacagugaccuucgacuaaagguagcuuuguaaaaagaaaauaccaaauaaaucagugcccuuucugauuguuguaaaacuggaagggggauggggggcauggggggaaggggagcuuguuuacauaaaaguugguccaaacuuacaaaaaaaagcacaagugugcauaguucagaagaucugccacagggccauaaaaacauuaugucccuaauguuagcauccacuuaaaacugcaagaauacaaaauaaaauuguuaacuaaaaucugugacgauguacaaucaauagagcuaguuuuaagaacagcaugaauuuaagcaaagauuuuuuuuguuguuuuguuuuuuucacuauuguaugcaagacccuuuccacauaaaaauaaagcuguuguugaauuaauauuauucaagucucuuggauugcugccugaaauugcagcuagaaaagucuuuccagauaaaaaugaugugccugaggaaaaacagauacucaguaugguaacccucugccucgaccucugccagcugaugugcuaauguguccccuguauccuugugaauauccagguccuugggcaggagaaguccaggucuguccaugcaugaggcuagggccaccuggauuuuccuguaaguuaccaccauaguuauaguugugcaucuuugcuggcaagggaugaguacucucuggcccuguggaagggucauugcuguuugugaggacugugauaggaccauggcuauauucaaaucuaugguccuugucuccacuaaacaacaugggaccagcauugagguaaaugucuccauauccagcuacugaacuggcaaacgacucaguaaaggcagaaguuugagguggaccaccagugugagaugaagcaguacuguaguuauccagagacugaauaucugaguuuccaaugaaacuacgugcuuccaauggugcagcagcggagcuacuuccuagaccaucacugcuaacguaaggagcggcagagaaagaagauccaaaguuguccuuauagucugaacugggcacauaugugucuccugugggauaaucgauaccaccuucucuuuugggaucauccuggggcugaugcugagcaagcagcuguaagagggcugccuucacuccagcaugugggucaguuaaugaagaacuagugguaggaacaugcugguuuucuguccgauaaucuagguccuccucaguaacugguggugguucaggagguucaggaggccguugaucaggaggcagaauucgaggccggucugguucuggugucagcuccaauauccuccugucuuggugcuggaugaggucaucuugcccuaaguaagauaaacccaagaaagaguucaaaguuaccauggaaaaugaaauauucagaacggucauacauuccaccuuugacaaaauaccaaaggauguaucucacaagugcucauguuacccacuacuacuuaagauuauuaaagaaauacaccauucaacuccacacagucguacugaaugcuugaagagcaagauucuacuauacacacaacauuuaguaccuuuuguacuaagaauagaguuauuguauauuuaccuuaggaaaaaaguauuguauucauaaugaauaauaucccacauggacaauuuucuaaacaaucuacuccaggaaguaaacaaaauagaaaaccacuucucacaagggaccugagaaugucuuuaacaacugucaaugagcagucaaagcuauaucuaucaacagcucugagccaaucacucaccggauccaggagugcucgguucuagaggaggccugaguugcaauggagcuucauguccugauccauuuucccuuuccucuagcauggcaucuuucuguuuggacuguugggccuuuauuaacugagucaagaggacugcaaaugcacucugcacagcagccugggcagcaucaguuuccacuuuaggcuggauggucugugaaggcugaacuccucccaaugauuuugaagacuccuguugugguguugauggaucugucuguuuuucaccuguugccaaaauuccagcaggaagguuuauuuuauuuagcugcuguugagucucagaguuuaccuuaauguucaacacuuggacaaaaucagccauauuaacacuugauuuagauuguaguagguuuagaagaauugccaauucacugugguuuaacggcuguccagggccuguuauuacuaaagacaaaauguauugauuagaacugccauaauucacaguuuucccaacccccauaaccucuucauuacacaauuagaauuccacuuguggaagaguuaugaaacaaugugaaugagcacuucagucuacucacugucaugacauucaaaaucuaacuacaacacaagucaagacagacauuaaaacuacagucuauuuuggguaauucaucuuuaggaauuuacuuuccaaaagaaaaagacuaccaccagagcagauuuaaccaugagcuaucacuguaugagagaaaugaacaacaguaacucuaacagugccagcacuguuaagcauuuguagccuuuauccucacagccacuuuauaagacaauaaauaauacuaauuauccuaaaaguggauaaauugccaagauccuagauucugaaauuuaauccugaaugcagucucugaauucuuucuacaaaaaugaaguuaacuguugugcaaauaacuuuuuagaaauuaaaacuaauacuguaauacuauaauaaaauaucuuuuuauucgauuacuuucuuuaaaaaacguuaaaccauuuucaguuagauagaccuacacaaacauacauauuagauaucaacuuacuaccaguaagacacaucuaguuaguuuucuuccuccaauacuuaguucuucaggaaaacugaaacucaauuuuuuaaaaccugucaacuagccaaccauaguggcacacaucuuuaaacccagcccuuggggggcaaagaugggugguuguuugugaguuugaugccaaacuacuugcaaagagaguucuaggacagccagggcuacaaauugagaccuuaucucuagacagacagguagauagauaugaaugcaagaaagaaauaacuaggucuaaauaacagauuucaaucuuuuaaaauacagucuuaguaagaaugauguacagauagauauccaccaaugggaugaaaaauuccuuuugcaguuuuggcuaucuuuguguuuucuaugccuuaauuaaacacugaacuaaaucugcuaauguuaaucaaagacccuugacucuugaacuagagaaacaggaaaaagaaaucuaaccaaucaccacaaauccaugauuugagacugcuuguaaugcgaguugugcuggcaccaacaauaaaguaaugcccaguucaucuuuuugccauaauauguuuuaacaggagaacaaacacauucaacgcaggccacaaagcaaugugaacaaaacaagccaaagaagcauuacugaccaggugcuacauuugaguugcucugagauuucaacugugcggguggcagcacacccugggguguguuaguucugcugucaucuaagcccagagacagguccuuccuaggggcuuugauuguggaaagaucaucagucaugcccaucuguuucugucuucuucucuuuuuacuccauaauucaugacaaucuugccacaaaggaaggcugaaaaaaacauaucaaugcuaaaucacaaaugccaaagccacaaauacuaauguuacaauguaccacgaaagccauuccccucccacaagccauucuggaaagcuucauacaaacauucaauaaaauucauccauacuucaggguuuuaacuuuagugguggacuaauuauuuuuuuuuuauuuguccuaaauuuuuauuguuuaaaauuguauucaugcauuaauguguuugaacaaguacaucccgaaucuccccacuaaaaugccuuuccuaucuccccuaaaucucuaugcccucccaauuucauguguuuucuuucucucucaaaacucacuaagucaacuuagugcuaccaguauguguauggguaagaggcuaccugcuggaauauaaauauacucuaaaggggccacaucucugaagaaaaaaggugacucucccuuucccagcagccauaacugcacauaucuccucagcugggagugagcuuucaugacuaacuccuucccuccaagcugggauuuugucuggcuugaucugaagugggccuugugcauauugucacagcugcugugcccgcauaugaacugcuguacccuacagaugaacuauuuuugucuucugaauaaucaauaaauaaaauuaugaauauauauuaauaaaagcuauuagaauaacuuuuuuaaaccaacuauagcacacuguacacuaaacaggaauuuugaaaaaggaugcagaaacaugcuauuuguagaagccagacauaaacaaaaaggagaguaacagaauaggcuacaacacaggauucguacagaacuuuuuaguaaaaucuuuucaauuuuuagucacauauuugcuacuauuaccaauuguuuuggaaauaaacugauucuauagaugagucucaagaauagguaauccaggcacagagaggcucaucauacucaucaacagaauucuacgugaucaguaacuaccaaaauuaccucuaauucucuaauaacuuuucaucucaauauaauucuuuaacacugaacacuaaaaguaacuuuuucugaaagacaaaaauacuugauuuacaaauguuuucuuuugaucccaguaauaacuuacuacuacuuuucucuagcuuaaaggugagaaaauuaaggcuuggaaagguuaauaaacuugcccagaauaucuagauucuuuuaagcaaugccaucuaacgguauauaccugcuguccucaacuuggauguuuaucucaagagguacauaggacuuuccaagaguguagcuaagguuguguaagggugcugcauuuccacauggacccuuuucgaagacugaacuagaagaacacccugaaugcucaaguagauaauucuuccacaauuacuuucucauauuauaaaauaaaggcauaugcaacagaaugguugaaucuuagcaauauaauauuaauuuaaaaaugucauuccacaggauuacaaaacagcaugacaccuuuguauaaaaugaaaaacaacuacauuuuuuaaauguaauuuuuauggauacauacagauggcaacagaaaauauauacaagaauaaggaaacgggaaugaugguuaccuuggggagaagagggcaagggaacacguggguaggaagaaggguuaugauaugauuaaaguggguuauucucaagguucuagcuuuugcuugguaggcucauggcugcuuauuaacauuuaaaauaacuaauuaaaguaacuaaaauaauaacagagagccaugcauggaccaaugaugagugacacaaggauuaugauuaaaccaagucuaugcaccugagguccgaaaacaaaacaaaggcauaccucucagccaucuuacuauggugcauugccucagcguguaaaaaccuccuggaguaacaaacaaagggauaauuugaaauauugauacugggaagcuguaaggcaucaaaaacccuccaaaagacuuuccuuucugggaauguguuuguguuuuaugaugugggcuguagccucuguugggauggugauuucaaauauucuauaguacagguuaggguaaauaaaaucauuacaucuccuccauucuaacagccaagaaauacaauguucuuguggaaaaguaaagaaauccagguaaaggauuuguuuguucccucccacaacuuaaagagauucauuaugaauuacuuuaacacucaucucuaugaaauauaaacaaaaccuuacaaugaucuaaaauggcagauuauuuaugcugauuuucuaaacaaaucaggcauguucuccagauaaccaaaaguaugugcuuccugaagguucaaaugcuggcucagccacuuauuugcuaucuugucagacaaguaaauggaccucuguaucucaguuuuuuuucuuuaaaaaugggauuaacaauuauuaccuauugccaggagacagaaguaguauguuaauuuuaucagggcauccuuggucaaagccacucauacaguauuugugaguggcuauacuauauuugugucugauaucacugaucuucauucaguugucuaaaagguuguuuaucaaaucaugaaauacuuauucuaaugauagauggucacauuacuguccaaauguuuaauacuuuuuauacugcugauaagguauaggcuagaggccuuuuaauucacaucuuaguuauauacuuuauagaaugacagcccuacuuaguaguuucucuuacauauuaaauagagggcacuuuuaauuuaaauacugaaccgaugucauccuaaccuugacuuggauuccucaaugauguaucuaagagcauacauuccauagcagucucacagaacaccugaguggacugcuaccuugcuguuuaauagaaaagugcaggaaaguguaccugaguuacagggcaaugacaagaauuacaauuuauaagaaaaaaacaaaacaaaaaacccaacaacuccacaagucuuuuaagucauagcacaaaaaaaugguagagcuaguaaaauaaaauuaaugacuaaugucuaaaugagcuucugggucacaugacuuccuuauugucagaagaccuguggaagggaggaagcuuuucaaauguucuuacuuuuuuuguuguugcuuauugaaauguguuuugucugcaaauauguuuguguaacauauauguguuugauacccacaaaagucagacgagggcaucgaauucccuggaacugaguuuuuagauggugugaaccaccauucgagugcuagaaaccaaaccaagguccucugcaaccaaugaggaacgguucccucccugaucucauuuuuuuuuuauuauaaaaccaaaacuuuagauacuuaacgcagaaauucaaaggcagugauauagcugugaacaacuucuuucagugaaugcuuauuugcaagaacacucacgaaaauaacaaguaaguuauaauuaauauagaacuaugucucaugucuacuaaauaggacuaguucaaagacaugaaaauuacuaugugacuaggaaaagaucucaggucugucacuucuacuagacuucauagccaacaaaauucacugaugguuuaaaacacugaaauauguacuacuaaugcaguaccagauaucauauuaauagucauagaaauauuuuaaaauuaaaauccacuuauauacauaccauuguuuaagaaguauaauaucacaacuaauguaauauuaguuacaucagaauaaaaauguaagaaauaaugcaaguucaauagggaaaaauaaauucccaaauguuuaacauuugcuaagugaauuaaaggacauucagaucccaguggacacacuuacaaggcuuuacaaguuuguaugaaaauaagcuugagaagcuggcuucacaauccuuuccuguagaguaagugaugaggauuagcauguauguccucuauaauccucuugacaccgucuaugagaacauguuaccuuguagguauuaugcuugcacuggaaaauguuaacguaauguugaucacagaaaaccaaaaaauccagauuauggaaagcuuuaccaagcagccaccucaggcucuuagccuuuguugggacuggagauugagcuuagcagaagcccuugccaggcauguguauggcccuauguuugauguccacuaccaaacacagaagccagugucaucaaaaccuucucuaagagugaggaaauauugaagauauaugcuaaguaaacauauaugugaguucugaacaaauuguucaauccugacuccguagaaaacuuguuaaaaacaaaacaguuuuauugggcuacugggagacuuaaauauguacuaguuuuuaugauguuuuaugcuauauaauaguaguauguguaguaaaguuccaguuuuuauagauucaugcaacagcuuaauauucaacuacuucagaaaaaguuuauaaaguaaugaaacaaauguguccacacaccaauaauuauugaaucuaggugaagaauauucuacauuucugcagaggugaaaacucaaaaccaaaaguuaaaaccaguaaaacaaaaacaacaacaacaaaaccuuugauaugcuacuagaaucaagccacuuggagacuacugauauaucuaaauaagcaaaacuaaaugcuaaauauuaaacauuuagcucaacaguaucugaucuaggugagguggugcacaccuguaagaggcauagacuggaggaucuugagcuaaaggccagccuguacuauacaacccaaacugagucaaaaagaaagaaaaaaaagaaaguuaaauaaauuaaaaaaaaaaaaaaaaaaaaaaaaaaaacccuggaacuagugaaugacuucugcaugucagaugauaguuauuuuuuuuaacuuucaaacuaccucaugggccauuuauauauauaguucaauaaaaucuuaauuacaaacccuguggaaaauaugcucaauaugacuacaaaguggaagagccaggauuugaacucuaaagcccauguuuauucauuuaaaauauguaaauuuuauuacagcaaaguacuuuaugagagaaaauguuuacuuuuaaugcugcugaucauguuaacaaauaccaaggaaauaccuacaaaccuucagccccuaucguagagaagcaaaggcacaauccucuucccaaccaauuccagacaaauuacaggagcgauguaaagacuuagaaauaagcuauucugauccuccaaaccgcacuuucccuucaugauaaguaagaaucauugcaaacaugcuucugauacuaacauucuuugaaauaaugauaaggauuuucuauugugggagaugucacagcuuauuuucagaacuuguuucuuaucgaacugacuucaauuugagaacuggcaccauccuuuaccguauuuguauucuugggcaaguuuuuuaaccucuuugagccugcucccuccuguuaagcagugguaauaauaccuaccguagaggguuguacagauuaagcuugacauagaacucagaacucuggcugaagcuuggccugacggccauauuccaccauaacaaaauuguuauggaggggaaauauaucacuacccagcaucagcuaaagaaaugggaaaggcuguuuuuacuggucuauggcaaacucaacaauaaacaagcacuuacaugcuugaugugcaaaucauguaauuuucugaugucuuuccuaacuaguucaacuucagcauagaaucauggaucaugacaucuaauuaacaaaauuuucaaagcuguccagauaaugcaaaucuaaaaugaaaaaagucacuuacucugguggaggcauuuuggaggguuccacgucucgcaggaacucacacugaagagccugcucagcagugcagcgcuuacugggauccaaggcaagcauguaaucgaauaagucgagugcagcugcggggaugcuagcgccagaggacacaagagucaagcacagccuucacacacgcucggugcuucuauaagcacuuaguuuacaaauuugaaaauuaauuuuaaauuauauucuaaauaccaauugcuuuacucugauuaccuauaucuuuaaaguccuuauuacuuuauuaacuaauaaauucuuauuuuaauuuauagaauaauacagauagauaacugcaggugauauuuuaaaacuaauuuaguaaucaguuaaguauuaaugguuaaauaauguaugcaguauguagcacaaguaucaauuuucaaaaaucauuguuauuuuuauccaguucuggacuauuuagcaaauaauauccuuuaucacucuaugagcaauucaugguuauaaauuaaaaacuaacagccuccuaaaauaaaauaaaaacuuaagcucaagucauagaaagcuguuccagugaaauuuacaaaacuauuauuuaaaguuuucuucauguaaacaaauaaaaccuaauggauuagucacagacuuugagaugaauggcacuucacaugcagcaaagagagacgcacaacacaaggcccuagaagaagagcugcacuaugccuuaucuuaggucaagguggcacuuaagauuucuuaagaaaugaccuucucagcugugugugcuagggcacaccuauggucucagcacgaguucaagaccauccuuagauacacagacaaaacaaaaaacaaaaacaaaaaacaaauuuaaaccuuauaaugacuacaaaaaaaaaaaaucaaugcaauccagauauuuaagcaucccuuucuuacaaaacaaauucuucucuuaacuuccgccgauauugcuucuuugguuucaugguguugaaauauggcaguuugauuacaucaggccacacugcaggacauggacucccacauauacggcuaaaauaauacaaaaaagaaaaaagaaaaaaauuuuaucauuacaaacuacuuuaaaaacuaauaaauauaauuuuuuaaacaucaaucaguucuuaaggacauaaaagcuuugauauaauguuaugagaaauuuaaauacuuuagucuucacaauuuaauuugaaaauucccaaauuucacacauaaacauugaaucuccuaaagaaccuuccuacugcauaaaaucuuaagauauaggucauauuuacaauauguggccuauauauuacaaauuaaggaaacaaguuaaggaaaccacgucucacucuggcuuuucauggucucuccucucucucaaacauaggguaucuugaugguaacagcagaagcagacuuccuacccaacuguaaccacuaccucuagaugcaaacaagaagcacucugaagguaguaaucuugaaauauacaguuguacaguuucagcagugcaacuguucaugaguauuuacacauuuuaacuguucuacucuaugacuaugccuugaaauucaauaguuuaguauaaauacacagguaaucacauuugggaaaauaggcuuuaguauauaauaaaaaccacaauaauauauguauaucauuaauaaagcuaucaaugaggcuuacuauguuaagauaaaaugugcaacuaguaaugccuuauuuucugucuacuagugucuuuucugcuuaagacucaauuuucaaaaccuccucagaccucuuaggaaauguuggacucucagagaaugggcuccaauaggaucaaagaagaauagcgccucaugcacaugagccgcaccccuucucagauccuguuucuucgcaggcugcucuucccauuucugugauucuauuagauucuaagcagcuguauccuuaucacaaucuacccaacaaggaccucucuuccccaaaggccaugaagaauagacauuccuucaccugcuauuuuuuuucuguuagcacuuguuugauccuuuauauuuucuuuuuuuuuuuuaaagauuuauuuauugguuauauguaaguacacuguagcugucuucagacacuccagaagagggagucagaucucguuacggaugguugugagccaccaugugguugcugggauuugaacuccagaccuucagaagagcagucgggugcucuuacccacugagccaucucaccagcccccuuuauauuuucauuguaugccuagcuguuacccuuggacccaggcaaagugauacauauuaauaaaauagaauauacuagaguagagagaugaaagacaccuucaacuucugauaaaaaagaaaauuuaagugagagaagaaaugaagcuuuuuuggucauaguuccaaagauaaaccauagccaggugaaaaagagaguaagacaaauauguuauagggagaagaaacagaaaacaggcacaagcauuaaaaauagcaaagaauagacauguaacuaaauauaugaguauaccuaaaauuuaugauguucaagggaggugagcuggaagcacagauacacucagugaaguuuaacaauccuucuacaaaugcauaaugcagauagacugaaacaaacuuuagauuugaauccugucuuugguaucagucuaaauauacaacuuggaaaucgguucuuuuguauaaagugauaaauauugcuucaaagccauggaaugaauuaguaccugccuacaagagcuacaaugaacauaaauaagcuaaagagugucaaguuuauuauuacauguacuauuggaaaguaaguauuaaagguaccaacuaacagcagcacacagaacaucagagaaaaucuugauguucuaaauuuagaaacuuaacauuuccagccuagaaauaaucuauuucccuuaguuuuauguauuuuuuuuccaauaagaccugguguuaccuguuaacaguuucuuuuucuuuuaaauguuuuuagaccaguguauuuucuaagcaguuaaucugaaaauacuuauauaagaaggcucaaaacugaagcuuuacagauuuacaauacagauacauagcauugcauuauuuaacaauucuuagaguguuaaaaugcugaugauggcauauuauacaguaauuuugaauuuacucucugcaaaagcugaugaauuuuaguuugagaaacacaaaauacauauugcaguauauucacaaacaaacacaagaauuuccacaaaucuacuacuaagaauguauucagugagccagaugugcuguacagacagagggccuaucucucaaaaaagcagaacaagaacaugugugaaccuuugucuacauccaaauaaaaacaaucuuuauccccuucugccccauuuuguuaacucuaauauuuuccauuuuuuucauuguuucuuucuaucucuaauguagaucacacuaucugccuuaugaaaauauuuguauauuaugcuguauuugacuuauuccuacugcagauugaaaccagaguguacuacauguuagacaagucuucuaccacugagcuucaccuccagccuaacucacuugaacaaagcagauuauaaacaaaucagccauugcaguauaaguuuuaaagcagauuuuuauuucuauuucuagccgauaaguuuuucacuuuuaauuuggacaccaacaugucagcauacccaucagcuucugacugaaguaucacugcagauaaaguaagacagaaagucugcacuggggcagacuaacuauauucauuuccuauauucuuugggcguguuaucaguccuguucuaacuaugaagagccaaauuuacagcaucacagaacuuauaccauaaauaagcaggagucaugaggcugguauuugaacucaggucuaucagacuccaaggcccaccccccuuuaguauacuuuuguugucugauacacucaaacuucuaagaauguucuuuuaguuuuucuuaacuuaaaaaaaaaaaguuauagcaucauaccuuaaacaacuucuaaaaauacuaucagaaucaaacauguuuaaauuuauagaaaauaacucuuccuucuuagcuuucucacaaguccaucuucagaugaacaaauuacagaugucuuugauauguuuuauguaaauggaaucuaaacugugaaacuguucuuaugcugcuauucuacaugcuacuugcaauuaacacuucaccaagcacauagacugaacugagcuguucugcuccucaucacucacuuaauauucauaaaagcaaauuaaguacacuuacaucuaggggcuuuagugauuuugaagaacuuaauuuagauuuccgcucaaauguuaccuucccuaauuacacacauacacacaacacacacacagggcucaaauguuaccuucccuaacuacacacacacacacaaaacaucaucauuuccuacacccuuauaucuuaccaauuaguuuugucugugcccacucagaaccagaaaauagaaaugugagacuuucucuuucuggauuccaaggcauucucaguauguuguaguaaugccacacaaacaugccaucaacaaacauuguucaugcuggucauaguggcauauguucauaauaccaggauuuagggggcagaaagauugucauaagcuugaggcaaccuagucuacaaugugauucuaaggcuagauggggugaaauagugagacccuccugucucaaacauuuaaacauaaauguuuaagccaaaugacuuugauuuguccuccucuguauuacacucuauggugaauaucgucugcuuuacucuccgaaauucucauguaauuccacucgauugugaccaaguaguuuguuguuuauuguauucaguuuuaacaagcuagguuaaguucucccuuucuuuucaaaaaaguucuuucugguuauuuucuuauuguccuucuacucccuuccuagauauucucacauuuaucuuuacacagauauaaaaaauaaaauuaaaacaaugugugcagugugaaaagcccuuguuuggaaauucucgcuguggauuuaaggaaacacaaugggacuggagagcuggcacagcauuaagugcacacacugcuccuacaaccuauggcucacaaacucuaacuagcaccagaggagccgacaccgcuuaccuguuccagcauccacauucaugugcacaaacccacaugcuaaaaauaaacaugaaaagcaaaccacauuuaagauaggauaaacugucaguuuaaaagacccuuuaaagccuaguaaucaaaaauaaacuaugucucuccaacagucuuucuacuauuuuaauuuuuaauuauguauauuauauggaucuauauguacauuugugcacauaaguauggugcccuguggagaucagaagagggaaucauaugcccuggagcuguaauuacaagcauuauuaucugucugacaugggugcugagaaccaaacucaaguucucuacaaaagcagcaaauguucuuaaccacugagucauuucuccagccccaucuccaacagguuuuaaaaucuuaaauauacuaaagauuauucuacaguuuuauaguuuuucaguacuucaggggcauacauguuggugauuuuauuagagcacauccucuuccacauuguauuuucuuuuuuuuuuuucuuccauuuuuuauuagguauuuagcucauuuacauuuucaaugcuaucccaaaagucccccauacccuccccccacuccccuacccacccacucccccuuuuuggcccuggcguuccucuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggagggccauaguguccacacuucagucuucauucuucuugaguuucaucacacuguauuuucuaauugguacccauuuagaaaagcuacuguuguccuuguagauuaguaaaugacacauacaucugaacaugucuuuuaaucuugucauuuuaaucaaccuuuuuguucucaggcauuuuaggugaucaucuggcacauucaacauauucuacucucuauauaaauguaugcugugcuauauacaaauuguuuccaacuauacacaucucauacugguuuacuuuucuaacacuacuaauugacugacuuuguaaacacugguaaauugcaauacaagaaagugauugauuguucuuuacuuuuucuucuaauauuuuaccauuaaacauuauucuggcuguuagugauauaaacuuuuacugugguuuaccuucccuuauacuuuuuucgguuuuuuguuuugguuuuccgagacagggauucucuguguagcccuggcuguucuggaacucacuuuguagaccaggcuggccucgaacucagaaauccgccugccucuaccucccgaguacuaggauuaaaggcgugcaccaccacgcccagcuucccuuaaagagcuuauaugcccagcaaaugucuauccaaaucuaucaaauaaacagauuauuucauuaguaaaaugaaaaauuaaaguaauuaaagcuuccuuguaucuugggaugaaccuuauuucuaauucauguuacaaauuuaauuuauuuauaacauuuuucuguuaguucuuugaaaagucccuacaugcuguauuuuaccaagauagaauucuuuuuuucuuuucuuuuugauuuuucaagacaggguuucucuguguagccuuggcuguucuggaacucacucugcagaucuggcuggucucgaacucagaacuccaccugccucagccucccgagugcugggauuaauagcgugugccaccauugcccggcuccaagacagaauucuugaugaaaacuugaauaguuugcuaauguuccccuuagaaaucucaauauagaaaaauuucaaacuguguuugugaaauauuacuauuuguacauauguacauacauauguacaaauauauauauguauguauauguauguauguguguauauauauauauauauauauauaaaaaguuucagaagaaguccuauuucuuacauguacaaaaugcuuaauucaaagcucaauuuuuccaauuaucacuugaaagacccuagauaaauuuuuuaaacugaagaagacauugaguaguaagaauuuaacuuaaauaauucaggugaaacugcuacaguaauguguaccuugaagccuaacuacgucaacuaggacuuguaggcaacaaaaucagguccaacaaucaaacagagaacaggcuuagaaggaaucacaguaaagaaaauauacacauacaucauuugggcaucuuuauuuuguccauuucaaagguaaauauuaaaagcauuuucaauguacuuaggauaauccuuuuuuuuuuuauuuccuuucacuuauaacauuacuugcucaccccuaguucgugaacaauguuucugaaaaccaacagauucuaugucuaugugagucaacuuaaaaaaaaaaaaaaaucgacauucauucucuuuuugauacucacauuccuuaacuaagauaaauauguaaccucacuagaaaauuacagguuacuaacauucuuuuagcuugccauguguucaagauacuauuuacagaggaacgcaacagaaguaugcaacaaaagauugggaagcaguuacauaacaguuuaaggacccaucuucccugcccucugagcccucugaggcaaagcugccuggagcagucugcuauuccagggggaccucccuucuuccaccaccucuccuccacccaucagacuccugaaccauacauauaggagcauguuguccucugagaggcuccaccaagcagcugacucagacagauacagacauccacagccaaacaauggguagaguuugggaacucucagagccugaaccaccaaccaaagaacacacaccagcuaaaccuagaccuccccacacauauguaacaugcagcuuggucuucacauggguccugagcaauuggaacggggggggggggggcuaucccaaaagcugggauguguuguucuagcuaggcugccuugucuggcucagagggagaggauauacuuagccucacagagacuugaaguaccaggauacgggggauacccagaggggaccccacacacacauaccagcucagaggaaaagggagggaggggauggggaggaaugcccaggaggggagcagugagcaggauguaaaguaaguaaguaaaaaauaaaauuaaauuuaaagaaagaaagaaaacaaaacauagagcagugaccccagauucaggauagugauuaaucugagcagggaugggaagauugaaguuaggaaccuuuuucuuaagguacugagucauggcuguugaaagacuagacuguuacauuugugaauugcuuauauuauacuauuuauucaacauuuaagaaaauagguuuccauuucaacauuuauagcuugaaacauuauuuuuaaaacuguaaacauuuuuuaagcuaaucguuuuccucauuuaucaacaacaagcauaaaacugcuuugcucuuguuccauggagggacuggaugcugauuucaucaguguggucaaagccuggcccagaaagcaggaagcuaaccuuguauauguaagagacagagaggagccucuuuuuuccugugaagauaaugcaagagggaagcagggaacaggaggaggagugggucuuugaggcugacccacauucugaaaugcugaccucuuugagggcacugaagacuuugucugccuuaguagugaaaucuucaguuuggcuaaguuuacuuuuuguucauuacccuaauccauuauccacuuauaugaaauucccuguuaugcaaauugaguauuauaguuauuuucucuuuguuaauucauaaauuaaugauaagaacaacuauaaaauacaaacacuggggaguuggauacacacaaggaugagaaagaacaggaaggagggguguuccuuugcauucuuucucugccagcaugucagaguaaggcaccagugaaucucaggcauaugcuacuaucacuuuucugauauuuaaugaauguuuguugauuauuuaauuuacugacuuucuucaauuuugaaaaaaauuaguuuaagaaacauugcaacuacugauuuuagaaauacuugcaagcauuuacauacuaacauacagggccugguucuucugaguacuuugauaguaguuuaggacuuucuaguguguuacaggauuacuuuuaugaauuaaauaaucuuguaguuuuuccuuuauaucugagguaauuuuuucuaucaaagucuucauuucacugcauuucuuuucucacuguuaaguuauaagauuaauuuacauagugcaguggguaacuccuucagacaugacauuuuggcguuauacaugaagcucuccauuuuuguacuguggucauuuauucccugggcuuucuuuugcugcuccguuugucaccugaaugaucccuaugcugguuucauuuucuuacuuacacuauagacaggaucuguucugagaacugcacuguuuggcggaucauuuaaugugaccucuuaguacaaucaaaagagggaguuaaauaugagaucuguaaugcacaagacugaacugaagcaaagacugagcuaugacacuuuaauauuugaucuacugcuuccaauuuguauaugcuugucagccaugugcacuuguuaugguaggcaugugcagaggacagugugaugaauuaguccucuugcucaaaccucacuucauuaggcuucacagcaacucuuuacccacugaaccauuccuccugccuucucuacuacucuuuuuaaaaugcaaacuucaucuucguuuuuguauucuaauuuuauccuauuuaauuuagggcacauauucugcuauuucauucuuucggaauucucauuuuuggcaucuucuaacuaaugcuuauaaauguucaaauuagcacugaaaaaauugggggagugucaguuccucaugauuccaguucacuugccuguaauaucaaaaaagaaagauaaaagcuugcuguguuccugguaaaguccaccacugcuaaacaaccuuuauucuacauacauuaucuagucugugguauucagacaguaacaaaaaugaaauggacugagacaaucuucuuguaauuucaugaaaaguuccauauguagauucccauggguuaaggcuaggacauaugcuuucauuuuauaaggcaacugguugcucuggacuuggaaguaguguucguucuggaugagguacuucugacuguagauauguuaccccagagaagaggcucuaacacacuuuuguuuguuugcugugcacuauagcaaaagaucuagccacuaaaaaaagaacaauguuaaaguuuggggccuuuucuggagagguaggugccuaagggguagccaaacucuaagacuguaaugaacuuccucauaggcagaauauccacucguacaacuuucuucuuuaaauaaaaugcuucuuucuagacgguaucuuucagauuucuaagaugaaguuaggaauccuuuucugaguccugucuguugcuuuguauuuauuuuguucaguuaaaaaagggaaaugcuguaaauuugugucuccuuccaaauuuucuaccaaaauuaccuuauucucauuuugaaauuuucaugcaaucuuauauguuguacauuuacauuguuauagagaaaaccaaacuccuuuaaagaaaauuuaaagucugaugagaugacuuauaccuguaaucccaacauggggagacuaaggcaggagaacuucugagaguucaagguuagccugugcuacaaugugaaaucauaucuugacaggaaaaagaacagacuaaagaagaaaaagggcaaacagaaaagaauacucuuaaaaugcaaucugaagagaaaauuaacugcuuguaagguauauccuaagagccuaccaaaaauggcauaugcugauaagcauagccauauauucuaguaugugcaguuuacaugguauuuaguuaugcagcacucucgccuaucauuacacucuuccuucucaguccuaugagagacuaaguucuuugacuuaauccaugucaccaaaguaaauaaugucaaaauaaaagaaaaaaaaccaucuuuaagauccuuaauuuuccuggaaugaguaucaaaguguugcgcucuaguuuguccuccguuuaguagucacuaacgacacgagcuugaaaugaguucaauaccuguggagcaugacaucauccauucccaacaauggaugucaccagcagcuuaccuuauuagcucuagcugugcaaguuccugguuugcuugaaauauagguuuuuuagugaagaguucaccaaggauacaucuaauagagaaaaagagcaccauuauuaucuaaauuuucucauuuuaauucacuaacagaacuuuuuaguacucuaagaaaauguguccaucuuacccacagcuccauacaucaauggcugguguauaucguucuucucccaagagcaauucagguggacgauaccacaaaguaaugaccuuguuaguauaugggcgacuaagacacaaaaagaaaaaucauaggacucuuuaaaguuagcauuuacuauauuaagagauucucucaauacuacuuuggaaucccaaagacugaaccaccaaccaaagagcuagcaauggacuagaccuagucacccucacauauguagaugugcggcuuauucuucuuguggaucgaauaacugaagagggggugugucccugaaucuauugccugucuguggauccgguuccccuaacuuggcuuccuugcugggccucagaggaagaaaauacaccuaguccugagaggguuuccuccuucucagaaaagggggaagagcugggacuggagggggggggguagagugcaaauauugggauguaaagugaauaaauaaugaauggaaaaaauacuacuuuguauaaucaaagcaaucugaucauucuaauucugauuaccuaagguauuucacacaaucauacaaugcaugggcaagcagcaguaauucccugaacauaugaauauaaaaauaagcaguuagcuauuaacuguaauuuggucaaagagaagucacucaucaacucaauuuaaguaauguuuuuuccuuuccauaaaaacuuuaaaaauuaguaauucauaaaggaacaacugcagaaaaacaauguaguucaagcugagauuaccuaauccaaugacuuguuuuguuuugggucugaggaguggauugaagaaggcucgugugcuaggcaagugcuuuauaacaaaaguuugcuguuuguugaugagauagggucuugauauaaagaccaggcuagccuugaacucagagauccucuugccucuuuuccauguugcuaggaaucaaggugggugccaccacaguuggccccuagcaaaaguguuuaguuaggcauaucuuugauaauauuuaacacauuuggaugcacccugauuuguaaaaauaaaguagauguugacuauauaauaauuaucuguggucuagacuacacagaauuacaaguuacagguauggugcuucaucagaaaacuacaaagaaaauauauauaacuggagguuauguaaaucuagccaauuuauaauaacacuaagucugaccaugguccaguacaaauuucaguagcaaaguuguuuuuguuuuuuguuuuucaagacagaauuuuucuguguagcucuggccuggaacuugcucuguaaaccaggaugaccuugaacucaagagagccaucugcuucugucucccaaaugcugaggauuaaagacacugcccagcuucagcaaaguauuucuaaacauuagacaauagucacuuucuuuaugauucauaugaauaaagaugauccuaaaaaaucaggaccuaugguuuauagauuucagaguaacuacaucuuuagaucuuuauaaaccuuauucuuuuagcugucuuccgaauaacaaaggcagguagcaaguuccccaggaaagcuauucacucaccugagacuggaugaaucggauucauuuggggaggaaagaaaaaaaaaaaaaaaaugcccacaauuuaacccagcagcuuucucuuagcaaccacaggucuaaguuuccagaaagccuaggauguaucugaacugcucuguccuaaccuggccaaauuucucuaaauaauuugagcaccaauacucuuagguuaucaauuugggcaucauauuuccagaacccccccccccaaaaaagaaaaacuuccguugacacugaccacugaccacacugaaaguuaacaaaugagaguuuaaagcuuuuucguuugguuuaauuucaagcaaagccucacuauuccaucccuggcuguccugggauugcuuuguaguuagaguggccuugaguuuccagugacuuuucccaacuguggccccaagaacugaaaguuaggcauguaacacaucuggcuaaaaugucuaugaagcaaaugaaaauugaguauauuugacuuaguaaauuuuccuugcuuauuuccugguaucacuuaucuucauauaguuaaaguguuucaauuuuucuuaacuauauacuauuauuucauacacagcaaaagagcucccaacauaaagucuagucuccacuuucaauaauuaaucuugacuugcuuccacugucuuauuaaaacucucuuuacuucagucaaaagucaaaacauucuuuaacaugaacccaaacauaaagccagcacuuaaauguaacauaaggugacaugugagucuucuggguaggggaagaaagccuggaaaacaugcgagaacuagcuuuucaauuguucaaagggucuaugagcacuuuaagccuaugcuguaagacugaggcuagauuaacuauacucucaaagaaauauuuaaauuaauacaaaucuauaauuuuuaaauuuagaaaauaaaguauaaagaaacuacaaauauuuaagugaugaaauuuauuuaagagaaaaguuuaaacaaaagauuaguuuacaugacauauauuaaauuuuauguaacuuauuacauggucauuuuuagcuuuaaguuugguuagccaccuuuaucaaauuuagaauagucaacuugcaagaugauuaaacacaaaacugcacaaaauguaguuguaaauguaucacaaauuauuuaucaguuaauuguuuucuaaguauuucuaaaauguuaguuuuugccagauauuuuuguuuggugguguauuucaaugugucucuucuauaggcucuuaggaggucagagcuuggagagguugauuugguuauggugguuccuaucuagauucauguaaaggaagcaagauuuaaaauacuuaaauuucucaaacaaaacauaauaaaaucuucagugauuucuuucauacuauaauuuguaguauuuuuuugagauaagaaagaaaaccguaagguugugacaaaugccgaucauucuguuaacaccuaccuagcugcugcaggaaaacaauccagggccuuucuuugcucuuauggguggggaaugagcauggucuccccagguaucccacaggaagcccacagguaggccucaaaguuccuaagcgcuaagaugacagguaguaugccaucguaucuacccaaagaucaagaaagucaucuuaaaugcaacacuuuuacaauuucaacagcaacaaccaaagagugagcugugaugcaggaggaaggagaaaacaccaugggcaguuaagugagccauaaaaacguggccccgagggcuggucaguuggaguuaagagcagcccagauaaaacuuaguaaauaauaacucagguauacggauaggaaaguagauucuaaaagcccagcucuugugcuguuuaaggcuuauuauaaauauaaaggauguguguguguguguguguguguguguguguguguguguguguguuuguguguguuuuauacgggaacugaaugaucuaaggcaggcuaaaaacuccaggucaggauuaaauaauuucuacagcagagcugcuauuauugcugcuuacauacuuaucucaacaguauaguuauugguuuucucaccucuaaagugccuuugccucauccaucuuuuaaaaaacauuuuguuucaaaaagaaaaccagaucacgucccacugcaaauaaauaaaacuuaacucagccuuacaauaagcuuguauacugaggaucuuauuccugugacccuacuauagaauuucagacuuugaaaaaugccagggugcuuaccaucaacuaaucuucuccuacuguaaaauucuuugucugggucuucauuacauuuucuuucuucaccuucaaaucuuaguuccaauuuacuucuucaaagauggcuauccuaacuguccuaucaaaaauuccucuguugaaaacugcuuucaaacaguguugcaguagugagaacagcauccucuaguacuuuggucauuucuucuagagcagcugcccaacuaaauaccguaccauccucacugcagugagguguggccauguggccaagugcuugcuacuggcuuuucuaggcaugucuccuaauuccaccccuccuauuucuggccaacagccuuggaaggcuuaugcaagugaucacagguuccaaccaaguugccugcaugauuacaugacagucgccauuugaacugaugcuacgguuaaguauuaaugguacaaugagguaaggaaccaucaguuaauaugauuaagugagagaucauaguacuuuaagucauuacuaaauuucuuucaauaguuuugcaucuccuaacuguaaauguauucaguuacuugaccagaaguaguaauggagacaagaguuuucauaacagguaaugguuucuaacuauucuccaguagagaccauugugaaauaauucaccucuuucuuauaaauagucuauuguccuauucuagccacaauaauuuuuaucaaaauuuagugcaauagcuuuuuaaucaaaaguucuuguuuccagauuuucaagauuaacucauuuuucaaaacacagccaaaaugaguuuuaaaacauauuguuuccagugacuguuugcacaagacccauaaaauguuuuuacuaccaaccacacugaaaucuucccuaagauggcugagcaaauguauauuuucuagagcagggagucagaaaccaaguccggggaggugagggcaggagaggguguuggagggagcaagaauccuuugagaaaguuaauggucuuauuaauguucuaaacaaacucuaaaaaaguaaauugauggagcauuccugaaaucacagcacucgguaugcugagaaacagggggauuuucaguucaaguccagccugggucauuauacuuaacucccuaacaacaauuaaaaaaaaaaaaaaaaaguugguguucuaguucugcuccucccaaaaggauacuaugccacauuuuccauuuuacuauuuaaugagaaaaaaagcaaacacugagaaaguaugcaaacagaaggacuuuaaucauaaaaacaaaauucaacauaaauaaaaaagcuaggagaguagugaagcccauucacaaaccacaccacccaacagcaguuauauaguauuacacgaaacacuccauguuaugauuagguucauauauuuacaaugguaaagaucaaaauaaaugaaauguaaauuauguuucaaaguaaaaagaauuuaaaucccaagaaauucaaaaguauuguugcauuaugaagagauaauccaaaugcagaaauuauuggaaauccggaauccuaaaaaauugccuuucaaacuuccagaucugguuacagauucccaacauccuagagaucuuauuuacaccauacaaagaauuaggaaguucuaugauaacauaacuuuuuucuucauggauauagcacugaaaaaaguuucaacuuauuuacacaaucaaaguucuaagcaauuucaucaaaggcgucacacagauaaaaacuuccuguuauuaaauuaaaacaguaaguccaaugagcucuuauuagcagauggcaaaacuaaacuuuauacauacuugagaaauaaaagggucuaaaagccagcaaguuccaauuuugcuauuauuaaguaaaccacugaugacuuuggguuugauuuauaaaccuaaaacuaacuagaaauccaaaccaguaccuugagcauacuggguaaguacuuuuauuaauuuuugaaaaggcagcugacauuaucauauugaaaagugggacagaaacaacaacaagcuuuuuuuuaaaaagcccuuaauguaauuaugucaauuuuuuucauuuuugguguccuaguuuaguauuaaacacuaccuaaauacaauagaaucaaaugugauuauggaaaaaagugaaaaaauauaauuuguuaaucuacuucuagaaaacuauaguuaaaacauauauucugacuggagaggugggaggacaaagccaguuaaauucaacaaaucuggggcugaagaugucucaggaguuaagagcacuggcagcucuucagagaacccagguccaacuuccagcacccacauggcagcucaaaaccaucuauaacuccaauuccaggguauucaacacucucuucuaaccaccuuggguacugcacauacacauggugcauauacauacaugcagacaaaacacuaaguaaguucaggaaacccuuugcuauaaaacaacuacaaaaaaaauguuguuuaccuaaugguaccauuuaaagaaaccuggugaagccccuagugcucgcuaccugaaaaagauacuucacaagaucaagguaugauccaaggacuuagcuagaaagcacuacagaaaacaguguuucugucaauaaauccagaucuacuuccuaacucuauuggguacugguggugugaacaaacaaaaagccauguauuuuaacuuguaaccaucucagaggacuuucacuucaaguaauuuuuuggguacuggugaugugaacaaacaaaaaaccauguauuuuaacuuguaaccaucucagaggacuuucacuucaaguaauuuuuuucuggcauaauuaacaaggcaaguaacauggcuuaauuuaagauaugcacagcacuuuaguggagaugugcaacaaacacauaugcuuuagauaacaugaaaaagaauuagauuuguaguaggggaaaugugggugguagguuccaggaggguacacaggacacugcuagaaaauuuaguugccuuucuuacuuuacauaaucaaaacagaauacaugaggauagaaagaacugcaauuucauucugauuuuccgauuaagucaucgaucugaguaagacuggcacuguaaauacuguugaaggguacuguuuccuguuauguguaucacucuguaguauuuucuugucuuaaggucuccagccucccaaaagaucuucagcuuuaccuggaaccccaaaguucccugcuauacauuaggaccauucugcacgucaggguccccuuuucucaaaaccacauuugauauuuuaaagcauaaaaaacaaaaguuuccaucucuaaaaucacaucaauucaagauuuaagaacaauugagccauaaugcugaauaauuucuccaaguaccuggacaaauggcaagauuggaacagccacuagguggcaccauuucuuuuaacauguucugcuugggaagggagggguguuagcaaaaguucuaaaaacccuuuucucccucuccccuuugaugggaucagagaaaugcagcagacuuugguuaccauuuaaggaaguuuucucuugauaauggcaacuuuuagaagcauuaauagauauuuguguuuguucauuaguuugaguacuuuguaagucacaacuuaaagcauuuuguuuuugguaguucuguggguugagcugacaaucucaagcacaccacauagggguucuacuacugagcaacacuucaagcccaguauaugaaacugugaagucuuguuauuuuuuugagggugugauaguuuggcuugugugucuauauguguuccaugugcaugccuaaugcccauggaggccagaaccagaagacagcauucgauacccugaaacuggaguuccagauaguagugaggugucacaugguugcuagaaaccaaaccuaggcccucugcaagugaaccaucuccuccacgagcaacuuuggagauauuaaauccaucaucauaacauagagucaugaaauuaguuaacuagcuuaaccaauauuucacagcuaccccaguacaguggcugagguaccaucaggaggccuauacaagaacaagcuaaacuacaaagcauguuugaggcccaccugggcuauacagugagaccuuaucucaagaaacaggauuuuacaacugauuaaaggguaaugaaaagacaacaaacaaaagucucucaauuuaggacuauuuuauuucuucaaacuuaaaacaguaauaauaaaugugauaauauuuucucuagaaaaagcaguaaauuaaaacuuuugugcaaaauacuuuuuguccuauaggaaaguggauuucuccaguaaauuuuaaaaacacuuuuuaaaaaugcaaaugggguggggaggcaguaucuaaaggaacaacucucucaaagaugguauguuugcuuauaaaacaagggauacaaaauuuuucucauuaauuugacugcccccaaaaaagaauuuacuaugcauaacuuuaagaaucaaaauuacagggcuguaaauuucucuagccugaaaauuccuacaucaauccaccacaacagagaucaugucagugaacugccacauuuuugauauauauuauguauguauguguguguguguguguguguguauauauauacacacacacauacacacuacauguaugcaacauauauacuacauauauauauuuagugccaaagagagauaucauauauguauguauauacuauacaauaauuuuguuugggacaucuauuccaaaugcauggggcuaucuucaauaaguaaccuauuagcuguaaaagguuaauaaauuagaaugaaacauaagaaaguaagaagaauagaaguaaaacacucaagcaugauaguuaaguuacauuaaggacaauaaaacuagggugaaaugucaagagauuaugaaaauagaaucaauuaauuaaccaaaauuccucccaaauagccagauuaguuaaaaccuuuaaaaauuauuauucaaguaaaauuuuagacuaaguaacauuaagaccauuuucuucacaaauucuaccaaaagauacauuacuauaugguagaaauauuuaaaaauuuaggaccaaguacagagguauacauauuuaauuucaacacuugggagguagaaguaguugggucucugaguucaaggccagcuuggguuauauugugagacucuuauuuuauacaaguaaaagaauuuaaaagcugaacuuuauagcuccuugacccugucaacauauacguuaaagucauucaguccuucacaguaacaaagacacaacugaauguguccaacaacagaagaauugaugaggggcuggagagauggcucagcgguuaagagcauugaccacucuuuccgcaggucccaaguucaaaucccagcaaccacaugguggcucacaaccaucuguaaugagaucugauacccucuucuggagugucugaagacaguuauauuguacuuacauauaauaauaaauaaauaaaucuuuuuaaaaagaagaagaagaauugaugaagaaaguaugguauauaugcacauuagaauaacaugaauuuguguagacagagagguggaaggaucugggagagggggaguguuuuaaagaauaugaccaaaauacaguauaugagcaaaauucuaauaaaauauuuuauaaaaaauaauacaugcuuuguuguuacacacuguaacaacaugaugagccugaaggacauuaagguaaauaaaccaggcacauaagacauaggucacauuaucucauuuuuguguguguguguguguguguguguguguguauauauauauauauauauauauauauauauaguguguguguauauauauauauauauauauaguguguguguauauauauauauauauauauauaguguguguguauauauauauauauauauauauauauauauaguguguguguguauauauauauauauauauauauauauaguguguguguguguguguguguguguguguguguauaaaagcuaaaaaaguucaauucaaaaaaguaaagucaagaaugguuaauugcuaagaguuguguguugaagacagaguuguucaaaaaauauaaaaucuuuaguuagaugagaggacuaaguucaagauauuuagcaaucaacuugauaaaccuaauaacaauucagugucuucuugaaaauuaacagaucuuaauuguucuaaccaccaauaaaaaaaaaacugagauaagacacuggcuaauccuccugcauuagccauucuacaauguuauucaaaguucaaagcaauguaacuugauauaccaauuauaaauaauuuucuaaaagcuuauuacuuaauucacaaaauaauuuugauuaaacaaauacauaaauaaaagcuacaaucagcuauacuaaauuuauuaaaucaaauaaaucaaucccauagcuuauuuacauaaaaucauuauuucaacaaaauauuuuauuuugaaagucuguauuaauucuacaagaaucuuauuccuuuacaaccagacauaaagggagccaaucagauauacaaccccaaguuuagccagagaagcuccaucugucucuaucucauacacugaacuuccuucacaauugcuuguuuaaauaguucuagugaguuuggaaaaaacauacuacuguaaauagauauaaguaaaacaaaaaaggugaagucuaaaauuaagaaaaacaaauguuuagaauuuaaauguacuauuuauaaaguauauaccaaacuuuauuauuaaauacacaaauaaaauccuuaaugucuugaucuguauuaaaaauguauuaauuuuuaaaauuuaaaguuuauugcacucauauuaggagucauacauuuuaauagaaauuuuaauuuauccaccauuuaaaaauuaaauuuauuuaaaaacugaaaacaaaacuguaagauuaagacagccaaacuagguuuuuguuuuuguuuuaauuuucauuauuauuuaggaaacaaaaauguuaaauaaaaagaaaaaaaaucagggcuggagagauagcucaccaguuagaacacuuguugcuuuuucagacagccuagguucaguucccagcacccacaugguaguucacaucuuuuuguaacuccagucucaguggauccaaaggcccucuuccgacuccacagauacaagacaugcauauggugaacauacaaacacauagccaaaggcucauacacauaaaauuuuuaaaaauuaauauucuaaauauagcuuuuaaaacugaacuuacugcuuaaaauuauuuguuucaaggagcucuuaccuuucuucugagcuauauaaacgagcaaguccaaaaucugcaaguuuuaucuguccucuggcaggaauaagacaaaauaaaaaagcauuagcuuaccaugauuuugauaauauauacuuaauauucuauuccagggcucaaugaaaacacauuagaaacaaaaaaaacaaaaaacaaaaacaaacaaacaaacaaaaaaaaccacauaaauucucucauugcacugcuauacuucaggcaaggauaacuaaugggaaaauguacaaccuaacaacuaguguuuugcuuuggauaguuucuuguuauuguuguuauggguccauucaaucauacauaucuacauguucuuaauuuucugauucaguuggauauagaucaaaacuacuggagggacuauauuguacucaagucauguguguuaauauuuccuaccuaauacuguaccaacuauuuauacaacauuuacauuuuaaauaagcuacacaaauacuaucuuauuuuauaaagagccuuauaucccucgguacuauuaaaaagaugcaguagugagguuagucuaaagcaacccuccaacagggcccaacacacuuaaugguguuaguguaacaguaucucauguccccuucaguuccuacuuaggaaaguaccucaaaugacauuuaggucuagaaguacguauucaaauagugcccaagaacuaaaucacauuauuugaaauuuauguuuaauuuucuagcucuuaaaagguuagggugcacaaauuauuuucuacuauuuaaaaccaggugaugcauguuuuauucaaauuuuaaaaauaauacuaaguacgagaauaauacuagaaguaugcuguuucugaagauauuuaccauaaaccuuauauauacauauuuuaaaaauacauguaaaaaaaaucuaauguuuggagauggggauaaggacaaagaaauaacucagaagcagaaugauggcugcucuuuuagaaaaccagggucccauucccagaacccauuugguagcuaacacacgucuguaacuccaguuccaauguaucuacacccacuucgagcuuccacagacacuguagacaguguacauagacacacaugcaagcaaacacccacucauuacaaauaauuuuuuaaauuaauuuuguuuuguaaaaucuguacaaaaaccuaaagcugaaaucauauuauucaugauuaaauugauucacuucaaauuaucuggaagaauaccaaacaaaaaggacauauguacauugcaaaccauuauuggagcuacuggagaacaacuguggaggcaauagucacuggcugcuguuccuuacccaagaaauuagaauaaaccuaauuuauaggaaguuauacauuauauuaacacuuuaaaaacauaaauuucauauccauaccuauuauuuagaaggauauuugaacauuuaauaucucuaugcaaaaaguucuucuuaugacaauaauccaggccuuccaugagcugucucauaaaagauuuuauaugguuuucauuaaaaugaaccaagccugauuccagcagucccaucagaucaugguccauauauucaaacaccagguaaaaugcaccugagaaugagaauaauuaacauauuaaaggcuuuaauucuauaaucuaucuggagguucaaaugacuuugauaaaauacugguaaaauggaauugacccuugaaaauaacuacuuugucauuuauuuguaagauucguuuacccucucagaacuuaguaucaaaaaagaugucucaagaaaucaguaaaagcaguuuucuucugagagccauugaaacagaucaccucuguuaacuuccacauuauucaguuuuugaucugauuacauucuucccuauaucugacaaauuguuuuucaaaaaaaaauuugaauaaaauuuguaugguccaaagaguauuaauaaguuguacaaagaacugcuuuuaauauaagaauauaagcccaaauagaccaaagucaucuuaggugauuuauauuaguuuuguuuauauaagacuauauuugaaagcauaaaaauuacaacuuuauacaguguuuaaaaaucuuaaauaaaacuuacacaaauugaauccaaagcuaaauaaacaaacauuacaaucaagcaaagcuuuacagagugaguucuaggaaagccauaucuacaaagaagcccugucuugaaaaaccaaaacagaaaaagaaaaaacuaacaaaagccaugucaucaucugugaaaagagaaaaaccaguauuaugccaaagaagacacucaacacaauucacaaucagcuccuaacuuuaaacagagcaaagaacuuucaaaauugauacaauaaaagaaugccuucuaaacauuuauuauaguaccucucugagacaagaaccacgcauauuuacaagaaaaugcuacacagugaaaaaaaaucuucaugguuauuaacuuuauguagauguuaauauguaaaauuuaagaagcuucagagccaguaagaaaaccuaucucaggaaaaaugacuugaagagagcagauagccauccuccuccuucagccuccuccacauaagcacucaugcucaccaaaaaaaaaaaaaaaaagggggggggguaauaauacugcagaaacagaaaaacacaaaugacaagaacuaaauuguaacaagaauuaaacaucaaaacagaaaauacuauaauguaauuucaauuuaaaaaaaaaaaaaaccuaguggcuagcuuuuauuacuuugccugagaagcgggcauuuaacugacaaaguaaccaccacauucaccuugaagacacugcauuugaccaucauccaaacacugcugaaaauacacuuugcccuauaagaaauuaauguacccugucauacuuagauaaagacacaacagugaaagaaaauacacaccagaaaacaaauuacaaauguuuacccauuaauuauggaaauguucauuuuaaguuuaaauaaauuauaaaguaacagaaaaaucucauuuagauaaaauuauaauccacggggagaugagcaguaccaucacagagaaaccaauaaaaauguaacuaacagauuccacuaaauagugacucaggaauaucacuagaaaacaauaugaacagggaaaagacaacugggaaauacuguccacaauauaaaaaaguaagcauccuuaauauaaaagaaagccuuauaaaccaguacaaaagaaauuuaucccauagcacaagaugagaaagaaaaaggauguuagaugacaagauggugugugcagcaaccuucauacuuuaaaggacaaggaccaggaguucaaagucauccgcaguucuguaucagguucaauggagccuccaauaucaaaaaagucuguguuuaaaacaacauuaaagaugcucaaucucauuacaacuccaaauguucacuauggcauuuaaacaaaaagauuucaagagagcauauaauauuaacacagguguauagggagaaacauaguauaaauauuuacaaguuauguuucauuuccaauugcacaacccacagaguuagccaggagcucauagauagcuacugagcacuugugguuuagucaaaaaauguuuuaaguaugcaccagauuuccaauacucaauauaaaacaaaaauaaauaugucaguuaguaauacaguacacugaguuaguaauacaguacacugaguuaguaauacaguacacugaguuagguauuaaguacagaggaaugaagcacagacagacaaaucucaaaugcaaggccaaacugguuauuacacagcaagacuuugucucagauauauaauacuacuaauaauaaaugguaagaauggauaauugccaggcaguggugaugcacgccuuuaaucccagcacuugggagacagaggcaggcaaauuucuaaguucgaggaaaaccagggcuacacagagaaacccugucucgaagaaaaaaaaaaaaaaguuaagaaauaaggaaggaagggagggagggagggagggagggagggagggagggagggagggagggagggagggagggaagaauaggcuagagagagcugaaugauuaagaguccuuguugcucuuguagaacugaguucaauucccagcacucauaucaaguggcuuauaauugccuguaauuacagcucuaggggauacauccucuucuggcuuccaugaacauccacauacacacaugugcagagacacacaaauuuagaaacaaaaucuuuaauaauuuaugauaaauugacuguacauugaaaucaauguacuacacaccgaguuacaaguuauuaaaauugaauaauuucaucuguuccauucuguaacauaauuauuagaugacauuuuaauuugaaauagaaagcuuacuucuaucaaguaacuaugacugagaggccuaggaacugaaauaagacaagaugauauuccauucuugaaaaccauuaaguucaaugaaagauuauuagaaagaguuaaaaaauguggaaaaauaguguaacauacaauacucauugauauuggcaaccaguuaaaagauaaaauagaacccauuaauaauagcuauuuaaauugaaaggaauuuuuuuugaaaauucccuuuuaaugcagaaaacacacauauacaaaaaaaagggcacaguucaaaaauaccaaucuucccaaauuaauuuguaaauuaugcaaaagcccaauuucuaaaacuuaucagugugguucuguaaaugcuaaaauggccuccuaggccuaugugcuggaacacuugaugccaaguuaacagcacuguuuaggaaaguuauggaaucuuuaagagguagaaucuuguaaguacaucaacaagggcaggcucugagguuucuagacugcuuucacuucugcuucccucucguugccuccaguguaaggaugaaaugugaccauccugcuuccucucugaccugccacaccauccccacccugccgucacauucccucacaacuguaagccacaauaaucguuuucccccuugguuuauauccagauauuuuauaacagcaaaagcaacaaguacaaucagugaaagaguuuucucuacagcguauaucauacaggaaaauaacuaagaacaaaaacaucugaaagaaaaaaagguauauagaaagaaugguucuacauuccuauuuuaaaauuuuuaaauuauaauguaaauuauuuuuguaaaggcuggagauauggcucauagagguccugaguucaauucccagcaaccacaggguggcucacaaccaucuguaaugggauccaaugcccuuuucuggcgugucugacaacagcgacaguguacucauacacauaaaauaaguaauucuuaaaaaaauauaccaaguccacacuaaacuuguacuguagaauagacugugaugcugggagauagcuuaggugauaggcaagcaugagggccugacuccagauccccagcucauaugugcaaggcacagcggcacugacuuuaaugccaguguugggaagcacgagagaggccgaucccuauuggccaaccacacuagcugacaaugaaugagagauccugucucaaacacuaaaguagagagcaauuuaagaagacaccugauagugacuuuuggcuuucacacacacuuagcauccccaauaaacagguaccuacaucauacauacacccaccuacgccccccagccccccagucucaaaaaagagacaggagggaaauaaagggacagaacacaaaaagguauuucacucaguuagauggucuucucaguaaguggugguaggaugacugaacaccuacccagacauagcaagaugaaaaguauccuaagaauggccaccaacauaaaaaacaaauauaucaauuauagaacuaagaaguaaaaacagaacuauuuguugaaaauaauucccuacagugagaaugggggaaaacaccccucaacagcagucaacagcacaaaacaguaguaagacaaauaaaugugacuauuucuaaguuagagaaauaggcagauaaauuuucaucacuagaaguccugugccaaaaugcucaugaaaacaauguauauuugccucuaauaaaaucaguaaagaguaaacaauaagcccagaacagugguucucagcccaugggucaccaccccuuuagaaguugaacagcccuuucauaggggucaccuaagacuaccugaaaaaaaaaacagauuauuuaccucaugauucauaacuguagcaaaauuuccaaggaaagaaucacugaguacaaagauguuugaauagacauguucggaagugaaugcguauggugggaugggauaggggaauacaaaaaaagcagaacauccaagggccauaaaacaaucacaaauguuaacauucuuucaaggcuuuaaaagaagaaaagagaaagagacagaagaaauauuugaugcaauaaugagugaaaaguucuccccucaacaguuacuacagaagauuugaagggaaggaagggaagggagaaaugauauaauaucacagagaaaagacaaaagauugguguauacaaagagggagggggagauuuucuuccagacugcuucaagacccaacaaacuccuaucagaaacguuuuuucuuaacuuaguuuugacauguuuucaauagccccauagcacuucccaguaauguauguuggcauucauuauuccuauuaaaaaauugcuuguauuguuuauuauaagcaguauuauaaaaauaaucucguaauucuggaaaauccaaauuaaaacaguaaauuaaaaaggacauuuuacuuaaaauaaaacauuuauuauguucaaaguaucauaucaugucaucagaauucauaacuuaccuuuauaccucuuucccacuuugcaagcaacaucuugcugagacaucuuggcagcuuguuuuuuauuuuuauugacaauguuuaguucuaauaauuagagacuucuaugcauccagaaaggcuauauuuuguugguggcagcggguauguauacaugagaccagauacugguguauuucucaacuacucucuuauaacuuuacacaggagcuuucacugaaccugaagcgccccauuucaaauagcuuggcgggcuggccaacaagcucauauacuggguuauuguuuagcaaagaacucaagucuaaauacaccuaugugaaaagcccuaugcugggauuauaggcacgcauggauuuacaagggugcugggaauuaaaacuuaaguguucaugguugcaaagcaaguauuacccaaugagccacuuccccagcccccaaagguauauuuuuaaaaguuaacuucugauuuucauaauuaugucugaucuccauacuguucuuguacuacagauuaaaacuauucacuucuucaaucucuacccuucccuccuaauaaaaaauaauugcuucuacuagcgauuucauuuuguucuuaucaaccuaccacuaaaauuuacauauauauauguauauauguuuguguguauguguguguguguauguauauauauauauauauauauuguguguguguguguguguguuacuaucuuagaaguccuucacauuaaaagaccacaauaaacuuaauuauuacuuucuuuuuccagaagaggaaaacagaguacaaggggaagaaaauacuuuuuuuguaaauuauuaauaacaaaacuccccaucuuaaucauuuuuagguauacaguucaaagauaauuacauucacacaguggcacaaacaccagcaccacucaccucuguaacucuucccaucuuugcacaauuagacuucucugacuggcaaguaugcaauaaaagccucccacccuucuaagcuccacagccaccacuuucuuugucucagugcauuuaaccauccuggucaaagagugagugagugagugagugagugagugagugagugagugagugagugaguguguguguguguguguguguguguguguguguguaugaauaaaaucucuaugcugaauuuguucuguuucauaaagcauccuaauggguaugagcuagcauaguacuauggcuugaguuauacuucccaaauagcuaucauguggaaguguuuuugguuuuuuguuuuguuuuuguccaugugauuuuuggcuauuuacccgucuucuuggaaagaaaaucuacuuagguccuuuuaaucagccuaucuuuuuuucuuucaagacaggguuucucuguauagcccuggcugucccggaacucacucuguagaccaggcuggccucaaacucagaaaucugccugccucugccucccgagugcuggaauuuaaaagcgugcgucaccaugcaauuuacugaaguuuucuguacuauuguuuuccuucacugugugugcugcugaugucaucuaacaacacuuaccauuucagucuaacccaaauacuagagucaacugauuuaugaguauaaaaucuuuuauaaucauuaauuaacuucuaaugguagugccagacaguuacggucacuuuaacccugcaguaaagauuuaaauuuaaugcauucaccuuucuucuuucuucucagauccuacugacuguaauacuaaaaaaucuggaauuuugguuucuuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaaaaaaaugaaaaaaagggaaaaaaaaaaaaaaaaaaaaaccacagccgggcgugguggcgaacgccuuuaaucccagcauaacaccaugugagucagggugggugagaaagagagagauugauugagagagagagagagagagagagaguguguguuauuguuagaaguacagacauggaguaucacauuuaaugaguugaagccaucaaaguuuacuggccuauuugugagccccaaagacuaaaguaacugaagcuuagcucauaauaaaaaccagcaaacuugggauuagagaaguaagcagggaggugacccgacaggugaaaacaggagacuuuggcauguuagagcaaauauacuaaucugucuacaaagugguaugaaggcaaaacaaauuacacuguacucuacuucaugucuaagguccuuagcccaauuuuacuaaauagugagugagagagagagagagagagagacguacauccccuuuuaagaaugagaaggaacagguucagaagagauaaaagacuuacuaauaaggucacgauguucaguaagucauuacuaagucucaaaucugaaacauuuuaacuaaugucaaacaguaaguacuuucuuuucaauuauguacucagaagcaauaaaguaagguaagauggcaaaccaugucaaaugcuaagguaauauggguuuccaaauuucugggauaauauucacuuaucagugagugcauaucauguguguucuuuuguugauuggguuaacucacucaggaugaugcccuccagguccauccauuugccuaagaauuucauaaacucauuguuuuuaauagcugaguaguacuccauuguguaaauguaccacauuuucuguauccauucuucuguugagagacaucuggguucuuuccagcuucuggcuauuauaaauaaggcugcuaugaacauaguggagcauguguccuuauuacaaguuggaacaucuucuggguauaugcccaggagagguauugcuggaucuuccgguaguacuauguccaguuuucugaggaaccaccagacugauuuccagagugguuguacaagcuugcaaucccaccacauccucgccagcaucugcugucaccugaauuuuugaucuuagccaaucugacuggugugagguagaaucucaggguuguuuugauuugcauuucccuggauuaaagauguugaacauuuuuucaggugcuucucagcccuucgguauuccucagcugagaauucuuuguuuagcucuguaccccauuuuuuaauaggguuauuugauuuucuagaguccagcuucuugaguucuuuguauauacaagauacaauuugcaaaacacaucaaacucaaaaagaaggaagaccaaagugugaauacuucguuccuuuuuagaauggggaacaaaauacccaugaauggaauuacagagacaaaguucggagcacagccugaaggaaugaccauccagagacugcccaacuuggggauccaccccauaaacaaccaccaaacccugacacuaggcagaugccaacaagagccugcugacaggagccugauauagcugucuccugagaggcucugccagugccuggcaaauacugaaguggaugcucacagaucauccauuggacagagcacaaggucuccaauaaaggagucagagaaauacccagggagcugaaggggacugaagccccacagaaggaacaucaauauccacuaaccaguacccucagagcuccuuggaacuauaccaccaaucaaagaaaaaauaugguggaaguuguggcucuagcuauauuuguaguagaggauggccuaguuggucaucaaugggaagagaggcccuugguucugugaaggcucuaugcuccaguauaagggaaugccaggaccaggaagugggagugguuggguugggguguagggggaggggggaggggauaggggauuuucggaggggaaacuaagaaaggggauaacauucgaaauguaaauaaagaaaauaucuaauaaaaaauaaauaaaaacacccgcacaaaaaaaaaaaaaagaaagaaacauggguuuuacaaauaugugagaaagaacaggaugauuuacacaacauaauuacuguaugaucuaucaauuauuuaaaacuguacaucccagaagaguaagauuguaugugugcagccuguaaagaggcuaaguaucauuuucaauuguaaacuaugaugauugauuuuuguggucaaacugugauguagcagaguugcacaggaaagagaaaaucuucaauuaagaacaugaccaaaugguauuccuauaggaaugcauguggagcauggucuuuauuucugacagauguugaugggcccagcccacugugacaguuccaucucuaggcaggugguccugggcuguaugagauaacuacuuauacaugaacuagcaagagagucagcaagcaacauuccuccacuguucguauuaugaguuucugcuuaaguuccugcccuaacuucccuuaguagauauagucugaggaaaauguaaaaaaauaaacuccucaauuucuaagaugcuuuuuuggccagaguauuuuagcacaacagcagcagcagcaacagcaacaacaacaaagagacauuccaacucacucuauuuuauauuggacuuaaugugugcccuaaggcagcuauuuuuaaacaaaaguugaacuuuucuuagcaguauauuuuuuaauuaaaagcaaccacuauaucagccuguauuugaaaaacuauuucaaaaauguugcuuuuauauuuuaagaaauguggugcaugccugucaaaaggugucaguggaaggcugaggugaugguucacaaaguaagcaugagaaagaauuuaagcucaaagccacagaacacauaauaaaaacugcaaauggccacaugcaucuguaaccccagcucuauggaaagggagacaggaaggucaguagggcuugcugacaggcucagugauaaauccuguucucaggggaauaaaguagacagugauugaacaggacagucaauaucuccucuggccucagcucaugugcacaggcauguauaucacacacacacacauacgcacacaaaugccccccccacaucuuuuuaaauuaguuucugugaauucauagcauuuauaauguaaaaauguaguguaaguauauuuuaaucuuuucucaauuaguaaaacauacaaagaucacacacacacacacacucacacacacacgguuucaaagcucaaagaaagccaauguuacuacucaguaccugggcucuaacacugguaacuacaucugacuucucugacucaugaaccucaagaaccacuaacguaaauauguacuucuuuaacucuacuaaauuuuaaaacagguugacauuagaaaacauuuuaucuacccaguccuuaaauaauuauccaguuggaaauaacaugaauucaaagacuugguuaggaagucugcauacauaccuuugucuuucuuaaaauccaaagcaucuucuuuaucagucacgauuuccuucauauugaugauacucuggugggugaguugccgaagaauuuuaauuucucuaauugcuguaauugggaaacccuccuuuucauuauccagacguacuuucuuuaaggcuaccauuucuccuauuagacaguuaaauaaaaucaaguuacuagcuaucaaaagacaaugccauuuuucauaauuuuaacauuuuuaucauuucuguuccuaccuuuuaaaauuauaauucacaaguuauuuucauguccaacauacuagauaauauuuauaauuuaaaaaguaaccucaaguaaauuuuggagcauuucacugcauuuaacaccauacaguuggcuaggaugagguagguauguauucacuguuucacacggcccauuaaucagaaaagagggaagguaaagugugaucuuauuaucaucuucucuguguaaaggaggaaaggaucaauauauccaggguauuaaaauuuagguaugugugaguuuuguaucagacagaauguaauuaaucagacauauaaacaaacacaaaguuauuacacguuaagcguagguccagaugguuuagauuuuggagguugggggggggguuguuuugugggaauauguauagccuuaguaggcuaagcaucagucaguauaagaaaaaguuucauaaaggcauauucauuccacuucuuuggaaguaaaguaaaaaagacugauguuaaaaauuuucuaagaaaaaaauuuaucuucuuaagcauuaaaauucuuuuuaaaaauuuuucacuauuuuccuauauauaauguaauauauuaaagcuucugaaaguuauaauuuaauauuauuaauaauacauuauaaauaucaaugguuacgguauguucuaauugccuauauuuguuucuaacaauaaggugguuaaacuaaauggccucaaacaacugucaauuuuaaucuuaguuuaugcuaaaaagacaguguaaguucugccacgcaguaguggugaaugccuuuaaucccaacacucagaagggagaggcaggcagcagaucuaugaguuucaggccagucuuggcuacacagagaaauacugucucaagguaaguaggagggagaggcgggaagcuaguuuuaugcacuauuuaguuaaauaccuaucuucuccuguaauaugacuucuaacacaacugcuuuucuggaggagguauuucaaaacuuucccccauguucuuaauuauaagaaaaaguaaugaaaaaguauugcagaguuuuguccaaaggguaaacuucuauacaugggaaaaaguuagucaaaagaaaauuuuaugugacuuaauacaaaauaacuucacuccuaaaaacaagcauggugacacaagccuguaucaccagcccucaagaagguaaagcaggagagucacaaauuucacagcagccugggcuacauauauacauaccuugccucaaaaagaaaaauuaaacuacuaauauuuuagccuaaguagcaacaguuuuaauaaucauuucaccacaaaaggaacacauuccccuaaauccugccauauaacauauaacauaucacaaauacuaaauccugccauauaacauaucacaaauacugaaagaaaguuuuuaaguuuguuauguggccacauguacugauaugaggacacagaaaaugaacauacaggauaaaaauuaagacuaagcaacagcacaaagaauuuuuacuucuuuuggaaauucuuaaagcucuacauuagaggaaaaaacagaaaguaagcacauucuacccgaaacuuaacacucuuacccgugucuuugucccuggcuuuguaaacuuguccauaaguaccuucuccaauaauuccgaugauaucaaauuuauccacgcagcguuucccccagucaauaucuuuuucuuugauuucaccauagcgaggcccacauauucuauuaaauauaguucugaaguuuuuauagacaaucaagcaaacuaaaugaacugcuuaauaauucaauagcaaucuugcccaaucuuaaaucauuauuuuacacuauucauguauauuuguaaacauucaaguaaaacaaguuacugucaguugauauuacaaguuauaaaaauaaacuauaauuucuacauacccacucuaaguagauaagaacuucaaagagaaguagcaacugcuuauuuauaaugcuuuuaggaauguagcuuuucaguaagaagguagaaacauuacuagaaaucaucaagauuuucuacuccgucuccacaaaauuuuucauucaaggauucucucucuccccauauauguauguguauauacauguucaugugcauacacacacacaugcacacacacacauaguacaaguuagcaaauaguaacauaagaaacugacuacaaauuacuuacaaaaugauuuauagcauuauaaaacaccaucauaaacauacugaagauuuuucacucagcaaguauaggaagucuuaauucauguaaaaccacaacucaaaauuccauacuuggguagagauuaauagaaaugucaaaaaucaaauucucuaaagagguguuucuuuguuauauuuugauauuuaauagcagggccaacauagacucaagaauuauagcaaaaggauucaaggauagacuaaaguuuucuucucuuaauagaaaacaauuuuauauuuuuaaauuagauguuaccugaagagcaauuuuaaauuaaaacuaugccaaaaguuuuaaacuuuuccuuucuugaguaaacauuuuuuaaaaguauuuuauuucuuaccuucaaggaaaagaacucuacccgauauuuagcaggaagauacaucagcuccauuaaaaaaaaaaauucuaucucuuggaaaauuacaaaugcauacaguuauauggaaaaaaugaguaguuaaaagcaaaggaaaacacuacccauuacugauuuuguuugaguacacugaaugcugucuuccauuuuguucaauuucaguguuuuuauauuagcuaccuuaaugauagauuagugucuuucacacauguaacaccgccaaauuaauaauuacaaacuguaagaaaauuucauuugguuuuauuaguagcugcaaauagguaccaccguucaugaauauuuguuucagaacucuaaaccaaccuguauauuuauguucaaauaaauauacacuuuucauuuaaaucuuacuguuuucuaguuuuuuaguuauccaggauauaguguguccagucaaccuaagugccaguagaaagcaagcacauacuuaggccuucguuugcuauguaacugugcugcuguuuucuucuccucuggacucuuggaaagaucaucuccuccugguaacucagggggcaaugguaaaucagcaagcagacaucggaguuucuuuucuacuucuuuuuuaacugcuuugacagaaauguugccucuuaagcuaaagaaaaaaaagggggagggguguaagucauaucaaccauaaguaauugauuacacgauaaaacuauggucauauuuaaaauuuaagcagcaugcaaaggcauaugucauacuucaaguccaucuaaacagauuauuauccuucaaccacgaaguaaaaaaaaaaaagaaagaaagaaaaaggugacacaaaauuaaguaaaaaccauagaaaucuauagaguagaccuuaauuaauaguaguauaugaauacugacuaaauguaauaagugcaagacaaauguggauucaauaucuuuuuaucuuugcaaaucugaaacuauuuuuuaaaaauaaagucuaggaagcugggaagaugguguuguggugcuagucauucaaguguaagaaccuggauucaaaucucaaaaauccacauaaagcugggcacagcagcacagucuacaaucucaguaacccucaucugaggggaggggaggaggcaggagaaucccugaaagcucauuggccagcuacccugguguuuauauuggaguaacaaagugaaguugccuaaaacaaggucagaagcaacauucaagguugcccuuagagccuauaccagcaguauugcaugcacauacaauacacacaaacaaauaacaaaguuuaaacuuaaaaaaaauaagcucuaacuuucaaaauuaugaauuaaaaagaaagaaucaaaucaauaugcuuugcaagaaaccucauaauuuuguaguauuugauuaugacaaggagacaaugaugccuucuuuuuagcaaauaaaaucacaaacuacaauuagcacacgauucucuugcccauuuacauaaccaaaaccaaugaauucacuuuuagucucagcacuugggauguacaggcugguggauggaacucugaauuugaggccagucugguuccagaacuacauaguaagaccuugcuuuuaaaagaaaaaaguugccgggugugguggcacacaccuuuaaucccagcacucgggaggcagagacaggcggauuucugaguuggaggccagcuuggucuaccaagugaguuccaggacagccagggcuacacagagaaacccugucucgaaaaacaaaaaaaacaaacaaaaaaaaguuguuucucagcuguuccagcugcccugccuuuacucugccaucaggaaugcuaacccuccauaauagaauuacaagugaauuaaaggccugguuaguucuauacuuuuuuuuuuuaauuuccagaguuauaauuuucaaauuguaucugaaguuguaauugauaauuuaaauuuucccaauacaaaaaaaaaaaaaaucuguuacccaagagaaccuuuuaaugauaaaaacagagaauuuauuacauaaauauucagaccaggguuuuguuguugcuguugguuuuguuuucuuuucuuuuauuuugcuuuucaagaaaagcuguacaacacuggggucagauuuuugaaggaagggcuaugguugaaguuuggaguucaguaguaggaggauggcccagcauguacaacucuugaguuaaaccccaaaaccacuaaacaaaacagaaaaauaaaccacuucacuuucauaccacuuaaguuccccuuuaauagaaauuaagagugagugucaguauaccagguaucuagaggauaaaacacaaacacuaaaguaccagcaaagaaauaauauguugacagacaacaaaguacacagaaacacagauauuccuuaagaguuuucaaauuagucaaacucugguagcaacacugcuacaaggaagaagguggcaaaccagaccaucucuuucuucuuccuguaacaaccuaaaccaauuucugugagaaaaucuuuugaguucaccuuuuauaaauuuuauaagcuaagauuauaaagggaaaaaagugauuugacuagaaaaauagaaaauauccauagcaaguuaaaaacaaaaauagguauaaggcauagugguguaagcuuuuaauuccaacacucaggaggcaaagacagauggauaucuaguuuaaggccagccugaucuaauagcaaacucuaggccagcuagauauuucucaaaaagugaaaaaaacaaaacaaaacaaaacaaacaacaaacaaacacaccccaagaacaaauaucaaagaaaaacaagagucugaacuacaaagaucaaaaguccuagugagaaaauucuacuauaaaagggaagaacugaaggcucugagccacacaacacaccaagugccggucccauuagcaaccaaauaagcacaaaaccuaacaauguaacuucaagacuauaaaaauucaaaguguuaaaaucuauuacuguuaagaugauuccauacccaaaaaggagagcucaugguggcucaggccuuuaaccccagcacucuggagauucaguaggcagagacagguagaugcuaaucuugucuacaaaaugaauuccaagaaagccagauacacagagaaaccacgucucaaaaaaaaaacaacaacaaaagaugauuccauaacauuucagaauauaaacuagcauggccuuauuaggauacaauuuguugcuuucauuucuaaaguuuuaaauggguauaauuugucauauucuaucuuaaccaagugucuauauacauuaguaguaaaaaguaugauguacugauuguuauagauaagcauauugaaccuaucaagauuaacauggaaauaucuucaacaaguaaaugaaaaaaaaaaaggaaaggaauaccaugauccuaauucauuuuaaauaaaacaaucauguuuuuuguaaaaacacaaugguaacagaagaaacaguuuguugcaguucuaagaaaaggauucaaagugaguauggcauagacuauuuggcuaagacuccaaccaaguaaaaaggugaaagauuuagcuuagaggaaccucugaucugauaauguaggaagagcccuacaauuaagaagacugggaggaguagaaagaacugccuuuuuaauauuagcuuuauuaacaucuauuaagaggaguaaucaaaauccaaaaucaucauuugcagguccaauuacaguaacugauuaagacaaaucuuauuagugggugcuaaaccauuagaugaccaguugcagggaaaacaaaucuucaaaaugacaaauguguuauccuacaaauucuacaaaaaaagggucacaaguaccuucuacauagagauucuuaagguuggucaucacuuaaccaaguuaucacaucacaauuuaacauuguguucaucauauaauaggaauuauauaaaaucaucuaaauauucuagcccaaaacuguuauuuguucucaaccuaaccaagauccaacugauuucuaguuuauaggaaauggaaagguaagagaagagcaagugaacugucaucaagaaguuauaaucagacaaauacuacuauaaaacuacacagagauggcucagccguuaagagcacugacuccucuuccagaagucaugaguucaauuccaagcuaccacaugguggcucaaaaccauuuguaaugugaaccaaugcccucuucuggugugucugaagacagugacaguguauuuacauauauaaaauaaauaaaucuuaaaaaaaaaaaaaaaaaaaaaagaguacagauccaaagucuucaacuuaugagguuaacauugcaauuuucuuagguuacauuaaugguacuuguggcuaaacugaaaacuauggcaaccacuuauuuucaaaagaugugcauacacauauaccuucccccuacaaaaaauuuuaaagcauagaaauaaauauuaaauaaaauauuagcauuuguugacucuaaaaacuugguucucaaccuguggucacaacccuuugggaaaggaggaggcuuaacaauccuuucacaggguugccugagaucaccuugcauauuagauauauguacauuauaauucauaacaguaacaaauuuacaguuaugaaguaggaacuaaaauaauuuuaugguuaggggucaccacauauaaacaacguauuaaaaggucgcagcauuaggaauauaggaaaccacugcucuagaagguuauauauagaugcuaauuuuauuaacuuuuuuaaaugccuaaaacauaaaacagaguacagauuuauaaaaucauagucacaaaacaacacauaaaaucuuucauagauaauuauuuaaggauguaacugugacaguuagcuaggaaugcuuaaagaaagcaagauggaaagcauucauuaagaugugacuacugaggcuguguagaccauaaugguucuuuaaaauaacccuuggauuuccagugaauaacaguaaauaaagauggcuuucacauucagggucauucaggauuccaaaagcauaucaggacagaaaagaugaucucuauaucauaaucaacaagacagacaauuucaacaaauaacaauccccccucucccuucccccaucgcccuacaccagguugcuaaaaaccuggugaaagggaauguggagcauggaguugcuccccccuuaugaaagagggggaaacccaacauuaugugcuuaaaaacuuaaaaaccaguccuuuucaagcaaaacaugaagucuauuauaccuuguaacucucugcacaaaagcaacuagucauuuuauuuauuuuuuuauuuaauaaaagcaucauuaaccuaagguagucaguauuuccuguugucuugauuuauacuaaagcuaauaaucauaguaucugagaugcauagaacuuucgauuacaaaaucuuaucaggucacuuaauuuaaauaacuaaucuaugauuuuucaggauaaauauuuuuacuuuuggauauaaauacauggaauagagcacaaaaaaacugaaaacauaagacuaacaacuacucugaccuuauacuuguaauccacuaacaaaauuauacuucuuuuuuuuuuuuuuaauuuuuuuuuuuuuaaagauuuauuuauuuauuauauguaaguacacuguaguugucuucagauacaccagaagagggcaucagaucucauuacgggugguugugagccaccaugugguugcugggauuugaacuucggaccuucggaagagcagucgggugcucuuacccacugagccaucucaccagccccaaaauuauacuucuaacaaaacuuagacuauagaaauaucuuuuucccuauccaaguaauuuuaaccauuucuuuuucacaguacauuuuuauuuaguuacuuaauuaaaacuuugcugaaaguaaugucuccucuuuauauacuuaaaacuuguacuuaaaucagucacugaaacaaauaaguuaauggcacagacaugucuguaguaguauucaguaacaguaagaaaacauacauacaaaacauacaaacccacaaagacacaaucaaaacagaaaaacaagagacaguauagaucaagcaaucuguagcuggguggguguggcgcucaagagcucugcagaggcaggcggcucucuguggguuaagagguuagccuauucuaaacgcuaagcuccagaccagccuacauaguguaaggcccucugaaucuccuucccugcccauuccuuaaaaaacagcaaaauaagcagacuuuuucuuugaagaguuacuaauuucaaauuugucuggacuuaccuaucagcaucuuuaucuucaggcagcaugggaggcaaagguaauggcgguaacguagaggucacuaaagccacaugcugcuccuucuccuuggcuccugugcuuggugugaguggcuugcuuuucucuuuaguggaaacugguucuuccuuuguagcagcagguuuacucuccuucccaacaacuguuuucuugguggcuuucucuacugucaaauuauugucuaccuuuguuacuugaagcgguggcuuuguuuuugcuuugucgcuuuugacggucccaccacuugaaggagaaggugcaugcucaguuuuaaguuuuuugacuuccuucacaugguuugucugugagacacuggcaccaguuucuguguuccccuugguagguguagaagcauuugaggcuuuggcagcuuuggcagcugcuucagcagccuuagcagcuucugcagcuuuugcugccucugcagcucuugcugccucugcagcucgugccuuuuuauucuuguucaauucagcugccaagcuacucuucagaguuagugugcuaggagaaaugcuugaaugacgacuucuugaucuagacaaucugugccugcuccgagaucuugagugccuagaugaauaugggcuucugcuucgggauuuggcagaucgucugaugaaaaauaauuuaacauuuagucaguaaccaaauuaaacuuuguagagugcuaauuuaaaucucugaaaugaaacaauuuuacuuaauuucaaaaugguaauauuaguguuucugaaguugcugucagugaguaaaauaccagaugacaauuuucuuuaaaauauuccuccuuucucuggccugugaaugcccaaagauaaaccuggauuuaaaacaaacaaauaaacaaaccaaaaauaaauaaauaaaaaaccaacuucccuaagaaauguaacaauuagggcagcaacaggccaucacuguuaucucagaaaggagaagucuuccauuccuccccacucccccuccccucacuugguuauauuuucuggcacaaacuguugucucuucaccaccaugacuccuguuuuugacacuucagagcucccugcuacuccucuaucuuaccccugcaaucauuucauuaaaaauccagcaccuacauugaggcucacaaacaucccuaacuccagguccaaaaauucugacacccucuucugaccuccacaggcuacugugaacauaggguggugcacucuguuguguacacacauccccuaauauuuggggggaaaaauguaucuguacuggaaauauaaagucuuuaaaaaaaaucucuugcccaucuaaauuagauuccauuucuuuuuagagcuuuaacuaacuaguguguguauggggguggaggguaauuaaauucauaauuuuuaacucuacaggagacagguuaacacaauuuaacauacuuaacagaagaaaagacagcucuuacuagacuuugguagaaaugaugguuauaaaauaggacagguuaacacaguuaaacuaccaaagacagcccuuacuuaagaaacuuugcagaaauuacaggaagcagaaaaaguaaaggaagaaauuccagaaacccauagagaaaacaggcagaaaaaaaaaauguccuuuauggcuagcgucagagauauuuuuuauaaacaaucuauaauucuagaauacaagugaaauuacuaggcauaaaauuaaaugaaaaucauaguuugguagucuaaaauauaauacagaaaaacaaaacucagccaggcaugguaguauaugucuuuuaaucccagcacuuagaaggcacaggcaaucaaaucucugugaauucuagguuaggcuggucuacaaaucaaguuccaggacagccaggccuacacagagaaacccugucuaaaaaaccaaaaacaaaacaaaacucaaaucuugguagcuuuuacuaaugauuuugccauacauuacuaaaagcauuaccacuuuacuaacuaaugcuucaggcauaugguuguaagaguaagaaaaaaaaugaauauucaaacuuguaacaauuacacuauaacuuuuuaaaauuuuucuuggacugacaauacaguucagucaaagugcuugucacgaaaucuuaguaccaaaauucaaucucugcaagcuguccucugaccucaauacauacacacacacacacacacucacucucucucucucucacacacacacacacacaacucacauaaguuaauacaauuaaaauauuuucuucuaauaguucuauacuguugaaccuacaaugagcacauauuaauuauucauugauugguuuccacaaguuaaaagagcucuuuaaaagcagaaaagauggcucacagguuaagagcacuaugugcucucaaaggaucagcaccaaggucaggcacccugcucuaggagauccaaaggcccugucuggcuucaauagacaauguguuuaauuugcacauacuuauacacagacauaaacauaauaagaguuuuaaaagacaucuuuuaaaaagcuaagagauggucuggagagaugccucaaugguuaagagcacuggcugcucuuccagagauacuggguucaauucccaacauccacauggcagcucacaacugucucuaacuccaguuccagggcaucugacaccuucauaaaauaagagacacuuaaaaagagagagagauuaugcuccuaagaaguuuucccaaacucauacaacucaaauaaaaucagaauugcaacucaaacuaacuaggguucacuauuaauuaguuguggugacucccaaccauaaaauuauuuuuaugacuacuuuaugacuguaauuuugcuaagguaugucugaauaguaaugucaauauuuuuggagacagaaauuugacaaaggggcucagcaaaggggucgauacccacaaacugagaacagcugccuuaaagagagaguauaauguccauugaagccagacagggccuuuggaucuccuagagcuaagugccugaccuuggugcugaucuuuugaaaguacgcagugcucuuaacccuugagccaucuuuucugcuccuaaagaguucuuuuuaacaagugaauaaugugcucaacuauaucagagacuuugcaagaaucuaguucuuaacauuguacuuagugaacaaacacaaauucaggcugauuuguccuuggcacccucucuuccacagcucuuaucagcacuguauucuugccacuucagaguuccagguuaccacugacuaagcaucuuuuaugaacuccuuuaaucuacaucuuacaucaccucugugaucucauuuuaaagucucuugaaccaucuaagauggauuucacucuuucuagagggucacuagccuagagguacaccaaguauaucaaaauagguaugccaaaauacuuuaucacaauuuuagcuuccuaaauuauuuuugcuaaagaauauccaaucugucacuggguaucaucucccagucuaacuuccuaggauaauagaaaacacagaagcucguguaauaaauuuccaguaggacuguuauccauuagcuccaauuguucuuaucccacuuuuucugccuaucuuacauccucagggaauucucucagucacauuuacuuuacaagcuuaaguccucaaaagagguaugaaauguuuaccaaauuaaaaucaccauguugucuuuuuuuucccccaaaauguugucuuucuaccuccauguuuagugcacaauaauuaguaaauggaacuacuuuagaugucuaucaacauucaaauguguuuuuaaaaaaaaaugguacauacacaaaauguaacuucacugagccauaagcaaaaucaaauugcauuuguaggaaaaugaaaguggaaacuguuauguuaggcggauuaaacaagacucauuuuuuaaaaagcgcauuuucucuuaaauguacaauuuagauuuuaaauuauuuguguauaauuuuuaaaagaucucuacaugcaacacuuaccuaccuuccuaagucaaaauuucaaauagcuggacauaaagacauaacuuuaaucccagcaguaggaaggcagaggcaggcaaaaaucucaugugugugugagaccagcuuggucuacauagugaguuccagacuagccagggcuauguaaucagacauuggcaaaaaaaaaaaaaaaaaaacggugcuccucuguacuaaauuuauuauguacuguuuuaaguguucugcuauuuccaacaaauuuauuauguacuguuuuaaguguuauguacaagacucuuaaauguaucucauuuaauaucuaucuuaucuaaucuguacuauuauagucaaacuacugauuccaucagaucuggcaccaucugaaauuaagacuuagaaagugcauauauggucuuaauauuugcuccuuuuaacauucucuauuuuuaauuuuacuauucucuaucuauuuaaccaggcuauaaauuucauuuccuggcaaacacacauuauaucucagcaacugucucaucuuauugacccuaacucuauauauucccuuauagccauacucucugaauacugucacuagcaaacuaccucaaauauaaugacuuagagcaauacaaauuaucucacaguuuuaagacagaaauccagugagcucugaaaaauuaaaccaucuaccucugcugaaaucucuuggaaaaaucuguucucuuacuauucccagcuucacuuacucaagaccccaucacucaggccucucuuuuuaucauauuucuuuccucucugucucuaucaucacauggcauuucugacucaaccuuucauucaaucauauaugaacuaccuagguaauuuagaaucucuccaucucgaaacccuuaacuuaaugacaucuacguuuuaaucauaccaacuuuuugccacaacauacuuuaaauacauaccccaaagaguguagcauggguauuuuaagggaacacuauguggucuaccauacuguccacuuuuauccucaaaaucacuuuucucucucacccuaccaccucuucucuuaaucuacccuauccagcugauaccuucucucugcuccauuuauuauuguagauagaauaaccaaaccaauacucacuguugaaugaaguuuuuuacauguuccaaauccuucacuggccuuuucuucuuaguuguuacugcaagccuucacaacuuucuucaugcucacaaccucaguuacaagauuuaccaggcgugucuucucccaaauuauaauuaccuuccaccuuacauacaaccucacugcuuucuauaauugacccuucugguaaacuauugaugccucauucuccugaaucuuaccuuguggaguacugaccaaaaauagcauagccugaaagcuugucaaaauguuguuucucacauccgauccauaccuauagucucauacacauuuauuuuaaauuguagacagguuaaucaaaaggugcugguugguaccuugguauuuuaucuuuccugcugcucaaacucuugggcccauaaacucauagucauugaaauuaacuaguaaguaaguauauuuuacaacacuagaacaagaaaaauucaagucuacagugacaauaguaaguacauucuuaaaaagacuuccuaccauuucuguuuccuuaguuucuuccugacuauaugugcugccagcuucugccucuuaagguucuucuuccuuacuauauuuagucucacacagauuuuaauuuauacuuacaaauugugguggucugaauaagaauggcccucacagggcucauauauuugaauguuuaaucaccagagaguggcacuauuugaaaggauuagaaggauuaggagguguggccuuguuggaggaaguguguuacuggagugggcucugagguuucaaaagcccaugccaggcccagucucucucucucucucucucucucucucucucuuucucucucucugccuauggaucaggauguagaacucucagcuacuucuccagcaccaugugccugcuugucgccacgcuucccgccaugaugauaauggacuaaccucugaaacucuaagcaagcacacaauuaaaugcuuuuuauaagaauugccuuggucauaagugucucuucacagcaauagaauaguagcuaagauacacaggauagcuuagacucuuagguuguuugaauugcugaauguuucuuuacaaauuagucaucagauggauuuuggcauaggauuaggauaugauucccaucaauuucugaaaggaccaaaaaccuaccuuggccauuuuguauuauuuacucgaagcagugcucuugguacugaccaucauaaaacaacacggaagagcucuacauaugacaguauuaagucaacauuuaauucuuuauguaaaagugaaaaaguauaagcauuucuuuaauaucaaaucugguugggucuuuaauagcauuguauucuuaucaaagaauuguuuuaaaauaaauuuguaauuuauuaucaguaacuaucugaacuguauagcuauuuuguaugccucuauaccugacaugaauaugaaccccugguuuaaaaacucaccuccuccucacuuccaacuaccauucauagcccucaguacaauacaacuaaacuauuaagguauauuaaaucugaaauauucccuauucucuugcaauggugccugcuaaaagggcaaaaaucugaagucacuguacacuccacaaguucucuucuuccccauacucaauucaucuccaaguccugucaacucuaccuuucuucaguuuuaacuagucuccagauucuuuaaacuaaacagcuacagguacucucacuauuagauucugaauaauaacuuucuuggaguagucucuauaucaggcuccuuacauaaaaucuucaccuguccuaauuacucucaaugcagcuaccugaguaaccuuccaauuaccccucuaacaaaacuccuuaaucguagcauguacacaaaguccguguccagccauucaaaauuaaucaaguaucaggccuagaauuuuuuuucucacauuccuccuauauuugucaaagggauacuuaacaucucagcauaaugguuaccaccuaucuaaaauuuacccucauuugaacuggauucaacugauaacuaccuagcauacaagaagcccugaguaaaaucauccacacaacauaaaccaagcaugauggagcacaacuauaauuccaucacuccagaguuggagguagaaaaaaaucaaaucaaaguuuaaggcuacacagcaagcuccagacuacaaugagacacaugagagugucuaaacacacacacaaaacaugcaccaaaaacccaccuccuucuuaauaugaugacagagagagagagagauucuguccaauaauccucccacauuauuugucucgugucauuauaauaaaaauaauuuaaccaucuugccauauuaaacuaagaaaacuaucuucaaagcuuugacucugaauacaaaccuugccaauuccauauacucaaaaguauuuauauaagaacaccacugaugcuauucuucuggaauguaauuucaccuuguuaacccaguuaucaaggugcugcugcagaucagucugguccuaaucuagcuuucccuacugcucgguuugaauguacuuaguucccacagugguacuaugugggaagguuauaaaaacuuuguggaguagaaacuugcuuaagucaaucuaucacuaguggcagucucucagguuuuauagccuggcccaacuuccuguuuucucuccuucuuguguaugaacaagaaacaacuagccaguagucuaaaacgugcugcugccaugccuaccccacaugacaacacuguauacccucuggaacuguaaauaaaauaaaucucuuuucugccaaaggugcuauuugucaagguauuguaucacagcaccauaaacaaaacuaacauaucuaacaacuacuagauuugaccaaugcuucuguguuuucacugacuaugaagaacauccuccaucucuucaucccagugaugcagggaugguucaacauacugaaauccaucaacagaauccacuacauaaacaaacucaaaggggggugggggggggggaagaccacauagaugcugaaaaagcauuugacaaaauucaaccucccuucauguuaaaaagucuuggaaauaucagcaauucaaggcccauaccuaaacacaguaaaagcaauauacagcaaaccaguagccaauaucaaacuaaauggagagaaccuugaagcaaucccacuaaaaccagggacuagacaaagcugcccacucucuucccuaccaauucaauauaguacucaaaguccucgccagagcaauuaaacaacaaaaggagaucaaagggauauaaauugggaaaguggaagugaagauaacacuauuugcagaugauaugauaguauacuuaagagaccccaaaaacucgaccagagaacuccuacaacugauaaacaacuucagcaaagugacuggauauaaaauuaacucaaacaaaucaguagccuuccuuuauacaaaugauaaacaggcugagaaagaaauuagggaaacaacacccuucacaauagucacaaauaauauaaaaauaucugggcguaacucuaaccaaacaagugaaagagcuguaugagaagaaugucaagucucaaaagaccucagauuauggaaaaaucucccaugcucauggauuggcaggauuaauauaauaaaaauggccaucuugccaaaagcaaccuacagauucaaugcaauccccaucaaaauuccaaaucaauucuucauagaauuagagcaauucgcaaguucauuuggacuaacaaaaaaaccuaggauagcaaaaacuuuucucaacaauaaaagaaccucugggggaaucagcaucccugaccucucaagcuguagaacagagcaauugugauaaaaacugcauggcacugguacagagauagacagguaaaucaauggaauagaauugaagacccagaaaugaaaugacacaucuauggucacucaaucuuauacaaaggagcuauaaccauccagugggaaaaaagacagcauuuucaacaaauggugcugguucaacugacagucagcauguagaagaauacgaauuaauccauucucaucuccuuguacaaagcucaaguccacaugaaucaaggaacuccacauaaaaccagauacacugaaucuaauaaaagacaaauuggagaagaaucccaaauacauggacacaggggaaaauuuccugaacagaacaccaauggcuuaugcucuaagaucaagaaucaucaaaugggaccucauaaaacugcaaagcuucuguaaggcaaaggacacugucaauaggacaaaacagcaaccaacaguuugggaaaagauuuuugccaaccuacaauccgauagaggucuaauauccaauauauacaaagaacucaggaaguuagacucaagagaaccaaauaacccuauuuuaaaaauggggaacagagcuaaacagagaauucucaacugaggaaacucgaaugguugagaaacaccugaagaaauuuucaacauccuuagucaucagggaaaugcaaaucaaaacaacccugagauuccaucuccuaccagucagaauggcuaagaucaaaaagucaggugacaggagaugcuggcuaggauguggagaaagaggaagauuccauugcuaguagaaucguuccaaauuuucaaacaauugucaaagagucuuuccuucacagagccuuaccaacugcaagacacaauagugccuuaucagcaccuaucuugugaccagauccaucauucauaacuuuuuaaacauuuaccucacuaccauaucaaacuauaccuucuuugaggaacauaauauaaugaaagucaauuuuauuuugucaccuuauacuccauagcuuaaugccauuuggauagcaguucuugcucaaaugaauauaacacaaugaacauuaguguacaaaacacauuucauuugacuuguucuuccuucagcaaugaaaauaauagaaagcaaauggggaaacugagacagcaugcuuaagagacuuauuacauguacaucagaaacuagaggaagaaucaagagucaggcaagucacccuauccaaagccuggggcuacuuuccgcuaucaaacuagacucuuucaccuacauuuacuuagcucuaugcuaagcucucuuucaaagaucaguuuguucacugucaucuguccauuuccuaaaaucugaacauuuaucacuuaccacaaggcacuccggaaucagauuuuuuaaaagaacaaaaccaauaauuuauaauuaaauaagaauaaauguuuucccuccaucauuaggaauaagauaaggaagucucuucuuaccaucuuagcauuauacuggagauucuagucauuguaauuaggcaagaaaaaaaguuaauuaaauucagaagcaagaaagucagcuaugucaauuaucugauggcauaaucuugcuuauagaaaaauuccagaauccacuaaaaaaauauggaaacuaauaaauaagucaacaaaguuucugcuuacauaaccaauaagaaaaaaaaguuuuaguucucagcagggcagugguagccuucacuuuuaauccuagcacuagggaggcagaggcaagccaaucucuggguucgagccagccagucuacagagcaaguuccagaacagccaagggcuacacagacaaacucugucuucaaacaaacaacaacaacaacagaaagaaagaaagaaagaaagaaagaaagaaagaaagaaagaaagaaagaaagaaagaaagaaagaaaggagaggagagggaggggaggggagacauuuuaaguuauauacauuagcaaugcauagucagcacagacaggcagauagcccgcuagggcuaugggccuaucgaaaaaucaagguucagggugauuaucugccucugauaaugaggaagaguaacaugaagacacuauaagaugcucuccucuugcuuccaugugugcacauaaaggcauguacacccacacaggugcacacauauguaacacaugcaaauaaaaauaagaauuuaaaagucauguuuuuaaaaaccuacagaaauauccaaaauggcaagcaacacucagguacaauuggccucaguuuccaaccaauaagcugggaaagcuaaaaaaaaaaaaaaaaaaaaaauagcuaucugaaaaguuacaugguugguggggaaauaauaccggaguuaguggcagcaucaggaggaaaagccaggaaaaucucuucuugucucugggugugugguacuaucaaucaacagaauaggagcacacuauacuuucugaaacacuucggcuucugugguggcuuggcagcggacacccugugcaaaucacauucucagaaaacucagagcaagugguacaggguuagcaguucaguauuacgaaacaagacaaagagaauacuccaagacuggaaaagaaaccuuaaucagcauagcauucaauaagcugaaacuaauucaaagcaacaaguaggaauuaccaagaacugcagaggggcaggaggcagugcgagcauuuugaacucuaauuucuguaaugaauucuaagagauaugaccagaucucagacucugaacagccuuuggggggcggggaggggggcacucagagaggaggaagacagaauuaccuaucccaaccccagagaaguguggaaagcaagaaagcccagagugaaguugauggccauaucaaggacccaaugucucaaacccaaaggaauggcaagaccuuaaccacagaaugaagcugaaagggaugacaaagccuuccuauguacaaguaugacuguucuaugaacacugccgaguguguaaaaccuaacaacuacagauaucuacugauuacaaccugaaacugcucccauacagagaggacccacaaagacuagcugacucaccuucccucuguccuacacauaaacuuauuaacaauguuuuccagcaaagcaagcacagcccacuagaucccagcuuuucuguguucuguauguguuuguguguuugugugccuauccuuucuugagucccucaucuccuucaucaggaacucaauaaagacaaaggcaauaaucaucccagacauuuuucauaccuguauccaccuaucucacuccuucuccacaccuaucaugucucuguuuaaugcccaaugccauuggagcccaggaacuugacccuauucugccgcugcccuauacugcuccccacaacuauuuuccuuuugccuuuuccucucccaaagaauauagucugauuugcagagucucugugcucagucuaagaacuggacuauuagcugggcguuaauuaaucccagugcucagaagauaagaggcaggcggaucucugugaauuggauggcaagcuugcucuacaaaaacaguuccaggauagccaaggcuguuacauauagaaauucugucuuaagaaaccaaaagaaaaacuggaugauucuauauaccaguggcacauuaguauuccuucagacaaagcugaaucauuccucuaccacuuccuacuaguauagcucccuuauuaugaacaugacccucuuuuaucucuauccccccaaugcuaauuacuagucucccauuucuuauuucuuucuauuaauaugcacgguaacuacuauaccaguucacuaaguacuagugauaucacuuugcuccacagaaugauuagcaguuaaggagugauugcuauauacuuaacuauuauucugucuucacaggggguguacucuaaguaguuaaugacaacuacugcggaaaguauucuuacugacccuuacagauacuaacuggaagguaggaagggaggaaaucaaugaucuuacuccuggugcauaaagcccaggauaaaaagacaaguaacaugaaaaguuaacacaacaucucauccaacaguuaucaaccucagaguaaaggcccagaaugaaagagacucagacaaauucuagauugggaaucuaaaacaaugacaauauguucaaaaaugaaagagggccugaacaaccuucugauugcauuaaaaaggagcauagaaauaagaggugaaugaaauaagucaaugaaggauaagaaaauagaauucacuaaagagguaggauuaauaaacaaauaccaaacuaaaguaaugguagaaaugaaaaauucaguaucaaauaaagagcacaguggaaaggcuagagggaugguucagguguuaagaggaccuggguucaacucccaacugucuguaacagggcauccaacgcccucuucuggccucuacacacauaguacccaaacaaauaugcaaagcacccauacacauaaaaacaaauaugcaaagcacccacacacauaaaaaugcuuuuaaaagggaaacaggacagucacagcagagaagcagguaucugagcucugcuuguccaaagccuaacaacuaacucccgccuaccacagcaacgcuugagaguccaaaucagaagucaaaagaggucccccauauccauucugccuacccuacccaccauuccacauacaugaaaccacaugaagcuacauguaccaagaauuacagguaaggaacuuccaaaccagucaaacccauuuaccaagauacacuagaaccauagugcccuaugcuccuaaccccacauacagacuccaggacuagccuccucuaucugagaacaaugugauauucuaugaucugcucccagcccccacagagcacuacucauuuccacucugacccuagcuagccccugcuacccaaagacuauuuucagaaucuagcgugccuuccacaaacuucugagaucaacagugagaaucuucuaagacuaaaauaggcucagaaaucgguacuuaucccuaccugagccaauaccacaccugacaugcuauuuaaccaucaacagaaugguucuaugaaugaaaaacaagcaccauucugcugauccaaacaaaauaaguugggauaacagcaagcaaagauccaaacacccaauuaacaaauaaaugggagaccagaugccgauaccaaaacacacuucugacauuagcccccuagcauaauauuccccaagaaaagcaaccuagcuuaauguacaaugacuucaaaauagcaauuacaaauaucuucaaaaaaaucagaguauauguacaaaccucuaacugaaugaaaacuucaaaagcacaguugacugaaauaguaaaaaauaguucgagauuuaaaaacacauuuuuaaucuaauuuuucuuucuugucaucuuccaauuggaaauauuuguaaugugcaggggguacaauguuuuuguagaguugagauguccuuuucuuuucuaugacugguauucagggcaucagguacuauggugcuacuuauuucaucuucuaugaguagaccacucucuguaacuaauuuccaacacuaaagagacucucuaaagaaaagcucaauuaaaauaaaacucaaaugaaaaguucaagaagcaaaacaaaaagcucagaggaaaagucucaccaaaguauugaaugauguggaaaaggucuuaaagacaaaacagagaaguggguaauuccaugaaaaaaauuaaaucuuuaaaaauaaauuaauuaauuaauuaauuuaaauuaaaaaaaaacaaaaccucuggaacagaauuagcaggaaauuuggaacauuacaaaguaacuauacauauaggaaaagaagaaauccaauucaaagucacagaaaauauuuucaacaagaucacagaagaaaauuuucaccccaaaaaaacaaaagagaagcugccaaggugcaaaagagauacaaaacaucaaauugacauggaaaaaaaaaauuccccaugucacauaaaacauguauaaaacaaagaaugcauauugaaggcuacaagagaggaaaaucaagccacauagaauggcagguacaucaaaauaacuuuaaaaucauaguuugaaagccauauaagguccugaacugauuucuguaaccuuuaaaagaccauacagacaacuuaaaauacuauaccagggaaacgaaacuuaccauucacaaucaaaagagaaagaaaaacuuaccauaauaaaaacaaacuuaaggaauuuauguaaaccaagucaguuguauaguggauauaucagucuaaaaaaagguaaacuauauccagaaaacaauauauaauccuauuaacagugaaccaaaugaagucuaaaaaaaaacaccacaacuagauggcaggaauaaauaaacauuuuuaauaauaauucucaguauuaauuaucucaauuuccugauaaaaggacaggaauagauugcauuagaaaauaggauccaguacuguggaggcagagguaggcagaucucaaguucaaggccagucuggucuauauagcaaguuccaaguucaaauuguuacacagagaagcccuaucucgaaaauaaaauaaaauaaaaauaaaauuuaaaaaaaauaaaggaaggaaggaaaaaagaaaacaggauccaucuuuuacugccucuaaaauaaauaucucaccaucagugauagacuuaggauaaaggauggaaaaaagguguccaagcaaaugaaacuaaaauaagcaggcacagccaaucuaauaucugauaaaacagacuucaaaccaaaucuaguuaaaagagauaggaaaaggcauuuuauacucauuaaaggaaaaauucaccaaaaggauaauacauuccuaaacauuuacacaucaagcaugugugcaucaauuucauaaaagaaagcauuauaagaucaaaaaauaacagauugaccacaacacaaugacagugaaugacuucaauaucccaacuuaucaauagaaagauuauccugagaaaaauucuacagcuaaauggcaucauaaaugaaaccgagcuauuggaccuuuagagaaagaacauucugccaaacacuacagauacacuuucaucuuaguggcccauagaacuuucuccaaaauagacaacaacaacaaaaaucagucacuauagugaggaaaauuaaaauagcaugcuacauucuaccugaucacaaaggaauaaagcuggauaauaauaauaucaacaacaacaaaaaagacaauacacaaacucauaaaagcuaaacacaccaaugagugaaaauucuuucuugggggaaaucaggaagauaauuaaugaacuucuagaagugaaugaaaugcaaaccaaaaccugcaagacacaaugaagagaucuuagagcacaaaucuggagagaucgcucauuaauaauuuaauguuacacuugaaggucuuggaaaacaaaaaacaccagagagaggagagggagggagaggaggagggggagagaggcagggagaguggggggggugaaaguagaguaaggagagggaaugggggagagggagagagaaagaagagagaagagggaaaggagagggagagggagggggagggagaaggggaaaggagagagagagaaauagaaaucagggguaaaauuaacaaaauagaagugaaaaauauuacaaaaaacucagugaguucuuugguucuuugaaagauuaagaaaauugacaaccuuuggacaaauuaaucaaaagaggauacaaauuaauaaaaaucagagaugaaaaaagagaaacauuucagcagaugcugaggaaauuaauaaaauccuaaggccauaauauaaaaguuuauaauuccacuaaacugaaaaagcuaaaauagaugaaauucaagauaaccaugaccuaccaaaaguaaaucaagaugaaaugagcaacagauuccucacaaccagugagaaagaagcaguaguuucacaacuaaaaggaugaaacgacaccacagaaucaggugucuacaguguacaauucuaccagaccuucaaucaacucucucaauuuauuccacaaaacagaaaaugaaggaauacuuccauauccuuuuuaugaagcccuacaccaaaaccaaagacccccccccaaaaaaagauacaccaaucuuucugaugaaacacuaauacaaaaaucaucaguaaacuugcaaaaugaguucaagaacgcacagaaaagacaagacaucauggucaaauuggcuuuaucccagauauuccaucauaguuagaucagcuucauccaagagauaaaaagauaggucaggccggacaugguggcgcacgccuuuaaucccagcacucgggaggcagaggcaggcggauuucugaguucgaggccagccuggucuacaaagugaguuccaggacagccagggccauacagagaaacccugucucaaaaaaccaaaaaccaaaaaaaaccccaaaaaccaaaaaccaaaaaaaaaaaagauaguucaacacauauaaaccaauaaauauaacccacuacauagacuaaaaucagacaucacaugaucaucucaugagauggagaaaaggccuuugcaaaaaucagcaucuuuucaugacagaaauccuaaagauuacagggauaccaggaacauaucucaacauaauaaaggcaauauauagaaauaccaacaaccacacacuaaacaaagaaauacucaaagcauuuccagcaaaaucagaaauguuaaaagugaaggaacaaaagugaauccacauagaaaaggaagaaaucacaguauccuuauuugcagaugaccugauucuauaaaacuccacacacacaccccaagaaaaucgccuuuuauauaaauaccaaacauacuaaaaaggagagcagaacaagaaggcagguaggcaggcagaaagggaagggaaaggaaggggaggggaggggaggggaggggaggggaggggacgggaggggaggggaggggaggggaggggaggggaggggaggggacuggugugaugguuaaucccagaauuugggaggcagagacagguggaucucuuugagcugaagguuagucuggucuauacagcagugaguuccagacagccagggcuauauaauauagaaauccaaucucaaaaaaguaaaaaagaaaaaagacuugcauaauuaaguuuuaagaaaguaaagaaacugagggaaauagcaaaagaauuaaagauugcccggcagugguggcacaugcccuuaaucccagcacuugagaggcagguggauuucugaguucuaggccagccuggucuacagagugaguuacaggacagccagggcuacacagagaaacccugucucgaaaaacaaaaaaaacaaaaaacaaaaaauaaacaaaaaacaaaaaaaaaauaauaauuaaagauucccugcugugcauauaguuugcuagaauuaauauugucaaauggccauccucucaaaagcaacuuauggauucaauuccccaccaaacccuaugcuauccucagaagcuaacuauucuuaaauuucauacagacacacaggaaacaaacaaauggaaagcaggauagccaaaacaauccugaauaauuaaaaaccaaaaacuacaaguguucucuucaucccuaauuuugagcuauacuacagacccugucucaaacacaagaaauuaauauuaaaaaaaaaaaaagacagaaaccaaugaaacaaagaaagaacuaguucuuugaaaagacaaaagccuggagacauggcucugugguuaagagaaccugcugcucaaccaugaggccuugaguucagauucccaccuauaacccccagcaggaucucuggggcuaccagacuaaccaaaaauuccacgggggcgggggggggggggggggcgggaggggcagacaaaacagcacuauuauaacaaguuaagugguaagaaugagaaaauauuuaaguaauaauaaaaaaaagauacucagcuguccaagaacuaugcucaacuucacaaucccucaaagaaauguaaauaaaaucauacuggcguguggacauaauguuauugugcacuaugugaagauuccauugaugauuucugucuccccuauaucuccuugaaauccuuauucagagaaauauccaggcucaaucuuguguaaagaucagcuccccaguuguucccugaugugucaauaaagagagacuaacaaccaaugacugagugagcagggaagagaauaggccuggacuucugucagccaggggagggagucaaagaaagaaaggcagggacugcuggagcugagaaagcccaaaaaaugcaagaaucuuauggauuuugacugggagauagccaaaccaguuuagaggauuagaauagagaguaacugcucaauacuguucugccuaaaagcuuguuaaauuuuaguccagucucaauuacuuaagagcuagcuggguuaagagaaaacuguaacacuuacugaaaagccacuaacacugacauguagcuguuuuugacuacuuugugaguucuucuuuauuccacccuacuccacccuuuuucuuccacccuuucaacccccuaacagaagugaggaaaaauguauagagaggaagggaaagagauccccgaauaaagucaggggucagaaaaagaacaacguuuuaucacuagauagaccucuuccagcugggacaaguuugauccuugccaucaggauacugaauuuguuuuuucuuugugcacaacuaccuaacaaaccaugaccgacagcaaccaacaguaaccuccaaccuccaccgccugccucuugggacccuagcauuauauacccucugaaaaguccccagaauuccaaaugucacagaaccacagaaacuaucugcggcuggcaaaaccugcuccugcuagagcacaaggcaguuacagucaacugcuguggacaaucugaagcagccccauauccugcaccuaggaguaaaacaaaaacuucuuauaauauuucaguguuuuuaaaagaaaccaaaacuccaaaauugucaguauacuaauauauucaaguaggagauggcuauaauucaaaaacacucuguggguuugagguagaauaaguggagguccccauucauugccaguguaaaacugaugcaguuacuaugaaaaaugguuuggugguucuucaaaauguuaaaaaugacaugacccaacaaaucuuagguauguaccugaaaagaagugaaaacacuaaaaacuuuauacaauaaaggcucauaagagcauaauuuuggggguaugggggcaggggaggacugguuugguuuuucaagacagggcuucucuauguauauaccucuggcuacccuggaacucacucuacauaccaacugaccucaaacucauagagacccaccagccucugacucccaaaugaugccucccaaauaauggcaugugucaccaucauccagcauggagcaauaaucuuaacagugaaaaaguuaguaacucagauguccauuaauuaauaguaaaacguaguguucucuguauagcagaguauuaguugaagauaaaauguaaaaaaguauuggcacuuuauuccauuuuaugcucaacuaauacauauuuaaaaaaaaaaaagacacacaacuaacauuuuacacauuuucuguaacaaggucuagucuacuaagccuaaacugucuucauuguuucacugaaccaugaccugaaauauguuucuuuuucuuuuuuccuuuuuuuuuuaauuaaucauuuuguucaguuacauuucaaaugauaucccccuuccugguuaccuguccacagaccuucccaucccauucccucuagcccccccgcccccgccucuaugagggcgcuccucuacccacucacccacuccccucaucccucuagcaucccccuacucugggucaucaagccucccuccccucccauggaugucagauaaagaaagucugaguaccagaaaacucugugucuaguuugcauuaaggugcauauacauacauacauacauacauacauacauacauacauacauacuacauuucucagggucauuuuagacuuuuuaacaugaacacauuuaaagaaccggugguugguguuaacauuuuuuugucuaaaucagguuaauaucauuuucuagguacuuaaaugucauauacugugcuagauguuaaaagauacuaccucaaaaaaaaucuuacuggauauaaaauuaaguggcugaaacaaaaugaaaaauucucaccaaaguauggaagccagguguagacaguucaaaauacugacaaagaaauaauauugauuuaggauucuacaaucaggagaaauaucuuucaaaauagaaacuuauauacaaacuagcagacugcauucuaagaacucuaucacacuggccagaggaaauucaacaaguuagaccuauacaaagggaaugaaaagcauuugaaaagguaaguauauaaguaauaugacucccacauuuaaaaauucugugucuauagauaagacacgugucauacaugucuaauaacuaaucuacuaagaauaugcaaggaagaugguguugcuggaauuuccaaccccaauaagcccuuauaaaaacacacaauccaguuacuauaauuauaagcuacacacuagauggggcagaucuaacacuauacuaauuuauucccuagcuaaaagaccccuuguuacuugcaguuucuucuggcccaucaaggcuuccuccuccuccucuucaguucucucuccuuccccucugguacucuucugccucucucucuaccugcacccacucucaaaacuccagucccaccuuucuccuccacugcccaaucacaagcucuagccuuuauugaccaguuaaaauggggagaagguucccauaagaucacccgagcuuguaaugggccccucaucaguggcaaccccucuugaggaagcagaauuaacaucagaauacaaacaccuggacaacucauaauugaaaaguaugcuagugaaauaccauuacacauaaagaugaacccaugaaccaagaagaaaaucuuuuucacuucaagguuagacaaaguuuuuuuuauuacccaauuuuauaaaucauaaaaguugacaagcauaaaugcuacuuggaauuuauaaaaaugguaagcuuuugcuuucugaaauuacuauugaaguaaagagcaagacauugcacuaucuggcaaaacauuaagcaaucuaauuccaaauaugaaaaauuuaaacaacuaaaaaaaugugaugggugaauaaguauuugggaagauguugaguauuaugauaagaaaacugacaauaaaacugaaaugcacuggugggguacuggagaaaagggaacuauuuuguacuguugguacuaaugagaauuaacaaaaccauuauggaaggcgguauaagggucccucaauacuuuaaaaauaguauugucacaugauucaguaaucugacuucuccauauaaaucagugaacuaaaauguuauacucccaugcuuacuauggcacaauagucaauauagggagugacaucaguuuucauuaccagaugaucagguuaaaaaaagcgguacauguguacagaguaaaauacuguaaaaaggaaaaccagccuggagagauggcucagugguugagcaugcucugcucuguuccuugcugagcagccuacaacccccucuaacucuuaacuccaggaaauccaauaccuuuugacuuccauguacacuguacaaacccauacagagauacauguacacauaacuuaaauugguaguagaguaguaauaauaauaauaauaauaauaauaauguaguuuggggaguuggaaauauggcacagcaguuaccagugcuuguugcacuugaaaagggaacauacaugcacgcacgcacgcucacacauaaagagacaaaaagguuugaaaaaauaaggaaaugcugucaucuauaguaauguggauguacuaguauaguaauguggauguggaaaaagauuaaagugaaauaaguugugcacaaaaaaacaaaugccuuaugacuuugguguuauguaaaaucuaagagacaagucugacuuauuauuacucuaccaaacauuuaagaacaucuauaaaagcagagaaugagaugauguuuaacagaggucuggggaaaagaacauacagggaaaggagaaaugcugaucuaagaguacaacaugucaguuaagaaaaauaaagaagccagguguggugguggaugccuuuaaucccagcacuugagaggcagaggcagguggauuucugaguucgaggccaggucuacagagugaguuccaggacagccagggcuacacagagaaacccugucucaaaaaaaaaaaagaaaaaaggaaaagaaaaagaaagauuuagugauugcacaaaauaaugacuacacaguagugcaauagauauuucaaaauugcuaaggggagguuucauauaggaguggugaugcacaccuggauggaaucccagggagucacacacacaccaaccacacugugaggcaacagauuucuaaaucaucuugaagcucaugcugugccuuacaaaggcacacaaucacuacuuauugauuaaaaauagaauguagccagguauaaugaaugguacauaccuguaaucccaccaacugaggaggcuaaggcaggcagauugucaugaguuagagccuagacuagacuacacagcuaguacuggaacaucuagugaacacagcaaugcccugcagcaaaaaugaaacaaaaacaaaacgaaaaaaaaacaaaacaaaccccacccacuagagguaagauggcucacuagaucaggaugcuugcccucaugccugauaccucaguucaauucccucaaccuacaggacaaauucauccaaguuguucucccaauuccacaagcaugcauucacuggcacauaaacaugcacucgugagcaugcagacacacgugcacacaaauaaugaauaaaaaugaacaaagaacauucauuaaaaugucaaacgugaauauagauuuaggcaagggcuggacugaaagaacacguaaaauggcugcagagauggcucagugguuaagggcacuugcugcuuuugcagcgaucuauguuugauuccuagcucccacaugguucccaaccaccuguuucuccaguucuggggaagccaaugcucuuuuuugguuccucaaguaacaggcauucaugggugaacauacuauauaugcagguaugacauacauaaacauaaaaauaaauaaaucuuaaagaacacuuucgauuucauucacuuuucuguacuaacugaaaauuucuacuaugagcuucuauugucuuuauaaauggauaaaaaaaauaaagagcaguuaucgaaagagagaaaauauuaaucccaaagagguaaaagaauuuacucuuagauacuauguuaaguaucaaaacaacccagugaaagugccccuguguaacugaaaauagaacagaagaaugcaauuuucaguuccuuucaauaccuuuuuuauguaaauucccuauuuuacuaacauguuauucucuaauacacauucacagcacugagacuccccacaauuuaaaggguuuguuuugguuuuuuuuuaaauauuaaaggcagguuuauugggaagcugcucuggggugggcgaguucauuagccccaaggacagaggacagggaagucaccacuugcacagagagaagaggaaggggaggaagaagaggaagaggaggaggauaauaauuuuaaagguuuuaauuccauugccuuaaagaagucauauuucugauaccagcuugguauuuuugcuuccagcauccacuucaaagcuuauuaacaauuuccauaugugagauaaaaguaaccccaaacaaaaauaacaauaacuacuacuacuaccaaaaaaaaaaaaaaaaaaaaaagauaaaaagaaagugacauggggaggagggauaccaauuaggggaaaacuuagggauuacuuuauauauugauuuuucaggaauuuuaggguuucaaguaaaauaagaaagucugcucagacacuuccuaccauaacaagugacuuuaaauucaccaagaaaaacuaauuauuuuuccuagaaaguacaagauacagcaaauauaagcaguuuauaaguccauagguauuuuauuuacauuaaagugaaugagcacucuauucauuuuccaguaaauuaagacuuucuuuuuuuguuuauuuguuuuuuaaggugaggaucucauuaugcagcccuggcuggccucaaaugacgagaucaaccugccucugccucacauggcugggauuaaagauaugugccacuauaccuggcugggggauucuaaauaacaguuuuuauugucuguguguuuaaguguggagcacucaggcugugggcaugugaaugaaggucaaaggauaauuuuccagaaucagcucuuucaaaccaaauucaaaaauguacaguacauuuuuacccacuaaagucucucccuauaaaucacaauuacuuccacaauccuagagaauaugugaaccaaaauggcuagcaaguuucaugaugguaccuguacaaauugguuuucuuuacucugugaaagagaaagaggggaggagaucuuaaggaauuaaaccacuacuaccaaauacauuuuguaaauucguccuuuaguuuaccagcuaguaaggacaaacaaaugcagucagccaauuaacuaagguagaaucaggguacuuuuaacagaucuacagcaaaaauaaaacaaaagugcaguaaggagcacagaggaaaaaaugagcaugcagaggagugaacaaucaagauguuaagagcugagacuaaguuugugaaugcaagguaaacagcaaauauggaaaaaaagguugucaguguuucuucaagcuugaagaacaguuaucagggagauacagaaaauaaaagugggacuggugagauggcucagccgguaagaguacugacugcuuuucuggagguccugaguucaaaucccagcaaccacaugucacaaccaucuaaaaugagaucugaagcccucuucuggugugucuaagcacagcuauaguguacuuauguguaauaauaaauaaaucuuaaaagaaaaagaaaaagaaaaguguuugaaaaauaagaguagagauagaaugggguuagaucauuaaaggcauugaaucacaauguaucacaauguuuauaaucaaccuuacaaaagagacaaaaguauuuaacuacauaguuaaaaaacuucccuaauaaaccaugggcuagaauggguaggagaaaacaguuauauuaaaguagcugacuccuuuaaugcuggugguuccagaggcugaggcaggacuacccucagagugguggcacacgccuuuaaucccagcauuuaggaggcugaggcagguggaguucugaguuugaggccagccuggucuacagagugaguuccaggacagccagggcuacacagagaagcccugucucgaaaaaaaaaaaaaaaaaaaaaaaaaaaaaaaaaaaaaaagagagaagagaagagaaaagaaaagaaaaagaaaaaagaaaagaaagaaacugaacaggaguagaggaaggauauuaauaaggaagucugacccauuaauaaugacagccuacaugauggaaaagugccaggcuuaguggugcaugccuuuaguccuggcaaccagaagacaguagcagaucucagugaguuugaggccaaccuggucuacaaauggaguuccagguuguuacacagcgaaacucugucuuggaaaaacaaaagaauacaccccccccaaaagaaaagaaaagaaaagcaaauaauggaaaggcagauauaaauauuaguguuaagaggaaagaaaguuaaagaggacagaacacaugaaaauguaugguaaagacugaccugagaaaagagcaagacaugggaccaucuucugagaaugaauggaccauaacuuuuggaaacuaaacuguucacccuaagauccauucucuucaguuucugcacuuacucuuuaucuuacauuucugauacuuuuucuaugaagaacauaucaaaccagaagcauuuuuauaauaagaguuuaaagaaaaaaaaaaaaaaacccucaaguauucuagcuucacauuacuuugaacagcagcugugagaaugaaaucaucguagcgagguacaccauauaacaggcuaguaaacaccagugacuuccauuaugucugccugaggagcagaaauuagauucucagugucuugguauuauucaauagcaaagucugcagacccuugauguaacggagccuauacagaugggagacaaaacuaacuacaugcaugcagcccauccugauggacaucaaccugacuucaguaacuucaagucaacaccuccugcagcagauaagucaucaauaaguaauaaucuacaaauucagaugggaggaaaccaguggugggaugcuuaucuaacaagccagaggaccugaguucaucccaagccccaccaauaaauaaauaaauaaauaaauaagcaagcaaauaaaaaugauauucaagcugaaugcauuguuagaaacauuauguuucuuguauuuucaggcacggucucagugagguccaugcuaaccuagagcuaauccugaguacugauuauaagaugucaacccagucugccuagaaaauuucuuuaaaaaaaaaagaaaaaagguaaaagaaaaacuuuaggguuuaaaggcacuuuuugcucuuuguggagagaccuauguucaauucuuagcacccauaaggcagcucacaauuacuuauaauucugggcagaacaucugacaucuucugacccucuuaccucagcaggcaccaggccaacaagugguacacagacauauaugcagcaaaacacucaaaguuuuaacaaacugacaaguacccuuaaaagguugguuuaucuuuguuuuuguuuuuguuuuuucacacaaaacaggucaguacaaaagguaccacgaauaucaacuaagguuguauacagcacaauauuaaagacuuucaaaucagcuagcucagcuuuagaauucaaacugaccuugaugcaaagcacuuacauuuuugaagcauuuguuucauauuccaucagcaaaucacucaaguuuuggggguauuuguuuccuaauccaucagugggaacaaucaccacacagagcacugcacucagcacccuucuauuuccuuguauuaacacuccucacauuuauuauagggcuuaucaggaagaugauaagaauguacacaccucaacaaucaaagagugaagaggcaucuuuagucccauagcucaggaggcaaaggcagguggaucugaguugggaggccagccuggacuacagaacacaggaaagaaccuaccuggaaaaaacaaaaaagaaaaauacaguaaacagcuuuugaggagaaauuaagccaagaagauccauccaaugaaaugcaggagcuaagaaaugaagacacaaaugcaggcaaagagcauguuguaugguagucccuugaacagagaauuuauucuaugaguuaucaguuacgcucugggacaugauuucaauacuauauugaguauggauacacuuccuuuaaaaaaaucuacauggguaauucaucaguaugugggcuuggaaaaugucauauugaaguuucuuauaccauagcacguugucuauauuaauuauuuauucaaaugaagcagguaauagagagucacagugguagauucuauguucagucaacucuaucuaucaucccuucacuuaccuauucaacgauuauuaagaguguauaaccacccaaauacagugcugagcacuaggaauucaaugauggggaagacaggccagaugccacuuguggagcuuacaaucucgucuauucauuaaagagccagucaucugacucuacuacuaaaccuagaaacaaauaaaacuuuuugcauuaagcuggacaagugaauucauguuccucagcaguaaguacauuugcuauuuuucuaaaucuuguuuuucaaguaacuauuuagucaucaauucugguccucaaauuuuaagaauagcauuuaacaagcaacacaaugcaaacaaacaaaccaaacaaacaaaaacaaaauaaaaaaccugaaguccauaccuuguaauaauaauaaaaaaaaaauuccaaagcuauuggcccagagagaagaccuggaaacaugacaacuaucuuccaagauuuaaagaacuaguucacaaacuuguuguguacauuccaaagcauuauacacagaugcagauuucuauuuccauaugaagacuuuuaacaauucaaacuauucacaauucaaccacuuuagauuucuuuagggaaaucuauacuuuauaaaauaaaaaggcaaguauuaaauauuacuguuuagcaaacuaagucgucaaugguuuugcuaagaagccuaacaaaucaugcaguaaagaaacugggaaaaucaucucugaacucaaguccaacaaagacugcccaaacaauguguucccaccuacugauguauucaggagugaaccacauagccaguuguuagaaauguugaccaauauuacugaaaagcuucuuccaaaaaugaacccuuuggaaauacagcuggucaauacacacaccaugaagacucccuaguaaauguacuuucuauaugcuagcucuaugaggacaguaacuuugucuuucuucacugcuacacugcccugccaaaacuaucacugacauauaauaugugcucuuagauauuugcuaagcaugcaguccuaaucacacaaacuguacuauguaguacacaccaccaaccuuacuaaaccuuaccaaaucuaaccacguuauuuaaauugccauuacauacuuaaaugacuauauaaaguuauaaaacuuuaaaaaccuagucaauccuaggacuaguuuaccaaaccauaaaaccuagauggcccaaauauguuaaguaauauaagaagcuacaagaccugcaaaguacucaaaagcuacuuuuaauucacucuacaaaauagauauguaucaauauacacacauuuucagacuguuaccguauaacaauggcuuaacagcuauauaaaagcaguauucaaauuucagauuauauuaucucuacaaaaauuucugaacacguucaugagaauuguuauuacuuaaaaggccuaacuuuacagugagcaguuucagauuuauaguggccugagaauguacuaagccauucacgcaguuacgcuguaccacuauauccacuuauauauauuauuggcaacuggguacuggacauagcugucauuucccccuccuuuuuaaaaccaugacuuugaaagaucagauuuaaaaaaaaaaaccuacccaacacaagaaucacucucauauauaauuuaucuucaaacuauuuuuaucaacaucuacuuacauguauuuugaguauuaaacuuuacaaaagcugcuuuucccauccccguauuaaccacaugaaacaucugcaauccuuaucuaacugacaucaccuccugaaucugauugcucuuuaauauaagucccuguauauuaguaaagcaccaacaaagugacguuuucuccauaagcagguauuaagacaaauuaagccaaaauagcaaugcuggaaaaggagagcauuuugcacuaaccugcugacaguuaaaagcaacaaguuaaaaacuuugaacucuuaggacucaucccugccuaggcuggucgcuuggucccucccacccucacaggugcauucagcacuccccucuccgcuagaaacccacccuccgacccggagcgcuggccugggaagcggaccgaguaaaccagaggcgccucgccccaccuuccccgccuccuaggguuggggggacaggacucaccugaguacugggcuguaggggcugcgcgagcgccgccagcugcugcugcuguacgggcugggggauacgucgccgccccgcucguaggagcuguggcggcuguagcugggcgagcggcgccggcuauaggggcucggggagcgcggcagccgccgggaauaaggacugcugccaccucccgccggacugggggacuugcggcuccgaaggcucugcgaggcccugugggacaccgggcuuucgucccggccucccagcgggcucagggaccgcugccgccgccuguaggccuucggcucgcucuuguccucccgguaggccuugggcggcuccuuguaggccgagggcgguuccuuggacgacuuaguccggcugcggugggccuugaggucccgguccuugcggcugcuacugcugcuggacguagccgacgcgcucuugcggcggccgccgcugcugcugcugcugccgcucuuggcggccuccgcccgcuccucgccgcuguguccguggcggcugcgggccuuugaggccucgcugccgcugcgcgucccgucccgccgccggugcucgcgguggcgcuccuugcugcggccgcugcugcugcggcggucccggcgcggccugcgcuccgaccccuccgcgcgccucugcgugccggaggaggaggccggacucccgccguugccccccguucccccggcagccgucgccgccguugccgcgcuggcgccccccagcagcagccccugcucggacugggagcucacauccucguacuccaccagcggggucacacccccgccgcuacuggcaccgccaccgccguccugcugcggcuggggcagcgagaagacccggcgcuucuccgccuccugcccggcgcggggcccgcggcgccgcuucugccgcccuccggggcgccucuugccucucgccagccgcuugaccuccagaggagggcccgggcugaagcaagaggaggaggccgcggcggcggcggcugcggcggcggccgcgccgggggcagccaggaagagcagaggcggcgggggcggcggcgguugcaggagcugcggcugcaggagcggcaacagcagcggcggcugcugaggggacaggaaucgccuccgcuugcggcgcuccuccaacuucuucucggcccagcucaggcccccgccuccccccagcgccguguccgagcuacucggcaucgccuagagcccgccgcagagugcggcgcgggugcggccuccuccggggucagacccuggccaugucccccgccgggaagggggacggcagccgcggcggagggguagcgagcagcagggccggccgggagucgcgccacgauaauccgggucgggacgcgcguccccgguuccagucgcggugugugcgcagcggcgucagggccuggcgcgggaggauccuauccucggcggaaagccggccgugccgggcggcggcgguggcggcggcggcggcggccucgggcuccggcggcgcaacgcggaagugccaccgcgggccgcgcuucacuccaucguccugacgucgggggcgagcucgcgggagggcagugggcgcgaccacagcacgccuccgucgccggccggccgcggcgcguccacgucguccuguggcggcggcggcgacaccccgcggcgcucggacgggccugggccuggcgccccgagggcacugcgcgcagcuuccggagcgggggcgcggcucgcuguccuccgccccuccacgcgggcuccgcgcgcgccgcucgccccucccugcccuccgcguucucccugcgggacggcgacgcgacuggcuggccgagcccucgccgcgcaccacccacucgcc

SEQ ID NO: 6909 - RNA, 91301 nt, Mus musculus
ggcgaguggguggugcgcggcgagggcucggccagccagucgcgucgccgucccgcagggagaacgcggagggcagggaggggcgagcggcgcgcgcggagcccgcguggaggggcggaggacagcgagccgcgcccccgcuccggaagcugcgcgcagugcccucggggcgccaggcccaggcccguccgagcgccgcggggugucgccgccgccgccacaggacgacguggacgcgccgcggccggccggcgacggaggcgugcuguggucgcgcccacugcccucccgcgagcucgcccccgacgucaggacgauggagugaagcgcggcccgcgguggcacuuccgcguugcgccgccggagcccgaggccgccgccgccgccgccaccgccgccgcccggcacggccggcuuuccgccgaggauaggauccucccgcgccaggcccugacgccgcugcgcacacaccgcgacuggaaccggggacgcgcgucccgacccggauuaucguggcgcgacucccggccggcccugcugcucgcuaccccuccgccgcggcugccgucccccuucccggcgggggacauggccagggucugaccccggaggaggccgcacccgcgccgcacucugcggcgggcucuaggcgaugccgaguagcucggacacggcgcuggggggaggcgggggccugagcugggccgagaagaaguuggaggagcgccgcaagcggaggcgauuccuguccccucagcagccgccgcugcuguugccgcuccugcagccgcagcuccugcaaccgccgccgcccccgccgccucugcucuuccuggcugcccccggcgcggccgccgccgcagccgccgccgccgcggccuccuccucuugcuucagcccgggcccuccucuggaggucaagcggcuggcgagaggcaagaggcgccccggagggcggcagaagcggcgccgcgggccccgcgccgggcaggaggcggagaagcgccgggucuucucgcugccccagccgcagcaggacggcgguggcggugccaguagcggcgggggugugaccccgcugguggaguacgaggaugugagcucccaguccgagcaggggcugcugcuggggggcgccagcgcggcaacggcggcgacggcugccgggggaacggggggcaacggcgggaguccggccuccuccuccggcacgcagaggcgcgcggaggggucggagcgcaggccgcgccgggaccgccgcagcagcagcggccgcagcaaggagcgccaccgcgagcaccggcggcgggacgggacgcgcagcggcagcgaggccucaaaggcccgcagccgccacggacacagcggcgaggagcgggcggaggccgccaagagcggcagcagcagcagcagcggcggccgccgcaagagcgcgucggcuacguccagcagcaguagcagccgcaaggaccgggaccucaaggcccaccgcagccggacuaagucguccaaggaaccgcccucggccuacaaggagccgcccaaggccuaccgggaggacaagagcgagccgaaggccuacaggcggcggcagcggucccugagcccgcugggaggccgggacgaaagcccggugucccacagggccucgcagagccuucggagccgcaagucccccaguccggcgggagguggcagcaguccuuauucccggcggcugccgcgcuccccgagccccuauagccggcgccgcucgcccagcuacagccgccacagcuccuacgagcggggcggcgacguaucccccagcccguacagcagcagcagcuggcggcgcucgcgcagccccuacagcccaguacucaggugaguccuguccccccaacccuaggaggcggggaagguggggcgaggcgccucugguuuacucgguccgcuucccaggccagcgcuccgggucggaggguggguuucuagcggagaggggagugcugaaugcaccugugagggugggagggaccaagcgaccagccuaggcagggaugaguccuaagaguucaaaguuuuuaacuuguugcuuuuaacugucagcagguuagugcaaaaugcucuccuuuuccagcauugcuauuuuggcuuaauuugucuuaauaccugcuuauggagaaaacgucacuuuguuggugcuuuacuaauauacagggacuuauauuaaagagcaaucagauucaggaggugaugucaguuagauaaggauugcagauguuucaugugguuaauacggggaugggaaaagcagcuuuuguaaaguuuaauacucaaaauacauguaaguagauguugauaaaaauaguuugaagauaaauuauauaugagagugauucuuguguuggguagguuuuuuuuuuuaaaucugaucuuucaaagucaugguuuuaaaaaggagggggaaaugacagcuauguccaguacccaguugccaauaauauauauaaguggauauagugguacagcguaacugcgugaauggcuuaguacauucucaggccacuauaaaucugaaacugcucacuguaaaguuaggccuuuuaaguaauaacaauucucaugaacguguucagaaauuuuuguagagauaauauaaucugaaauuugaauacugcuuuuauauagcuguuaagccauuguuauacgguaacagucugaaaauguguguauauugauacauaucuauuuuguagagugaauuaaaaguagcuuuugaguacuuugcaggucuuguagcuucuuauauuacuuaacauauuugggccaucuagguuuuaugguuugguaaacuaguccuaggauugacuagguuuuuaaaguuuuauaacuuuauauagucauuuaaguauguaauggcaauuuaaauaacgugguuagauuugguaagguuuaguaagguuggugguguguacuacauaguacaguuugugugauuaggacugcaugcuuagcaaauaucuaagagcacauauuauaugucagugauaguuuuggcagggcaguguagcagugaagaaagacaaaguuacuguccucauagagcuagcauauagaaaguacauuuacuagggagucuucaugguguguguauugaccagcuguauuuccaaaggguucauuuuuggaagaagcuuuucaguaauauuggucaacauuucuaacaacuggcuaugugguucacuccugaauacaucaguaggugggaacacauuguuugggcagucuuuguuggacuugaguucagagaugauuuucccaguuucuuuacugcaugauuuguuaggcuucuuagcaaaaccauugacgacuuaguuugcuaaacaguaauauuuaauacuugccuuuuuauuuuauaaaguauagauuucccuaaagaaaucuaaagugguugaauugugaauaguuugaauuguuaaaagucuucauauggaaauagaaaucugcaucuguguauaaugcuuuggaauguacacaacaaguuugugaacuaguucuuuaaaucuuggaagauaguugucauguuuccaggucuucucucugggccaauagcuuuggaauuuuuuuuuuauuauuauuacaagguauggacuucagguuuuuuauuuuguuuuuguuuguuugguuuguuuguuugcauuguguugcuuguuaaaugcuauucuuaaaauuugaggaccagaauugaugacuaaauaguuacuugaaaaacaagauuuagaaaaauagcaaauguacuuacugcugaggaacaugaauucacuuguccagcuuaaugcaaaaaguuuuauuuguuucuagguuuaguaguagagucagaugacuggcucuuuaaugaauagacgagauuguaagcuccacaaguggcaucuggccugucuuccccaucauugaauuccuagugcucagcacuguauuugggugguuauacacucuuaauaaucguugaauagguaagugaagggaugauagauagaguugacugaacauagaaucuaccacugugacucucuauuaccugcuucauuugaauaaauaauuaauauagacaacgugcuaugguauaagaaacuucaauaugacauuuuccaagcccacauacugaugaauuacccauguagauuuuuuuaaaggaaguguauccauacucaauauaguauugaaaucaugucccagagcguaacugauaacucauagaauaaauucucuguucaagggacuaccauacaacaugcucuuugccugcauuugugucuucauuucuuagcuccugcauuucauuggauggaucuucuuggcuuaauuucuccucaaaagcuguuuacuguauuuuucuuuuuuguuuuuuccagguagguucuuuccuguguucuguaguccaggcuggccucccaacucagauccaccugccuuugccuccugagcuaugggacuaaagaugccucuucacucuuugauuguugagguguguacauucuuaucaucuuccugauaagcccuauaauaaaugugaggaguguuaauacaaggaaauagaagggugcugagugcagugcucuguguggugauuguucccacugauggauuaggaaacaaauacccccaaaacuugagugauuugcugauggaauaugaaacaaaugcuucaaaaauguaagugcuuugcaucaaggucaguuugaauucuaaagcugagcuagcugauuugaaagucuuuaauauugugcuguauacaaccuuaguugauauucgugguaccuuuuguacugaccuguuuugugugaaaaaacaaaaacaaaaacaaagauaaaccaaccuuuuaaggguacuugucaguuuguuaaaacuuugaguguuuugcugcauauaugucuguguaccacuuguuggccuggugccugcugagguaagagggucagaagaugucagauguucugcccagaauuauaaguaauugugagcugccuuaugggugcuaagaauugaacauaggucucuccacaaagagcaaaaagugccuuuaaacccuaaaguuuuucuuuuaccuuuuuucuuuuuuuuuuaaagaaauuuucuaggcagacuggguugacaucuuauaaucaguacucaggauuagcucuagguuagcauggaccucacugagaccgugccugaaaauacaagaaacauaauguuucuaacaaugcauucagcuugaauaucauuuuuauuugcuugcuuauuuauuuauuuauuuauuuauugguggggcuugggaugaacucagguccucuggcuuguuagauaagcaucccaccacugguuuccucccaucugaauuuguagauuauuacuuauugaugacuuaucugcugcaggagguguugacuugaaguuacugaagucagguugauguccaucaggaugggcugcaugcauguaguuaguuuugucucccaucuguauaggcuccguuacaucaagggucugcagacuuugcuauugaauaauaccaagacacugagaaucuaauuucugcuccucaggcagacauaauggaagucacugguguuuacuagccuguuauaugguguaccucgcuacgaugauuucauucucacagcugcuguucaaaguaaugugaagcuagaauacuugaggguuuuuuuuuuuuuuucuuuaaacucuuauuauaaaaaugcuucugguuugauauguucuucauagaaaaaguaucagaaauguaagauaaagaguaagugcagaaacugaagagaauggaucuuagggugaacaguuuaguuuccaaaaguuaugguccauucauucucagaagauggucccaugucuugcucuuuucucaggucagucuuuaccauacauuuucauguguucuguccucuuuaacuuucuuuccucuuaacacuaauauuuauaucugccuuuccauuauuugcuuuucuuuucuuuucuuuugggggggguguauucuuuuguuuuuccaagacagaguuucgcuguguaacaaccuggaacuccauuuguagaccagguuggccucaaacucacugagaucugcuacugucuucugguugccaggacuaaaggcaugcaccacuaagccuggcacuuuuccaucauguaggcugucauuauuaaugggucagacuuccuuauuaauauccuuccucuacuccuguucaguuucuuucuuuucuuuuuucuuuuucuuuucuuuucucuucucuucucucuuuuuuuuuuuuuuuuuuuuuuuuuuuuuuuuuuuuuuucgagacagggcuucucuguguagcccuggcuguccuggaacucacucuguagaccaggcuggccucaaacucagaacuccaccugccucagccuccuaaaugcugggauuaaaggcgugugccaccacucugaggguaguccugccucagccucuggaaccaccagcauuaaaggagucagcuacuuuaauauaacuguuuucuccuacccauucuagcccaugguuuauuagggaaguuuuuuaacuauguaguuaaauacuuuugucucuuuuguaagguugauuauaaacauugugauacauugugauucaaugccuuuaaugaucuaaccccauucuaucucuacucuuauuuuucaaacacuuuucuuuuucuuuuucuuuuaagauuuauuuauuauuacacauaaguacacuauagcugugcuuagacacaccagaagagggcuucagaucucauuuuagaugguugugacaugugguugcugggauuugaacucaggaccuccagaaaagcagucaguacucuuaccggcugagccaucucaccagucccacuuuuauuuucuguaucucccugauaacuguucuucaagcuugaagaaacacugacaaccuuuuuuuccauauuugcuguuuaccuugcauucacaaacuuagucucagcucuuaacaucuugauuguucacuccucugcaugcucauuuuuuccucugugcuccuuacugcacuuuuguuuuauuuuugcuguagaucuguuaaaaguacccugauucuaccuuaguuaauuggcugacugcauuuguuuguccuuacuagcugguaaacuaaaggacgaauuuacaaaauguauuugguaguagugguuuaauuccuuaagaucuccuccccucuuucucuuucacagaguaaagaaaaccaauuuguacagguaccaucaugaaacuugcuagccauuuugguucacauauucucuaggauuguggaaguaauugugauuuauagggagagacuuuaguggguaaaaauguacuguacauuuuugaauuugguuugaaagagcugauucuggaaaauuauccuuugaccuucauucacaugcccacagccugagugcuccacacuuaaacacacagacaauaaaaacuguuauuuagaaucccccagccagguauaguggcacauaucuuuaaucccagccaugugaggcagaggcagguugaucucgucauuugaggccagccagggcugcauaaugagauccucaccuuaaaaaacaaauaaacaaaaaaagaaagucuuaauuuacuggaaaaugaauagagugcucauucacuuuaauguaaauaaaauaccuauggacuuauaaacugcuuauauuugcuguaucuuguacuuucuaggaaaaauaauuaguuuuucuuggugaauuuaaagucacuuguuaugguaggaagugucugagcagacuuucuuauuuuacuugaaacccuaaaauuccugaaaaaucaauauauaaaguaaucccuaaguuuuccccuaauugguaucccuccuccccaugucacuuucuuuuuaucuuuuuuuuuuuuuuuuuuuuuugguaguaguaguaguuauuguuauuuuuguuugggguuacuuuuaucucacauauggaaauuguuaauaagcuuugaaguggaugcuggaagcaaaaauaccaagcugguaucagaaauaugacuucuuuaaggcaauggaauuaaaaccuuuaaaauuauuauccuccuccucuuccucuucuuccuccccuuccucuucucucugugcaaguggugacuucccuguccucuguccuuggggcuaaugaacucgcccaccccagagcagcuucccaauaaaccugccuuuaauauuuaaaaaaaaaccaaaacaaacccuuuaaauuguggggagucucagugcugugaauguguauuagagaauaacauguuaguaaaauagggaauuuacauaaaaaagguauugaaaggaacugaaaauugcauucuucuguucuauuuucaguuacacaggggcacuuucacuggguuguuuugauacuuaacauaguaucuaagaguaaauucuuuuaccucuuugggauuaauauuuucucucuuucgauaacugcucuuuauuuuuuuuauccauuuauaaagacaauagaagcucauaguagaaauuuucaguuaguacagaaaagugaaugaaaucgaaaguguucuuuaagauuuauuuauuuuuauguuuauguaugucauaccugcauauauaguauguucacccaugaaugccuguuacuugaggaaccaaaaaagagcauuggcuuccccagaacuggagaaacaggugguugggaaccaugugggagcuaggaaucaaacauagaucgcugcaaaagcagcaagugcccuuaaccacugagccaucucugcagccauuuuacguguucuuucaguccagcccuugccuaaaucuauauucacguuugacauuuuaaugaauguucuuuguucauuuuuauucauuauuugugugcacgugugucugcaugcucacgagugcauguuuaugugccagugaaugcaugcuuguggaauugggagaacaacuuggaugaauuuguccuguagguugagggaauugaacugagguaucaggcaugagggcaagcauccugaucuagugagccaucuuaccucuagugggugggguuuguuuuguuuuuuuuucguuuuguuuuuguuucauuuuugcugcagggcauugcuguguucacuagauguuccaguacuagcuguguagucuagucuaggcucuaacucaugacaaucugccugccuuagccuccucaguuggugggauuacagguauguaccauucauuauaccuggcuacauucuauuuuuaaucaauaaguagugauugugugccuuuguaaggcacagcaugagcuucaagaugauuuagaaaucuguugccucacagugugguuggugugugugugacucccugggauuccauccaggugugcaucaccacuccuauaugaaaccuccccuuagcaauuuugaaauaucuauugcacuacuguguagucauuauuuugugcaaucacuaaaucuuucuuuuucuuuuccuuuuuucuuuuuuuuuuuugagacaggguuucucuguguagcccuggcuguccuggaacucacucuguagaccuggccucgaacucagaaauccaccugccucugccucucaagugcugggauuaaaggcauccaccaccacaccuggcuucuuuauuuuucuuaacugacauguuguacucuuagaucagcauuucuccuuucccuguauguucuuuuccccagaccucuguuaaacaucaucucauucucugcuuuuauagauguucuuaaauguuugguagaguaauaauaagucagacuugucucuuagauuuuacauaacaccaaagucauaaggcauuuguuuuuuugugcacaacuuauuucacuuuaaucuuuuuccacauccacauuacuauacuaguacauccacauuacuauagaugacagcauuuccuuauuuuuucaaaccuuuuugucucuuuaugugugagcgugcgugcgugcauguauguucccuuuucaagugcaacaagcacugguaacugcugugccauauuuccaacuccccaaacuacauuauuauuauuauuauuauuauuauuacuacucuacuaccaauuuaaguuauguguacauguaucucuguauggguuuguacaguguacauggaagucaaaagguauuggauuuccuggaguuaagaguuagaggggguuguaggcugcucagcaaggaacagagcagagcaugcucaaccacugagccaucucuccaggcugguuuuccuuuuuacaguauuuuacucuguacacauguaccgcuuuuuuuaaccugaucaucugguaaugaaaacugaugucacucccuauauugacuauugugccauaguaagcaugggaguauaacauuuuaguucacugauuuauauggagaagucagauuacugaaucaugugacaauacuauuuuuaaaguauugagggacccuuauaccgccuuccauaaugguuuuguuaauucucauuaguaccaacaguacaaaauaguucccuuuucuccaguaccccaccagugcauuucaguuuuauugucaguuuucuuaucauaauacucaacaucuucccaaauacuuauucacccaucacauuuuuuuaguuguuuaaauuuuucauauuuggaauuagauugcuuaauguuuugccagauagugcaaugucuugcucuuuacuucaauaguaauuucagaaagcaaaagcuuaccauuuuuauaaauuccaaguagcauuuaugcuugucaacuuuuaugauuuauaaaauuggguaauaaaaaaaacuuugucuaaccuugaagugaaaaagauuuucuucuugguucauggguucaucuuuauguguaaugguauuucacuagcauacuuuucaauuaugaguuguccagguguuuguauucugauguuaauucugcuuccucaagagggguugccacugaugaggggcccauuacaagcucgggugaucuuaugggaaccuucuccccauuuuaacuggucaauaaaggcuagagcuugugauugggcaguggaggagaaaggugggacuggaguuuugagagugggugcagguagagagagaggcagaagaguaccagaggggaaggagagagaacugaagaggaggaggaggaagccuugaugggccagaagaaacugcaaguaacaaggggucuuuuagcuagggaauaaauuaguauaguguuagaucugccccaucuaguguguagcuuauaauuauaguaacuggauuguguguuuuuauaagggcuuauugggguuggaaauuccagcaacaccaucuuccuugcauauucuuaguagauuaguuauuagacauguaugacacgugucuuaucuauagacacagaauuuuuaaaugugggagucauauuacuuauauacuuaccuuuucaaaugcuuuucauucccuuuguauaggucuaacuuguugaauuuccucuggccagugugauagaguucuuagaaugcagucugcuaguuuguauauaaguuucuauuuugaaagauauuucuccugauuguagaauccuaaaucaauauuauuucuuugucaguauuuugaacugucuacaccuggcuuccauacuuuggugagaauuuuucauuuuguuucagccacuuaauuuuauauccaguaagauuuuuuuugagguaguaucuuuuaacaucuagcacaguauaugacauuuaaguaccuagaaaaugauauuaaccugauuuagacaaaaaaauguuaacaccaaccaccgguucuuuaaauguguucauguuaaaaagucuaaaaugacccugagaaauguaguauguauguauguauguauguauguauguauguauguauguauaugcaccuuaaugcaaacuagacacagaguuuucugguacucagacuuucuuuaucugacauccaugggaggggagggaggcuugaugacccagaguagggggaugcuagagggaugaggggagugggugaguggguagaggagcgcccucauagaggcgggggcgggggggcuagagggaaugggaugggaaggucuguggacagguaaccaggaagggggauaucauuugaaauguaacugaacaaaaugauuaauuaaaaaaaaaaggaaaaaagaaaaagaaacauauuucaggucaugguucagugaaacaaugaagacaguuuaggcuuaguagacuagaccuuguuacagaaaauguguaaaauguuaguugugugucuuuuuuuuuuuuaaauauguauuaguugagcauaaaauggaauaaagugccaauacuuuuuuacauuuuaucuucaacuaauacucugcuauacagagaacacuacguuuuacuauuaauuaauggacaucugaguuacuaacuuuuucacuguuaagauuauugcuccaugcuggaugauggugacacaugccauuauuugggaggcaucauuugggagucagaggcuggugggucucuaugaguuugaggucaguugguauguagagugaguuccaggguagccagagguauauacauagagaagcccugucuugaaaaaccaaaccaguccuccccugcccccauacccccaaaauuaugcucuuaugagccuuuauuguauaaaguuuuuaguguuuucacuucuuuucagguacauaccuaagauuuguugggucaugucauuuuuaacauuuugaagaaccaccaaaccauuuuucauaguaacugcaucaguuuuacacuggcaaugaauggggaccuccacuuauucuaccucaaacccacagaguguuuuugaauuauagccaucuccuacuugaauauauuaguauacugacaauuuuggaguuuugguuucuuuuaaaaacacugaaauauuauaagaaguuuuuguuuuacuccuaggugcaggauauggggcugcuucagauuguccacagcaguugacuguaacugccuugugcucuagcaggagcagguuuugccagccgcagauaguuucugugguucugugacauuuggaauucuggggacuuuucagaggguauauaaugcuagggucccaagaggcaggcgguggagguuggagguuacuguugguugcugucggucaugguuuguuagguaguugugcacaaagaaaaaacaaauucaguauccugauggcaaggaucaaacuugucccagcuggaagaggucuaucuagugauaaaacguuguucuuuuucugaccccugacuuuauucggggaucucuuucccuuccucucuauacauuuuuccucacuucuguuaggggguugaaaggguggaagaaaaaggguggaguaggguggaauaaagaagaacucacaaaguagucaaaaacagcuacaugucaguguuaguggcuuuucaguaaguguuacaguuuucucuuaacccagcuagcucuuaaguaauugagacuggacuaaaauuuaacaagcuuuuaggcagaacaguauugagcaguuacucucuauucuaauccucuaaacugguuuggcuaucucccagucaaaauccauaagauucuugcauuuuuugggcuuucucagcuccagcagucccugccuuucuuucuuugacucccuccccuggcugacagaaguccaggccuauucucuucccugcucacucagucauugguuguuagucucucuuuauugacacaucagggaacaacuggggagcugaucuuuacacaagauugagccuggauauuucucugaauaaggauuucaaggagauauaggggagacagaaaucaucaauggaaucuucacauagugcacaauaacauuauguccacacgccaguaugauuuuauuuacauuucuuugagggauugugaaguugagcauaguucuuggacagcugaguaucuuuuuuuuauuauuacuuaaauauuuucucauucuuaccacuuaacuuguuauaauagugcuguuuugucugccccucccgcccccccccccccccccgcccccguggaauuuuugguuagucugguagccccagagauccugcuggggguuauaggugggaaucugaacucaaggccucaugguugagcagcagguucucuuaaccacagagccaugucuccaggcuuuugucuuuucaaagaacuaguucuuucuuuguuucauugguuucugucuuuuuuuuuuuuuaauauuaauuucuuguguuugagacagggucuguaguauagcucaaaauuagggaugaagagaacacuuguaguuuuugguuuuuaauuauucaggauuguuuuggcuauccugcuuuccauuuguuuguuuccugugugucuguaugaaauuuaagaauaguuagcuucugaggauagcauaggguuugguggggaauugaauccauaaguugcuuuugagaggauggccauuugacaauauuaauucuagcaaacuauaugcacagcagggaaucuuuaauuauuauuuuuuuuuuguuuuuuguuuauuuuuuguuuuuuguuuuuuuuguuuuucgagacaggguuucucuguguagcccuggcuguccuguaacucacucuguagaccaggcuggccuagaacucagaaauccaccugccucucaagugcugggauuaagggcaugugccaccacugccgggcaaucuuuaauucuuuugcuauuucccucaguuucuuuacuuucuuaaaacuuaauuaugcaagucuuuuuucuuuuuuacuuuuuugagauuggauuucuauauuauauagcccuggcugucuggaacucacugcuguauagaccagacuaaccuucagcucaaagagauccaccugucucugccucccaaauucugggauuaaccaucacaccaguccccuccccuccccuccccuccccuccccuccccuccccucccguccccuccccuccccuccccuccccuccccuccccuuccuuucccuucccuuucugccugccuaccugccuucuuguucugcucuccuuuuuaguauguuugguauuuauauaaaaggcgauuuucuugggguguguguguggaguuuuauagaaucaggucaucugcaaauaaggauacugugauuucuuccuuuucuauguggauucacuuuuguuccuucacuuuuaacauuucugauuuugcuggaaaugcuuugaguauuucuuuguuuagugugugguuguugguauuucuauauauugccuuuauuauguugagauauguuccugguaucccuguaaucuuuaggauuucugucaugaaaagaugcugauuuuugcaaaggccuuuucuccaucucaugagaugaucaugugaugucugauuuuagucuauguaguggguuauauuuauugguuuauauguguugaacuaucuuuuuuuuuuuugguuuuugguuuuugggguuuuuuuugguuuuugguuuuuugagacaggguuucucuguauggcccuggcuguccuggaacucacuuuguagaccaggcuggccucgaacucagaaauccgccugccucugccucccgagugcugggauuaaaggcgugcgccaccauguccggccugaccuaucuuuuuaucucuuggaugaagcugaucuaacuaugauggaauaucugggauaaagccaauuugaccaugaugucuugucuuuucugugcguucuugaacucauuuugcaaguuuacugaugauuuuuguauuaguguuucaucagaaagauugguguaucuuuuuuugggggggggucuuugguuuugguguagggcuucauaaaaaggauauggaaguauuccuucauuuucuguuuuguggaauaaauugagagaguugauugaaggucugguagaauuguacacuguagacaccugauucuguggugucguuucauccuuuuaguugugaaacuacugcuucuuucucacugguugugaggaaucuguugcucauuucaucuugauuuacuuuugguaggucaugguuaucuugaauuucaucuauuuuagcuuuuucaguuuaguggaauuauaaacuuuuauauuauggccuuaggauuuuauuaauuuccucagcaucugcugaaauguuucucuuuuuucaucucugauuuuuauuaauuuguauccucuuuugauuaauuuguccaaagguugucaauuuucuuaaucuuucaaagaaccaaagaacucacugaguuuuuuguaauauuuuucacuucuauuuuguuaauuuuaccccugauuucuauuucucucucucuccuuuccccuucucccucccccucccucucccucuccuuucccucuucucucuucuuucucucucccucucccccauucccucuccuuacucuacuuucaccccccccacucucccugccucucucccccuccuccucucccucccucuccucucucugguguuuuuuguuuuccaagaccuucaaguguaacauuaaauuauuaaugagcgaucucuccagauuugugcucuaagaucucuucauugugucuugcagguuuugguuugcauuucauucacuucuagaaguucauuaauuaucuuccugauuucccccaagaaagaauuuucacucauugguguguuuagcuuuuaugaguuuguguauugucuuuuuuguuguuguugauauuauuauuauccagcuuuauuccuuugugaucagguagaauguagcaugcuauuuuaauuuuccucacuauagugacugauuuuuguuguuguugucuauuuuggagaaaguucuaugggccacuaagaugaaaguguaucuguaguguuuggcagaauguucuuucucuaaagguccaauagcucgguuucauuuaugaugccauuuagcuguagaauuuuucucaggauaaucuuucuauugauaaguugggauauugaagucauucacugucauuguguuguggucaaucuguuauuuuuugaucuuauaaugcuuucuuuuaugaaauugaugcacacaugcuugauguguaaauguuuaggaauguauuauccuuuuggugaauuuuuccuuuaaugaguauaaaaugccuuuuccuaucucuuuuaacuagauuugguuugaagucuguuuuaucagauauuagauuggcugugccugcuuauuuuaguuucauuugcuuggacaccuuuuuuccauccuuuauccuaagucuaucacugauggugagauauuuauuuuagaggcaguaaaagauggauccuguuuucuuuuuuccuuccuuccuuuauuuuuuuuaaauuuuauuuuuauuuuauuuuauuuucgagauagggcuucucuguguaacaauuugaacuuggaacuugcuauauagaccagacuggccuugaacuugagaucugccuaccucugccuccacaguacuggauccuauuuucuaaugcaaucuauuccuguccuuuuaucaggaaauugagauaauuaauacugagaauuauuauuaaaaauguuuauuuauuccugccaucuaguugugguguuuuuuuuuagacuucauuugguucacuguuaauaggauuauauauuguuuucuggauauaguuuaccuuuuuuuagacugauauauccacuauacaacugacuugguuuacauaaauuccuuaaguuuguuuuuauuaugguaaguuuuucuuucucuuuugauugugaaugguaaguuucguuucccugguauaguauuuuaaguugucuguauggucuuuuaaagguuacagaaaucaguucaggaccuuauauggcuuucaaacuaugauuuuaaaguuauuuugauguaccugccauucuauguggcuugauuuuccucucuuguagccuucaauaugcauucuuuguuuuauacauguuuuaugugacauggggaauuuuuuuuuuccaugucaauuugauguuuuguaucucuuuugcaccuuggcagcuucucuuuuguuuuuuuggggugaaaauuuucuucugugaucuuguugaaaauauuuucugugacuuugaauuggauuucuucuuuuccuauauguauaguuacuuuguaauguuccaaauuuccugcuaauucuguuccagagguuuuguuuuuuuuuaauuuaaauuaauuaauuaauuaauuuauuuuuaaagauuuaauuuuuuucauggaauuacccacuucucuguuuugucuuuaagaccuuuuccacaucauucaauacuuuggugagacuuuuccucugagcuuuuuguuuugcuucuugaacuuuucauuugaguuuuauuuuaauugagcuuuucuuuagagagucucuuuaguguuggaaauuaguuacagagaguggucuacucauagaagaugaaauaaguagcaccauaguaccugaugcccugaauaccagucauagaaaagaaaaggacaucucaacucuacaaaaacauuguacccccugcacauuacaaauauuuccaauuggaagaugacaagaaagaaaaauuagauuaaaaauguguuuuuaaaucucgaacuauuuuuuacuauuucagucaacugugcuuuugaaguuuucauucaguuagagguuuguacauauacucugauuuuuuugaagauauuuguaauugcuauuuugaagucauuguacauuaagcuagguugcuuuucuuggggaauauuaugcuagggggcuaaugucagaaguguguuuugguaucggcaucuggucucccauuuauuuguuaauuggguguuuggaucuuugcuugcuguuaucccaacuuauuuuguuuggaucagcagaauggugcuuguuuuucauucauagaaccauucuguugaugguuaaauagcaugucaggugugguauuggcucagguagggauaaguaccgauuucugagccuauuuuagucuuagaagauucucacuguugaucucagaaguuuguggaaggcacgcuagauucugaaaauagucuuuggguagcaggggcuagcuagggucagaguggaaaugaguagugcucugugggggcugggagcagaucauagaauaucacauuguucucagauagaggaggcuaguccuggagucuguaugugggguuaggagcauagggcacuaugguucuaguguaucuugguaaauggguuugacugguuuggaaguuccuuaccuguaauucuugguacauguagcuucaugugguuucauguauguggaaugguggguaggguaggcagaauggauaugggggaccucuuuugacuucugauuuggacucucaagcguugcugugguaggcgggaguuaguuguuaggcuuuggacaagcagagcucagauaccugcuucucugcugugacuguccuguuucccuuuuaaaagcauuuuuaugugugugggugcuuugcauauuuguuuuuauguguaugggugcuuugcauauuuguuuggguacuauguguguagaggccagaagagggcguuggaugcccuguuacagacaguugggaguugaacccagguccucuuaacaccugaaccaucccucuagccuuuccacugugcucuuuauuugauacugaauuuuucauuucuaccauuacuuuaguuugguauuuguuuauuaauccuaccucuuuagugaauucuauuuucuuauccuucauugacuuauuucauucaccucuuauuucuaugcuccuuuuuaaugcaaucagaagguuguucaggcccucuuucauuuuugaacauauugucauuguuuuagauucccaaucuagaauuugucugagucucuuucauucugggccuuuacucugagguugauaacuguuggaugagauguuguguuaacuuuucauguuacuugucuuuuuauccugggcuuuaugcaccaggaguaagaucauugauuuccucccuuccuaccuuccaguuaguaucuguaagggucaguaagaauacuuuccgcaguaguugucauuaacuacuuagaguacacccccugugaagacagaauaauaguuaaguauauagcaaucacuccuuaacugcuaaucauucuguggagcaaagugauaucacuaguacuuagugaacugguauaguaguuaccgugcauauuaauagaaagaaauaagaaaugggagacuaguaauuagcauuggggggauagagauaaaagagggucauguucauaauaagggagcuauacuaguaggaagugguagaggaaugauucagcuuugucugaaggaauacuaaugugccacugguauauagaaucauccaguuuuucuuuugguuucuuaagacagaauuucuauauguaacagccuuggcuauccuggaacuguuuuuguagagcaagcuugccauccaauucacagagauccgccugccucuuaucuucugagcacugggauuaauuaacgcccagcuaauaguccaguucuuagacugagcacagagacucugcaaaucagacuauauucuuugggagaggaaaaggcaaaaggaaaauaguuguggggagcaguauagggcagcggcagaauagggucaaguuccugggcuccaauggcauugggcauuaaacagagacaugauagguguggagaaggagugagauagguggauacagguaugaaaaaugucugggaugauuauugccuuugucuuuauugaguuccugaugaaggagaugagggacucaagaaaggauaggcacacaaacacacaaacacauacagaacacagaaaagcugggaucuagugggcugugcuugcuuugcuggaaaacauuguuaauaaguuuauguguaggacagagggaaggugagucagcuagucuuuguggguccucucuguaugggagcaguuucagguuguaaucaguagauaucuguaguuguuagguuuuacacacucggcaguguucauagaacagucauacuuguacauaggaaggcuuugucaucccuuucagcuucauucugugguuaaggucuugccauuccuuuggguuugagacauuggguccuugauauggccaucaacuucacucugggcuuucuugcuuuccacacuucucugggguugggauagguaauucugucuuccuccucucugagugccccccuccccgccccccaaaggcuguucagagucugagaucuggucauaucucuuagaauucauuacagaaauuagaguucaaaaugcucgcacugccuccugccccucugcaguucuugguaauuccuacuuguugcuuugaauuaguuucagcuuauugaaugcuaugcugauuaagguuucuuuuccagucuuggaguauucucuuugucuuguuucguaauacugaacugcuaacccuguaccacuugcucugaguuuucugagaaugugauuugcacaggguguccgcugccaagccaccacagaagccgaaguguuucagaaaguauagugugcuccuauucuguugauugauaguaccacacacccagagacaagaagagauuuuccuggcuuuuccuccugaugcugccacuaacuccgguauuauuuccccaccaaccauguaacuuuucagauagcuauuuuuuuuuuuuuuuuuuuuuuagcuuucccagcuuauugguuggaaacugaggccaauuguaccugaguguugcuugccauuuuggauauuucuguagguuuuuaaaaacaugacuuuuaaauucuuauuuuuauuugcauguguuacauaugugugcaccuguguggguguacaugccuuuaugugcacacauggaagcaagaggagagcaucuuauagugucuucauguuacucuuccucauuaucagaggcagauaaucacccugaaccuugauuuuucgauaggcccauagcccuagcgggcuaucugccugucugugcugacuaugcauugcuaauguauauaacuuaaaaugucuccccuccccucccucuccucuccuuucuuucuuucuuucuuucuuucuuucuuucuuucuuucuuucuuucuuucuuucuuucuuucuuucuguuguuguuguuguuuguuugaagacagaguuugucuguguagcccuuggcuguucuggaacuugcucuguagacuggcuggcucgaacccagagauuggcuugccucugccucccuagugcuaggauuaaaagugaaggcuaccacugcccugcugagaacuaaaacuuuuuuuucuuauugguuauguaagcagaaacuuuguugacuuauuuauuaguuuccauauuuuuuuaguggauucuggaauuuuucuauaagcaagauuaugccaucagauaauugacauagcugacuuucuugcuucugaauuuaauuaacuuuuuuucuugccuaauuacaaugacuagaaucuccaguauaaugcuaagaugguaagaagagacuuccuuaucuuauuccuaaugauggagggaaaacauuuauucuuauuuaauuauaaauuauugguuuuguucuuuuaaaaaaucugauuccggagugccuugugguaagugauaaauguucagauuuuaggaaauggacagaugacagugaacaaacugaucuuugaaagagagcuuagcauagagcuaaguaaauguaggugaaagagucuaguuugauagcggaaaguagccccaggcuuuggauagggugacuugccugacucuugauucuuccucuaguuucugauguacauguaauaagucucuuaagcaugcugucucaguuuccccauuugcuuucuauuauuuucauugcugaaggaagaacaagucaaaugaaauguguuuuguacacuaauguucauuguguuauauucauuugagcaagaacugcuauccaaauggcauuaagcuauggaguauaaggugacaaaauaaaauugacuuucauuauauuauguuccucaaagaagguauaguuugauaugguagugagguaaauguuuaaaaaguuaugaaugauggaucuggucacaagauaggugcugauaaggcacuauugugucuugcaguugguaaggcucugugaaggaaagacucuuugacaauuguuugaaaauuuggaacgauucuacuagcaauggaaucuuccucuuucuccacauccuagccagcaucuccugucaccugacuuuuugaucuuagccauucugacugguaggagauggaaucucaggguuguuuugauuugcauuucccugaugacuaaggauguugaaaauuucuucagguguuucucaaccauucgaguuuccucaguugagaauucucuguuuagcucuguuccccauuuuuaaaauaggguuauuugguucucuugagucuaacuuccugaguucuuuguauauauuggauauuagaccucuaucggauuguagguuggcaaaaaucuuuucccaaacuguugguugcuguuuuguccuauugacaguguccuuugccuuacagaagcuuugcaguuuuaugaggucccauuugaugauucuugaucuuagagcauaagccauugguguucuguucaggaaauuuuccccuguguccauguauuugggauucuucuccaauuugucuuuuauuagauucaguguaucugguuuuauguggaguuccuugauucauguggacuugagcuuuguacaaggagaugagaauggauuaauucguauucuucuacaugcugacugucaguugaaccagcaccauuuguugaaaaugcugucuuuuuucccacuggaugguuauagcuccuuuguauaagauugagugaccauagaugugucauuucauuucugggucuucaauucuauuccauugauuuaccugucuaucucuguaccagugccaugcaguuuuuaucacaauugcucuguucuacagcuugagaggucagggaugcugauucccccagagguucuuuuauuguugagaaaaguuuuugcuauccuagguuuuuuuguuaguccaaaugaacuugcgaauugcucuaauucuaugaagaauugauuuggaauuuugauggggauugcauugaaucuguagguugcuuuuggcaagauggccauuuuuauuauauuaauccugccaauccaugagcaugggagauuuuuccauaaucugaggucuuuugagacuugacauucuucucauacagcucuuucacuuguuugguuagaguuacgcccagauauuuuuauauuauuugugacuauugugaaggguguuguuucccuaauuucuuucucagccuguuuaucauuuguauaaaggaaggcuacugauuuguuugaguuaauuuuauauccagucacuuugcugaaguuguuuaucaguuguaggaguucucuggucgaguuuuuggggucucuuaaguauacuaucauaucaucugcaaauaguguuaucuucacuuccacuuucccaauuuauaucccuuugaucuccuuuuguuguuuaauugcucuggcgaggacuuugaguacuauauugaauugguagggaagagagugggcagcuuugucuagucccugguuuuagugggauugcuucaagguucucuccauuuaguuugauauuggcuacugguuugcuguauauugcuuuuacuguguuuagguaugggccuugaauugcugauauuuccaagacuuuuuaacaugaagggagguugaauuuugucaaaugcuuuuucagcaucuauguggucuucccccccccccaccccccuuugaguuuguuuauguaguggauucuguugauggauuucaguauguugaaccaucccugcaucacugggaugaagagauggaggauguucuucauagucagugaaaacacagaagcauuggucaaaucuaguaguuguuagauauguuaguuuuguuuauggugcugugauacaauaccuugacaaauagcaccuuuggcagaaaagagauuuauuuuauuuacaguuccagaggguauacaguguugucaugugggguaggcauggcagcagcacguuuuagacuacuggcuaguuguuucuuguucauacacaagaaggagagaaaacaggaaguugggccaggcuauaaaaccugagagacugccacuagugauagauugacuuaagcaaguuucuacuccacaaaguuuuuauaaccuucccacauaguaccacugugggaacuaaguacauucaaaccgagcaguagggaaagcuagauuaggaccagacugaucugcagcagcaccuugauaacuggguuaacaaggugaaauuacauuccagaagaauagcaucagugguguucuuauauaaauacuuuugaguauauggaauuggcaagguuuguauucagagucaaagcuuugaagauaguuuucuuaguuuaauauggcaagaugguuaaauuauuuuuauuauaaugacacgagacaaauaaugugggaggauuauuggacagaaucucucucucucucugucaucauauuaagaaggagguggguuuuuggugcauguuuuguguguguguuuagacacucucaugugucucauuguagucuggagcuugcuguguagccuuaaacuuugauuugauuuuuuucuaccuccaacucuggagugauggaauuauaguugugcuccaucaugcuugguuuauguuguguggaugauuuuacucagggcuucuuguaugcuagguaguuaucaguugaauccaguucaaaugaggguaaauuuuagauaggugguaaccauuaugcugagauguuaaguaucccuuugacaaauauaggaggaaugugagaaaaaaaauucuaggccugauacuugauuaauuuugaauggcuggacacggacuuuguguacaugcuacgauuaaggaguuuuguuagagggguaauuggaagguuacucagguagcugcauugagaguaauuaggacaggugaagauuuuauguaaggagccugauauagagacuacuccaagaaaguuauuauucagaaucuaauagugagaguaccuguagcuguuuaguuuaaagaaucuggagacuaguuaaaacugaagaaagguagaguugacaggacuuggagaugaauugaguauggggaagaagagaacuuguggaguguacagugacuucagauuuuugcccuuuuagcaggcaccauugcaagagaauagggaauauuucagauuuaauauaccuuaauaguuuaguuguauuguacugagggcuaugaaugguaguuggaagugaggaggaggugaguuuuuaaaccagggguucauauucaugucagguauagaggcauacaaaauagcuauacaguucagauaguuacugauaauaaauuacaaauuuauuuuaaaacaauucuuugauaagaauacaaugcuauuaaagacccaaccagauuugauauuaaagaaaugcuuauacuuuuucacuuuuacauaaagaauuaaauguugacuuaauacugucauauguagagcucuuccguguuguuuuaugauggucaguaccaagagcacugcuucgaguaaauaauacaaaauggccaagguagguuuuugguccuuucagaaauugaugggaaucauauccuaauccuaugccaaaauccaucugaugacuaauuuguaaagaaacauucagcaauucaaacaaccuaagagucuaagcuauccuguguaucuuagcuacuauucuauugcugugaagagacacuuaugaccaaggcaauucuuauaaaaagcauuuaauugugugcuugcuuagaguuucagagguuaguccauuaucaucauggcgggaagcguggcgacaagcaggcacauggugcuggagaaguagcugagaguucuacauccugauccauaggcagagagagagaaagagagagagagagagagagagagagagagagacugggccuggcaugggcuuuugaaaccucagagcccacuccaguaacacacuuccuccaacaaggccacaccuccuaauccuucuaauccuuucaaauagugccacucucuggugauuaaacauucaaauauaugagcccugugagggccauucuuauucagaccaccacaauuuguaaguauaaauuaaaaucugugugagacuaaauauaguaaggaagaagaaccuuaagaggcagaagcuggcagcacauauagucaggaagaaacuaaggaaacagaaaugguaggaagucuuuuuaagaauguacuuacuauugucacuguagacuugaauuuuucuuguucuaguguuguaaaauauacuuacuuacuaguuaauuucaaugacuaugaguuuaugggcccaagaguuugagcagcaggaaagauaaaauaccaagguaccaaccagcaccuuuugauuaaccugucuacaauuuaaaauaaauguguaugagacuauagguauggaucggaugugagaaacaacauuuugacaagcuuucaggcuaugcuauuuuuggucaguacuccacaagguaagauucaggagaaugaggcaucaauaguuuaccagaagggucaauuauagaaagcagugagguuguauguaagguggaagguaauuauaauuugggagaagacacgccugguaaaucuuguaacugagguugugagcaugaagaaaguugugaaggcuugcaguaacaacuaagaagaaaaggccagugaaggauuuggaacauguaaaaaacuucauucaacagugaguauugguuugguuauucuaucuacaauaauaaauggagcagagagaagguaucagcuggauaggguagauuaagagaagaggugguagggugagagagaaaagugauuuugaggauaaaaguggacaguaugguagaccacauaguguucccuuaaaauacccaugcuacacucuuugggguauguauuuaaaguauguuguggcaaaaaguugguaugauuaaaacguagaugucauuaaguuaaggguuucgagauggagagauucuaaauuaccuagguaguucauauaugauugaaugaaagguugagucagaaaugccaugugaugauagagacagagaggaaagaaauaugauaaaaagagaggccugagugauggggucuugaguaagugaagcugggaauaguaagagaacagauuuuuccaagagauuucagcagagguagaugguuuaauuuuucagagcucacuggauuucugucuuaaaacugugagauaauuuguauugcucuaagucauuauauuugagguaguuugcuagugacaguauucagagaguauggcuauaagggaauauauagaguuagggucaauaagaugagacaguugcugagauauaauguguguuugccaggaaaugaaauuuauagccugguuaaauagauagagaauaguaaaauuaaaaauagagaauguuaaaaggagcaaauauuaagaccauauaugcacuuucuaagucuuaauuucagauggugccagaucugauggaaucaguaguuugacuauaauaguacagauuagauaagauagauauuaaaugagauacauuuaagagucuuguacauaacacuuaaaacaguacauaauaaauuuguuggaaauagcagaacacuuaaaacaguacauaauaaauuuaguacagaggagcaccguuuuuuuuuuuuuuuuuuugccaaugucugauuacauagcccuggcuagucuggaacucacuauguagaccaagcuggucucacacacacaugagauuuuugccugccucugccuuccuacugcugggauuaaaguuaugucuuuauguccagcuauuugaaauuuugacuuaggaagguagguaaguguugcauguagagaucuuuuaaaaauuauacacaaauaauuuaaaaucuaaauuguacauuuaagagaaaaugcgcuuuuuaaaaaaugagucuuguuuaauccgccuaacauaacaguuuccacuuucauuuuccuacaaaugcaauuugauuuugcuuauggcucagugaaguuacauuuuguguauguaccauuuuuuuuuaaaaacacauuugaauguugauagacaucuaaaguaguuccauuuacuaauuauugugcacuaaacauggagguagaaagacaacauuuugggggaaaaaaaagacaacauggugauuuuaauuugguaaacauuucauaccucuuuugaggacuuaagcuuguaaaguaaaugugacugagagaauucccugaggauguaagauaggcagaaaaagugggauaagaacaauuggagcuaauggauaacaguccuacuggaaauuuauuacacgagcuucuguguuuucuauuauccuaggaaguuagacugggagaugauacccagugacagauuggauauucuuuagcaaaaauaauuuaggaagcuaaaauugugauaaaguauuuuggcauaccuauuuugauauacuugguguaccucuaggcuagugacccucuagaaagagugaaauccaucuuagaugguucaagagacuuuaaaaugagaucacagaggugauguaagauguagauuaaaggaguucauaaaagaugcuuagucagugguaaccuggaacucugaaguggcaagaauacagugcugauaagagcuguggaagagagggugccaaggacaaaucagccugaauuuguguuuguucacuaaguacaauguuaagaacuagauucuugcaaagucucugauauaguugagcacauuauucacuuguuaaaaagaacucuuuaggagcagaaaagauggcucaaggguuaagagcacugcguacuuucaaaagaucagcaccaaggucaggcacuuagcucuaggagauccaaaggcccugucuggcuucaauggacauuauacucucucuuuaaggcagcuguucucaguuuguggguaucgaccccuuugcugagccccuuugucaaauuucugucuccaaaaauauugacauuacuauucagacauaccuuagcaaaauuacagucauaaaguagucauaaaaauaauuuuaugguugggagucaccacaacuaauuaauagugaacccuaguuaguuugaguugcaauucugauuuuauuugaguuguaugaguuugggaaaacuucuuaggagcauaaucucucucucuuuuuaagugucucuuauuuuaugaaggugucagaugcccuggaacuggaguuagagacaguugugagcugccauguggauguugggaauugaacccaguaucucuggaagagcagccagugcucuuaaccauugaggcaucucuccagaccaucucuuagcuuuuuaaaagaugucuuuuaaaacucuuauuauguuuaugucuguguauaaguaugugcaaauuaaacacauugucuauugaagccagacagggccuuuggaucuccuagagcagggugccugaccuuggugcugauccuuugagagcacauagugcucuuaaccugugagccaucuuuucugcuuuuaaagagcucuuuuaacuuguggaaaccaaucaaugaauaauuaauaugugcucauuguagguucaacaguauagaacuauuagaagaaaauauuuuaauuguauuaacuuaugugaguugugugugugugugugugagagagagagagagugaguguguguguguguguguauguauugaggucagaggacagcuugcagagauugaauuuugguacuaagauuucgugacaagcacuuugacugaacuguauugucaguccaagaaaaauuuuaaaaaguuauaguguaauuguuacaaguuugaauauucauuuuuuuucuuacucuuacaaccauaugccugaagcauuaguuaguaaagugguaaugcuuuuaguaauguauggcaaaaucauuaguaaaagcuaccaagauuugaguuuuguuuuguuuuugguuuuuuagacaggguuucucuguguaggccuggcuguccuggaacuugauuuguagaccagccuaaccuagaauucacagagauuugauugccugugccuucuaagugcugggauuaaaagacauauacuaccaugccuggcugaguuuuguuuuucuguauuauauuuuagacuaccaaacuaugauuuucauuuaauuuuaugccuaguaauuucacuuguauucuagaauuauagauuguuuauaaaaaauaucucugacgcuagccauaaaggacauuuuuuuuuucugccuguuuucucuauggguuucuggaauuucuuccuuuacuuuuucugcuuccuguaauuucugcaaaguuucuuaaguaagggcugucuuugguaguuuaacuguguuaaccuguccuauuuuauaaccaucauuucuaccaaagucuaguaagagcugucuuuucuucuguuaaguauguuaaauuguguuaaccugucuccuguagaguuaaaaauuaugaauuuaauuacccuccacccccauacacacacuaguuaguuaaagcucuaaaaagaaauggaaucuaauuuagaugggcaagagauuuuuuuuaaagacuuuauauuuccaguacagauacauuuuuccccccaaauauuaggggauguguguacacaacagagugcaccacccuauguucacaguagccuguggaggucagaagagggugucagaauuuuuggaccuggaguuagggauguuugugagccucaauguaggugcuggauuuuuaaugaaaugauugcagggguaagauagaggaguagcagggagcucugaagugucaaaaacaggagucaugguggugaagagacaacaguuugugccagaaaauauaaccaagugaggggagggggaguggggaggaauggaagacuucuccuuucugagauaacagugauggccuguugcugcccuaauuguuacauuucuuagggaaguugguuuuuuauuuauuuauuuuugguuuguuuauuuguuuguuuuaaauccagguuuaucuuugggcauucacaggccagagaaaggaggaauauuuuaaagaaaauugucaucugguauuuuacucacugacagcaacuucagaaacacuaauauuaccauuuugaaauuaaguaaaauuguuucauuucagagauuuaaauuagcacucuacaaaguuuaauuugguuacugacuaaauguuaaauuauuuuucaucagacgaucugccaaaucccgaagcagaagcccauauucaucuaggcacucaagaucucggagcaggcacagauugucuagaucaagaagucgucauucaagcauuucuccuagcacacuaacucugaagaguagcuuggcagcugaauugaacaagaauaaaaaggcacgagcugcagaggcagcaagagcugcagaggcagcaaaagcugcagaagcugcuaaggcugcugaagcagcugccaaagcugccaaagccucaaaugcuucuacaccuaccaaggggaacacagaaacuggugccagugucucacagacaaaccaugugaaggaagucaaaaaacuuaaaacugagcaugcaccuucuccuucaaguggugggaccgucaaaagcgacaaagcaaaaacaaagccaccgcuucaaguaacaaagguagacaauaauuugacaguagagaaagccaccaagaaaacaguuguugggaaggagaguaaaccugcugcuacaaaggaagaaccaguuuccacuaaagagaaaagcaagccacucacaccaagcacaggagccaaggagaaggagcagcauguggcuuuagugaccucuacguuaccgccauuaccuuugccucccaugcugccugaagauaaagaugcugauagguaaguccagacaaauuugaaauuaguaacucuucaaagaaaaagucugcuuauuuugcuguuuuuuaaggaaugggcagggaaggagauucagagggccuuacacuauguaggcuggucuggagcuuagcguuuagaauaggcuaaccucuuaacccacagagagccgccugccucugcagagcucuugagcgccacacccacccagcuacagauugcuugaucuauacugucucuuguuuuucuguuuugauugugucuuuguggguuuguauguuuuguauguauguuuucuuacuguuacugaauacuacuacagacaugucugugccauuaacuuauuuguuucagugacugauuuaaguacaaguuuuaaguauauaaagaggagacauuacuuucagcaaaguuuuaauuaaguaacuaaauaaaaauguacugugaaaaagaaaugguuaaaauuacuuggauagggaaaaagauauuucuauagucuaaguuuuguuagaaguauaauuuuggggcuggugagauggcucaguggguaagagcacccgacugcucuuccgaagguccgaaguucaaaucccagcaaccacaugguggcucacaaccacccguaaugagaucugaugcccucuucugguguaucugaagacaacuacaguguacuuacauauaauaaauaaauaaaucuuuaaaaaaaaaaaaauuaaaaaaaaaaaaaagaaguauaauuuuguuaguggauuacaaguauaaggucagaguaguuguuagucuuauguuuucaguuuuuuugugcucuauuccauguauuuauauccaaaaguaaaaauauuuauccugaaaaaucauagauuaguuauuuaaauuaagugaccugauaagauuuuguaaucgaaaguucuaugcaucucagauacuaugauuauuagcuuuaguauaaaucaagacaacaggaaauacugacuaccuuagguuaaugaugcuuuuauuaaauaaaaaaauaaauaaaaugacuaguugcuuuugugcagagaguuacaagguauaauagacuucauguuuugcuugaaaaggacugguuuuuaaguuuuuaagcacauaauguuggguuucccccucuuucauaaggggggagcaacuccaugcuccacauucccuuucaccagguuuuuagcaaccugguguagggcgaugggggaagggagaggggggauuguuauuuguugaaauugucugucuuguugauuaugauauagagaucaucuuuucuguccugauaugcuuuuggaauccugaaugacccugaaugugaaagccaucuuuauuuacuguuauucacuggaaauccaaggguuauuuuaaagaaccauuauggucuacacagccucaguagucacaucuuaaugaaugcuuuccaucuugcuuucuuuaagcauuccuagcuaacugucacaguuacauccuuaaauaauuaucuaugaaagauuuuauguguuguuuugugacuaugauuuuauaaaucuguacucuguuuuauguuuuaggcauuuaaaaaaguuaauaaaauuagcaucuauauauaaccuucuagagcagugguuuccuauauuccuaaugcugcgaccuuuuaauacguuguuuauauguggugaccccuaaccauaaaauuauuuuaguuccuacuucauaacuguaaauuuguuacuguuaugaauuauaauguacauauaucuaauaugcaaggugaucucaggcaacccugugaaaggauuguuaagccuccuccuuucccaaaggguugugaccacagguugagaaccaaguuuuuagagucaacaaaugcuaauauuuuauuuaauauuuauuucuaugcuuuaaaauuuuuuguagggggaagguauauguguaugcacaucuuuugaaaauaagugguugccauaguuuucaguuuagccacaaguaccauuaauguaaccuaagaaaauugcaauguuaaccucauaaguugaagacuuuggaucuguacucuuuuuuuuuuuuuuuuuuuuuuaagauuuauuuauuuuauauauguaaauacacugucacugucuucagacacaccagaagagggcauugguucacauuacaaaugguuuugagccaccaugugguagcuuggaauugaacucaugacuucuggaagaggagucagugcucuuaacggcugagccaucucuguguaguuuuauaguaguauuugucugauuauaacuucuugaugacaguucacuugcucuucucuuaccuuuccauuuccuauaaacuagaaaucaguuggaucuugguuagguugagaacaaauaacaguuuugggcuagaauauuuagaugauuuuauauaauuccuauuauaugaugaacacaauguuaaauugugaugugauaacuugguuaagugaugaccaaccuuaagaaucucuauguagaagguacuugugacccuuuuuuuguagaauuuguaggauaacacauuugucauuuugaagauuuguuuucccugcaacuggucaucuaaugguuuagcacccacuaauaagauuugucuuaaucaguuacuguaauuggaccugcaaaugaugauuuuggauuuugauuacuccucuuaauagauguuaauaaagcuaauauuaaaaaggcaguucuuucuacuccucccagucuucuuaauuguagggcucuuccuacauuaucagaucagagguuccucuaagcuaaaucuuucaccuuuuuacuugguuggagucuuagccaaauagucuaugccauacucacuuugaauccuuuucuuagaacugcaacaaacuguuucuucuguuaccauuguguuuuuacaaaaaacaugauuguuuuauuuaaaaugaauuaggaucaugguauuccuuuccuuuuuuuuuuucauuuacuuguugaagauauuuccauguuaaucuugauagguucaauaugcuuaucuauaacaaucaguacaucauacuuuuuacuacuaauguauauagacacuugguuaagauagaauaugacaaauuauacccauuuaaaacuuuagaaaugaaagcaacaaauuguauccuaauaaggccaugcuaguuuauauucugaaauguuauggaaucaucuuuuguuguuguuuuuuuuuugagacgugguuucucuguguaucuggcuuucuuggaauucauuuuguagacaagauuagcaucuaccugucucugccuacugaaucuccagagugcugggguuaaaggccugagccaccaugagcucuccuuuuuggguauggaaucaucuuaacaguaauagauuuuaacacuuugaauuuuuauagucuugaaguuacauuguuagguuuugugcuuauuugguugcuaaugggaccggcacuugguguguuguguggcucagagccuucaguucuucccuuuuauaguagaauuuucucacuaggacuuuugaucuuuguaguucagacucuuguuuuucuuugauauuuguucuugggguguguuuguuuguuguuuguuuuguuuuguuuuguuuuuuucacuuuuugagaaauaucuagcuggccuagaguuugcuauuagaucaggcuggccuuaaacuagauauccaucugucuuugccuccugaguguuggaauuaaaagcuuacaccacuaugccuuauaccuauuuuuguuuuuaacuugcuauggauauuuucuauuuuucuagucaaaucacuuuuuucccuuuauaaucuuagcuuauaaaauuuauaaaaggugaacucaaaagauuuucucacagaaauugguuuagguuguuacaggaagaagaaagagauggucugguuugccaccuucuuccuuguagcaguguugcuaccagaguuugacuaauuugaaaacucuuaaggaauaucuguguuucuguguacuuuguugucugucaacauauuauuucuuugcugguacuuuaguguuuguguuuuauccucuagauaccugguauacugacacucacucuuaauuucuauuaaaggggaacuuaagugguaugaaagugaagugguuuauuuuucuguuuuguuuagugguuuugggguuuaacucaagaguuguacaugcugggccauccuccuacuacugaacuccaaacuucaaccauagcccuuccuucaaaaaucugaccccaguguuguacagcuuuucuugaaaagcaaaauaaaagaaaagaaaacaaaaccaacagcaacaacaaaacccuggucugaauauuuauguaauaaauucucuguuuuuaucauuaaaagguucucuuggguaacagauuuuuuuuuuuuuuguauugggaaaauuuaaauuaucaauuacaacuucagauacaauuugaaaauuauaacucuggaaauuaaaaaaaaaaaguauagaacuaaccaggccuuuaauucacuuguaauucuauuauggaggguuagcauuccugauggcagaguaaaggcagggcagcuggaacagcugagaaacaacuuuuuuuuguuuguuuuuuuuguuuuucgagacaggguuucucuguguagcccuggcuguccuggaacucacuugguagaccaagcuggccuccaacucagaaauccgccugucucugccucccgagugcugggauuaaaggugugugccaccacacccggcaacuuuuuucuuuuaaaagcaaggucuuacuauguaguucuggaaccagacuggccucaaauucagaguuccauccaccagccuguacaucccaagugcugagacuaaaagugaauucauugguuuugguuauguaaaugggcaagagaaucgugugcuaauuguaguuugugauuuuauuugcuaaaaagaaggcaucauugucuccuugucauaaucaaauacuacaaaauuaugagguuucuugcaaagcauauugauuugauucuuucuuuuuaauucauaauuuugaaaguuagagcuuauuuuuuuuaaguuuaaacuuuguuauuuguuuguguguauuguaugugcaugcaauacugcugguauaggcucuaagggcaaccuugaauguugcuucugaccuuguuuuaggcaacuucacuuuguuacuccaauauaaacaccaggguagcuggccaaugagcuuucagggauucuccugccuccuccccuccccucagaugaggguuacugagauuguagacugugcugcugugcccagcuuuauguggauuuuugagauuugaauccagguucuuacacuugaaugacuagcaccacaacaccaucuucccagcuuccuagacuuuauuuuuaaaaaauaguuucagauuugcaaagauaaaaagauauugaauccacauuugucuugcacuuauuacauuuagucaguauucauauacuacuauuaauuaaggucuacucuauagauuucuaugguuuuuacuuaauuuugugucaccuuuuucuuucuuucuuuuuuuuuuuuacuucgugguugaaggauaauaaucuguuuagauggacuugaaguaugacauaugccuuugcaugcugcuuaaauuuuaaauaugaccauaguuuuaucguguaaucaauuacuuaugguugauaugacuuacaccccucccccuuuuuuuucuuuagcuuaagaggcaacauuucugucaaagcaguuaaaaaagaaguagaaaagaaacuccgaugucugcuugcugauuuaccauugcccccugaguuaccaggaggagaugaucuuuccaagaguccagaggagaagaaaacagcagcacaguuacauagcaaacgaaggccuaaguaugugcuugcuuucuacuggcacuuagguugacuggacacacuauauccuggauaacuaaaaaacuagaaaacaguaagauuuaaaugaaaaguguauauuuauuugaacauaaauauacagguugguuuagaguucugaaacaaauauucaugaacggugguaccuauuugcagcuacuaauaaaaccaaaugaaauuuucuuacaguuuguaauuauuaauuuggcgguguuacaugugugaaagacacuaaucuaucauuaagguagcuaauauaaaaacacugaaauugaacaaaauggaagacagcauucaguguacucaaacaaaaucaguaauggguaguguuuuccuuugcuuuuaacuacucauuuuuuccauauaacuguaugcauuuguaauuuuccaagagauagaauuuuuuuuuuuaauggagcugauguaucuuccugcuaaauaucggguagaguucuuuuccuugaagguaagaaauaaaauacuuuuaaaaaauguuuacucaagaaaggaaaaguuuaaaacuuuuggcauaguuuuaauuuaaaauugcucuucagguaacaucuaauuuaaaaauauaaaauuguuuucuauuaagagaagaaaacuuuagucuauccuugaauccuuuugcuauaauucuugagucuauguuggcccugcuauuaaauaucaaaauauaacaaagaaacaccucuuuagagaauuugauuuuugacauuucuauuaaucucuacccaaguauggaauuuugaguugugguuuuacaugaauuaagacuuccuauacuugcugagugaaaaaucuucaguauguuuaugaugguguuuuauaaugcuauaaaucauuuuguaaguaauuuguagucaguuucuuauguuacuauuugcuaacuuguacuaugugugugugugcauguguguguguaugcacaugaacauguauauacacauacauauauggggagagagagaauccuugaaugaaaaauuuuguggagacggaguagaaaaucuugaugauuucuaguaauguuucuaccuucuuacugaaaagcuacauuccuaaaagcauuauaaauaagcaguugcuacuucucuuugaaguucuuaucuacuuagaguggguauguagaaauuauaguuuauuuuuauaacuuguaauaucaacugacaguaacuuguuuuacuugaauguuuacaaauauacaugaauaguguaaaauaaugauuuaagauugggcaagauugcuauugaauuauuaagcaguucauuuaguuugcuugauugucuauaaaaacuucagaacuauauuuaauagaauaugugggccucgcuauggugaaaucaaagaaaaagauauugacugggggaaacgcugcguggauaaauuugauaucaucggaauuauuggagaagguacuuauggacaaguuuacaaagccagggacaaagacacggguaagaguguuaaguuucggguagaaugugcuuacuuucuguuuuuuccucuaauguagagcuuuaagaauuuccaaaagaaguaaaaauucuuugugcuguugcuuagucuuaauuuuuauccuguauguucauuuucuguguccucauaucaguacauguggccacauaacaaacuuaaaaacuuucuuucaguauuugugauauguuauauggcaggauuuaguauuugugauauguuauauguuauauggcaggauuuaggggaauguguuccuuuuguggugaaaugauuauuaaaacuguugcuacuuaggcuaaaauauuaguaguuuaauuuuucuuuuugaggcaagguauguauauauguagcccaggcugcugugaaauuugugacucuccugcuuuaccuucuugagggcuggugauacaggcuugugucaccaugcuuguuuuuaggagugaaguuauuuuguauuaagucacauaaaauuuucuuuugacuaacuuuuucccauguauagaaguuuacccuuuggacaaaacucugcaauacuuuuucauuacuuuuucuuauaauuaagaacaugggggaaaguuuugaaauaccuccuccagaaaagcaguuguguuagaagucauauuacaggagaagauagguauuuaacuaaauagugcauaaaacuagcuucccgccucucccuccuacuuaccuugagacaguauuucucuguguagccaagacuggccugaaacucauagaucugcugccugccucucccuucugaguguugggauuaaaggcauucaccacuacugcguggcagaacuuacacugucuuuuuagcauaaacuaagauuaaaauugacaguuguuugaggccauuuaguuuaaccaccuuauuguuagaaacaaauauaggcaauuagaacauaccguaaccauugauauuuauaauguauuauuaauaauauuaaauuauaacuuucagaagcuuuaauauauuacauuauauauaggaaaauagugaaaaauuuuuaaaaagaauuuuaaugcuuaagaagauaaauuuuuuucuuagaaaauuuuuaacaucagucuuuuuuacuuuacuuccaaagaaguggaaugaauaugccuuuaugaaacuuuuucuuauacugacugaugcuuagccuacuaaggcuauacauauucccacaaaacaaccccccccccaaccuccaaaaucuaaaccaucuggaccuacgcuuaacguguaauaacuuuguguuuguuuauaugucugauuaauuacauucugucugauacaaaacucacacauaccuaaauuuuaauacccuggauauauugauccuuuccuccuuuacacagagaagaugauaauaagaucacacuuuaccuucccucuuuucugauuaaugggccgugugaaacagugaauacauaccuaccucauccuagccaacuguaugguguuaaaugcagugaaaugcuccaaaauuuacuugagguuacuuuuuaaauuauaaauauuaucuaguauguuggacaugaaaauaacuugugaauuauaauuuuaaaagguaggaacagaaaugauaaaaauguuaaaauuaugaaaaauggcauugucuuuugauagcuaguaacuugauuuuauuuaacugucuaauaggagaaaugguagccuuaaagaaaguacgucuggauaaugaaaaggaggguuucccaauuacagcaauuagagaaauuaaaauucuucggcaacucacccaccagaguaucaucaauaugaaggaaaucgugacugauaaagaagaugcuuuggauuuuaagaaagacaaagguauguaugcagacuuccuaaccaagucuuugaauucauguuauuuccaacuggauaauuauuuaaggacuggguagauaaaauguuuucuaaugucaaccuguuuuaaaauuuaguagaguuaaagaaguacauauuuacguuagugguucuugagguucaugagucagagaagucagauguaguuaccaguguuagagcccagguacugaguaguaacauuggcuuucuuugagcuuugaaaccgugugugugugagugugugugugugugugaucuuuguauguuuuacuaauugagaaaagauuaaaauauacuuacacuacauuuuuacauuauaaaugcuaugaauucacagaaacuaauuuaaaaagauguggggggggcauuugugugcguaugugugugugugugauauacaugccugugcacaugagcugaggccagaggagauauugacuguccuguucaaucacugucuacuuuauuccccugagaacaggauuuaucacugagccugucagcaagcccuacugaccuuccugucucccuuuccauagagcugggguuacagaugcauguggccauuugcaguuuuuauuauguguucuguggcuuugagcuuaaauucuuucucaugcuuacuuugugaaccaucaccucagccuuccacugacaccuuuugacaggcaugcaccacauuucuuaaaauauaaaagcaacauuuuugaaauaguuuuucaaauacaggcugauauagugguugcuuuuaauuaaaaaauauacugcuaagaaaaguucaacuuuuguuuaaaaauagcugccuuagggcacacauuaaguccaauauaaaauagagugaguuggaaugucucuuuguuguuguugcuguugcugcugcugcuguugugcuaaaauacucuggccaaaaaagcaucuuagaaauugaggaguuuauuuuuuuacauuuuccucagacuauaucuacuaagggaaguuagggcaggaacuuaagcagaaacucauaauacgaacaguggaggaauguugcuugcugacucucuugcuaguucauguauaaguaguuaucucauacagcccaggaccaccugccuagagauggaacugucacagugggcugggcccaucaacaucugucagaaauaaagaccaugcuccacaugcauuccuauaggaauaccauuuggucauguucuuaauugaagauuuucucuuuccugugcaacucugcuacaucacaguuugaccacaaaaaucaaucaucauaguuuacaauugaaaaugauacuuagccucuuuacaggcugcacacauacaaucuuacucuucugggauguacaguuuuaaauaauugauagaucauacaguaauuauguuguguaaaucauccuguucuuucucacauauuuguaaaacccauguuucuuucuuuuuuuuuuuuuugugcggguguuuuuauuuauuuuuuauuagauauuuucuuuauuuacauuucgaauguuauccccuuucuuaguuuccccuccgaaaauccccuauccccuccccccucccccuacaccccaacccaaccacucccacuuccugguccuggcauucccuuauacuggagcauagagccuucacagaaccaagggccucucuucccauugaugaccaacuaggccauccucuacuacaaauauagcuagagccacaacuuccaccauauuuuuucuuugauuggugguauaguuccaaggagcucugaggguacugguuaguggauauugauguuccuucuguggggcuucaguccccuucagcucccuggguauuucucugacuccuuuauuggagaccuugugcucuguccaauggaugaucugugagcauccacuucaguauuugccaggcacuggcagagccucucaggagacagcuauaucaggcuccugucagcaggcucuuguuggcaucugccuagugucaggguuuggugguuguuuaugggguggauccccaaguugggcagucucuggauggucauuccuucaggcugugcuccgaacuuugucucuguaauuccauucauggguauuuuguuccccauucuaaaaaggaacgaaguauucacacuuuggucuuccuucuuuuugaguuugauguguuuugcaaauuguaucuuguauauacaaagaacucaagaagcuggacucuagaaaaucaaauaacccuauuaaaaaaugggguacagagcuaaacaaagaauucucagcugaggaauaccgaagggcugagaagcaccugaaaaaauguucaacaucuuuaauccagggaaaugcaaaucaaaacaacccugagauucuaccucacaccagucagauuggcuaagaucaaaaauucaggugacagcagaugcuggcgaggauguggugggauugcaagcuuguacaaccacucuggaaaucagucuggugguuccucagaaaacuggacauaguacuaccggaagauccagcaauaccucuccugggcauauacccagaagauguuccaacuuguaauaaggacacaugcuccacuauguucauagcagccuuauuuauaauagccagaagcuggaaagaacccagaugucucucaacagaagaauggauacagaaaaugugguacauuuacacaauggaguacuacucagcuauuaaaaacaaugaguuuaugaaauucuuaggcaaauggauggaccuggagggcaucauccugagugaguuaacccaaucaacaaaagaacacacaugauaugcacucacugauaagugaauauuaucccagaaauuuggaaacccauauuaccuuagcauuugacaugguuugccaucuuaccuuacuuuauugcuucugaguacauaauugaaaagaaaguacuuacuguuugacauuaguuaaaauguuucagauuugagacuuaguaaugacuuacugaacaucgugaccuuauuaguaagucuuuuaucucuucugaaccuguuccuucucauucuuaaaaggggauguacgucucucucucucucucucucucacucacuauuuaguaaaauugggcuaaggaccuuagacaugaaguagaguacaguguaauuuguuuugccuucauaccacuuuguagacagauuaguauauuugcucuaacaugccaaagucuccuguuuucaccugucgggucaccucccugcuuacuucucuaaucccaaguuugcugguuuuuauuaugagcuaagcuucaguuacuuuagucuuuggggcucacaaauaggccaguaaacuuugauggcuucaacucauuaaaugugauacuccaugucuguacuucuaacaauaacacacacucucucucucucucucucucucucaaucaaucucucucuuucucacccacccugacucacaugguguuaugcugggauuaaaggcguucgccaccacgcccggcugugguuuuuuuuuuuuuuuuuuuuucccuuuuuuucauuuuuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaagaaaccaaaauuccagauuuuuuaguauuacagucaguaggaucugagaagaaagaagaaaggugaaugcauuaaauuuaaaucuuuacugcaggguuaaagugaccguaacugucuggcacuaccauuagaaguuaauuaaugauuauaaaagauuuuauacucauaaaucaguugacucuaguauuuggguuagacugaaaugguaaguguuguuagaugacaucagcagcacacacagugaaggaaaacaauaguacagaaaacuucaguaaauugcauggugacgcacgcuuuuaaauuccagcacucgggaggcagaggcaggcagauuucugaguuugaggccagccuggucuacagagugaguuccgggacagccagggcuauacagagaaacccugucuugaaagaaaaaaagauaggcugauuaaaaggaccuaaguagauuuucuuuccaagaagacggguaaauagccaaaaaucacauggacaaaaacaaaacaaaaaaccaaaaacacuuccacaugauagcuauuugggaaguauaacucaagccauaguacuaugcuagcucauacccauuaggaugcuuuaugaaacagaacaaauucagcauagagauuuuauucauacacacacacacacacacacacacacacacacacacucacucacucacucacucacucacucacucacucacucacucacucacucuuugaccaggaugguuaaaugcacugagacaaagaaagugguggcuguggagcuuagaagggugggaggcuuuuauugcauacuugccagucagagaagucuaauugugcaaagaugggaagaguuacagaggugaguggugcugguguuugugccacugugugaauguaauuaucuuugaacuguauaccuaaaaaugauuaagauggggaguuuuguuauuaauaauuuacaaaaaaaguauuuucuuccccuuguacucuguuuuccucuucuggaaaaagaaaguaauaauuaaguuuauuguggucuuuuaaugugaaggacuucuaagauaguaacacacacacacacacacacaauauauauauauauauauauacauacacacacacacauacacacaaacauauauacauauauauauguaaauuuuagugguagguugauaagaacaaaaugaaaucgcuaguagaagcaauuauuuuuuauuaggagggaaggguagagauugaagaagugaauaguuuuaaucuguaguacaagaacaguauggagaucagacauaauuaugaaaaucagaaguuaacuuuuaaaaauauaccuuugggggcuggggaaguggcucauuggguaauacuugcuuugcaaccaugaacacuuaaguuuuaauucccagcacccuuguaaauccaugcgugccuauaaucccagcauagggcuuuucacauagguguauuuagacuugaguucuuugcuaaacaauaacccaguauaugagcuuguuggccagcccgccaagcuauuugaaauggggcgcuucagguucagugaaagcuccuguguaaaguuauaagagaguaguugagaaauacaccaguaucuggucucauguauacauacccgcugccaccaacaaaauauagccuuucuggaugcauagaagucucuaauuauuagaacuaaacauugucaauaaaaauaaaaaacaagcugccaagaugucucagcaagauguugcuugcaaagugggaaagagguauaaagguaaguuaugaauucugaugacaugauaugauacuuugaacauaauaaauguuuuauuuuaaguaaaauguccuuuuuaauuuacuguuuuaauuuggauuuuccagaauuacgagauuauuuuuauaauacugcuuauaauaaacaauacaagcaauuuuuuaauaggaauaaugaaugccaacauacauuacugggaagugcuauggggcuauugaaaacaugucaaaacuaaguuaagaaaaaacguuucugauaggaguuuguugggucuugaagcagucuggaagaaaaucucccccucccucuuuguauacaccaaucuuuugucuuuucucugugauauuauaucauuucucccuucccuuccuucccuucaaaucuucuguaguaacuguugaggggagaacuuuucacucauuauugcaucaaauauuucuucugucucuuucucuuuucuucuuuuaaagccuugaaagaauguuaacauuugugauuguuuuauggcccuuggauguucugcuuuuuuuguauuccccuaucccaucccaccauacgcauucacuuccgaacaugucuauucaaacaucuuuguacucagugauucuuuccuuggaaauuuugcuacaguuaugaaucaugagguaaauaaucuguuuuuuuuuucagguagucuuaggugaccccuaugaaagggcuguucaacuucuaaagggguggugacccaugggcugagaaccacuguucugggcuuauuguuuacucuuuacugauuuuauuagaggcaaauauacauuguuuucaugagcauuuuggcacaggacuucuagugaugaaaauuuaucugccuauuucucuaacuuagaaauagucacauuuauuugucuuacuacuguuuugugcuguugacugcuguugagggguguuuucccccauucucacuguagggaauuauuuucaacaaauaguucuguuuuuacuucuuaguucuauaauugauauauuuguuuuuuauguugguggccauucuuaggauacuuuucaucuugcuaugucuggguagguguucagucauccuaccaccacuuacugagaagaccaucuaacugagugaaauaccuuuuuguguucugucccuuuauuucccuccugucucuuuuuugagacuggggggcuggggggcguagguggguguauguaugauguagguaccuguuuauuggggaugcuaagugugugugaaagccaaaagucacuaucaggugucuucuuaaauugcucucuacuuuaguguuugagacaggaucucucauucauugucagcuagugugguuggccaauagggaucggccucucucgugcuucccaacacuggcauuaaagucagugccgcugugccuugcacauaugagcuggggaucuggagucaggcccucaugcuugccuaucaccuaagcuaucucccagcaucacagucuauucuacaguacaaguuuaguguggacuugguauauuuuuuuaagaauuacuuauuuuauguguaugaguacacugucgcuguugucagacacgccagaaaagggcauuggaucccauuacagaugguugugagccacccugugguugcugggaauugaacucaggaccucuaugagccauaucuccagccuuuacaaaaauaauuuacauuauaauuuaaaaauuuuaaaauaggaauguagaaccauucuuucuauauaccuuuuuuucuuucagauguuuuuguucuuaguuauuuuccuguaugauauacgcuguagagaaaacucuuucacugauuguacuuguugcuuuugcuguuauaaaauaucuggauauaaaccaagggggaaaacgauuauuguggcuuacaguugugagggaaugugacggcaggguggggaugguguggcaggucagagaggaagcaggauggucacauuucauccuuacacuggaggcaacgagagggaagcagaagugaaagcagucuagaaaccucagagccugcccuuguugauguacuuacaagauucuaccucuuaaagauuccauaacuuuccuaaacagugcuguuaacuuggcaucaaguguuccagcacauaggccuaggaggccauuuuagcauuuacagaaccacacugauaaguuuuagaaauugggcuuuugcauaauuuacaaauuaauuugggaagauugguauuuuugaacugugcccuuuuuuuuguauauguguguuuucugcauuaaaagggaauuuucaaaaaaaauuccuuucaauuuaaauagcuauuauuaauggguucuauuuuaucuuuuaacugguugccaauaucaaugaguauuguauguuacacuauuuuuccacauuuuuuaacucuuucuaauaaucuuucauugaacuuaaugguuuucaagaauggaauaucaucuugucuuauuucaguuccuaggccucucagucauaguuacuugauagaaguaagcuuucuauuucaaauuaaaaugucaucuaauaauuauguuacagaauggaacagaugaaauuauucaauuuuaauaacuuguaacucgguguguaguacauugauuucaauguacagucaauuuaucauaaauuauuaaagauuuuguuucuaaauuugugugucucugcacauguguguauguggauguucauggaagccagaagaggauguauccccuagagcuguaauuacaggcaauuauaagccacuugauaugagugcugggaauugaacucaguucuacaagagcaacaaggacucuuaaucauucagcucucucuagccuauucuucccucccucccucccucccucccucccucccucccucccucccucccucccucccucccuuccuuccuuauuucuuaacuuuuuuuuuuuuuucuucgagacaggguuucucuguguagcccugguuuuccucgaacuuagaaauuugccugccucugucucccaagugcugggauuaaaggcgugcaucaccacugccuggcaauuauccauucuuaccauuuauuauuaguaguauuauauaucugagacaaagucuugcuguguaauaaccaguuuggccuugcauuugagauuugucugucugugcuucauuccucuguacuuaauaccuaacucaguguacuguauuacuaacucaguguacuguauuacuaacucaguguacuguauuacuaacugacauauuuauuuuuguuuuauauugaguauuggaaaucuggugcauacuuaaaacauuuuuugacuaaaccacaagugcucaguagcuaucuaugagcuccuggcuaacucuguggguugugcaauuggaaaugaaacauaacuuguaaauauuuauacuauguuucucccuauacaccuguguuaauauuauaugcucucuugaaaucuuuuuguuuaaaugccauagugaacauuuggaguuguaaugagauugagcaucuuuaauguuguuuuaaacacagacuuuuuugauauuggaggcuccauugaaccugauacagaacugcggaugacuuugaacuccugguccuuguccuuuaaaguaugaagguugcugcacacaccaucuugucaucuaacauccuuuuucuuucucaucuugugcuaugggauaaauuucuuuuguacugguuuauaaggcuuucuuuuauauuaaggaugcuuacuuuuuuauauuguggacaguauuucccaguugucuuuucccuguucauauuguuuucuagugauauuccugagucacuauuuaguggaaucuguuaguuacauuuuuauugguuucucugugaugguacugcucaucuccccguggauuauaauuuuaucuaaaugagauuuuucuguuacuuuauaauuuauuuaaacuuaaaaugaacauuuccauaauuaauggguaaacauuuguaauuuguuuucugguguguauuuucuuucacuguugugucuuuaucuaaguaugacaggguacauuaauuucuuauagggcaaaguguauuuucagcaguguuuggaugauggucaaaugcagugucuucaaggugaauguggugguuacuuugucaguuaaaugcccgcuucucaggcaaaguaauaaaagcuagccacuagguuuuuuuuuuuuuuaaauugaaauuacauuauaguauuuucuguuuugauguuuaauucuuguuacaauuuaguucuugucauuuguguuuuucuguuucugcaguauuauuaccccccccccuuuuuuuuuuuuuuuuuggugagcaugagugcuuauguggaggaggcugaaggaggaggauggcuaucugcucucuucaagucauuuuuccugagauagguuuucuuacuggcucugaagcuucuuaaauuuuacauauuaacaucuacauaaaguuaauaaccaugaagauuuuuuuucacuguguagcauuuucuuguaaauaugcgugguucuugucucagagagguacuauaauaaauguuuagaaggcauucuuuuauuguaucaauuuugaaaguucuuugcucuguuuaaaguuaggagcugauugugaauuguguugagugucuucuuuggcauaauacugguuuuucucuuuucacagaugaugacauggcuuuuguuaguuuuuucuuuuucuguuuugguuuuucaagacagggcuucuuuguagauauggcuuuccuagaacucacucuguaaagcuuugcuugauuguaauguuuguuuauuuagcuuuggauucaauuuguguaaguuuuauuuaagauuuuuaaacacuguauaaaguuguaauuuuuaugcuuucaaauauagucuuauauaaacaaaacuaauauaaaucaccuaagaugacuuuggucuauuugggcuuauauucuuauauuaaaagcaguucuuuguacaacuuauuaauacucuuuggaccauacaaauuuuauucaaauuuuuuuuugaaaaacaauuugucagauauagggaagaauguaaucagaucaaaaacugaauaauguggaaguuaacagaggugaucuguuucaauggcucucagaagaaaacugcuuuuacugauuucuugagacaucuuuuuugauacuaaguucugagaggguaaacgaaucuuacaaauaaaugacaaaguaguuauuuucaagggucaauuccauuuuaccaguauuuuaucaaagucauuugaaccuccagauagauuauagaauuaaagccuuuaauauguuaauuauucucauucucaggugcauuuuaccugguguuugaauauauggaccaugaucugaugggacugcuggaaucaggcuugguucauuuuaaugaaaaccauauaaaaucuuuuaugagacagcucauggaaggccuggauuauugucauaagaagaacuuuuugcauagagauauuaaauguucaaauauccuucuaaauaauagguauggauaugaaauuuauguuuuuaaaguguuaauauaauguauaacuuccuauaaauuagguuuauucuaauuucuuggguaaggaacagcagccagugacuauugccuccacaguuguucuccaguagcuccaauaaugguuugcaauguacauauguccuuuuuguuugguauucuuccagauaauuugaagugaaucaauuuaaucaugaauaauaugauuucagcuuuagguuuuuguacagauuuuacaaaacaaaauuaauuuaaaaaauuauuuguaaugaguggguguuugcuugcaugugugucuauguacacugucuacagugucuguggaagcucgaaguggguguagauacauuggaacuggaguuacagacguguguuagcuaccaaauggguucugggaaugggacccugguuuucuaaaagagcagccaucauucugcuucugaguuauuucuuuguccuuauccccaucuccaaacauuagauuuuuuuuacauguauuuuuaaaauauguauauauaagguuuaugguaaauaucuucagaaacagcauacuucuaguauuauucucguacuuaguauuauuuuuaaaauuugaauaaaacaugcaucaccugguuuuaaauaguagaaaauaauuugugcacccuaaccuuuuaagagcuagaaaauuaaacauaaauuucaaauaaugugauuuaguucuugggcacuauuugaauacguacuucuagaccuaaaugucauuugagguacuuuccuaaguaggaacugaaggggacaugagauacuguuacacuaacaccauuaaguguguugggcccuguuggaggguugcuuuagacuaaccucacuacugcaucuuuuuaauaguaccgagggauauaaggcucuuuauaaaauaagauaguauuuguguagcuuauuuaaaauguaaauguuguauaaauaguugguacaguauuagguaggaaauauuaacacacaugacuugaguacaauauagucccuccaguaguuuugaucuauauccaacugaaucagaaaauuaagaacauguagauauguaugauugaauggacccauaacaacaauaacaagaaacuauccaaagcaaaacacuaguuguuagguuguacauuuucccauuaguuauccuugccugaaguauagcagugcaaugagagaauuuaugugguuuuuuuuguuuguuuguuuguuuuuguuuuuuguuuuuuuuguuucuaauguguuuucauugagcccuggaauagaauauuaaguauauauuaucaaaaucaugguaagcuaaugcuuuuuuauuuugucuuauuccugccagaggacagauaaaacuugcagauuuuggacuugcucguuuauauagcucagaagaaagguaagagcuccuugaaacaaauaauuuuaagcaguaaguucaguuuuaaaagcuauauuuagaauauuaauuuuuaaaaauuuuauguguaugagccuuuggcuauguguuuguauguucaccauaugcaugucuuguaucuguggagucggaagagggccuuuggauccacugagacuggaguuacaaaaagaugugaacuaccaugugggugcugggaacugaaccuaggcugucugaaaaagcaacaaguguucuaacuggugagcuaucucuccagcccugauuuuuuuucuuuuuauuuaacauuuuuguuuccuaaauaauaaugaaaauuaaaacaaaaacaaaaaccuaguuuggcugucuuaaucuuacaguuuuguuuucaguuuuuaaauaaauuuaauuuuuaaaugguggauaaauuaaaauuucuauuaaaauguaugacuccuaauaugagugcaauaaacuuuaaauuuuaaaaauuaauacauuuuuaauacagaucaagacauuaaggauuuuauuuguguauuuaauaauaaaguuugguauauacuuuauaaauaguacauuuaaauucuaaacauuuguuuuucuuaauuuuagacuucaccuuuuuuguuuuacuuauaucuauuuacaguaguauguuuuuuccaaacucacuagaacuauuuaaacaagcaauugugaaggaaguucaguguaugagauagagacagauggagcuucucuggcuaaacuugggguuguauaucugauuggcucccuuuaugucugguuguaaaggaauaagauucuuguagaauuaauacagacuuucaaaauaaaauauuuuguugaaauaaugauuuuauguaaauaagcuaugggauugauuuauuugauuuaauaaauuuaguauagcugauuguagcuuuuauuuauguauuuguuuaaucaaaauuauuuugugaauuaaguaauaagcuuuuagaaaauuauuuauaauugguauaucaaguuacauugcuuugaacuuugaauaacauuguagaauggcuaaugcaggaggauuagccagugucuuaucucaguuuuuuuuuuauuggugguuagaacaauuaagaucuguuaauuuucaagaagacacugaauuguuauuagguuuaucaaguugauugcuaaauaucuugaacuuaguccucucaucuaacuaaagauuuuauauuuuuugaacaacucugucuucaacacacaacucuuagcaauuaaccauucuugacuuuacuuuuuugaauugaacuuuuuuagcuuuuauacacacacacacacacacacacacacacacacacuauauauauauauauauauauauauauacacacacacacuauauauauauauauauauauauauauauauacacacacacuauauauauauauauauauauauacacacacacuauauauauauauauauauauacacacacacuauauauauauauauauauauauauauauauacacacacacacacacacacacacacacacaaaaaugagauaaugugaccuaugucuuaugugccugguuuauuuaccuuaauguccuucaggcucaucauguuguuacaguguguaacaacaaagcauguauuauuuuuuauaaaauauuuuauuagaauuuugcucauauacuguauuuuggucauauucuuuaaaacacucccccucucccagauccuuccaccucucugucuacacaaauucauguuauucuaaugugcauauauaccauacuuucuucaucaauucuucuucuucuuuuuaaaaagauuuauuuauuuauuauuauauguaaguacaauauaacugucuucagacacuccagaagaggguaucagaucucauuacagaugguugugagccaccaugugguugcugggauuugaacuugggaccugcggaaagaguggucaaugcucuuaaccgcugagccaucucuccagccccucaucaauucuucuguuguuggacacauucaguugugucuuuguuacugugaaggacugaaugacuuuaacguauauguugacagggucaaggagcuauaaaguucagcuuuuaaauucuuuuacuuguauaaaauaagagucucacaauauaacccaagcuggccuugaacucagagacccaacuacuucuaccucccaaguguugaaauuaaauauguauaccucuguacuugguccuaaauuuuuaaauauuucuaccauauaguaauguaucuuuugguagaauuugugaagaaaauggucuuaauguuacuuagucuaaaauuuuacuugaauaauaauuuuuaaagguuuuaacuaaucuggcuauuugggaggaauuuugguuaauuaauugauucuauuuucauaaucucuugacauuucacccuaguuuuauuguccuuaauguaacuuaacuaucaugcuugaguguuuuacuucuauucuucuuacuuucuuauguuucauucuaauuuauuaaccuuuuacagcuaauagguuacuuauugaagauagccccaugcauuuggaauagaugucccaaacaaaauuauuguauaguauauacauacauauaugauaucucucuuuggcacuaaauauauauauguaguauauauguugcauacauguaguguguauguguguguguauauauauacacacacacacacacacacacauacauacauaauauauaucaaaaauguggcaguucacugacaugaucucuguugugguggauugauguaggaauuuucaggcuagagaaauuuacagcccuguaauuuugauucuuaaaguuaugcauaguaaauucuuuuuugggggcagucaaauuaaugagaaaaauuuuguaucccuuguuuuauaagcaaacauaccaucuuugagagaguuguuccuuuagauacugccuccccaccccauuugcauuuuuaaaaaguguuuuuaaaauuuacuggagaaauccacuuuccuauaggacaaaaaguauuuugcacaaaaguuuuaauuuacugcuuuuucuagagaaaauauuaucacauuuauuauuacuguuuuaaguuugaagaaauaaaauaguccuaaauugagagacuuuuguuuguugucuuuucauuacccuuuaaucaguuguaaaauccuguuucuugagauaaggucucacuguauagcccaggugggccucaaacaugcuuuguaguuuagcuuguucuuguauaggccuccugaugguaccucagccacuguacugggguagcugugaaauauugguuaagcuaguuaacuaauuucaugacucuauguuaugaugauggauuuaauaucuccaaaguugcucguggaggagaugguucacuugcagagggccuagguuugguuucuagcaaccaugugacaccucacuacuaucuggaacuccaguuucaggguaucgaaugcugucuucugguucuggccuccaugggcauuaggcaugcacauggaacacauauagacacacaagccaaacuaucacacccucaaaaaaauaacaagacuucacaguuucauauacugggcuugaaguguugcucaguaguagaaccccuauguggugugcuugagauugucagcucaacccacagaacuaccaaaaacaaaaugcuuuaaguugugacuuacaaaguacucaaacuaaugaacaaacacaaauaucuauuaaugcuucuaaaaguugccauuaucaagagaaaacuuccuuaaaugguaaccaaagucugcugcauuucucugaucccaucaaaggggagagggagaaaaggguuuuuagaacuuuugcuaacaccccucccuucccaagcagaacauguuaaaagaaauggugccaccuaguggcuguuccaaucuugccauuuguccagguacuuggagaaauuauucagcauuauggcucaauuguucuuaaaucuugaauugaugugauuuuagagauggaaacuuuuguuuuuuaugcuuuaaaauaucaaaugugguuuugagaaaaggggacccugacgugcagaaugguccuaauguauagcagggaacuuugggguuccagguaaagcugaagaucuuuugggaggcuggagaccuuaagacaagaaaauacuacagagugauacacauaacaggaaacaguacccuucaacaguauuuacagugccagucuuacucagaucgaugacuuaaucggaaaaucagaaugaaauugcaguucuuucuauccucauguauucuguuuugauuauguaaaguaagaaaggcaacuaaauuuucuagcaguguccuguguacccuccuggaaccuaccacccacauuuccccuacuacaaaucuaauucuuuuucauguuaucuaaagcauauguguuuguugcacaucuccacuaaagugcugugcauaucuuaaauuaagccauguuacuugccuuguuaauuaugccagaaaaaaauuacuugaagugaaaguccucugagaugguuacaaguuaaaauacaugguuuuuuguuuguucacaucaccaguacccaaaaaauuacuugaagugaaaguccucugagaugguuacaaguuaaaauacauggcuuuuuguuuguucacaccaccaguacccaauagaguuaggaaguagaucuggauuuauugacagaaacacuguuuucuguagugcuuucuagcuaaguccuuggaucauaccuugaucuugugaaguaucuuuuucagguagcgagcacuaggggcuucaccagguuucuuuaaaugguaccauuagguaaacaacauuuuuuuuguaguuguuuuauagcaaaggguuuccugaacuuacuuaguguuuugucugcauguauguauaugcaccauguguaugugcaguacccaaggugguuagaagagaguguugaauacccuggaauuggaguuauagaugguuuugagcugccaugugggugcuggaaguuggaccuggguucucugaagagcugccagugcucuuaacuccugagacaucuucagccccagauuuguugaauuuaacuggcuuuguccucccaccucuccagucagaauauauguuuuaacuauaguuuucuagaaguagauuaacaaauuauauuuuuucacuuuuuuccauaaucacauuugauucuauuguauuuagguaguguuuaauacuaaacuaggacaccaaaaaugaaaaaaauugacauaauuacauuaagggcuuuuuaaaaaaaagcuuguuguuguuucugucccacuuuucaauaugauaaugucagcugccuuuucaaaaauuaauaaaaguacuuacccaguaugcucaagguacugguuuggauuucuaguuaguuuuagguuuauaaaucaaacccaaagucaucagugguuuacuuaauaauagcaaaauuggaacuugcuggcuuuuagacccuuuuauuucucaaguauguauaaaguuuaguuuugccaucugcuaauaagagcucauuggacuuacuguuuuaauuuaauaacaggaaguuuuuaucugugugacgccuuugaugaaauugcuuagaacuuugauuguguaaauaaguugaaacuuuuuucagugcuauauccaugaagaaaaaaguuauguuaucauagaacuuccuaauucuuuguaugguguaaauaagaucucuaggauguugggaaucuguaaccagaucuggaaguuugaaaggcaauuuuuuaggauuccggauuuccaauaauuucugcauuuggauuaucucuucauaaugcaacaauacuuuugaauuucuugggauuuaaauucuuuuuacuuugaaacauaauuuacauuucauuuauuuugaucuuuaccauuguaaauauaugaaccuaaucauaacauggaguguuucguguaauacuauauaacugcuguuggguggugugguuugugaaugggcuucacuacucuccuagcuuuuuuauuuauguugaauuuuguuuuuaugauuaaaguccuucuguuugcauacuuucucaguguuugcuuuuuuucucauuaaauaguaaaauggaaaauguggcauaguauccuuuugggaggagcagaacuagaacaccaacuuuuuuuuuuuuuuuuuaauuguuguuagggaguuaaguauaaugacccaggcuggacuugaacugaaaaucccccuguuucucagcauaccgagugcugugauuucaggaaugcuccaucaauuuacuuuuuuagaguuuguuuagaacauuaauaagaccauuaacuuucucaaaggauucuugcucccuccaacacccucuccugcccucaccuccccggacuugguuucugacucccugcucuagaaaauauacauuugcucagccaucuuagggaagauuucagugugguugguaguaaaaacauuuuaugggucuugugcaaacagucacuggaaacaauauguuuuaaaacucauuuuggcuguguuuugaaaaaugaguuaaucuugaaaaucuggaaacaagaacuuuugauuaaaaagcuauugcacuaaauuuugauaaaaauuauuguggcuagaauaggacaauagacuauuuauaagaaagaggugaauuauuucacaauggucucuacuggagaauaguuagaaaccauuaccuguuaugaaaacucuugucuccauuacuacuucuggucaaguaacugaauacauuuacaguuaggagaugcaaaacuauugaaagaaauuuaguaaugacuuaaaguacuaugaucucucacuuaaucauauuaacugaugguuccuuaccucauuguaccauuaauacuuaaccguagcaucaguucaaauggcgacugucauguaaucaugcaggcaacuugguuggaaccugugaucacuugcauaagccuuccaaggcuguuggccagaaauaggagggguggaauuaggagacaugccuagaaaagccaguagcaagcacuuggccacauggccacaccucacugcagugaggaugguacgguauuuaguugggcagcugcucuagaagaaaugaccaaaguacuagaggaugcuguucucacuacugcaacacuguuugaaagcaguuuucaacagaggaauuuuugauaggacaguuaggauagccaucuuugaagaaguaaauuggaacuaagauuugaaggugaagaaagaaaauguaaugaagacccagacaaagaauuuuacaguaggagaagauuaguugaugguaagcacccuggcauuuuucaaagucugaaauucuauaguagggucacaggaauaagauccucaguauacaagcuuauuguaaggcugaguuaaguuuuauuuauuugcagugggacgugaucugguuuucuuuuugaaacaaaauguuuuuuaaaagauggaugaggcaaaggcacuuuagaggugagaaaaccaauaacuauacuguugagauaaguauguaagcagcaauaauagcagcucugcuguagaaauuauuuaauccugaccuggaguuuuuagccugccuuagaucauucaguucccguauaaaacacacacaaacacacacacacacacacacacacacacacacacacacacacacauccuuuauauuuauaauaagccuuaaacagcacaagagcugggcuuuuagaaucuacuuuccuauccguauaccugaguuauuauuuacuaaguuuuaucugggcugcucuuaacuccaacugaccagcccucggggccacguuuuuauggcucacuuaacugcccaugguguuuucuccuuccuccugcaucacagcucacucuuugguuguugcuguugaaauuguaaaaguguugcauuuaagaugacuuucuugaucuuuggguagauacgauggcauacuaccugucaucuuagcgcuuaggaacuuugaggccuaccugugggcuuccugugggauaccuggggagaccaugcucauuccccacccauaagagcaaagaaaggcccuggauuguuuuccugcagcagcuagguagguguuaacagaaugaucggcauuugucacaaccuuacgguuuucuuucuuaucucaaaaaaauacuacaaauuauaguaugaaagaaaucacugaagauuuuauuauguuuuguuugagaaauuuaaguauuuuaaaucuugcuuccuuuacaugaaucuagauaggaaccaccauaaccaaaucaaccucuccaagcucugaccuccuaagagccuauagaagagacacauugaaauacaccaccaaacaaaaauaucuggcaaaaacuaacauuuuagaaauacuuagaaaacaauuaacugauaaauaauuugugauacauuuacaacuacauuuugugcaguuuuguguuuaaucaucuugcaaguugacuauucuaaauuugauaaagguggcuaaccaaacuuaaagcuaaaaaugaccauguaauaaguuacauaaaauuuaauauaugucauguaaacuaaucuuuuguuuaaacuuuucucuuaaauaaauuucaucacuuaaauauuuguaguuucuuuauacuuuauuuucuaaauuuaaaaauuauagauuuguauuaauuuaaauauuucuuugagaguauaguuaaucuagccucagucuuacagcauaggcuuaaagugcucauagacccuuugaacaauugaaaagcuaguucucgcauguuuuccaggcuuucuuccccuacccagaagacucacaugucaccuuauguuacauuuaagugcuggcuuuauguuuggguucauguuaaagaauguuuugacuuuugacugaaguaaagagaguuuuaauaagacaguggaagcaagucaagauuaauuauugaaaguggagacuagacuuuauguugggagcucuuuugcuguguaugaaauaauaguauauaguuaagaaaaauugaaacacuuuaacuauaugaagauaagugauaccaggaaauaagcaaggaaaauuuacuaagucaaauauacucaauuuucauuugcuucauagacauuuuagccagauguguuacaugccuaacuuucaguucuuggggccacaguugggaaaagucacuggaaacucaaggccacucuaacuacaaagcaaucccaggacagccagggauggaauagugaggcuuugcuugaaauuaaaccaaacgaaaaagcuuuaaacucucauuuguuaacuuucaguguggucaguggucagugucaacggaaguuuuucuuuuuuggggggggggguucuggaaauaugaugcccaaauugauaaccuaagaguauuggugcucaaauuauuuagagaaauuuggccagguuaggacagagcaguucagauacauccuaggcuuucuggaaacuuagaccugugguugcuaagagaaagcugcuggguuaaauugugggcauuuuuuuuuuuuuuuucuuuccuccccaaaugaauccgauucauccagucucaggugagugaauagcuuuccuggggaacuugcuaccugccuuuguuauucggaagacagcuaaaagaauaagguuuauaaagaucuaaagauguaguuacucugaaaucuauaaaccauagguccugauuuuuuaggaucaucuuuauucauaugaaucauaaagaaagugacuauugucuaauguuuagaaauacuuugcugaagcugggcagugucuuuaauccucagcauuugggagacagaagcagauggcucucuugaguucaaggucauccugguuuacagagcaaguuccaggccagagcuacacagaaaaauucugucuugaaaaacaaaaaacaaaaacaacuuugcuacugaaauuuguacuggaccauggucagacuuaguguuauuauaaauuggcuagauuuacauaaccuccaguuauauauauuuucuuuguaguuuucugaugaagcaccauaccuguaacuuguaauucuguguagucuagaccacagauaauuauuauauagucaacaucuacuuuauuuuuacaaaucagggugcauccaaauguguuaaauauuaucaaagauaugccuaacuaaacacuuuugcuaggggccaacugugguggcacccaccuugauuccuagcaacauggaaaagaggcaagaggaucucugaguucaaggcuagccuggucuuuauaucaagacccuaucucaucaacaaacagcaaacuuuuguuauaaagcacuugccuagcacacgagccuucuucaauccacuccucagacccaaaacaaaacaagucauuggauuagguaaucucagcuugaacuacauuguuuuucugcaguuguuccuuuaugaauuacuaauuuuuaaaguuuuuauggaaaggaaaaaacauuacuuaaauugaguugaugagugacuucucuuugaccaaauuacaguuaauagcuaacugcuuauuuuuauauucauauguucagggaauuacugcugcuugcccaugcauuguaugauugugugaaauaccuuagguaaucagaauuagaaugaucagauugcuuugauuauacaaaguaguauuuuuuccauucauuauuuauucacuuuacaucccaauauuugcacucuaccccccccccuccagucccagcucuucccccuuuucugagaaggaggaaacccucucaggacuagguguauuuucuuccucugaggcccagcaaggaagccaaguuaggggaaccggauccacagacaggcaauagauucagggacacacccccucuucaguuauucgauccacaagaagaauaagccgcacaucuacauaugugagggugacuaggucuaguccauugcuagcucuuugguuggugguucagucuuugggauuccaaaguaguauugagagaaucucuuaauauaguaaaugcuaacuuuaaagaguccuaugauuuuucuuuuugugucuuagucgcccauauacuaacaaggucauuacuuugugguaucguccaccugaauugcucuugggagaagaacgauauacaccagccauugauguauggagcuguggguaagauggacacauuuucuuagaguacuaaaaaguucuguuagugaauuaaaaugagaaaauuuagauaauaauggugcucuuuuucucuauuagauguauccuuggugaacucuucacuaaaaaaccuauauuucaagcaaaccaggaacuugcacagcuagagcuaauaagguaagcugcuggugacauccauuguugggaauggaugaugucaugcuccacagguauugaacucauuucaagcucgugucguuagugacuacuaaacggaggacaaacuagagcgcaacacuuugauacucauuccaggaaaauuaaggaucuuaaagaugguuuuuuuucuuuuauuuugacauuauuuacuuuggugacauggauuaagucaaagaacuuagucucucauaggacugagaaggaagaguguaaugauaggcgagagugcugcauaacuaaauaccauguaaacugcacauacuagaauauauggcuaugcuuaucagcauaugccauuuuugguaggcucuuaggauauaccuuacaagcaguuaauuuucucuucagauugcauuuuaagaguauucuuuucuguuugcccuuuuucuucuuuagucuguucuuuuuccugucaagauaugauuucacauuguagcacaggcuaaccuugaacucucagaaguucuccugccuuagucuccccauguugggauuacagguauaagucaucucaucagacuuuaaauuuucuuuaaaggaguuugguuuucucuauaacaauguaaauguacaacauauaagauugcaugaaaauuucaaaaugagaauaagguaauuuugguagaaaauuuggaaggagacacaaauuuacagcauuucccuuuuuuaacugaacaaaauaaauacaaagcaacagacaggacucagaaaaggauuccuaacuucaucuuagaaaucugaaagauaccgucuagaaagaagcauuuuauuuaaagaagaaaguuguacgaguggauauucugccuaugaggaaguucauuacagucuuagaguuuggcuaccccuuaggcaccuaccucuccagaaaaggccccaaacuuuaacauuguucuuuuuuuaguggcuagaucuuuugcuauagugcacagcaaacaaacaaaaguguguuagagccucuucucugggguaacauaucuacagucagaaguaccucauccagaacgaacacuacuuccaaguccagagcaaccaguugccuuauaaaaugaaagcauauguccuagccuuaacccaugggaaucuacauauggaacuuuucaugaaauuacaagaagauugucucaguccauuucauuuuuguuacugucugaauaccacagacuagauaauguauguagaauaaagguuguuuagcagugguggacuuuaccaggaacacagcaagcuuuuaucuuucuuuuuugauauuacaggcaagugaacuggaaucaugaggaacugacacucccccaauuuuuucagugcuaauuugaacauuuauaagcauuaguuagaagaugccaaaaaugagaauuccgaaagaaugaaauagcagaauaugugcccuaaauuaaauaggauaaaauuagaauacaaaaacgaagaugaaguuugcauuuuaaaaagaguaguagagaaggcaggaggaaugguucaguggguaaagaguugcugugaagccuaaugaagugagguuugagcaagaggacuaauucaucacacuguccucugcacaugccuaccauaacaagugcacauggcugacaagcauauacaaauuggaagcaguagaucaaauauuaaagugucauagcucagucuuugcuucaguucagucuugugcauuacagaucucauauuuaacucccucuuuugauuguacuaagaggucacauuaaaugauccgccaaacagugcaguucucagaacagauccugucuauaguguaaguaagaaaaugaaaccagcauagggaucauucaggugacaaacggagcagcaaaagaaagcccagggaauaaaugaccacaguacaaaaauggagagcuucauguauaacgccaaaaugucaugucugaaggaguuacccacugcacuauguaaauuaaucuuauaacuuaacagugagaaaagaaaugcagugaaaugaagacuuugauagaaaaaauuaccucagauauaaaggaaaaacuacaagauuauuuaauucauaaaaguaauccuguaacacacuagaaaguccuaaacuacuaucaaaguacucagaagaaccaggcccuguauguuaguauguaaaugcuugcaaguauuucuaaaaucaguaguugcaauguuucuuaaacuaauuuuuuucaaaauugaagaaagucaguaaauuaaauaaucaacaaacauucauuaaauaucagaaaagugauaguagcauaugccugagauucacuggugccuuacucugacaugcuggcagagaaagaaugcaaaggaacaccccuccuuccuguucuuucucauccuuguguguauccaacuccccaguguuuguauuuuauaguuguucuuaucauuaauuuaugaauuaacaaagagaaaauaacuauaauacucaauuugcauaacagggaauuucauauaaguggauaauggauuaggguaaugaacaaaaaguaaacuuagccaaacugaagauuucacuacuaaggcagacaaagucuucagugcccucaaagaggucagcauuucagaaugugggucagccucaaagacccacuccuccuccuguucccugcuucccucuugcauuaucuucacaggaaaaaagaggcuccucucugucucuuacauauacaagguuagcuuccugcuuucugggccaggcuuugaccacacugaugaaaucagcauccagucccuccauggaacaagagcaaagcaguuuuaugcuuguuguugauaaaugaggaaaacgauuagcuuaaaaaauguuuacaguuuuaaaaauaauguuucaagcuauaaauguugaaauggaaaccuauuuucuuaaauguugaauaaauaguauaauauaagcaauucacaaauguaacagucuagucuuucaacagccaugacucaguaccuuaagaaaaagguuccuaacuucaaucuucccaucccugcucagauuaaucacuauccugaaucuggggucacugcucuauguuuuguuuucuuucuuucuuuaaauuuaauuuuauuuuuuacuuacuuacuuuacauccugcucacugcuccccuccugggcauuccuccccauccccucccucccuuuuccucugagcugguaugugugugugggguccccucuggguaucccccguauccugguacuucaagucucugugaggcuaaguauauccucucccucugagccagacaaggcagccuagcuagaacaacacaucccagcuuuugggauagccccccccccccccguuccaauugcucaggacccaugugaagaccaagcugcauguuacauauguguggggaggucuagguuuagcugguguguguucuuugguuggugguucaggcucugagaguucccaaacucuacccauuguuuggcuguggaugucuguaucugucugagucagcugcuugguggagccucucagaggacaacaugcuccuauauguaugguucaggagucugauggguggaggagaggugguggaagaagggaggucccccuggaauagcagacugcuccaggcagcuuugccucagagggcucagagggcagggaagauggguccuuaaacuguuauguaacugcuucccaaucuuuuguugcauacuucuguugcguuccucuguaaauaguaucuugaacacauggcaagcuaaaagaauguuaguaaccuguaauuuucuagugagguuacauauuuaucuuaguuaaggaaugugaguaucaaaaagagaaugaaugucgauuuuuuuuuuuuuuuaaguugacucacauagacauagaaucuguugguuuucagaaacauuguucacgaacuaggggugagcaaguaauguuauaagugaaaggaaauaaaaaaaaaaaggauuauccuaaguacauugaaaaugcuuuuaauauuuaccuuugaaauggacaaaauaaagaugcccaaaugauguauguguauauuuucuuuacugugauuccuucuaagccuguucucuguuugauuguuggaccugauuuuguugccuacaaguccuaguugacguaguuaggcuucaagguacacauuacuguagcaguuucaccugaauuauuuaaguuaaauucuuacuacucaaugucuucuucaguuuaaaaaauuuaucuagggucuuucaagugauaauuggaaaaauugagcuuugaauuaagcauuuuguacauguaagaaauaggacuucuucugaaacuuuuuauauauauauauauauauauauacacacauacauacauauacauacauauauauauuuguacauauguauguacauauguacaaauaguaauauuucacaaacacaguuugaaauuuuucuauauugagauuucuaaggggaacauuagcaaacuauucaaguuuucaucaagaauucugucuuggagccgggcaaugguggcacacgcuauuaaucccagcacucgggaggcugaggcagguggaguucugaguucgagaccagccagaucugcagagugaguuccagaacagccaaggcuacacagagaaacccugucuugaaaaaucaaaaagaaaagaaaaaaagaauucuaucuugguaaaauacagcauguagggacuuuucaaagaacuaacagaaaaauguuauaaauaaauuaaauuuguaacaugaauuagaaauaagguucaucccaagauacaaggaagcuuuaauuacuuuaauuuuucauuuuacuaaugaaauaaucuguuuauuugauagauuuggauagacauuugcugggcauauaagcucuuuaagggaagcugggcgugguggugcacgccuuuaauccuaguacucgggagguagaggcaggcggauuucugaguucgaggccagccuggucuacaaagugaguuccagaacagccagggcuacacagagaaucccugucucggaaaaccaaaacaaaaaaccgaaaaaaguauaagggaagguaaaccacaguaaaaguuuauaucacuaacagccagaauaauguuuaaugguaaaauauuagaagaaaaaguaaagaacaaucaaucacuuucuuguauugcaauuuaccaguguuuacaaagucagucaauuaguaguguuagaaaaguaaaccaguaugagauguguauaguuggaaacaauuuguauauagcacagcauacauuuauauagagaguagaauauguugaaugugccagaugaucaccuaaaaugccugagaacaaaaagguugauuaaaaugacaagauuaaaagacauguucagauguaugugucauuuacuaaucuacaaggacaacaguagcuuuucuaaauggguaccaauuagaaaauacagugugaugaaacucaagaagaaugaagacugaaguguggacacuauggcccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacagaggaacgccagggccaaaaagggggaguggguggguaggggaguggggggaggguaugggggacuuuugggauagcauugaaaauguaaaugagcuaaauaccuaauaaaaaauggaagaaaaaaaaaaaagaaaauacaauguggaagaggaugugcucuaauaaaaucaccaacauguaugccccugaaguacugaaaaacuauaaaacuguagaauaaucuuuaguauauuuaagauuuuaaaaccuguuggagauggggcuggagaaaugacucagugguuaagaacauuugcugcuuuuguagagaacuugaguuugguucucagcacccaugucagacagauaauaaugcuuguaauuacagcuccagggcauaugauucccucuucugaucuccacagggcaccauacuuaugugcacaaauguacauauagauccauauaauauacauaauuaaaaauuaaaauaguagaaagacuguuggagagacauaguuuauuuuugauuacuaggcuuuaaagggucuuuuaaacugacaguuuauccuaucuuaaaugugguuugcuuuucauguuuauuuuuagcauguggguuugugcacaugaauguggaugcuggaacagguaagcggugucggcuccucuggugcuaguuagaguuugugagccauagguuguaggagcagugugugcacuuaaugcugugccagcucuccagucccauuguguuuccuuaaauccacagcgagaauuuccaaacaagggcuuuucacacugcacacauuguuuuaauuuuauuuuuuauaucuguguaaagauaaaugugagaauaucuaggaagggaguagaaggacaauaagaaaauaaccagaaagaacuuuuuugaaaagaaagggagaacuuaaccuagcuuguuaaaacugaauacaauaaacaacaaacuacuuggucacaaucgaguggaauuacaugagaauuucggagaguaaagcagacgauauucaccauagaguguaauacagaggaggacaaaucaaagucauuuggcuuaaacauuuauguuuaaauguuugagacaggagggucucacuauuucaccccaucuagccuuagaaucacauuguagacuagguugccucaagcuuaugacaaucuuucugcccccuaaauccugguauuaugaacauaugccacuaugaccagcaugaacaauguuuguugauggcauguuuguguggcauuacuacaacauacugagaaugccuuggaauccagaaagagaaagucucacauuucuauuuucugguucugagugggcacagacaaaacuaauugguaagauauaaggguguaggaaaugaugauguuuuguguguguguguguaguuagggaagguaacauuugagcccuguguguguguuguguguauguguguaauuagggaagguaacauuugagcggaaaucuaaauuaaguucuucaaaaucacuaaagccccuagauguaaguguacuuaauuugcuuuuaugaauauuaagugagugaugaggagcagaacagcucaguucagucuaugugcuuggugaaguguuaauugcaaguagcauguagaauagcagcauaagaacaguuucacaguuuagauuccauuuacauaaaacauaucaaagacaucuguaauuuguucaucugaagauggacuugugagaaagcuaagaaggaagaguuauuuucuauaaauuuaaacauguuugauucugauaguauuuuuagaaguuguuuaagguaugaugcuauaacuuuuuuuuuuuaaguuaagaaaaacuaaaagaacauucuuagaaguuugaguguaucagacaacaaaaguauacuaaaggggggugggccuuggagucugauagaccugaguucaaauaccagccucaugacuccugcuuauuuaugguauaaguucugugaugcuguaaauuuggcucuucauaguuagaacaggacugauaacacgcccaaagaauauaggaaaugaauauaguuagucugccccagugcagacuuucugucuuacuuuaucugcagugauacuucagucagaagcugauggguaugcugacauguugguguccaaauuaaaagugaaaaacuuaucggcuagaaauagaaauaaaaaucugcuuuaaaacuuauacugcaauggcugauuuguuuauaaucugcuuuguucaagugaguuaggcuggaggugaagcucagugguagaagacuugucuaacauguaguacacucugguuucaaucugcaguaggaauaagucaaauacagcauaauauacaaauauuuucauaaggcagauagugugaucuacauuagagauagaaagaaacaaugaaaaaaauggaaaauauuagaguuaacaaaauggggcagaaggggauaaagauuguuuuuauuuggauguagacaaagguucacacauguucuuguucugcuuuuuugagagauaggcccucugucuguacagcacaucuggcucacugaauacauucuuaguaguagauuuguggaaauucuuguguuuguuugugaauauacugcaauauguauuuuguguuucucaaacuaaaauucaucagcuuuugcagagaguaaauucaaaauuacuguauaauaugccaucaucagcauuuuaacacucuaagaauuguuaaauaaugcaaugcuauguaucuguauuguaaaucuguaaagcuucaguuuugagccuucuuauauaaguauuuucagauuaacugcuuagaaaauacacuggucuaaaaacauuuaaaagaaaaagaaacuguuaacagguaacaccaggucuuauuggaaaaaaaauacauaaaacuaagggaaauagauuauuucuaggcuggaaauguuaaguuucuaaauuuagaacaucaagauuuucucugauguucugugugcugcuguuaguugguaccuuuaauacuuacuuuccaauaguacauguaauaauaaacuugacacucuuuagcuuauuuauguucauuguagcucuuguaggcagguacuaauucauuccauggcuuugaagcaauauuuaucacuuuauacaaaagaaccgauuuccaaguuguauauuuagacugauaccaaagacaggauucaaaucuaaaguuuguuucagucuaucugcauuaugcauuuguagaaggauuguuaaacuucacugaguguaucugugcuuccagcucaccucccuugaacaucauaaauuuuagguauacucauauauuuaguuacaugucuauucuuugcuauuuuuaaugcuugugccuguuuucuguuucuucucccuauaacauauuugucuuacucucuuuuucaccuggcuaugguuuaucuuuggaacuaugaccaaaaaagcuucauuucuucucucacuuaaauuuucuuuuuuaucagaaguugaaggugucuuucaucucucuacucuaguauauucuauuuuauuaauauguaucacuuugccuggguccaaggguaacagcuaggcauacaaugaaaauauaaagggggcuggugagauggcucaguggguaagagcacccgacugcucuucugaaggucuggaguucaaaucccagcaaccacaugguggcucacaaccauccguaacgagaucugacucccucuucuggagugucugaagacagcuacaguguacuuacauauaaccaauaaauaaaucuuuaaaaaaaaaaaagaaaauauaaaggaucaaacaagugcuaacagaaaaaaaauagcaggugaaggaaugucuauucuucauggccuuuggggaagagagguccuuguuggguagauugugauaaggauacagcugcuuagaaucuaauagaaucacagaaaugggaagagcagccugcgaagaaacaggaucugagaaggggugcggcucaugugcaugaggcgcuauucuucuuugauccuauuggagcccauucucugagaguccaacauuuccuaagaggucugaggagguuuugaaaauugagucuuaagcagaaaagacacuaguagacagaaaauaaggcauuacuaguugcacauuuuaucuuaacauaguaagccucauugauagcuuuauuaaugauauacauauauuauugugguuuuuauuauauacuaaagccuauuuucccaaaugugauuaccuguguauuuauacuaaacuauugaauuucaaggcauagucauagaguagaacaguuaaaauguguaaauacucaugaacaguugcacugcugaaacuguacaacuguauauuucaagauuacuaccuucagagugcuucuuguuugcaucuagagguagugguuacaguuggguaggaagucugcuucugcuguuaccaucaagauacccuauguuugagagagaggagagaccaugaaaagccagagugagacgugguuuccuuaacuuguuuccuuaauuuguaauauauaggccacauauuguaaauaugaccuauaucuuaagauuuuaugcaguaggaagguucuuuaggagauucaauguuuaugugugaaauuugggaauuuucaaauuaaauugugaagacuaaaguauuuaaauuucucauaacauuauaucaaagcuuuuauguccuuaagaacugauugauguuuaaaaaauuauauuuauuaguuuuuaaaguaguuuguaaugauaaaauuuuuuucuuuuuucuuuuuuguauuauuuuagccguauaugugggaguccauguccugcaguguggccugauguaaucaaacugccauauuucaacaccaugaaaccaaagaagcaauaucggcggaaguuaagagaagaauuuguuuuguaagaaagggaugcuuaaauaucuggauugcauugauuuuuuuuuuuuguagucauuauaagguuuaaauuuguuuuuuguuuuuguuuuuuguuuugucuguguaucuaaggauggucuugaacucgugcugagaccauaggugugcccuagcacacacagcugagaaggucauuucuuaagaaaucuuaagugccaccuugaccuaagauaaggcauagugcagcucuucuucuagggccuuguguugugcgucucucuuugcugcaugugaagugccauucaucucaaagucugugacuaauccauuagguuuuauuuguuuacaugaagaaaacuuuaaauaauaguuuuguaaauuucacuggaacagcuuucuaugacuugagcuuaaguuuuuauuuuauuuuaggaggcuguuaguuuuuaauuuauaaccaugaauugcucauagagugauaaaggauauuauuugcuaaauaguccagaacuggauaaaaauaacaaugauuuuugaaaauugauacuugugcuacauacugcauacauuauuuaaccauuaauacuuaacugauuacuaaauuaguuuuaaaauaucaccugcaguuaucuaucuguauuauucuauaaauuaaaauaagaauuuauuaguuaauaaaguaauaaggacuuuaaagauauagguaaucagaguaaagcaauugguauuuagaauauaauuuaaaauuaauuuucaaauuuguaaacuaagugcuuauagaagcaccgagcgugugugaaggcugugcuugacucuuguguccucuggcgcuagcauccccgcagcugcacucgacuuauucgauuacaugcuugccuuggaucccaguaagcgcugcacugcugagcaggcucuucagugugaguuccugcgagacguggaacccuccaaaaugccuccaccagaguaagugacuuuuuucauuuuagauuugcauuaucuggacagcuuugaaaauuuuguuaauuagaugucaugauccaugauucuaugcugaaguugaacuaguuaggaaagacaucagaaaauuacaugauuugcacaucaagcauguaagugcuuguuuauuguugaguuugccauagaccaguaaaaacagccuuucccauuucuuuagcugaugcuggguagugauauauuuccccuccauaacaauuuuguuaugguggaauauggccgucaggccaagcuucagccagaguucugaguucuaugucaagcuuaaucuguacaacccucuacgguagguauuauuaccacugcuuaacaggagggagcaggcucaaagagguuaaaaaacuugcccaagaauacaaauacgguaaaggauggugccaguucucaaauugaagucaguucgauaagaaacaaguucugaaaauaagcugugacaucucccacaauagaaaauccuuaucauuauuucaaagaauguuaguaucagaagcauguuugcaaugauucuuacuuaucaugaagggaaagugcgguuuggaggaucagaauagcuuauuucuaagucuuuacaucgcuccuguaauuugucuggaauugguugggaagaggauugugccuuugcuucucuacgauaggggcugaagguuuguagguauuuccuugguauuuguuaacaugaucagcagcauuaaaaguaaacauuuucucucauaaaguacuuugcuguaauaaaauuuacauauuuuaaaugaauaaacaugggcuuuagaguucaaauccuggcucuuccacuuuguagucauauugagcauauuuuccacaggguuuguaauuaagauuuuauugaacuauauauauaaauggcccaugagguaguuugaaaguuaaaaaaaauaacuaucaucugacaugcagaagucauucacuaguuccaggguuuuuuuuuuuuuuuuuuuuuuuuuuuuaauuuauuuaacuuucuuuuuuuucuuucuuuuugacucaguuuggguuguauaguacaggcuggccuuuagcucaagauccuccagucuaugccucuuacaggugugcaccaccucaccuagaucagauacuguugagcuaaauguuuaauauuuagcauuuaguuuugcuuauuuagauauaucaguagucuccaaguggcuugauucuaguagcauaucaaagguuuuguuguuguuguuuuuguuuuacugguuuuaacuuuugguuuugaguuuucaccucugcagaaauguagaauauucuucaccuagauucaauaauuauugguguguggacacauuuguuucauuacuuuauaaacuuuuucugaaguaguugaauauuaagcuguugcaugaaucuauaaaaacuggaacuuuacuacacauacuacuauuauauagcauaaaacaucauaaaaacuaguacauauuuaagucucccaguagcccaauaaaacuguuuuguuuuuaacaaguuuucuacggagucaggauugaacaauuuguucagaacucacauauauguuuacuuagcauauaucuucaauauuuccucacucuuagagaagguuuugaugacacuggcuucuguguuugguaguggacaucaaacauagggccauacacaugccuggcaagggcuucugcuaagcucaaucuccagucccaacaaaggcuaagagccugagguggcugcuugguaaagcuuuccauaaucuggauuuuuugguuuucugugaucaacauuacguuaacauuuuccagugcaagcauaauaccuacaagguaacauguucucauagacggugucaagaggauuauagaggacauacaugcuaauccucaucacuuacucuacaggaaaggauugugaagccagcuucucaagcuuauuuucauacaaacuuguaaagccuuguaaguguguccacugggaucugaauguccuuuaauucacuuagcaaauguuaaacauuugggaauuuauuuuucccuauugaacuugcauuauuucuuacauuuuuauucugauguaacuaauauuacauuaguugugauauuauacuucuuaaacaaugguauguauauaaguggauuuuaauuuuaaaauauuucuaugacuauuaauaugauaucugguacugcauuaguaguacauauuucaguguuuuaaaccaucagugaauuuuguuggcuaugaagucuaguagaagugacagaccugagaucuuuuccuagucacauaguaauuuucaugucuuugaacuaguccuauuuaguagacaugagacauaguucuauauuaauuauaacuuacuuguuauuuucgugaguguucuugcaaauaagcauucacugaaagaaguuguucacagcuauaucacugccuuugaauuucugcguuaaguaucuaaaguuuugguuuuauaauaaaaaaaaaaugagaucagggagggaaccguuccucauugguugcagaggaccuugguuugguuucuagcacucgaauggugguucacaccaucuaaaaacucaguuccagggaauucgaugcccucgucugacuuuuguggguaucaaacacauauauguuacacaaacauauuugcagacaaaacacauuucaauaagcaacaacaaaaaaaguaagaacauuugaaaagcuuccucccuuccacaggucuucugacaauaaggaagucaugugacccagaagcucauuuagacauuagucauuaauuuuauuuuacuagcucuaccauuuuuuugugcuaugacuuaaaagacuuguggaguuguuggguuuuuuguuuuguuuuuuucuuauaaauuguaauucuugucauugcccuguaacucagguacacuuuccugcacuuuucuauuaaacagcaagguagcaguccacucagguguucugugagacugcuauggaauguaugcucuuagauacaucauugaggaauccaagucaagguuaggaugacaucgguucaguauuuaaauuaaaagugcccucuauuuaauauguaagagaaacuacuaaguagggcugucauucuauaaaguauauaacuaagaugugaauuaaaaggccucuagccuauaccuuaucagcaguauaaaaaguauuaaacauuuggacaguaaugugaccaucuaucauuagaauaaguauuucaugauuugauaaacaaccuuuuagacaacugaaugaagaucagugauaucagacacaaauauaguauagccacucacaaauacuguaugaguggcuuugaccaaggaugcccugauaaaauuaacauacuacuucugucuccuggcaauagguaauaauuguuaaucccauuuuuaaagaaaaaaaacugagauacagagguccauuuacuugucugacaagauagcaaauaaguggcugagccagcauuugaaccuucaggaagcacauacuuuugguuaucuggagaacaugccugauuuguuuagaaaaucagcauaaauaaucugccauuuuagaucauuguaagguuuuguuuauauuucauagagaugaguguuaaaguaauucauaaugaaucucuuuaaguugugggagggaacaaacaaauccuuuaccuggauuucuuuacuuuuccacaagaacauuguauuucuuggcuguuagaauggaggagauguaaugauuuuauuuacccuaaccuguacuauagaauauuugaaaucaccaucccaacagaggcuacagcccacaucauaaaacacaaacacauucccagaaaggaaagucuuuuggaggguuuuugaugccuuacagcuucccaguaucaauauuucaaauuaucccuuuguuuguuacuccaggagguuuuuacacgcugaggcaaugcaccauaguaagauggcugagagguaugccuuuguuuuguuuucggaccucaggugcauagacuugguuuaaucauaauccuugugucacucaucauugguccaugcauggcucucuguuauuauuuuaguuacuuuaauuaguuauuuuaaauguuaauaagcagccaugagccuaccaagcaaaagcuagaaccuugagaauaacccacuuuaaucauaucauaacccuucuuccuacccacguguucccuugcccucuucuccccaagguaaccaucauucccguuuccuuauucuuguauauauuuucuguugccaucuguauguauccauaaaaauuacauuuaaaaaauguaguuguuuuucauuuuauacaaaggugucaugcuguuuuguaauccuguggaaugacauuuuuaaauuaauauuauauugcuaagauucaaccauucuguugcauaugccuuuauuuuauaauaugagaaaguaauuguggaagaauuaucuacuugagcauucaggguguucuucuaguucagucuucgaaaaggguccauguggaaaugcagcacccuuacacaaccuuagcuacacucuuggaaaguccuauguaccucuugagauaaacauccaaguugaggacagcagguauauaccguuagauggcauugcuuaaaagaaucuagauauucugggcaaguuuauuaaccuuuccaagccuuaauuuucucaccuuuaagcuagagaaaaguaguaguaaguuauuacugggaucaaaagaaaacauuuguaaaucaaguauuuuugucuuucagaaaaaguuacuuuuaguguucaguguuaaagaauuauauugagaugaaaaguuauuagagaauuagagguaauuuugguaguuacugaucacguagaauucuguugaugaguaugaugagccucucugugccuggauuaccuauucuugagacucaucuauagaaucaguuuauuuccaaaacaauugguaauaguagcaaauaugugacuaaaaauugaaaagauuuuacuaaaaaguucuguacgaauccuguguuguagccuauucuguuacucuccuuuuuguuuaugucuggcuucuacaaauagcauguuucugcauccuuuuucaaaauuccuguuuaguguacagugugcuauaguugguuuaaaaaaguuauucuaauagcuuuuauuaauauauauucauaauuuuauuuauugauuauucagaagacaaaaauaguucaucuguaggguacagcaguucauaugcgggcacagcagcugugacaauaugcacaaggcccacuucagaucaagccagacaaaaucccagcuuggagggaaggaguuagucaugaaagcucacucccagcugaggagauaugugcaguuauggcugcugggaaagggagagucaccuuuuuucuucagagauguggccccuuuagaguauauuuauauuccagcagguagccucuuacccauacacauacugguagcacuaaguugacuuagugaguuuugagagagaaagaaaacacaugaaauugggagggcauagagauuuaggggagauaggaaaggcauuuuaguggggagauucgggauguacuuguucaaacacauuaaugcaugaauacaauuuuaaacaauaaaaauuuaggacaaauaaaaaaaaaauaauuaguccaccacuaaaguuaaaacccugaaguauggaugaauuuuauugaauguuuguaugaagcuuuccagaauggcuugugggaggggaauggcuuucgugguacauuguaacauuaguauuuguggcuuuggcauuugugauuuagcauugauauguuuuuuucagccuuccuuuguggcaagauugucaugaauuauggaguaaaaagagaagaagacagaaacagaugggcaugacugaugaucuuuccacaaucaaagccccuaggaaggaccugucucugggcuuagaugacagcagaacuaacacaccccagggugugcugccacccgcacaguugaaaucucagagcaacucaaauguagcaccuggucaguaaugcuucuuuggcuuguuuuguucacauugcuuuguggccugcguugaauguguuuguucuccuguuaaaacauauuauggcaaaaagaugaacugggcauuacuuuauuguuggugccagcacaacucgcauuacaagcagucucaaaucauggauuuguggugauugguuagauuucuuuuuccuguuucucuaguucaagagucaagggucuuugauuaacauuagcagauuuaguucaguguuuaauuaaggcauagaaaacacaaagauagccaaaacugcaaaaggaauuuuucaucccauugguggauaucuaucuguacaucauucuuacuaagacuguauuuuaaaagauugaaaucuguuauuuagaccuaguuauuucuuucuugcauucauaucuaucuaccugucugucuagagauaaggucucaauuuguagcccuggcuguccuagaacucucuuugcaaguaguuuggcaucaaacucacaaacaaccacccaucuuugccccccaagggcuggguuuaaagaugugugccacuaugguuggcuaguugacagguuuuaaaaaauugaguuucaguuuuccugaagaacuaaguauuggaggaagaaaacuaacuagaugugucuuacugguaguaaguugauaucuaauauguauguuuguguaggucuaucuaacugaaaaugguuuaacguuuuuuaaagaaaguaaucgaauaaaaagauauuuuauuauaguauuacaguauuaguuuuaauuucuaaaaaguuauuugcacaacaguuaacuucauuuuuguagaaagaauucagagacugcauucaggauuaaauuucagaaucuaggaucuuggcaauuuauccacuuuuaggauaauuaguauuauuuauugucuuauaaaguggcugugaggauaaaggcuacaaaugcuuaacagugcuggcacuguuagaguuacuguuguucauuucucucauacagugauagcucaugguuaaaucugcucuggugguagucuuuuucuuuuggaaaguaaauuccuaaagaugaauuacccaaaauagacuguaguuuuaaugucugucuugacuuguguuguaguuagauuuugaaugucaugacagugaguagacugaagugcucauucacauuguuucauaacucuuccacaaguggaauucuaauuguguaaugaagagguuauggggguugggaaaacugugaauuauggcaguucuaaucaauacauuuugucuuuaguaauaacaggcccuggacagccguuaaaccacagugaauuggcaauucuucuaaaccuacuacaaucuaaaucaaguguuaauauggcugauuuuguccaaguguugaacauuaagguaaacucugagacucaacagcagcuaaauaaaauaaaccuuccugcuggaauuuuggcaacaggugaaaaacagacagauccaucaacaccacaacaggagucuucaaaaucauugggaggaguucagccuucacagaccauccagccuaaaguggaaacugaugcugcccaggcugcugugcagagugcauuugcaguccucuugacucaguuaauaaaggcccaacaguccaaacagaaagaugccaugcuagaggaaagggaaaauggaucaggacaugaagcuccauugcaacucaggccuccucuagaaccgagcacuccuggauccggugagugauuggcucagagcuguugauagauauagcuuugacugcucauugacaguuguuaaagacauucucaggucccuugugagaagugguuuucuauuuuguuuacuuccuggaguagauuguuuagaaaauuguccaugugggauauuauucauuaugaauacaauacuuuuuuccuaagguaaauauacaauaacucuauucuuaguacaaaagguacuaaauguuguguguauaguagaaucuugcucuucaagcauucaguacgacuguguggaguugaaugguguauuucuuuaauaaucuuaaguaguaguggguaacaugagcacuugugagauacauccuuugguauuuugucaaagguggaauguaugaccguucugaauauuucauuuuccaugguaacuuugaacucuuucuuggguuuaucuuacuuagggcaagaugaccucauccagcaccaagacaggaggauauuggagcugacaccagaaccagaccggccucgaauucugccuccugaucaacggccuccugaaccuccugaaccaccaccaguuacugaggaggaccuagauuaucggacagaaaaccagcauguuccuaccacuaguucuucauuaacugacccacaugcuggagugaaggcagcccucuuacagcugcuugcucagcaucagccccaggaugaucccaaaagagaaggugguaucgauuaucccacaggagacacauaugugcccaguucagacuauaaggacaacuuuggaucuucuuucucugccgcuccuuacguuagcagugauggucuaggaaguagcuccgcugcugcaccauuggaagcacguaguuucauuggaaacucagauauucagucucuggauaacuacaguacugcuucaucucacacuggugguccaccucaaacuucugccuuuacugagucguuugccaguucaguagcuggauauggagacauuuaccucaaugcuggucccauguuguuuaguggagacaaggaccauagauuugaauauagccaugguccuaucacaguccucacaaacagcaaugacccuuccacagggccagagaguacucaucccuugccagcaaagaugcacaacuauaacuauggugguaacuuacaggaaaauccagguggcccuagccucaugcauggacagaccuggacuucuccugcccaaggaccuggauauucacaaggauacaggggacacauuagcacaucagcuggcagaggucgaggcagaggguuaccauacugaguaucuguuuuuccucaggcacaucauuuuuaucuggaaagacuuuucuagcugcaauuucaggcagcaauccaagagacuugaauaauauuaauucaacaacagcuuuauuuuuauguggaaagggucuugcauacaauagugaaaaaaacaaaacaacaaaaaaaaucuuugcuuaaauucaugcuguucuuaaaacuagcucuauugauuguacaucgucacagauuuuaguuaacaauuuuauuuuguauucuugcaguuuuaaguggaugcuaacauuagggacauaauguuuuuauggcccuguggcagaucuucugaacuaugcacacuugugcuuuuuuuuguaaguuuggaccaacuuuuauguaaacaagcuccccuuccccccaugccccccaucccccuuccaguuuuacaacaaucagaaagggcacugauuuauuugguauuuucuuuuuacaaagcuaccuuuagucgaaggucacugucagucuuugcaccugcuuucaguguuauugugaaagguguacuuugugcucauuucagaaaaauaaaacacaaccuuucucuugaugcaacaguuuuauauaaaaaauggucaacauuauuuuuguuuuguuuuuuucagguuaccauaauacaggaaaauucauucaaaugaaauagugguuuuuauaugaaaacuauggguaggguggggagggguugaguaagugccuuaacagguaagcuuaaggucugcggaugaaaugagccuucacaccacugucuuucuaagggagucuguacugugcugacggggcagggagcuucuccgcucucaggaguugcuuggucaguucuguuagcuccauucccucugccugccugucacacugucccuuucugccugucuuuuggcuguguugacuuccacuguuaccuucucuugguagggguguaagaggaaaagaaagggagaacucagaaccuuauguuacuucugggaaguacuaaaacuuuuuuuuaucaauuaagugguugaaaguaguagcugaaugagaauuuuagagugcuccuuucuuucuggcugucauacugacccaguuucuauuuggagggcaggaguuuugaagcaaguauguauaacaauucauaaauaaauacauaugguacauaacaaauguauugaaguccacagaaggaggguggcaaacaccuuauuuuaaguuauauaauuuuaagaaaaugucaacuuaaguagaaacauguccuagaucuaauuuaguaaagcaaacagaaaacucaaagagaaaaccuucccucuuccuuucaauucugugaaauuuacuauaauuucugccagauuagagcagugcuauucuauuagaaucaaccaagaaagaauaacucugauguugucaagucgcacuauguuuacguucacacacacacacacacacacacaaaaaaccaaaauucuauuucugaaaaggaaccaaagguaaauagccagcaucaccuucaucauucguagauaagagacucuggggaaccgcccucgcgugccgacugacaauuucaauuguuguaguaccuuucccauuggauacuaaguaaggaagaacuguuaugaaaagcagcuuagcuucaugcccuuuauaugauuugugacccugcauuuacaaacauucaggaaacauuauuguuuggugacagaauauuuuaaagauaauuuuccaguuuaugccuauuaaaaaugaguuuucaguugaccauuuuauuuuuugaucguauuuuguuggugaaagaaaaaaauuaauggaagaaaaaauauuuugcuuuuauuugaauacagaguacuaacaacuuaauaaaacaguagaggaagugaaaaaauguuuugaaauuuagaaauuagaguauucaagucucugaaauuuuaauauggugagucuuagagcuuuagacuuuccuauaagugacaguaucuaaauuauuauuugucacauuugguacaucugcuggccauaagcagcuaaccuaaaauugaaacuauuuaugugacaugaauagucuguguuuuaaaaauuaaauauuuuauauaaaauugacuuguguuuggauaguuuuucuaauuaaacauuucagauauauauauccauguugggagaguggcugggaagucagggaaauuauuggcuuugaaauagaaaauuggaacuauuucuucuaauaauguguguuuuguaagacuguguaacuauauccuguguuuaagaaaaggggaugccaauuaaaccauagugaagaaaggccagugacugcaggacaguccagacucagggugguguuacaagaaagaugucucaugaaguauuaaugcagugcugagaggugguaauucaguucggagaguuuggauuaagaacagagcugggaaaucacuaguuaaagucuguauuuuggguaagacuuaaaguaauaaaauucuaaggggguagaaucaagucacacugcagauaagaaagugaacguaagauugaccuauggaaaacagucuuccugugaaguuuuucugccucacaauuuuuccuacauggaaaauucgguaugucccaaaucuucaauuguuaccuguugguaaacugaaaauuaaaggaauaauucuagagaguuaauugauuaaaugguuuguggaaugugauuguuuaacagcuuccacuucuguuagcaaauacauaaugacuuaucaucgaggguauuuaaccacauauagaugaggcuggcagaauuucuuguuuguuaaugucuacuagcuucucuagucaucaaauguuugaauauucuaugcuuacgugaauaaaaauggaaauuugaacagagaaauaaggcuccaugaggaagcaaaaccacaaauucacugauggaaacaaacuuacuuaaauauuguuaguucauaagaauuaccaagguuugagaaaugcguuucucagugaaauggcuagcacuuguaugugagguuuuggugacuuugcugaguccacuccugcucugauuauuuuucagacuagguggaacuugaauauacugucugggaugcuggcugugguauuuaaagcugaaccagaccuacuuguaaccccaaauggaaugauuaaccuccacagugcagcugaagaaaggcuuagaggcugccugguuuauuugugauagcuggauugcuuaugugguucuuguacaccacaucuaagucugcaguaaacacuuaacauucuauugcuuuuucuugggucuucauguagcucaggauggccuuauacucacuggcuccuaauucucccaacgguuaggauuacaggggccuguuaccaugccuaugcaauaccaacuuaugacuaggaaaauugugugaccaguauuagaccagacuaauaaguuaauaauaauuuggacuaacaguaacuuuuuaagggcuagagcuagcucaaugacuauuugcccuagcaaguauaaugcccagguuuaaucccuaacaaacucaaaaaccuuaaaaacuuguaugccaggcacacuggcauaugucugcauucauaacacuugggaggcaggggcaagaaguuugaggcuaggguguuuuaccuauugagauuggaggccagccagaguuauagugacaccuguuuggacaagcaaaaacaagaaaagccuguuuucuuugauuauagaaaaaaaaguuuauuuagggaacuagaagguggcagcugaugcauuucauauuugcaguuacuaaaaggcuccuguguagaaagaccacauucagugauugugauaccaagucauuaaaacgucauuucugguuagcacaguauuuagaugguucucuuacuagaaaucauuuuauaagccugccauuuaccaaaggacuucuccagugauuuuucuuagauuacuagaaguuacuaauaguaaacuauuucauggucacccggagauggaagcaaacaaaauuuugaucauaguaguaagggcauacuguaggucucaacucaccauaaguuuguaguucucau

SEQ ID NO: 6910 - RNA, 1990 nt, Mus musculus
uguugcuuucuucuuuguaacauauuacauaguuuauuguaagaauucacucaaaaauuaaggauacaaguuucugaauauaaugaagcuaacuuauugaccauauucauuguuuaggccuuuuuuucuuuuuuacaguaagaggccauuuuucaaucuguguuuuggauuucaguucccccugccucuugagaccuccacacaucaguuauuuguucauaucuucauguagaccacuagguacuagaauaauauuagaauggcuauggacagugagauuaauacaguauuuuaaaauuuucucuuaaguaaagcagaaaggagaaaaaguuuugaaauugugcucaaugaagugagacugcaucugcuugaaaguggcaauauaaaccuauggcauaucuaacuucagcucguccugcccacuccagaacuuggaacccagcacacagcaacuaccacuagauaacaccauuucacuucagacuaaagaaacccuuuuccuguaaccuauguccauccuucuucgccucuucaguaaaguacaccuuuccgcaaucgagcuauagcucuaggagcaagaguguuugguggcuagguaugaaacucaggguucuagccccagcaaaaccagacuugauggugcaagucucuauuaccagcacuugggagauggaguuaggugagucugaaguucaaggucaccccccaguuacauggccaggacaaaaccacauacacaaaguacacuuuuauccugcaucuuuccaaaaacaaaacauugacuuccaauucucuuacccuccagcugcccagcaaacaauucuuauuuggcuuaugaugcuuauauggcuucaucaucugggaaucaucuuuugguugguuacuggcacuauuaaaaauaccuuucucuuuccucuucugcaauaguucacugucuacucuauguuugcuauacugcccaacucccccauuaaucgguccuccauuuauaaacugcuuaaaauuugauguauccagccauucuacuuccagaauuuaauagacacaaaagccagccaugacuugacuccugucuccuucuguagccucaucuuucucaucagcucuuguagaacuuuuaagacagauaaguggcacucagccuucuccaugaaccacugaucccuguucugcggggacucccuuuauuuggauccacauuuaccaucgucuuuuuguacuggaaaaaagaucauacuuaaguuuaaaacucuaaccuauuguuaguaaaguuaucaagucuucccuccauucauacuuccaaacgccaaguacuagguuucuagacugcaaacuugauugaguguacauucauuccuuuaaguagucaugccaaccaaccaagccguugguucuucauuuggggccaaaggaaaugagaauuuuaaaguccagggaagaacguguggccgcuaacagacacuaggcaaacuaucucgaacuugugggcaguuuuaaagaaaacaaccgauucaguuuaacuacuaauuuaagacauuaguguguuacggagccgucgccuuaucucagugccaaaucuagugucgaagggucuacuccaaaaggaacccgaagcccauaugcugaggccaguucuccacucggucagcuaccgagacccuccaaccaggacaagcgaccaauccaccaacucggacuugaucugcgacaaaccacguugcaggcuacacacuggaaaacucuugcaagagaaccuagcagcccccagaagcaagauggcggccucccccuccccuucuuucuccaggaaccccuccauguccggggaagacgaaaacaccgcgacacgggaaucccggcacggccuuggggggggggggcgggcuacgccucgcgaacccggggacucgccguggguccaccgggaggcuguaccacugcgccucccccgcgcccguagagccuuuguucgcagucgccauggaguacu

SEQ ID NO: 6911 - RNA, 2266 nt, Mus musculus
cgaauguuuucuuuuauaaguguugccuuggacauggugucucuucacaucaacagaauaauaacugagauugaucauggcauuuuauaacagcaauacaaaucuuuaccucaguaugcagaaaaucugcacacagauaugcccuucaaaguuuuaaaagcaaaauuaggguuuccuuuuccauucaacuaaauacaauaugcuuuuuauuuauuauuaaagauauuucugagcacuuaugaaguauaccaugaguagcaugaagaauacaaagauaaguaaaacaggaacugaggcgccaccggaagcggaagccgagcagggggucuucccgaccaggaagccugggaaauauagucuuguuaggcucacuaaacugccggauuacaagagcgacauuuugugguacggaagugacaaugcagcuuccccggaaaccucccggaguaaugucacgccuguuuuuaaucugggaaaaggagaccccuagauaagaucgagcaagauuuaaaaggucgaccugugcuggccagugguggcgcauggcuuuaaucccaacacuugggaggcagaagcuggcggauuucugagaucgaggccagucuggucuacagagcaugucuaggccauccuucaucgcauuuaccccaguggccgacuccagugaccucuggaaggaugggcagcagcaaccacagcaggagaaagcagagccuguccuggacggggcugcugcccgggcuuucuaugaggcucuaaucgcagaugacaguaguuccucuaagccccagagagcugaaccuaugagggagaggaagaagaagagaagagugacuagggagccugcagcagcaggaguccccagacaaggaagagcacuugaggaugaagacaggauagcccagcggauccugcuggcagcccagaauggggaucugacagaacuccggaggcugcuagaaccccaagaggcagugggagcuggagggaauaucaaugcucgugaugccuucugguggacucccuugaugugugcugcccgagcaggccagggcgccgcugugcgcuaucuccugggcggaggagcugccugggucagagucugugaccugggaggcagagaugcugcccagcuggcugaagaagcaggcuucccugagguagcccguauggucagagagagucauggagagacaaggagcccugagaaccagaaccgaucuacccccuccucgucccaguucugugaggacuguggugcccacuuugaagacuccaaccacugcacaucuacugcucaccugcugucacuguccaggagaccccagcccuccaaccuuccccuuggggugcccacuuccaguccuggcuucaggcuacugcugagagguggcugggaacccggaauggggcuaggaccccggggugaaggccuugccaacccuauccccacuauccucaagagggaccaggaaggauuggguuauagauccccaccccaacccugagucacacacuuugcagcgcgggauacccgggcugugucuggaagagacagagucccucgaguugccacucugagucagagggagaacagaaaucgagaagaaaagggcagagccugggagcgagaucuaagacuguacaugaaccucaaguucugacugauacagacuggcccuggucugucacucgcugggcuugggccucugacuuggacacuuggacuuccgaacccuuaggccuuggcuguugggcucugauuuuagagagaagggcggagaguugggagauaaaaaaaacuuccuuccuugugaaaaaaaaaaaaaaauaaguaaaacagauaaagccaaaagccaaaacaguacaaguguaguaaguuuaaaaauguaaguuuugcugaacuuuagagauucuacaagcauucaguaauaagauagaaaugcucaaaugagaaaaucucauguaacugucauaucuaacugaacaugguaggaaguauuagaaggaauaaugcaauugauagucucagagucauuaguuggauuuucuaggcauugguagcuuggaagguuucuggaaaccccugguccuuaguuaaugguaaagguuuggaaaugugugguuguggcuucuuuaugucuuaaguuguccguauuuugggggauuuaauauguuuaaucugcaauaaaauauauagcacuuucuccaccuccaacuccuuucauauccucaaccugucuucuccaacuuucaugucucucuu

SEQ ID NO: 6912 - RNA, 1326 nt, Mus musculus
aggguggagcgggacgggcccacccucggguuguagcuauguguaacacaccaacuuacugcgaccuaggaaaggcugccaaggaugucuuuaacaaaggguauggguuuggcauggucaagauagaucugaaaaccaagucuuguaguggaguggaauuuucuacuucaggucaugcuuauacugauacagggaaagcaucaggcaaccuagagaccaaauauaaggucugcaacuaugggcucaccuucacccaaaaguggaauacagacaacacucuugggacagaaaucucuugggagaauaaguuggcugaaggguugaaacugacucuugauaccauauuuguaccaaacacaggaaagaagagugggaaauuaaaggccuccuauagacgggauuguuuuagucucggcaguaauguugauauagauuuuucugaaccgaccaucuauggcugggcuguguuggccuuugaaggugggcuugcuggcuaucagaugaguuuugacacagccaaauccaaacugucucagaauaauuucgcucuugguuacaaggcugcagacuuccagcugcauacucacgugaaugauggcacugaguuuggaggcucaaucuaccagaaaguuaacgagaggauugaaacgucaauaaaccuggcauggacagcuggcagcaacaacacucguuuuggcaucgcugcuaaauauaagcuggauuguagaacuucucuaucugccaaaguaaacaaugccaguuuaauuggacuggguuauacgcagacccuccgaccaggagucaaacugacccugucagcuuuaauagauggaaagaacuucaaugcaggaggccacaagguuggauugggauuugaacuggaggcuuagugugguuuugaguagaguaucacuugucccuggaaaugaagagaaaugaacccacuauguuuuggccuuaaaauucugugaaauuucaaaagugugaacuuuuuauucuuccaaagaauuguaauucuucccacacugaagucuauagauuacagaucuauccaaugggagguccuggaaggcaugccuggaaauugucauguuugugccacauuucaguugaguucugcagaguuaauuuaaauauguuccucagcaacaacguagugucauguuaaaggagcgaccugccuccccggucuguacaccgcauccugcaugucccaguccacuuuuccauggccuuuuguuauaucagucucugcucuagugagagcuuugguuuugcaucagaguaaaauaaacccaucacauuuggaacacaaaaaaaaaaaug

SEQ ID NO: 6913 - RNA, 1737 nt, Mus musculus
uccaaauuccaucaagaaaagcuccccaagaggagaaguuaacaagauaacauacgaccaaugcuaaauguuuaaaaucugaaccggaaacaggcacaugaggccugcucaguucuggcaucuaugauugggagagcauagaauaguaaaaauauaaaauaaaacuaaucacccagaguagaauaaaaaagaagcgaauucaucccaugguuguaaaacuauucacaugcagugauuuuuuuauaguuuuauaauuuuguauuguuuuauaaauuauuuauauaguguuguaaugcuucuuauauugauuuuuuacugauaaauuuuuugcuacaaggcagaaaagaugccugaacagauucuuaggaauauaaacuguacuugggaacacauaagccuucaggaccacaccuacugcuuaauuuuuuuuagauauuucuuauuucuucugguaaacaacuucauaugccaauaacaucuaagugucuuuuauguuuccaugaacugaaggcuaagguugccaccaacaaaaagcaaaagccacuuuggguguaugugauuguauuucaagcuucuguguguuucucacccauuuaaaauugucgucaucuucaucuucuucauuauugaugagacaugacagccgauauguauuuuacacuugcuugugggggguguuuucucuuucaaccaaaaagauauuuugaauaguuaaaaguuuuacuugccuuugcaaguuuuggacucuuucugucgugaacacauggucacacacacaacacaacacaaaagagaauaaaaaaacaaaaaaacaaaaaacaaaaaacaaaaaaaaaaucaaagagcugggagaggcagaaccaaacaaguagaggcgucucaaagaacucaagcuguaaccaaaaagaaauccaauugccuuugcucucuucucugcgcuggaccaaagcucagcauguguaggaauaugcacauuguguagauauggcuaaauguugcugacaaucuugcaauacuaaacuguuccuauuuuaagaaaaaccaaucacaaacuguucaucaauguuuuaccucagcacucuacuuguacccaguuaaugaucaagcauaaacacaacagagaagaaggaaauugauuuucauuuucaugucugacuguaaaaucuguuuggauaauauuuuguaaugagcuuuuugucacgugacuugcuugucuucaacuugaaauucugugaggcacauuggcuuauuuguuguugaaaaguguuugguuuuguuguuguuguucguuuuauuuuucauaaguuuuaguucugauuuaugauuucauccucugugcugugaucuagacuggucaccagggucacuuaaugaggcgcugcaaaggaaucugcuucuccaugccuggggcaggcagcaggagagagggcaggaaaauagacuggguuguucuggaaaaauaaaaucaugccgacgagacauugacaugauagacucgugaccaagaagccaaacuggauauugaaagcuccuuacuuguugaaacauugaaaccaaagcugacuuaucugcacagguugcuuaauguuuaaaaauaaaauaaaauaaaauaaaaacuguacuuaaucuagagcaauaucuguaugguccguaaagcugcacuuuguguauuucuuaacagcuucagaucugucacuuuuaauuuguaccaugaaaaauaaagacuuguuugacaug

SEQ ID NO: 6914 - RNA, 150202 nt, Mus musculus
uaugucacaugacucucaggcugcgcuauggcggaagcagaggagcagguaaacgcuggcagaacuaguucggggcagccgggagcuggagacccgagcgagggguucugggacgcggagugccaggaacguggcagcucugaccgggcgaguugggguggcccuucuccgcgcggauagcgccuugcacacccgcucuguccgagccggccuugccugggcucagcccuucugguuuauguuaaaugggauuuuuugaaaaaggcaaguuaagaguagacugcuaugcaaggcuuuaaggauuauucccguugcuggcaagacguagauggaaacguccagcuauagcugagaaguggcauugaggugcugaguacaaauuauugccuuuuuuucauacagacguucugauauagggcgaaggacaaaauuaaaugaaacuaacaaaauagaagacucaggcuaaaacucggaagagauuccuuaaguauauguauauauguguauguguguauaugcauauacauauauguauacacacacacacauagaagcauauauauguauguaucaucuaccauauuucccccucauauauuaaaugcccugcuugccaguuucugugauguuccuuaagacaugcauggugaugcucuguuuacuguccuaagagacauuuacuaguggacuuuuuacuguucacaucugugcuuuauuuugagugugccaaaaguuacggaauuugacaaggaaaaauuuggguuuugucauuacguuaacaagagccucuuuacuaucauuugugcaaacugucuuuugcagugcagguccgaggcaaaagaguuuuccuucccagcagaccuugcuuaguuugacuacugcaagguggcuuuucacauugagcauuuucauuucacguugaaauacaguugugguuuuguaguaaaacaaacauccaaguuaaguuuuuagauuagacccagugugauagaaauauggaguagcccuuguauucccacucaugcagaagaggaauuugccaaggcugucugauguuaaaauguagaaaaucaggcagauaaccugauucacaguugugcagugcuuucgagcuuaaaaagauccucacacauggcauuugguccuucuaaaagaauucugugagguaaauauuuauucugauauggaagucauauacagccuccauguccuaaauccucuugucccaaacugugguaaaacagugcccauauuguaaucacccuaaagggccuugaguauccaccccuuccucgguucugugacucuguaagccacucugucucaugcugccuuucuugcuauucuguaaccaguccaggccuguacccacgcaggaccuuugcucacacugccccuuuucaugaucucugacgucuacaaggccuucucccuuacuguccucaggccucugggauggugugcuuuccgauuguggcucauucuuugaaaccaccuucugauguucgucuacauaauacuuaugaucuuaagcuuuuuauuucuccuuguauauucucacuucugcuugccacaugauaaauauuuauucauuacugauggcugauauugggauauugcuuaauacuuaauauauuaaaugauugaauuuuacagagaaaugaauugaaaugcagucaguuugaacugucucaugcuuacaucuauaauguuuuagugucaugucuccaaagcucacauuuucuucacacuaccuugugucuuaaaauaugcugaagaaccugucuaaauuuuauauaugaauauguguguguauauauguguguguguguguguauauauguauguauguguauauauauauauaaaaacuuuaugauguggaauagcccuuaucaucuucaugguuuuccauuuagcccuuauuccugcuguaguguuuucacagcugauguacuuuuaggaaaugcauucuucuccauugcuaucagggcagccuugagaaagaccaguagucuacugccuguugcagaaagaagcagacauucauaaauuguuuuaugaauucauaaaaauugcuaugucaaaauauaaauaaauaauauucauaucauuaguuuaaacaugaguagguuuuucuuuuucuuuuuuuuuuuuuaagucuggauuggugcugcuaauauuuuggcaccuugaauauuauuugaaaaccgugacauccuuuuuucuucuuacuggguauguuaggaguuggcauguguauuuaaaugaacuaucaugacaaauuacagagugaggcaaaacauuuucuugguacccuguccuguaagugcaaaauuucucccaagaugaauagcucaaaauuaagcccauuggcuuaucuuuccugacuguuguguucuuugaugguagucuccacuuuaauguuaugaauagcccaaauggugacaucugcacugaguuaacaugcuauaaaaaguuuccacaguuuaaagcuaaaaaucacuguuggaguagagauaaacagaugucuuuaagucauaaugaaaaccuugauuuugcugauauagaaaaaguacuuuguaaaaguaacauuuguguuuuauaguucacagaaagcuaauaaccucaaugcugccagggauucuuguaaccagcaguuuugcuucguucuggaacgauuuauagguggcuuucauagucacagaugcccaacaguguuugucccgaccccucaugaauaacgcucugcuugaagucugguuggugguguauuugucuccugcggacugcugaguccucagaaugagggcuguagcuuacucaugucuguaucucuccaggagcuugucuucaaaccaaaagggaauuuaauagaaagagaacacucaaaguugucacauugugaauucuguucaauagaguuuguguguaucauugcaucauauuuaaaacauugggauguuaauaauucacguguaauauggaccaccuucuccacacuucuuccaagccucucugcccacuuucaucucuucuccacucagccacaaaauuaaccuucugguccuugacuggaugagacaguuuuguuuugauuuccacuacugcaucuuagaaauuaggggaauuucauccuuauuucagguuauucgaugguauaauccaugccuaugaauagcuccaugcauauaaaguaaaaaugagguuugucuguauuccagugccucuuuguuuuuuguuuuuguuuuuguuuuuugcuuuuaaauuuauucucuaagacuuauugcuaugaaauauaucuauuaaagugguuagggugaaauagcuaauguauaaauaagacaaagauuaaucauuuagauccagguuuggcuggggcaaccuagguugcgcuguaaaggaaagucaauguuuaaaaauagccagugcuuuccaaguuuaagucucagguugguaccauggacuuaaagccaugacagugaagcucacguuggaggagcaggacacccaccuacguccacugugaagauuguccccauugagguccauuggaaucagagauacuacuaaaagcuggaaaccauuaggguccguaugcaguuaagccagggcuaaguggagggaacacccuaaggaaaaucucauuagagaucacagacucuaaugauugggagaucaccuuaucuuugucuuucuaguaaaagcuauccuacacuuaucugaagugauaaguguguuuuugauuagcauuuuuauuauuagagauucugagaaccuuucauguaccuuuuguccauuuuuuaaugucuucuuugucuauuuagguuagguuauauguuuuuuugcuauugaguuguguaaauucuuugcaagcuuggaaaguuagacuuuugugauguauauggccgacagauuuuuuuccccaacauauaagcugccucuguauauuauuugcuuugcaaugcagaagauuuuaguuuaauacagugccauuuauuuauuuguacaucugaagucucaggguuuuuuuuuuuuuugugugugugauagccaagaaaucaaugccaaggccaaagucaaguaaggauucuauguggagcuucaggauuuuguggcuuaaguggguauuucauccauuuugaguugcuuuuauucuuuuacauguagagagcuaguuucuuucagccucauaaauaacaggcccgcccuuccccaguguguuugguuagguaggguauuuaugggaagugaguacugcuuacuuggaauaugucugcucucuauucuguuagaauagugacuucauuguaaaaguggaauguguguguagaagaaauagaggaaggcgguaaaaagaccaaaaccaggaccugaauagcuagugccaaggaagagaaauggcuuggaagaguaggcaggaugcaugccauuaacuggacaaccaguggccaauaauaggaagguuaguuuaauuuuuuucuuuuuuguguggguugcagauauaagguaaacaguuuuuucggaggguugcagcuucaaaacuaaugagaguuuuaagauucugagucacauugaauaaaacaagcuguacaacuacucagaaaagauuuuauguuuuacucauguuaaggacacaugcccaguaaacaucuugaaaguaacauuucuauuuuuuacaugaucuucaaggacaagggcuauauuuuccguaagacuuaaacuuaagcuuccucuaggaguuaucugccuucucccacguuuuuauuguuuuuuugacauacaaaauaaagcaguuucugagcaucaaauuuacauuuaugcugguaucuugucuugaauuggguauaauaugcaucugacuuucuuuaaaauguucagucuagaauguugguacccacuucuuuuguuguucucuuuguuuaucucauggauuguaaaacgcuuacauucggugucagcauauuagcuggaacuuuuuauugcuauugauaucuauaaguacguuaaguaaaucuucauuuugcugaccucuuugaggaugcacggcaucagcagauucuuccuuacagcggacaggugagagauuagcgggaucaaguccauuuuuucucuuuuugcuuuguuuccuccggagcagcaagauucauuguacagcaggaagggaacuguuguaaguggaggaaucugucuuagaguuacugguuuauuaaaggguuuauaucgugucugaugagugccacuggagggagauucuuuuugauaagaauuguucuagaguugggcauguggcuuaggugcagaguguuggccuagcauauacagauccuugaguucagucuccagcaguagauaaaaccagacuuggugccuugaaauaccagcacauaggauauagaggaagaugauuagaaauucaaggucuuugugagcuacauaguguucaaggccagccuggaaaucgugagaaccugugucaacaaacaaacacaaacuggccacacccaucccaccaaucccuccccagacuucuagcaaacagugauucuggcucauuaauauaagagauuucaguauaaaaacugguucauuucauguucuuguuucuuuuuccccuguacuaucagggaaguuuugccagauggauuuccauuagugucauacccuaguguccuuugucauuguccccccucccuccucaccguggcuccucugucccaggccagccaggugugaaguuguaagaggaggauuuaagccgggcacgugcgacccucugaacccucugcacccucugcagugcccuugcagaugacuuuuccagaaaagcuggcgggguacagugacuuuucuacugcagguguguuuucuuuucugacucucuccucugugcuugcaggaaaccgagucucuugaagaaucuacggaugagucagagguaagguggagcauacaaguuugucauucaccuugaugcugucuuaggcuugcuuggacaaacaacaaagucuggcauucucaggggcugaaagauuagaaaaguaggacuguaaaacagagccuaaggaauagcaugccaguugucuuuaaaacacuaaauggauugguuuaaacaucaauagagacacaagcaagcuguuucucuucaucuucugaggcacagucuauagccccuacuccguggaccucuaucuguugucuugaauggugucuucaacugcagcugugcauccugggaagacugauguaaaguuguagaaaccaguccccacccauuaaagucuacuuguuuccacaguuuuugcauuaugguuuuacaguauauauguuuucuccuguacuucugaagauucuucccagcuccuugcauuugcuaggcaugugucucacgcuagagccacaccucagucccaaagcuuguucaauuucuucuucacgaaugugaaugaucauacacccuaugcucacuacuccugucuauaauauuuccuaagccaauaaaguuauagcucauuuaccuaaaagggaaacuaccugggaguuuuguuaaagauuauaacucauggggaaaaaaaaucauucuuuuaaaauugucacugcuuugaaauacuccuuuuuaaaacuuugccuaagaaauaggcugagcauaauguaaauucauuaguauacaaauuguguggaugggcuuacaggugaaauguuuucuuuuaauauuucauuuagggaaggcaaaugaaaauuauuuugucaaccugcaagaaauuucuaccagugugacaguaucugugauaauuucuucaucuuuaguugauauauauugcauauuuuuacauggauuuugcuuuucuuaugaaauaauggguuuuaaaucuccagacaacaacauauauauuacagcauuuucuaguccuggcucauaacauucacuguagcguuuuuagugccaugagaccccagaugccacauuucugaauuuccucauaaacaggaaaagauaucuguuaacuucugauaguguuugacgaacaguccagauuaccauuguuuugcuuggcaaucuaagaacucugaaugcccagaaucauuggagcagaauuaggcagcgcuugcuagaauuuuaucucacaggugaagaggauguugaaagccacuuacuuagaucuaaaucuuuucagauauccucaagauacuaaauggauuaacaaggagaguaagcaaaacauagaauaagcccuccaggagagccagaaaguaggggauaauacacaccaugaaaccagaagaucuggguuggugccagagcugagagaugcaaggagacuagcaacagucaccugaaagccacacguagugacuuauuuagccuuugugcgugggaaaauauugacaaaggauagaauagauaucaagggaucucaaggacugcaccuaagagagacugggcccagagguggccaugcuggaugcugcugcuucucagcaagaaggggaggcagucuuuagaaguugguccuaaagggaagagucaaaguagauauguaaaguguacuugaguccugugaaugguugggagacuugacuccuccauuuucgacaaggcaggaaguucacagcuguccaucuacagagcucaggaaaguacauagccgugcauccacagcacucaggauccuaguagucccccagguccuccagccuuccuaggaaccucugcuguugcuaucccaagaaaugcaagcuguuuaacauaaacaagagacagcuuugcuugcccagauguuaccuauugaaugaguuuguuguuggacaagucaagcuucaggcugcaguccagccgugggagaaaucuuugugguugucuuuaugcaguuugaaccacuguccauuccaggaauaguguuuuacaacaucacugaguaggcuggugaaucuuccuucauccuguuccacuuuucuucucuuacuuuuuuuaaaaaaaagaauuauuuguuuuauguaugugaguacacuguagcugucuucagacacaccagaagagggcaucagauuccauaacagaugguugugagccacauugugguugcugggauuugaauucaggaccuucgcaagagcagucggugcucuuaaccucugagccaucucuccagcccuuauucucuuauucuuaucaguuuuuguaacccuugcccuuuggaagacaggcauuugcuuuacaucuucauuucuguauucagggguucaaaacuuccauuuuuugcaaauaauuauuacuuacaaaauaauaguuuucaacugugcauuggaacaaguugccagaaauuucuguuauucccagagauuccacguuaaaugggaucuuauguuagucauauuuaucucaaggucuuauuuucuugacuuuuuugagaaguucacacaugaguacuacaucuauauuauuuucccaugcuuauccuuccccagucccuccugcgucccccgcaaaucuucaaauucaugaccucuucuuuaauuacuguuguuacauauauuauuguuauguguacauacaaauaaguacaaucuacagaguccauuuuugaaagcguugcuugcauguauauguguuuaggguugaucacuuaggauuggacagugcaccagagaacaagauaguaucaagggcucaguaggaauuuauaccaucagccaucuaguuagccuguucaguaggugucuuaguuaggguuuuacugcugugaacagauaccaugaccagugcaagucuuuuaaaggacaacaguuaauggggcuggcuuauagguucagagguucaguccauuaucaucaagguggaagaauggcagcguucaggcaggcaugguacaggcagaggugagaguucuagauuuucaucugaaggcuauuagcagaauacugauuuccuggcagcuagggugagaguuuuaaagcccacacccacaguaacaucuacuccaacaggguuacaccuacuucaacagugcuacaccuucugauagugccacucccugggcugagcauaugcaaaccaucacauuccacucccuauaggcuuguucaagcaugagucuaugggggccauacauaaacauaguauaaugcaaaauacauuuaguucaacuucaaaaguccccauagucuaaagcaaucucaacaauguuaaaaguccaaaguucaaagucucuucugagauucagccaaucacuuaacuguaauccccaaagcaagcugggcagacuccaaacucugcaucuccaugucugaugucaaggcagucuucagaucuccagcuccuuuuucauaguuguugauugcagcaacuucuuuguacugggcugguuccacucccuuuuagcagcuuucuuuagcagauaccccauagcucuggcaucuuggacaucuuggagucuccaaggcaacuuuaguguuacagcuucuuguuucaguaucugggauccacacaugaucugggcuccuccaaagggcuggcaucauuucugcagcucugcccucuguagcacucuaagcucagguugauccacucuacugcugcugcaguucuuggugaucaucccauaguacuggcaucucuaauaugcuggggucuuccacugaaacuaggcuucaccgguaguagccucucacaagcucucuucauggugccaagccucaaauccuuugcaugaccccuucaguccugggccaucaacugcaacugaggcugcaccuuuaccagugaccuuucauggccucucagagucccaagcgucagcugcucuucaugaccccuucaugccuucaaaaccaguaccaccuggguaacucuuacacauuaccaaguacagcuguaacacgaggggacaaccuugguuaucucuggaacacagcuucuuugugcucucagaaaacacuucccagaagauuucaccucagugaugcuggucucuucuuuaaucacugcuaauuucuuagcuccagcuaaguaggaacaacugucccaguagucccuucuauuuuuuuacucuaaaaccagagccacauggccaaagcuguucugcuacuugcugggucuggaacacacccucaccuccacccuuuauucuauuaccagcuucuauuacagcuuucuguuuuucaacucccucucugccuaagcuuggcuuuccuggaauuugcucuguagauuaaccuugaacucagagaucugcauggcugucuccuguaauucugggaguauaccaccaugacuggauuuaaacuuuucuucaccuagaaucugcuuugucccaggcuggccuugcauucagaaaucuguuugucuuugucuuuuggaauuaaagauauguacuaccaugccuggaucuaauuagcuggauggggucuugcccccaaaauccuuaaaucuguuaucuccuagaagguaggauucagcuccauucacuugcuggugccccuuuaauacuugaaccauauauuuuuuauuuuuccuuucuaagcuugcuaugcuuguucaaaaugcucuucaugagacuuaaccagagagcaaagucuguguuggcuuuuuugagucaucuuugucaauacaauuaauauaaaucucuuuaccuuagccucagguagacuuuucagacaagggcaaaaagcagccacauucuucaccaaaauaccauaaaaacagucucuaggucacauucuucuccacugaauccucuugggccacgucugcacaguucaaaucaaucucagcaacaaauucuuucauaugcuuacuaggauaguccauuaaucccuauuuaaaacauuccauggcuuuacaaauccaaagucccaaagucuacauucucccaaacaaaagcauggucaggccuaucacagcaauacucuagucccugguaccaacuucugucuuaguuaggguuuuacugcugugaacagacacugugaccaaugcaagucuuauuuaauuaaggcuggcuuacagguucagaaguucaguccauuaggugggagcauggcagcauccaggcagacaugguauaggcagagcugagagaucuacaucuucaucuggcugcuagcagaauaccggcuucuaggcagcuaggaugagggucuuaaagcccacagccacagucacauaccuacucuaacaaggccaaccuacuccaauagagcccuauaccuacuccaacagggcuacauacucuaauaguaccacugccugggcugagcauauacaaaccaucacaguaggauagauuuaugccgguacaguaaaccuagccaacuacucaugucugggugaaguaagucauggacccuagaggagaauauacuacugcuucugucaguaguauaauuccuaacuguauguuauaacccuauccuuauauccucuuguacacacuaaaaguguugcucucaccccucaguaagcucuuauuuuaauguauaucugagaaaagaacacggucuucuuuugucuuugauuuuuauuaauuuugaagagagaaaucaaauaaaaaguguuugccaaggguagcaauguugauguaauuuggacuuacauuaggugauuaagagccaggaauaaaauuuuaucgaucaaaaauguuuguuaaaaaccaacacaucauuauuaagagggcaugcaagcacauguaagcugaaacauggaggucugcuuucugugagugagggcucuguuggacucgugugauucauucgagcaacucaauagcuugauuugacugaguuugccuguaguguauuucacuaaggcaaagauucaggaacacauuuugcaccucucagcuucuggccuagaugugugauaacagaauggcuaaucccugucaucucuguguuuauagcuuuuugcuacuguuacuaaaaacauacuuucuaaacauggugacuuugaggugguuuaguuuuuucacaguuuagaggccaugaguacauuuaauaaguuaaauauauuaaauauuuaauauuuaacauuaaagucaaaaugaauugacagcugaagcuauuuaaacuaauauguugagugaaaaauuaaucuuaaaauaaagccaacuucuguggguuucagccacguggagagcucccuuuuaguuuuguugacaugaaaacccagccauuaugagaaaucaggaggaguuauuucuaaaucagaaaaugcaccauacaaaauuauuuaucucaccugguaguuagauugugaaucauuuauugaaaauuaaauugauuuucuuacacagauuaauuuuaauaaacagguuucuagcaacuaguaccuaaaaugguaauuacccuguucugaaauugauugcuauggagaaaagagcgugagguuacagugucccauguuucuagguaacccuugcauuucaaaccuguucuuuuauuuaaggagcuauuaauauucacaggcucugcggauuauugcaucauucaggcauggauaaauauuccccuggaagcaaauauuauaacuaucaucccuuuagaaacuuguagaacuuucuggguguaagguuuuuacucuauauuucugucauuuguuauagaugaagaagauaaauauggcaugacagaccucugaaugaaauuuauaauuuuauugcuuagaaggaaaauuauuucagacaguucaagauugacgccuugauuacucaaauauuuauugaauacuaggaugcuauggugcacuaguguuugacuaggaaaguagacaauaaaaggaauacuuauuaggauaugucagauaaugaacauagauuaaaaaaaauaccauggugcguggggaagaucugggaggaguugggggagggggaacuggucggcauauauugucuagaauuuaacugaauucuuuucaguuaaagaagugauucugagugaagggaauguggagcagccugacagguggauuguaaccuuucacuguuagugaugcuuuuucugauauggaggucauguguucuucuuuuggagaggguaaagcuugggccuugagagcccccugugucaaccagaaacagugacugccccaaccccuccaacccugagucagaaugagaauuguuugauucuuggacugcauccucaaaguggcaauaguugaagaagcaaaugagaccugucuagcuuuaauuuugacucugcucauguagcuaucuagccuacuaacuucacccaucugauuuuuaguguuagucuaguaacaaagaguaucuccccaaagauaucucuauccuuucgugcagaacuugugaauaugaccuguuccagaacaaggaggagauaagguugccagucagguggcuuugugacacagaaagaaauuccuugaggcaggugggcaggaaucacugugaucauaagagucuuuauagguaggacagggaaccagaagacggugugguguggugugguguggugugguguggugugguaugugguauguagaguggugugugugguaugugguauguagaguggugugugguguauguggugggcuguggugugguguguggcguagugugugguauaugguauaugguguguugugguauaugguguuuuguggucugugguguagugugguauauagugcagugcggucuguguugugugcuaugcucuauuauugguuugauguggcaugguguauuuauguaaaggagucugccuccuuuuaaagcuggggaauuugaguagcuuucagaaucuaggaaaggcaagaaaaagcuuuucccuuccugccucuagaagaauccugcccauggucauuugcuguuuacuuccuacuacugaauuguaagacagauguggauuguuuuaaggagcaguauuuguggucaguuuauaguaaugauaggaaucuaaugcauuaacuaauuugguuggaugaccuuguccuuguaguucuucaaugugacuuauuuuauaguuuacggaguaaaauacuuccaggcaagggaaagcauacuggaaacacaugguauuuaacugguuauccugggauaucaugggaaacgguuguaaagauacauguaucuuuuuaaugacucuucucaacuguuguuuaauuaaucauuucauucacaguuggggucaaaucugccuugcagagguuuaaagccucugucugcagacuaagaaugcuaugaggcaucuuuucaccccagggagauguuuuguuuauaaauauagagauucccacucaccugugcuguccuguuucuuuacuucacagugugacuggugccuucaggucgacuaaauugaucucccguacaguaaaagggagagauugggggaggacagccccugagagagcuugagauuuuagucuguuaucauuuucagcaccaagggacugggguguuuugcuuugugauaagcuuuuaggagaggauccuggauaaucuguagggucagcaauaccuccucuccuuuucccauuggccagacucauaacuauguuucaaaguguuugaaacuuuuguuuuuccucacugaugcucagaaccaaaccucaggaccugagccugcuagcucacagaacuucauccugagcugaagucaggcauuguuagucuagagcaaagaaguaguuagaguccacgcacuucuggucacuugauaguauauucuggcaguguacuaagaugcugaauuccaagagaggaugugagcucugcaguuuaaacuuggggcauuccacacauuauugacaauacuuuuaaaaaccaacauucauuggauauuaccaaauacuuuacuuuguguaacguuuuugcauuuaauguuuacaaaaauuuccugaauacauauuuaccauccuuuuaaaagugggguaacucagcuuuuaagauacuugcucaguauauauagauuguguagggcacagccgacagaggagauggcugcuugguuauggauuugaguaggcucuuggacaacucuuacuuucucuccaaccucugcuuuuuccucagcuuccauuuuaaaugauauagugaagacuguuuucuuuaguucuccggaaccaaacuucaccuaacaaaucuguggguacccaauaaaggccagucaaaacaaacaucuguagcggcagcagacccaaguucaguaggcagccucucuaaagcauucccaauuagcucuccacacuccaaaucagagacuagcaaccaaagcaacuucgagccuuuaauucucaggagcuguuguuaccuguagcuccuggaugucuucccugucauuugaauacuuccuugaaaacgugcuucguuuacagaauuugggcccaugacuuuucugaauccuugggauauguucuuugggguaaaccauagagaaaggugggcaucccugggaugaacucugcuaaugagaucuccacacucuaaaaugagagccuagacgccaaagccacugcaagugucauagaaacccuagagggugugauacucuuagauacugagaggggaugaagaggcuccaaaguagagaaaagucuuuuauuuuaauguuauuguuaauuguuuauggguguagaaauaguuucuuuguaagaaguuuugguggggcuggcuauaagauguucuauacauuuuuuaaaaaaauauucaguuaggcaugucugagaaauaguaagucucuacuaaaauagugacuuucuucucucuacuuuggagccucugcucuacucucuguaucuaagaguaacacccacccccucucucauuucugugaugucugcaguugcucugguuucuaaucucugauuuggaguguggagagcuaauuggggauaccuuagagaggcugccuacugaacuugggucugcagcuacuacagauguuuguuuugacuggccuuuauuggguacccacaguuuuguuaggugaaguucagaacaaugaaaaggcauaaacccugcuucuaaggaucuugugaucaccagaggauauugggaagaaaggaaaagagguuuauguuggcuuuaguggcggaaauuguccguccgaauggcauaucuugaagauugggcgguuauuccauauggcugggaggaaaugaaaagcuuauuugcuuuucucauuuuccuccucuucuauauauucuuaucacuuucccaauauaaaauaaaugaugagaguugauccuguuuaugguauguggcuuagggcaugggaaccuucaccuuuuauuuuuccccuugaauugaacaugaaauucugauacuacagggcaaaggagagagugggguuuaugaagaucaccugacuugugcaucuuacgcagugcuccucaauuauuacaggcucaacuucuucucccuuuuuuaguuagaguauuugagggaggagagaggcuccaaaacacagggauuucaauuuaguuaaugugguuuaaacaauacugaaguguggcauuuauuuuuauuuuuacaaaaauagcauaaaauagauuuuauuuuauaagaaaugcaauguuuauuuguuuuagaguguauuggccagguaucagagcagugauucccuucccccacuuuaaugugacacaaaucaaguuaucaccugcaucccacagacgaaggacaugacgccugagggagcuuacuauuugguguguguucuucaguuuuucccucaccaaauaugcauauauuucuagacaaaaaucugcaucaugcaggguauuuuaugaugcauuucagcuaagaagcaccaggagaaugcguccugugaguggugcuaaugucaacaacauauuuuaucaggagaaacuuacuaagcugguaucuaacuucggcaccaugggcuauuuaauugaguaauuuuugguuuccaggagugucuugcucaguguagguuaucucaccccaaugcucaccccucacuggaagccaagaaugccuucuccccacaugcccaagaguuuggccacagugacuucaggcacuuacggggcaacagaaucaucugauugcaaguuauguaucaguuagugcuugauguuuuuaaaaauaauguguagguacaaagagucauggagaauuuucuguacauuugaaaaggcagaccugaccauccauguuaguucaccaguuccaaauuuuagucuuuuuuaaaugacuuucucauaucagcaauauuccuuagaagaugaaaauuuaacauuauuuuuauucacauaggaauguaucugcuuaucugucaacagcugauagaaagauaggcaagacgcuuugaccacauugguuuuauuauaggcagugucuguuaucuucaugucacuuucuugagaaguguggucauugaggcagcuguaauaccuuauauuaucaaugagaaucagaaauuacucuuuuagcgucauuauguaguuuuuugcuauauuuuggcacuguagaaggcaccaugauaugcuccuucuuaucauauacucaucuuuuuguauaaauaaaaugcugcucuguaaaagaaguauagcacacaguaguuaacagugcccauucaggcgccccuguuccuuucgugcauuuuggggaggggcguuagaaagcugaagugaccgacuuugcgcuuuacuugcugggucucuucauaaaucccuuuccuuacccuaaguccccucuccuccucugaaguguagugcacauuuuuaagaucccuguacuacauuugaagcaguccuguguugggaacacacguguaaagauaacaguuucagcuaaauguguaugucuaguaaugucugauuuucauuuguuucugcugacuuuguuuauaauacucuggagguagauagaucuauuccuucaaauauuucuuucugguuuugaguuucaaauuguguuuugauugauauuaauuucaauaaugcuuuuaauaauuuccuuauuuguauauguucuucauuuccuuuaacaaauuauaauugaucagaaauauuagccuuuucauggauuuuauauagagugaacuauugguaaugggcgaaauuuaaaaugcaaacauucugaaauuuaaauguucugauauuggauuuugauaguuauuuuuuauauugaacuuguaagaaugaguacaauuuugaguauuucaguuuuccucaagguaauuagaguucuagacagaauguccuagaggacgcaaaccuuuauuuuaaacuuuccuacccaugguugauuauugauuugcuuuuuauuaacacuugguuuuuacuguggaaauucaagcugcaugagagcagguuuuuuuuguuuuuuguuuuuuguuuucuuuuaacacugagaaacucugaggauguuacugccuuucuaguguauccaguucuaaacacugggcauuuauuaaaagcauuugccccuagucagguguagcugaggacaggaaacuagguaaaccgcucgucugaugacauuuucuaaugguuagccgagaugucucggaagggcagcugugcugggaaggccaucugcucagagugacugaggguugcugaguagugucuacucagagaugcuuuuacuagcuuaguuugggcuuuaugugagcgcucaccucuuaaguauauuuaacgucaauuuugguuacuacuguuaaaguugaauuuaauaaagaggugguauucauaaauaaaaauguaauuucugaauaaauaguacucauagaaaauguaauuaaugguugaugucccugcacuuaguagguguuuuuauuuugagaggaucuugcuaaguuaacaugguuggucuugaacucaaauguagucagguaagccucaagucugcagugucccucagucagccccugaguagcugggauuauagggcugcaccaccaagcccagcuuauaguuuucuuuuucucuguaggugaaauucaagucuuuauuuggaauguaacaguggagagcuguauaaaauguauuaacaugcaaaacaaaaauauugacaaaauuaauauaggauggaaguguagaauccacuagcuagacuaaaauguuuucuuauccauggguuuuuaaugaugagaagaaugcagucaaugcaguguggguccacaggucuggugaggggcccugaacguccccaggacagucauacucccaggacacacugacaaaagaaggacugccuaguacuucucacagagaaccccuuaauuuguuauuuucuaaagagauuuucuccuuuuaaguucaaaauucaguaaaaauggcccugaaaugacauuuauuuuaugauaguguacuagaauuucauaggaugguuuaaggaucugucuuuaauuaaaagugcuauacauuuaguaccaaucuguguuuauugagaaauugauuccuuuagaaggaaagcugcaaacuuuucuuguauggguaaaugucacucuauucauaucuucacuuagcugcaagucagugcguguucuguuccaccagguugucauaguaacacaguuaacugucaucucaacuccagacuguugaugguuuuauuuguagguuuguaggauuauuaaaauuuaacaaaauuauugauuuucuuuuuauuagcacagaguuauuuaccaugaaaguucaagcugcacaaagguuuuuuuucuacuuaaauuuuuuuuccaaaauuaaagugaaacuagauauuaaauccuugugauugaauuuuuuuauuuaaaauguaauauagauucuucaauagcagaauaaccucugaauuguaguucugagucauuuccuauuuucuuucuucugacaaggaggcaaaaaauaaaaaccuuuaaauucaccuuuagcuugcuuuuaacuaaacauaaaggauaccugucaggaaggcgugaaaugggacggaaagggccuaauacugaguuuucacucuauuuauggcuuuugaaaucuugugggaaugcuucacugaacuguguuguaaauguauuuauuuucguauauuuaugugagagaaauuacuuaguuuucacuuauaaauaaggcagccaaaccuuauuuacaguaagcuuaucuaauggucuguggaugagugcuuuuaugcaaaguagucgggaggccagaauuaacuuucacauugagugcacauuugauguccacacuugagcagcauguggcaucuuacuuaacacguugaccucagaauacacagcuuaccugugggacaucucauguuuccuuuagagcaucuuuuucuuccgggggaugcagaggguuuauugguauuguacucuucccugcauaucuuuaaauacuuguuuaaguagcuacgucacauuacauguuaaaauagaucaguuuggggauguuacaacuucuucagucuggauugauuaguguaaaguaucuuuucauauuccgauggaaugcuguguauuuucuugcucuuaguucuuagucauggaaaauuaaaagugugugcaccaucuuugguggaacucaacagcuggcagcuuacuaagaaugcucacuaguguucaugaaaugcuucuuuuaaauauuaauauucuuguagccacauggugccccucccucccauuucucacgcucugguauuugcauccuguguccucugcucccauacugaaucauggcugacccauacaauuagaauauugaagaaaaaugaagugcgcauacuuugagcauaaggcuuuaccugguucucagagucauucaucgugggagaaacugaauuccuuugaggugcucaggcaguucaggaaaaagcccaugaguaaggagaugauuuucccaucaaagccaauuuucucaucuugccagccauugcaugaggcucaugccuucuuuucuuagaauuuuguucaugagcauaaugaauuuucaucauacccuuccuuuuucccugcucccacuccuuuucccauccaccucucaaauucauguucucuucauucguauauguguguguguguguguauauguauguauguauguauguauguauguauguauguauguauguauguauguauaaaaccaauugaguccaauuaguuuuguccauaguacaugggcauagggcugacuucuugggcaugaauuuacuagacagcuugcccuugaagagcacugacuaucccugucaauugcuaucagcugcuuguaguucuuccaaccaggccugaguccucaugagcuguccuccauucaugcuggaaugguaacugguguggucuuuuacaggcagcuguauugcugagaguuccuggguaccauauccaugccauguccagacaagaacuguauugcuuaagucuagucuucuaggucuuaacauuuccuguaucauuuccuaggauauuucuagagccuuggggguaggguuacauuagcaguugcuuauucucugcacuuugacugguugugguuuucuguaguaauucuguaucugguaugaaaagaagcuucucugaggugggugggucaaagcugcacuuagcuguggacaucaaguauuuagaagggaguuggaaacuauaucaaauuaauaaauuguaguaguaggcucuccucucuaggcacagguucuuggauagguuuacuguaccagucgugaguuuccucauauugauugagucugacauccaaucacauuagcuguugacuacucccaaguuauuaguggcacuaauugcacuacugggcauaugaugcugggccaguuauuauugugguuuacaagaauucuagcuguggaggacuguuaacuuuuauaggcauccuggauuuauugauuugugguuauuaucaauacugauuaccaauuuuauucauuaacuauauggauggagaaaauccuagguaccuaccacacacaguaagguugaauauacaguuauuuacaauacaacaguaagcucaaauaucuauguuuucaacuuuugaauuuauuuuaucagugaaauuauauguguaauuggaaaaaagaaacaggaauauuaaguuauauuuguaguuguaguuuuuaacaaugaaugaaaggacuaucucuuguucuaccuugagaaguauauuuugaaucauucaaaacagagccacaguaguuccacugucccuuuguuuuucaugcaggaagaaagugaagaggaacccaaacugaaguaugaaaggcuuuccaauggggugacagagauucuucagaaggaugcagcaagcuguaugacgguccaugacaagguaaugaggacuuuaagaguacugcagaugccuaacaucuguuguugcuauggcaaagauauugggucacaccauuagucuauucuuaaagccaaacugcuuauauuauaauagugcuuuuauccauuguucucuucuucuccgugagccugggagugagccuuagaccuuccaaaccuggcagaucccuacuucugauguauccuuuggauuuaugcucuguuguuucauucugcagcuggccucccaccuaaugcccuuugcuccagauuauguuccuuuauaaacauaucccuauauucacucaauccuuuaaugauaaugccuacucuuguuuuuaccauaaauucccugcugugaggucccugccuacuuuggcugucaugccuugguugcuuagcccuagcuaacuccgcucuucuucacugaugaagguugaccuggcaguucuucagacuuacuuccauugaacuucacuuccuuacaguugucuuagucaccauaacccacuuugugaagagguaccaccaccaaggcaacucuuuuaaaacacagcauuuaauuggggacuggcuuccaguuucagaggcuuaguucauuauuaucauggcaaagaguauaguggcaagaaggagugauacuggagaaguagcuuagagcuacauccucauucccaagcagagagauagagccuguccuggcaugggcuuuugaaacccucaagcccauccccauugacacacuuucacaagcaaggcuacaucucccaauccuucuaauccuuucaaauagugcuacuucuuagugacuaaauaugagccuaugaauucggagguugggaguauucuauucaaaccacaauggugcaccucccacgcuaugguacaugcuauggauaauuuuaguaacuggaacuugaugaacuuuggccucugcauauggucuucaaauuuugauguucauuuucacacaaacgucauuccugacuauggagucccaaucucaauucuucuuguuuucuguccugugaaacugcuaauuaucuugaaccuaccaaucuuccuuauccugcacuugguaaaugggggacuugucgcauccgcucucgaucagcaagaacaacacuaccaccaguccuucuaacagcaguuuauucagcaagcuucagucuucaucucucuugcuucaucuuuuucucccccaaacccugggcuucucacucuuauauacucucagcccccauccacucacggcaggccacgucaccucacuaggcacgcagcuucagccaaucagggcaggaggggcacgucuccaccaaauauggacuuguuuacaccaccagcaucauggugcaccugcgcagcucucaugauggucguggcaauuuucagguguaugaggaagucaggugcaagucauaagacuuagcugcaguccugggcgccaucuugggacugcugccacaccugcuccucacagggacuguucuuguuuuucugucuagacucuucugccucuugguugcaguguguuguguugaaaauacugaaguuugcagacccuuguauaauuaggcugaggucuucaguguggcauguaaggcacucuaggaucuugccugccauguguaauugagcuacuuucucacuagucuuugcugugggcaugggacugugguagcaauguuuguccuauucugccacuagcuuaugugcuagauucuucuccuccugagcuucuaauaguugacacucaucauuucucccugaaacuuauuuccgugggucuuugagguacugccauuuuaaacauagucuuuaaauugaauugcaauugcuuauuuuugaaucuguuuuccucaguguagcaggaucuuuuuguuguguuugcucauguucuaaguacauuacacuucuuuuugugugcuuacugaaugaccauuuggaugcaugaaguggaaagcuuguuugugcuuuaguuaacacuguacacaauuggccagagaggcugugaguugggaaggauugucagugcugacauuuagacuuucaguugagguuuguauuuuauauuaagaggauuccaauuggguugauagcauuuauuugggcuuuguuucugcagugcuaggaagugaaugcaguguguacuaggcaugugcucugcauuucaguauuuauuucugucccugucugcacuugguagguguuucuaaugaggucucaucaguuccugggaccugauuccucaugugugacugagggcuguccuaguaguuguauguggaauauugugaaacauuugggaaagggcugagcagacauguagugugcuuccuuuucuuggggacaccaggaccuguucacaaccccucuacuugaccuacaugaaguucaguuguacacuuaguagguuaaaauguccacccuugguaaggcaaaccagaguuauuuaauuaaacauuaaagaggacauugaagcuauaguuaugauuauauauccuagauuuuacacauuuuuaggcaaaacaaaacaacaaaaaccaaagcaacccaaauucuaauacucaaguaguucaaggauuuaaaaaaaucauuuucugagaauuucauaaaauguauuuuaauuauauucucccuuguauaugugcuucuccaacucuuuccauucccaggucuauucccuuuucccuaucaaauuuaguucauucgucuccuuccuuccuuccuuucuuucuuucuuucuuucuuucuuucuuucuuucuuucuuucuuucuuucuuucucuuucccuuucaaagaccaaauugugcugcucagauauucuuggguauguggcagaacggucaacuucccagaggcuauacucuuagaggaaacggacucuguucccagcagcuaacaguugccagcagcggcaugauuaggguugauuaugucccccacuccuauaugggguuugaucuggcuuaggcuugcacagacuuugugcauacuguuaccaccaaguucaaauuugcuguguucagaggagaauguuuccuuagaguuuuccacuaccuuuggcuccuacacucuuuccuuccccauuucugcaaugacucaugagccuugggaggaggaaggaguauggguaguacacguguuccauguaagcauucuguagauuuuuauuucuaugcucugaucaucuuccauuuauugauugauugauugauugauuguuuaugugugugagauaguauguggguauauauaggcaugagugagcaaugguguaugcauauauauguauguauguauauguauauauacacacacauauauacacauacauacauauguauacacacacacacacacacacacauauaggcaugagugggagugaaccaugguguaugcauagaauguauauguugguauaggugugugagacaguauauguguauauauagucaugagccagcuaugguguauguauagaagucagaggacaacuucauggaauugguucucuuuuuauaccacauguauucuagggauuaaacucaucugucucagcagcaagcacuuugacccauugagcccaaaaccucaugguuuuuaaugacuagaaggaaaauaaaaauuuaaggcucuguucuuauauucugccauauuguagggaauuuuguaccuugcauuuuugcugcauuuuaaguuagucaaaaaucauuagcaaaugauuauaugaauuauccauaauuucaguaauuaaagaugcccagcuuauuaaacauuauuuggaaugguauuuaguugcauaguucagcacacuauuuuaaaugguuacaugauuuccuaaacaaaagauagcuugccauagaaauaucugugaauuuuucauaaaugguccaaauuuacuauaucuuuagaucaaaauuuuaaaaucaaaauaauaucuugcuaucuauuacaaaugguuaaaaaugguauuuuuuuuaaaaaaacaaaagauaaaaagaauuaaaaugaguagaauacccucuauuuuucauaaaguaaaacauaauuauuuuuaaguggccuuuacagggaagccgcagagugacacaguauuauugcauuuuaaggauccaaacucccuuaguuuccuaacaaacuaaaugcagaauuuaugaggagaaucgauacugugagauacguggggugcagugagcuuuuaagacccauucuuuuaccgcagaaagccgucaaauggcauaucgcuugccuuuggucugcauuuuauauggcaucuccuauucagauaucgucaguaucacucugaagauaaaauuacagccacuuggguccucuaguucugauuagaauguucuugugcuuuggggaaaacauugcuucuugcuuuaaauauuccgacuaauuucccaccagaaucagcucuuuucccuuucucuugcagcgagcgcccaugccuccuguuugcaccagccuugcugucugcccgggaugacuaaucgucauggcaccuggugcauucaggcaggccugugcagcggaaucgucaucccuaguuaugucugcacaccugauguuuuauuaaccaguauugauuuuuuacccaggggacuuuuuucuuccugaaaaaaggcaaccuugcaggagugaaaggcguugcgggggaugaauuccuaaugagccccuuccccuucuugugguuccucuuuaauguagcuucguauuuuaagugucugaauugaaauuucauuuuuagcaauucuauuuugauaaaucccuucaaaccuuggcuuucugugagguuauuuuuuuuuuuuuuuuuuaaagauuguccugcuugacugaaaugccuaguagugccugugaauucgagcauuucauuauaggcugcaaugaagcaugcucgcaugcagugaaauacagaggguucuggacuauuugaguaaagcuuagagaaaugaaaaggaagaaaaaucucaugucguauuucagguagucuguaaguuucuucuggcuuguuuaggaucaguucagaggaauaaagagacagugggaugcaugaacuagugugauaucauaaaaugaauauguagcccagcagucacuaagugacaggaaaggauuauuuuugcauuggaauauaaacauuuaugcucaggguuauguggaaccauuuauagagauauucuaaggcugaugauacaaguacaucugaggguuuucaucccucaauauggcauggauuuuuccauucagaaacaauauuuucuuguuuuuaagcauuuuccccucccccauuggccugaaaugacgcccagauuuucacauuucccuuaaauuagguagaguuucuuaaucauuuccucugacuuuggguuugacuguagcacuguugagcuuuuuacugcuccauuuuuaauuuacugccucaguccaucaggcauuguguaccgagcacauccaaaccauuaguugucaguagaugaggguccucaugagucauuuugacagcugggaugcacuagcacgggaaaacaggccugguucugucauuuuccccaggcuggagccaugccuuuucuagggaauguguaucuuccaagauauuucagauauuuaugcacuaaguguuuucacuuugaaagguuucuauuaacugcaugcuaauacacagcauauuuauuaauugacaucuccauuuuucuuacaguuuuuggcacugggaacacauuauggcaagguuuauuuacuugauguccagggaaacaucacucagaaguuugauguaguaaguauaugcuauaaaaugauguacacauuaauugccaugcuaaaauugugauuuuuaacagucagauaagaagaagauauuaauuaaauuugagugcuaagaguauaagucuaaaacuuauaguguauucuaaauguuuugaaguugaauuagagaaagaacucuguagauacaaguauacauauauuuggcugauguguguauauguauauuuuauuuguauaaauuuauauaguugcaauguuuggaucauuauagucauuauaguuugacuuugaauuaaaauauuauauguauuguauauauuuuuaauggacaguauugaaugucuagaucagagauuuucaaccuggcuaaugcugugacccauuaaaacaguuacucauguuguagugauuuccaaccauauaauuauuuucuucacuguuuuauaacuguaauguugcuacuguuaugauuauuaaugcaaauaucugauacucaggauaucugauaaacgaaccacauguggagaaucuauucuagaugaauugugauuaacacaggaagaaccuguuuuuauuagugaauggauauacaugcucucagaaguugugggauccuuugugugucaacucgucuuugaugucugaauugucuugccaucuccuugaguugccugaugugauugaagcuuuccugguaguguugguggaucgguuucucucuucuaguauacacagugcaaauguuuuaugugaaugcuuuuaggcuuacuugauugggacuuuugguaucaaggauaaaagaaauguuacauuugaaguuugauuuuuuuuuuuuaauguuuaaucacuaccuuaaagacaaugguaacuuuuguuuuuuguuugacuaugaaaaugugggguaaaaagaugaucacuuugggaguacuauuaaguuuuaaaauauauuuauuuuauuuuuguguuugaguaucuugacugcaugcauauuugucuaccaccagugucucuggugcauaaagaacucagaggagggguuuaaauaugccggaacuaguguuauagaguauuguuggcuaucaugcacuucugggaacugagcccaggugcucugcaaaagccauuccucuaguggggugggaggcauggcugauauuaaacauaacaccaccaaaacucuucagcuuuugcugcaagaccuaauacaggauacugcaguuuacccagcaugugauacagaagagggaaaggaaugagggcccagaaagagaauaugugcucucacugaacugcuccaucaggacagcugugggguuggcuuguuuguuugcuuuucucuuaauuguuguuuuuugaugagggggauguacuucuacccuuccucuucuaauacuucagacacuggcuauauauccacacuuuggucuuccuucuucgugaauuuccugugguuugugaauuguauccuggauauuaugagcuucugggcuaauagccauuuaucagugagugcauaucauguguguucuuuugugauuggcuuaccucacucaggaugauauuuucuaguuccauccauuugccuaugaauuucauaaauccauuguuuuuaauagcugaguaguacuccauuguguaaauguaccauauuuucuguuuccauuccucuguugacgggcaucugcguucuuuccagcuucuggcuauuauaaauaaggcuacgaugaacauaguggagcauguguccauauuacauguuggagcaucuucugaguauaugcccaggagugguauugcuggguccucagggaguaauauaguuccaucuuucaauggcauauuagcuaugucuucuauccaucguuuuucagguuauuaauuaucucaucuguaagauugucugcacuuuuaguuuuuuggcucugucugacaucuuugaaaacuaaguguuugcagugguuuuguuuguuuguucauuuuuguuguuuccuuucuuuggaagauaaagaagauaauuugaugauauuuuaaaucauuuauuuauugucuucaagaaguuugauaaucuacccugaaaaaaaguuaguuguuuaagggcauggcuucuugaugguucuugucagauuagacuuuuuaauaucaaauugcagauggucauuaucuuuuggaagacauccuaauaacaguuucaugucugucaugaaauuuuuauuuccuuuuccuuuggucuugagguggcugauuuguagugcucagugugccucuuuaaaagguugccuuuugauuuugaaaccauuguuagcacuugacuuucuucagaugugauaguugccaauuuuuacauuguucuguguuuuuugagauaaagucucauccuuaggcucccaccccccauccccuguauuuauuuguauccuagaaaggucggggauauaauaauucaugauacuuauguaaucuuuuuacuuuccucaagaagugcauuuauaaccuauucauuacauugguauuuuugauuccaagaguggaaucaugaagacguacuccugguuuuguugaucaaaagcuugguuugacaggggauggaaguggggaagaaucacuuuaaaaaauaugucuaggugacucagauauuagagcuggguagugccauuaugccagaagcugucuaccuuccuuuuaccaauguaauauaaaagaagaaaacucaacaacucauucuguauuuuaaaaaaguaauguuacuucugccauuaauagcacaagaagaauaauguucuugguggaaucuacugaagcugagccaggcugccugauaacccagcagucccgcuuugaaguucauuuccaagaaaaaugcaugugguacauaggaccguaaagcuguaggucagcaauggccuaauucaugauagccuccacaugaagcaacccagaugcccacugauacagaaauggauguguacauucugcuguguccuuaacaacaaaaaggaacagauugucaguacaugcauauaauggccaaugaagccagaucaucgguguuaguuuugaacaguauuccuugguuggaauguaugaucauaaaacaccauugugcuuucucuuuaaugacccucauuuuccuguaauguuacaggaaaauuaaaauuaaaauuuuacaggaauuuuaaaauugauuuaaaauuucccacccgaguacuauuuaaacauugaucacauaguugugucauuucuuugcugacuauuuuagagcauuguaguggcacaucaguaagcauuuuguuguuuuuguuuuuguuuuuaacuguuagugaaacuggaaagauuuuauuuggcaaacugaacuuauguuuaccaaauuuuuguguuuuucuuucuuuacuacaaacagaaagugacaagguuuuccuggcagugucaugggaggagaugcuagagacacccgugauugcugaagagaaggacuaaacaagggcgggaagcgccuuauuuguuaagacugacaguuuuuaaugaguuuagaacuuuccuuugauuccaggcaguuaucuguugguauuucuaguugcuuuucauuucccguugaauuaauagguucuggucugcaguugccaaacuuuggaacuguucaugccaugcauuaauaaaaaccuagcuucaaagcuuaacuaguuugaacaauuuuuuuuguuuguuuguuuuguuuuguuuuugagacaggguuucucuguauagcucuggcuguccuggaacucacuuuguagaccaggcuguugaaaauauuuuuauuugcaggaaaaugcauggaaaucauuauaauaagugaaguaagugaaacucagaaaauacauauugcauauuuuaucauauugaaguagauuuaaagaaaaaaaggacuugagugcagaagagggucuauuugagaacaagaaagucaccaguggggaaggguagagugacaagacagggacagugggguugauugugugcagaauacaugacaggcaugucacagugaaacccuacauuuuagacaauauauaaguguuaauaaagugccuuuuuuaaucaaaaaagcuguuuuuaauauaauuauauaauuucauccuuucauuuucugucucaaaccaccuuuucauuuacuccaucccccucucuuucaaauucauagcuucuuuuuucuuaaauuguuguaucauaugugucuauguauauaauacacaucauauauacacacaaauaaauacucauauacacauauauaacauauauguauauguguguauaauauguacauuccuaaauauauaaucuauucaguccauaagaauguuauuugcauguacauacuuugcauuucauauuggauagacaauuggugugcucuucucuucuuucuugguugccuguaguucuuugucuaggguugagccucauaaguguuuccucucuacauuaucaugucuauuggugucauccuuguuuaggucauguuugggcaaccaugcuggcuagacuuuauggauguccaagagcuauagaccuuuaaacaaccacaauaccaggcaugaaaagucaucauguagguuuuuagucuggguuguucaagaggcucucagaagauuauagccuauugcuauugcccuugguuguucccccgagguagaagauaagucccuguugcugaagacacccaugauuuucagacaagaaucucaaaaguccccaagcuggaacuguccugaaagacuucccacugagaauuauauuuuaugguaccagaagguaccauccaagcuucaaaggaaggaagcagccaauaguccuauccagcuacgacaccuaugaagcacaacagcaagcagcaugacaugauggccccagggguacagcaguggcaugcauacuguggcaauaaccaucucucuaauuggacuuauauccaacaagaggagaauuauccuugguacuggaaaccuguccaaauucuaagggcuaauaaagucauggaucuuggacaaaaaccuuuaacuaccaguuuauuaaaccggccuaauuuguaacuacaugcuaaaauauuuguccuuauacucacaguuaaguuuaauucucacuugucuucuagaaaauuucucuuugcaacagagacaguuacagaaaaccccaauugaugaagagauaaauugugaaucccagcugcaacugauauauacaacagagaacuccuacaccugagucucaaggaucauuguagaagaugggacagaacuauucugagaacuggaggacaggaaguuuccuuugagauuaugucuccgagaaauguccaaaaauggucucuuauucugcauucuugacccugauaggaagagauuguagagcaauaucucugaauucaaacaaucacuuuaggacggaggaagaaguuccuaagacucagaaagcuaaaccuuacaaggcucaggagacucauagaagaauuauaugauucauaaguccucucacuaccaucaaaaaacaagcaaacaaaaaccaaaaccaaaccaaaacaauaacaaacccuccuaccauuugcuggggaacauugauucucccccucucaggagucacugacuuccuacagcucuucacuuagggguggaaccuugugagacuucaucaaugcucauuggugugucagcugguauuauuuguuacuguuaaggucuuguuuagguuacaaaaauuaguuaaagacauauuuaguauaacuccugaaacauuaacacugcuagaagcaaacaggcagugcacucuaagaaacaguuuaagaaaggacuugaugaauaggaauccauuugcucaggaauuaaagucaacaauugaugaagugagaccucauuaacacuaaaacauuucuagaucccaagggaaacaaucaagugaacaggaagccuauagaguggaagaaaagccuuagccagcuaggacuauguagagggucaguuuguaaagaacuccaaaaacaaagaauccagaaacaaauuacaaaugggcuaugaaccugaacaguauuccguuguauucuucaaaaugaaaaaaauaaauguggcuuuaaaaguguaucaauucaacaccauuagaaaauuagggugacauaaaugaaaauuugcaauuauuugaauuauuuaauauuauuugaaauauccucuuacccagcugaaaagcauuugccgguaaggauguggggaaaggggaacccuuccacuguuggucagauugcacacucucauagguucucuggaagucaguguaaaauaggucuaugaugugacucagcuauuccacuaucacaguuugcuuccgguugcugugauaaagaucaugaucaaaagcaacuuugugaagaaaagauuuauuugccuuauagguuacaguugaucaucggggaagucaaggcagaaacucaaggcaggaacuugagggggggaauugaagcugagaacaacauggaguuaaacuggauccuuggucagcucagcugcuugcuggcuuguuccucauggguugcucagcuugcuuucuuaucuuuccuugucccccuccagcccuagaaauaccugcccagugguggcauugccccggugugcuaggccuucugacagccauuauuaaucaaggaaacaugcuacagaccuuccuauagguaaucugcuagaggcauuuucucaguuacaguccuucuucccacauaauucuagcuugugucaauauggccaaugaacgaaugaaugaacacaaccaguucuuggccuacccacacagcaaucuaggagaaggacucacagagaacaaaaauuaauagaagaaaggcauucuagacccaaaggguguggugaaaaaucuuaggaacaaguaugcacauacaaaacucagaagaggccaugcaaucaaaaugaggaguauggagaagcagcgagauuucagauuguacaagugcauuccuggccaugccccaggcuccagggcuuuuccuuccucugcacacacacacacgacauuguuauuguuaucuuugcagaaugggccuucaucuugccaguuacagcuuuuuguuccuauguaagguccugaagagcagaggucaagucuguguuguacuucuccaucuuacucccacucuugcucuggguuguuuggggcugaguaagcauauccuggcugacaguaccauguuugguucacacuugugaagcuaguugucauuguguaucauugccuguguaucauucagccauagguuucucacuguauuuaugaucagaauuguuuucuuuuguaaucugcuauagaaagaauuuuguuuccuuauuuugaagccguaaucuccacuguaaugagguuugggaaugagaccuaugggaagugauuagauuuuguuaaggcugugaaugagagcaaagagguccccugccccagaacugagaaaucugcucuaugaguugcccuaaccauaguauuuuccuaagguccaucuagaugacugguaugagauauggacuuucaaccuugcuuuugaaauuaauuccuucuggcaauuaauuuugcagauuuuuuaaaaaucaacuuuacagaaaccuauacauaucugguaagaggguguuuccauugaagaguucuggccuguaggcaagucuguggaggcuuuuucuugauuaaugaugauguggagggccuaccucaccguggaugguaagguaugauuccuccucccagcaggugguucuuauaaaggaaacgaacuaagcaagucauuggaagagcccuguaagugguaucuucuguggcuuuggcuucaguuccuucuuugaguuucugcuccacuuucuucucaaugaucgacugugguguggaagugcaaaauaaaauaaauacuuuccuuccuugcauugguuuuggucaguguuuuaucacaacaaaagaaacaaacuaggacccuaguuaaaauaauguuuuugagaauuucauguaugauuauuauauuuauaucauuuccucuuccuccucuugaucgcaccccacacacccucucaaauucaaggccucuuuucccuuauuuauuguuauacacacaugcacacauacacacaagcacauauaccccaccuguguugcuucuguguauagguuuuuagggcuacuuaucacaaucuuaauauuuucacagguccuuuuuguugcuauaguaauucaaaccuuucuuuuuuuuuaaauuagggcgaacucacuggucccgaggauugaggccaagggaguugccauggggagagaaggagggagagagggagagggggagaaagggaagaggagggggaggggaggagaggaggagaggagagcgagagagagagagagagagagagagagagagcgcaaucgaccauacaaagcaucaaaggugcuaaguaaggagugcaggaguuaauggacuuaugaugcugcaagcuuguguccuugccauuugcugugucugucuccuuacuugucuagguguuauuaggugucaucucuaaauuucaaaggauguguuuguuauugguuccuucugugaauaauuucauguuuguuucuggaccuugauacuuggccaucauuggacuaggccuugcacuuuugacauuggauugucuucuuuggcauagagucaucucuaaucuagaugaguucuucuuucuuucccauuaguggauaaauguuuggacgaccacuuaucuuuguguguuucagcaaaggaaacacuaucaacuguacauucucucuuugccaacacagcccugaaaguuuuguguuccuuucaagcuucuuaacuugcaguuuuaauacucauauaaaaaucuuuguuuacauagcauaauuguuuucucugagugauauuuaguacaagcauuugcauuuuugugcaaauuguuuuucuauccauugguguacuuacuuugauagcugugaggaagaaaauaaaaguucucuaaacuaauauagauaugugcuauaugauaguauuucaguggugacuggcauagagugcagcuguccuguaaaguuagauugagcagcuagcguaguaagaacacccuauaaugguucaauuaugauguuaccugucagccccucucauaauauuucauaagacauuaguucaaaucugaaaaaaaaaaccauguaucaggacaguuauucagggaaucagaguuuuauuucuuucuucucauaucagaauuaauauguauacauacauguaugauucucugguauuuuuuugcuuguucaucauguggccacugugguauuaagggugauuauucauugggagaauuuugaaaaucaggucuaagaaucucaucuagcuuccucaauccaaauagccaugcuuuauacuacaggucugcugguaccuggugucuguccugaacagauauugucuguagugugcuauuuuagcgguggcaucauuaauuaggaagcaggcuuuguauuuauugauaugaucaaaaugguacuuuauuggcccaaauaugccaguaccuauaauucuucuguaagacugauugacaggucucagacucucaugcgcuuaaagaaccuguuuucuauauuugagcauaguguuuucagugauaagagauguauccaaugaauugugaauuaagugggaaacauucuaacuuuugauaaacgauggugaggaaacucacauuuccaauuuucugcauuaaauauaaucucaaguuguggauuaagcauagguaccuugauaacuuguggcaucccugcaucuaagugaguaagaaaacuuauucggcauuaaggcugcuugccuaacuuagaaucagguauagagcgaaggaugcuggaauaucuggcccuuuugugguaaguguguuuggaaaguuaucucuucagcagcuauauuauaauaguucuucacagaagaaaaugcauuagaacuuucccuguuuuaaaaucgaaguugaaguaauauuaauuuccuacaacaugacugugaggugagauggguaguagccuggagcguagcuggcugaaaccugcagauuauuucccuccacagggagaaaauccuccggcugcuucuuucuuugaggcucagucauuuauuuuuaagagaagccaggguucgggguggggggugggggggagggaaggagggagggagagagggacagagacagagacagagauagagacagagacagagacaggcagugaucagauuugcaagagaggacugagaacccauggaggccggaauugggaguuuggagcucuggauggccgagugucacaucguugucacaguugggcuagacagggugauggcuacgucuaugaaaugguaucacaagguggaggagcagucuucuuauauaaacauuugugcaagcuccaggagcuugaggacaggagcguggacaggaaacgguaggcaugaacgguaguaguguagauuugguugacagguuuauauagcaagaugaaagugcuguguuuuccaagacugucuuugcaaaaugaagguugauguauuuagggauguaagugaaaccuggcacguuugggccagcagucgcuuagggcuaggguuaggguuagggcuaggguucugaucacuccaauacauacaaagccugcuuuccaauguguaaauuugaggucaugaaccagaagacagggucuuacuguguggauaaggucagcuuagauuuuaaacagcauuuaucuugaguucguuuuaauguaaaauagacuuuuuaauaucugggaacccugacaccguacuuguauauuauauguacucaaaauuauauauacuucuuccuuaaucuguuuuucugguagaauagauuuuguuuuguagcuucauuuugggggugggggagauuauuuggucuuaauuccaaauuaucuuuucuuugaauuauauauuaauuaggaaagauaauaacuugaaucauguuuuccuccauuucuucauacuguggagucuuauagaacuucuuagcacuugggugguuguccauuccuuguuucauguugauaaguaggugucauaacuucuaggaacauuauuaaucuuuaacucuucagauuuuuguuucauugaaaggaagaaaaauacuauacuaaagcuagggaaagugaaauaacacauauaauuaaaauaccuaucaaaaugguuacaauuacaaagaggagccaugcuaaguguuaggguauguggaaggacugcaccuucccuaccaucuaucuguucucucuccucuuguaauguugaggaucaaucccagcuccuguguuugcugggaaugugcucuggcugcaguuuagaucuccagauagauguggaacucaccagcacugauguaacaauaacagggugucggugaguuuguaggacauuaaauauaaacccacuguaugugucagacuuucuggacauggaggugaaaacauguuugcauagagaagcauauaucaauauucaugugagcuuuuugguaauaugcugcaacuuuaggcaaccucuguugucagucuguagagaaacacaaugcagcccauccacccaauguccugccucaucaguguaaaggaaagaaguacuuaugugugcaacacggcacacacagccuaucauaaggaaagaaguacuuauguguacaacacggguacacgcagcucuaucaugauaagggaaagaagccaaacuaaaaaagucacauguuauaaauucacauuuauaaaauuauagaaaauauaucaagucuauagugaagggaagcagaccagugagugauuggccaauuuuaucucagaggagaaauaagugccucgugaaauagucuaaaagcuaauauauuaggaugcuuuugagggauugguaacagaaaucuaugugucucacaugcaaagagaaaauaacacagaaaagaagugauccauucauuguugcuuuggaguuguuaauucucugcacauguaucaaacgaugcugaaccugagaauucaaguuugauaaauaucaucgagugggugggcuucuuuuaaauaaguucuguaagguaggggggccaugccagaugucauccagguucugguccaaguuguucuguuucccuacagugaggcaugccauguuacacccaccagcauuguuugcugccgugucacuccuucugguugcugucauuggcgagucucaugaagaaucucauggauuuagguuucaagaugauuaaguuuguauuuuucugguuacuuucuaggcuuuuuacuugagaguaguuaguucauguauuuuguuaauauguuuguaagguucuaaauugcuuugcacuuaaaacauuucuuguuuacaggcaaaacuaacaagagugagaaauuaacucuugaggagggugggucauguaaugacucagaaucugagucaucacuagaaguuaaauuugaugacuuucgaccuuaaaauagggggugugaccacuuuucuauugccuugauaauuuaaauaugaucuucauugguuucauugacuuagauauuuugauucuuuauguuuuagaaaagcuaaguguaugccaguuuuuuuaaaaaauauauguuauucuguaaaaauguuaccucuauaugagauguauaugagauggcuuaugcgacuguuuagugauuaagagcacuugcuguucuugcagagaaaaugaguuugguucguagcacucacauugaaaaguccacaagugccuguaucuccagcuccagggaaucuggcacccucuucuggucuccacaggccugcacaugcugacacacagucauacacaaauuaaaaucauaaaucuuuuaaagaguggcagauaucuucuaguaugcggcuuuuguuuaaauuucucaguuauagccauuucaguuaauaguuuuuuuaauggaauaaauauuuaucagucuucacauuuauaguuugguguacauaugugugugcaugugagugaguguguguguuacaggggaagaaaaaaacauuugcuauuguuaaaauaucaaaaguuauaagauuauucuauauuuuccccuaaaaguuuucaguuuuugcuuuuuauaguaagucuucauuuuuuuuuuucucaagaaaaauguucccaggcaugcggagaauucuauuucucuuagugugaggacaaaguuccugucuugccaggaaaauauuauaguaauuuucccuuacccuugggauuuguuccaauaccuaagcgagauguuugaaacuuugggcaauacugaguccugugcauucuccacuuaguauguuuuccccuguaggugcucacugugcuguguugaauguacagauuagcccuggagauaagcacuuauaaaauagaauguuuaugcaaguguagugaaguagcacugucucucuuacuacucgugcuuuggagacguugugcuuaaguaaaaagagguuaccugaauggaagaccugugcugauagccauguuccauuugauugauaaccaagauagcuaccagguuacuaguggguugguagugucgacuugaaacauggacgaaaagauggcucauuuucugggaggaacagaguugggcagagcaaguaaguguuugucauccuacuuagaacacagacaguuuaguacuucuaauuuuuuucuagaauccuucaucaaauauuucuagaccacaacugcuuauagguaauuaaaacauuggaaacugaaacuaugguuaagagaagaccacacagcccaaugugcagacuuuccauuuuaaugccuguccuuguguguauguacuguguuauuggaaaccuagugccuuagaaugcauguagaacuagagguagcucugaaaugacuuugagugaaaccacuagcaaaucagggucuccaucaggauggucagcaggauuguggugguggcggguguguacuugaggcuagaggguggugaaauagcaagagaaauagaccagugauggucugacucuugucuuccaacccuugcuccauguucaaaggcuguuaaauaaaucuauaccucccaacacaugugugugugcggucauauucuuauuuucaucuuuaaaauuaugucacagucguaccucagauuuacaguacaguuugggggucaugugagcuuguucaugugaagcauguuuugcaagacuggauaaaugauuaacaucagaaggugggucaagugaggagugacuuaacugcaggcauuuuuauacuucuugaagaauauauguucuuuuaaauuuaucuguguaguuggcuuuaauagugauauuguauauaagauugagaagaaaggaaggaagaaggaaaaaguuuucuguaguacacacacucugacaucagcuguagcagcugcuccaguagguccuuuguuuauuggggaggaacccaccuuuaccauauggugcagagagugcuugguaaguagguaugugaacucuguccgggacgcccugaugacaugacugagggagucuccuuucuaauguagaacagcuugguuucuagcauagcucucccuuggacacuuuucugugagaucauaaucuacuugggaaaugacuacuggaagacuguguuuguacugagcauuauagcgaugcuguuuguggggagguuugccugaauuugugaacugagagguggcauuucuuuaucaaggauuggaaaaguaaaauuuacuuugguuaaugauuuggucucaauuauguaaacuauauuguuugucuuuuuuagguaagugauuucuuuguuuuuuuuacuacuucuuaaauagaagggcuuuaaccucucaaauguuugguguucaacauugcugcugcuccugcagagcugaaaauaaaaaugagaaacaggagaacauccuuacugcuaauggauuuucccuuugucagugacaguaucauucacuuguauaauggaaaaauaggaaugucuguggcucgugagaugcucaugucgcuguaaagcaugucacuggcaggaauucaggcauuggcuuuucguguguguuuggggaggggcagggucucaugcaccucauaccagcuuugaauuuucuauguagccaaacaugccuuugaacuugcuuguucuucuagagccuuuauauagcaugcccauagaacaugucaaugcaaggguagccuucuaaggaccuuauuuuaaacagcggcgauaucuucuuuauacuuucauauuuguagauuccgaaggguggcaacucauuucuguugucuuacucuuaggaaaaaacaugacuuggcugaaugguucuggaggaaaaaagagaaaaacuuaguaccuggcugugguguggcacacccuguagauuaacugccguaguaacgcgguaaacuccacaacacuaugucccccuuucuccauacucaugaggacaauuaaaacuaguuuuugauuauuccuauucacacuucuuacuuaaacaacccaguucaucuggauugagugguaugugcacaacaugaugccgcugcagaaaccgggcacaccuuuaaucccagcacuugggaggcagaggcaggcggauuucugaguuugaggccagccuggucuacagagugaguuccaggacagccagggcuacacagagaaacccugucucgaaaacaaaacaaaacaaaaagaugccacugcagguuacuguuggaguugaaggagcagcaccaugcugucugcacugaauucuggcuccuuaggcuagcagcuuugcugucaaaaggggccugcuaaaggggcagaccuuuuaauaugacagggaaugcucuuucccccuggaauguagagagucuacaggcaaugccucauucuuuuuuauauaauugcugaagaagaagaaaaacaaaaucacucuuugccuaaaugcaaagaauagccuuuccuaggccacugguaagucaucccuucagaaggcucuguuuuuucugcaccccccccccccccaguguuugcuuucaucucuggcaucaucccugccaucgcuccauuguucucugucuauucuccccaugauccuuuuaucguguucuccccuuuaccaguuucucaaauugcuaccacccuuguucaagcuuuuauugagucucacauggguuauugcaguaaagcccaacugaucucccugucuuaugucucugcaaauccauccuucucacagcugcccaaggaaucuucucaaagugccacugggcuuuucaccaaaagcaaacagguggccuccagauuccagugcaauacagcugcccuucuggguagagcaggacuuacaguugguugucacaguguucuuuauuguagcacaugcuguugcuaccucuggauagaaagcuugucccaucuucccugugacauugcccuuaauuuuuacagguagaggaauauguauuugauauucauuuaguaauugcuucuuguuccuugugucaaacauuguccauauuuuccagcaauaugaugacagguaaguagagugcaccccccucugauucaguugaucgaaguugaucuggaaaguaauguguuaaauuauugcagagaggcccaaagugcuagcacuccacagacuccucaaaggcagacccaauuugucuauucuuuuccuuaaauucugcucaugucauguaggguauuuaguaauaguuacuguuuuguuaaaucaaaucauuacaaguucguuuccuucauaacuuguugcaacuacuuggugacagccuuugugguaguuugaauaugcuuggcccagggaguggcacuauuaggagguauggcuuuguuggaaaaguguguuagaagaagugugucacugugggggugggccuugagagccuccuccuaacugcuuggggaaacuuuggaugaagauguagaacucucagcuccuccagugccaugccugccuagaugcugcugugcuuccuggcuugaugauaauauacugaaccugugaacuuguaagccaaccccaucaaauguuuuccuuuauaagaguugccuuaguuauggugucuguuuacagcaguaaaacccuaacuaggacagccuuccuuuuuuguuauucuuucuuuuauauuuucaguggcuuuguguaugagcaaggaaaauauuugcucaauuaaaauaacaauuucuacaaugcuuuacacauuauaagucaccauucaaguaauuuauauuuagaguaaaugguuaucuguucaaaguggcauucaaguuauaaggaucacaggcuuguucucagcaauucuuuguuuuuauuggauauuuucuuuauuuacauuucaaaucuuauccccuuucccaguuuccccucugaaaacccccucuccccucuccaucuaccugcuucuaugaggauagucacucacccacccacuucugccucccugcccugguacuccccuacacuggggcaucaagccuucacaggaccaagggacucuccucccauugaugaccaacaaggcuaucuucugcuacauauguggcuggagccauggguuccuccauggguacucuuuuguugguuuagucccugggagcuccgagaggugggggucugguugguugauauuguuguucuuccuaugggguugcaaaccccuucagcuccuuaauuucuuuccuuaaguccuccccugggcccgccccugcucaguccagugguuggccgugaacaucugcuucuguauuugucagacucuggcagauccucucaggagauggcuaucaggcuccugucagcaagcucuucuuggcauccacaaaagugucuggguuuggugacuguauaugggaucgauccccagguggggcagucucugaauggccuuuccuucaaucucugcucuacacauugucuccauauuuccucccaugaguauuuuguucugccuucuaagaaggacugaagcauccauuggucuuccuucuucuugagcuucauguggucugugaguuguaucuuggguauucugagcuuuugggcuaauaccgacuuuuacacaguggaguacuauucagcuauuaaaaacaaugacuucaugaaauucuuagguaaauggauggaacuagaaaauaucaucuugaaugagguaacccagagcacacaugggauggacucagcaauucuuuauugacagagugcaugcccggaagaaaagcuuuauuuguuccuuauauugcuuccuggcucacucuugacuucuguagcagggccauuuaguguuccuucuuaucuuagauguaguguugcaggcaaccauucaagguaccauggugagacuagaaucagguuguccaagaucuucaacugaguuguuaggacacuuaauauugucucagagcaguaggauguggcugugaagacuguaggugccggagaagauaagguccaggugcugcccugcucuuccugcaccugcagcagagggcaccugcagcagaggguaccugcagggggaucucacgcugaacagcaugccacguuuucuuaguuuaagaaggacaaggccacgugcuuuuaucauuguagacuguauucuuuuccuugaagcaaucugugcccaaauggugaaugucuguguaguguaugguuacuuacugucugguguugugugcaagccagccuucugcugcuguuaaugcuucagccugaugagcaaaagaugcaauuucacaggaggcaggcaggucuagggaucagcaguacaugacuuccuuagaggccaaucccuuccagauccggucuuuucuuuuaaagguuguuaggauuuagaccaagaacaucaucuaauaaguccccugcaggcagaaaggccacucugugccccagcucugcagagguugcaguguccuggcagugcacagcuguaaagucggagccuuuuuucagauauggucacaagcucuuagucuuggauacuggauagagacagcagccuaagguuuuagaggcccagggagccucuagccuuccaagguuacaguagucacaucuagucauguuuccuuacaggggauagggaagguaguuaaaaagucuugaguagaggagauucuuaagaaaaacaauacuuaggauauuuuggugcucagcaaaagccuuuuaagcauucucaugcguggugauaauuuaaggucaacaauuagcuaagauagcaaugagggcugggaauguagucagugguagaguccucguuaugauacgaaaacugaaaaucaagcaagcaaucaagcagucaaucaagcagugaucgaaugacauaaaagggcagaguuauauucuuuucaggcaggagaacuucuguucaaagcuucuuuucauuccuuucauuuuuacaugacuuuuggcuuuucauguuuuaugaaggauauuuguucaagcucagguuguggacaauuauuuucuaaucaggugauuugguuuuuaaguaguuaaaauaggcuggucacauacaaaugucuaauuaaaaauaauaugagaaagacucaaagauggcacaaaaggugcugcacaaguuugaggacagaguuuucaccccaguaucuguggaaaagcuggggauagcagugugugcuuguaaccucagcucuggcaagaacguggugcagauggacccucugguuugcuggcuggguucagugagaggcccuaucucaaguaagguaggagcuaauugaggcaggcauccaguguuugugucugccuuccacaggccaagacaagcacacaugcacacaccacacacagcagcaugcgaaggaggcagagcacacaucagauguuuccuauuaagcagcauuuuuaccuugacaagaagaacuacuuugggcugcugggagguuuguauguaaacagugaacucuaugcauuuuaaccucucuguauuauugacacuuauuuuuuacgguugaggauggucauggugaccuaucaagccuagaagccacggggggaacauugccuacgguucaguauggcaugcuguuccugagaucuugguagagugcaguugacuucaccuuccaugagaggcaggcugccauucacaguuaggguggaggaauucauguucuggguuuguccugcuccgucauuucucaggcacuuuucgguuccgaugagcuuugcuuauauaaguaagagugagcuuuugaaagcauaaguuaauagugaccaugagugcuuggcuauggagugaagggaauguucccacuacucagugaacauugaaaauguaagcuaccaucaucagcccuaccauauuuugucacuuaccucuucuguuuguucaaaguggaaaguacauuguaauagagugauuucacuuuuaugucauugggauaguugugcugcucucugagcuuucucguucuuucucaguguggaaggaaucauuacugacaaagccccucucuccaucuguaggacagcagcuuggguuacaagccauuaugucuucagguucccaacucaagguuaaagaggaagaccucacagcacauuucuugugcauauuccuauugaacugugaaguagaguuaguguuacggggaugugauggcuauagugacugucaguuuugucagcuauucaagccccgcuuguagcuuugacaguuuggguucugcaagagccacaagcauaucagagguuagacuuuucucuuaaaguuuuuugagguuugaucagucucuaaaacuuuuaaagaagagauuuaggaaaagaacauuguaaccagauugcuuguuucccuaucuucuuuagugguuugucuguuuuacaggcuuuugccuguuauuuaguuguuugucuguuucacgaggccuuugucuguuauuuaguuguuuucagacugacugauucuccuaccugaugcucauugagccuuuaaagcuaugguucagcucuaacaguacugugcaaaacucaaagaauacucugucuucccacagagaugucuacacacaccucucuguguuuaucgauacuuuaucaugagcacugagcacauggaaauaacauagaugucucucaagagauaagcagguaaugggaaugugauaaugaggaugacaucugugucuugugaaauuuauucagccaaaaagaaaggaagguuuucauuucugggaaaauggcuauaucuggaaaauagcaaaugaaguaacccaagauuagaaaaauaaauacugcauuuuaaauauuugaauccuaguuucuaaucuucaucaguauaucaucauguaggaguuaguguggggucccugagagggagaaaaaaguuuuaaggaaggggaaugggaaaauuaacugaauacauguaacagggaaguggaaaggagagcggauucaggguagaaacauacaagaagggaggcgcgcgcgcgugugcgugugugugugugugugugugugugugugugugugugugcaggaggaggcucaaccaaaagaaaacauaaugaaaauggcaaagggcaauguauuacguuguuuccuuuguauuaaaaaagacuuacuucaaugaaguaauccugcuuugacucagggcagagauuuucuaggugggagaaaagaaggaggcugugcuuggugcauucaaagaugcugaguuuaaaaggacaguucaaaaucaagacugcuaaaacugcuaugaagugauagagauguuaggauuuagugucuuggucuaugugagggaacguuggacugggcugucuaaauagacagaggucauuuagggagugagcaucuagaagggucugauucucaaguggcaugcugacugagagcuguagagcgguuuguaagcacuggacucugaugaagccagagcuggaacagggugaguucugauaauugagaggcaggugagauacuauauagcccagacggagccugggaagcucacugagauggcaguaaggaaaugaggggauagguaaguagaagccagugcaggagagaguccggugcugggggcucgugugcacugaagggcaucggacuuuaaugugcacagugcuggagauguuuccaugagcagccuugcuggccacauucacgcggaccucuuguguguggcagugaaccuaaggaauggaagggagcaucacucauuguauuccuuggaagaauggugccuuaaguuguugaaaaccuuuaaaaauccucuuaaauguaacaucuguaacauucaucauucaagaucagucaauauuauaaaagcagaguagaaccauaggguauuuucaacuucgcucuuacuugucacgaaugcuacuuugggaucugcagcuuuccccguuuuucauaaugaagaagcacgagaucuaaaugucauuaaguaauuucucccaaacaguauuuaguggguucauguuuucauaaccuuuugguggagguggaccuggcgagcugguaaacgugucugcucugucagugggccacacauaacaaaggcuccuucugcuuuuucuucuuuuguucagcugugucucuaaguauaaaacgugacuaucauuagucagcaggggcauuuguuacaaagcaagcagccagcuacaguggucaggaagaguauuugugacagagucaaccagcuagccacagguccugacgauuuuauccucugacuugcuuggggauugggggggggggggggagcuggcauuggaggcagggacagcagccagcugcccagaugcacaugagugacucugggacaagaggcugggugacaguaaauguauggauuuccucaagaaacagcugacugcuguuuuacauuuucucuucuuuuuagccuguauuuggaucuuuucuggaaauagucacauaauaucugucacuucaagauuuuccccuguuaaaugucuuacccaucuuggaacaaagaaggcauugcugcuugagaugaagucuguugguacccgagguuugcaacuuuaucauuaaaguugggcuuuuauggcuuuaaaguaaauuggugagaaaauaaauguaguuuuuguuggguguauuuugagagcacauauagucaggcaugcucuccugggcuagugaagucugcauagagaucuuaucuacaggauguaucagcaguaaaaacaaccaguaaggugagcuuuucccaacuaggaaaguagggacauuugcuuuucacauauggaguucaagugugaacuccucacugacugugacuaaagggaagugaacgucccugguaaccaugaggaugcugggugccucugagagcaggagaaugaaggccugucuucuuuuccuauucauuccacucaguggcuguggggaugcaguguuugugaagggaucaauuauccauuuguuagucaaaggagccuuacaaauuauacauuagcagauugauuucuuagguucacuguuaggggacgaauagcuuaaggugggaugacgaggagugucuggggacacgguugccacuaagaacaccauuaaaagcagcuuuugaaaugaccaaggauuuauuccuaauugaagaaugggcauaauccauaccaaguguauucauuucaaguauuuuauguuagguaauugauugucccaugagguguacuuguuaguaauuuugccuuuucuuuaagaacuuggcaccacauguaguggacuuagauuugguuuguucugguccuugcccccuccuguuuacuuggacuucucuuuuuauuccauuaaggaaacauuuuuguauguucuguagugucagcuugacauuauugauuuuugaacaaacucacuuauauuguccagaauuccaaaugugucuccauuaggaauaaaauuguagcuaauggaaauuucgcacagcugaguccauuuuccucuggcuuguuuuccuuuggucccucuucuuuuucugugucuguuccagcauccugucuuuggaaauauguacccaaaauaugucuuuagauauggcauuucccuuuucugugcucuuaacuaaaagggaugaaauugucccguuuggaaggaauagagucuucugcuucugggcucugccugagucugugggcaucgccagccuuugguuuuacuucuggggcucugccuuagucugugggcaucgccagccuuugguuuuacuucuggggcuuugccugagucugugggcaucgccagccuuugguuuuacuucuggggcuuugccugagucugugggcaucgccagccuuugguuuuacuucuggggcuuugccugagucugugggcaucgccagccuuugguuuuacuucuggggcuuugccugagucugugggcaucgccagccuuugguuuuacuucuggggcuuugccugaguuugugggcaucgccagccuuugguuuuacuucuggggcuuugccugagucugugggcaucgccagccuuugguuuuacuucuggggcuuugccugagucugugggcaucgccagccuuugguuuuacuucuggggcuuugccugaguuugugggcaucgccagccuuugguuuuacuucuggggcuuugccugaguuugugggcauugccagccuucgguucuacuguuugcaguuguggaacuggcacaagaaugccagaccuuuguucccuugugagagggaugaugauggaugcuaacgcugggugcagccacuuacugauguuugcagcucuuguuuuguuuguuguuucuuacaugcuacaggauuguugugugacuggggaugguauuggugaucaccaacauuagcuguguaguaguuucuucccuggugaugcugaugaaaacuaacgaugauuuacuuucugguguuuugaucaguuuucuacuuagccagguuguuuguuuguuuguuuguuuguuuuuuguuuuuguuuuguuuuguuuuuuugaggcaggguuucucuguguagcccuggcuguccugaacucacuuuguagaccaggcuggccucgaacucagaaauccgccugccucugccucccgagugcugggauuaaaggcgugggccaccaugcccagcauacuuagccagguuuuaaagauguuuaucuuuguguaagcacauacuauaaauacuuuuagaaaauuugcaaaacauagacaaaacuuaguaauacuaguuuguauguaggugugauguacaugcauguucaugcagaucuuugcauguguguaggugcucauacacuuggagacuucccguugacauaauuccucuuugaucucuuuccacauuauucauucaggcagggucucucaguugaaccuauagcucauugauaagcuuaguuugguuuagcuagguugcuggagaaucuugucugcuuucuuaagcacagggaauugcaggagggcuccugugugccuucacagccuuuauguggguucugggaucuaaacuuugaucaucauacaaucacuuuauccacuguggcaucucuccaggcccuuacucuugaugauaucuuuuaaagaagaaauauauauucagugcuacuaucugugaauuucucucucuaauuauguaaauaauaaacacauacuuaaaaauaugguaagguuugugacuacugguaaauccuuaccuagagaggccagaccgagauucaugagcauguuccugcagacuuacaugccugcucaucacugauuuagugaguggguaaaggcauacacugggaauguuuauuacaguggucaguggcuaguguuaguuaccagcucuacaguugaaucaucuggaagacaguuucagggcgugccugugggacaucuugacuguguugauugaacugaggauaccugcccaccguguauagcaccauucccugcugggacccgggcuguggaagggcagagugcuugcuucugacuguggacacagugugaccagcugcuugauuccugcuguuccgacuuccccgccaugagcggcuaccuugaguugcgagcuaaaaugaauccuuuauuccuuaagucacuuuugucaaugcauuuuauuccagcaauaggaaaacaaacaaacaaacaaaagcaaacacuuaagacacacagaagagacccaugucaaaacaucagccaaaagucaauagccaccgccuggggcagcugcagcugcagaacuuccuugucccgaguuguaugugguacacuccugcuauggaugugagcugacggggagauagaguggagugugagcugugaaggcuuuagcaucucagccuccagguuagaucgcuuucuuguuuggugugccagccuccccauuaccaaguggggcugcuccccugcucugucagcccucagcagcugugacacauugcuucccagaagccaggacaaaugucagucauaucuuggagaaagccagauacuuuaaugaaugauacuucaaaguguuuauuuuauuuuuaucauuuauaauuacuuagauugcuugcuucuggaaauuuaaauaacuuccauuucucagccucauucaagaaaaaacuggccagagaaagcaacuuuucuugguuuaacugggaauauauauuuuaaaugauucuaauucauauuuuaaaauaucuuuuagaagggcuuucaaauuuggauugugauuuuuguuucaucaaccaacuagguacuuuaaaacucauugcugcucccguauauaaacacacucauuguuuuaguucuuaggggugaauugauucuuuaguaaauuugauaguucauaaccucauaaccuuuuauuuguagucuuuccuuuuuuaguugacugcuuuugauuuuagugaaucaaaauuucacauuucuucaaaaucucuucuaaagaaaacuucagaugcaacaagcgacaacccuucuucuuucuguaugaugaggguaaacaucaaucuacagcagucucuuaaauuaaaguuuugcuaucauagugaggaaaucagucuagauucuugcuuguggaguuuaagaauauauaguuguugcugguagauguacuagcucuccucuuucaauuuuguuuuaaguaacccaagaacuaucagauaucugaauucuuacuuuagaucauagaucaaauaaauaccucacuuucuaaaugagccaguacuuuuccauuugaucuuuucauagaaacacaauucagguaucauauaaaggcacucacugagaagcuagaguagacagcauguaacucugggaguaaaagaguaaagaauaugagcaaugucauacaggauaaaagcggagugaucaaacauucuaaaaccuagggacaagugcuauaguaccuaacucaggagguagaggcaggaggacuauaaggcuaaggccaggguggacgauguaacaagacuuugucuugaagaagcaagggcuagagcuguaguucaauggugcagugcuugcucaguguaugcaaggcccugucuauguucaguguuagcagccuccuccuuccagagucucuggaaguacucugcauccagauuauguggacagaaccgcuacauaaaagccaggcucaaacuaagcaugaggacagcagaagcacaacagugcaguuaaggcagagaaacagacaaguagaaauaugucauuuugauugcauuuuaaaguuaauggaagcuuuaacugcuaaacccccugaaacaccaaauuauagggaauauaaaauaaguauaaauuuauuuuaaccucaaggagauauguacaaaacuaugcuuguauugugaaaauuugaaaacuuuuaaaaucacuaaugguuggauaaacaguaaguaucuauggauaguaguuaaauaauauaaaugucauaguuaaaaaauauauauauacagaggcuuuccugagcuccuuuucucaaaacugugacaagcaccuaccagaagcagcuuccuagaggucuguuuauauuggcucacaaugcagagagaauacaguccuucauuuggggaagcauagaaaagagagcagcuuguuguguggagccaaucagaaguaaagggggagcuuauaauccugagucuaccucaaugacacuuuaccuguaguucuuauguccagaagguuccacagccuccucaaaacagugccaacagcugaggaaccaauguugaagcacaugggccugcaggggacauuucacagucaaaauacaggccuaaaauagagaauaugaacuauuuauaacuguuguguuaaaauagcagcucacaucugaacacagcaccccaggccaaagcaguuuaacguguaagagguuuauugggagagagggggggaggcggcagcaguaaaagaagggggaaagacagagaaagggaggggcauucuccauauuuauauggaaaaugacguaacacagguaaaggugggaggugagacaaguggauucugggaauauggugccuguugucuuggcagcaggucugcaggucacgcuuucgccuaugugaugucauagguuugggaggccccaaugccaacaauaacuaugguacugaaaguuacaaagaaagucauguaacuacacagagcacauuguguaaacaagugggauuacaccaggguucaugaugaggugagucuucuguuagacuuugcuuuccacggguucaguugcucauggccaacagucuaucuaaagccaugguucucaaccuucauaaugcuacggcccuuuaauacagucuaucauguugugguggucccuaaccauaauauuauuucuauugcuacaucguaacuauaauuuugcuacuguuaugaaucauaaaauaaauaucuguguuuuccaacagucuugggugacuccucccaaaaguggcugugacccauugguugagaauuguuggucuaaacauuaaguugggauuccagaagaacaucacaaaauguaaagugugcaccauucugagcaugaagacaucuuguugugucaccuagagcaugaguuaacccuaccauauguuacauuuuauucuacccaccacuuaguugcucuguagccauuuuggcugucagaugaaccuucucuucccuguuauuucuagauagagcucaguacuguuagcauuuucaggccuccucuaggcauuuggaauguauucuauacagaaaaggggaccucagcaacguacugccauccuuagauuugaagcagaauaaaaugugacuuuauuuuaaaaaaagaaaauaauuaauaaguaguuggauauuuugucuuagauuauggaaaagguuaauuagaaaauacuucauuguauaaugaaugaaugaauaauauugagcaaugcauuaauaugucaggaaauuggaguaagaccaucaagauuuuuuucuaaggcauagagugacaauuacuaagaaauuaguaaaauugaaaacauuuaaaauccacagccaaguuuugggagcauugugacuauuccuggcguaucuauaacagagaaucuauuccagugcaguccagcuugauaagccggugaauugauagggccacuuaccgggucacguuuauucaaaggcagcgcuguccuggagaaggcugccucuuccugggugagggugcacaaaugcugcauccccacagccccuucuucagcugacaggccacucagcccaugaaggaggggacuugggaaugugguaacuaacaccuugagccuccccacccuugaaugucucaucggcaucuucauguucugagccgucacugggagaagcgguucaaugcagaggaaaaggcagugcagcaugaguauugcugcuucaaugcagaggaaaaggcagugcagcaugaguauugcugcugcaaugcagaggaaaaggcagugcagcaugaguauugcugcugcaaugcagaggaaaaggcagugcagcaugaguauugcugcugcaaugcagaggaaaaggcagugcagcaugaguauugcugcugcagaagaggcacugcaacugagaagugucugauguggcuaaccacagaaaacgacaggcagauauucauauugcagcauacuacuguguacauguuuucauuuuugcaaauaaacaguugugugcugaaaauguaauugagugcuauuuacguuuaucacgcucaaagcagcggcuuuuugaaaauauagauaauucaaguacaacuagaauguuugaguagucugguaaucauuuuggcaaacauaaauacaaaagaaaaggcaaagaccaaaccuugaaauaacccaccaaagaugaucaucccagucauuuuaaaacacuuuuuaaauuauaaauggaaaaauuaaugcuuauuucugaaauguaacuuuuuacaauauggagaauaaugcaugguagauguauaauggugguggcaugaugaaaaucguuacuuucauucuauucuaaaauuauaaaaagaaaaguauguaaaugguguaauacagucacaaaguagacaugcuacuaguccauggaaguagcauaugggcaguccucagagcugucucuuuuucauuacccugcccucuacaggggggaaaguuuuggaucucugcuuucuuucaugauccucuuacuuaagacaauuuugccuauuuuuauguacuuuauaagugaggauggauugugaacaugaggaguaaagaaaagaugcuuauguuccaucaaggcuuuuauuaagaauaaagcauaggacucuaaaaggaaaucugaagccuuuucagaggcucugaacacaguuaaauaggcuucccauggagagaugcuucauauggaggcauguaucacacagagacacacacuucccauggagagaugcuucauauggaggcauguaucacacagagacacacacuucccauggagagaugcuucauauggaggcauguaucacacagagacacacacuucccauggagagaugcuucauauggaggcauguaucacacagagacacacacuucccauggagagaugcuucauauggaggcauguaucacacagagacacacacuucccauggagagaugcuucauauggaggcauguaucacacagagacacacacuucccauggagagauguuuuacauggaggcauguaucacacagagacacacacuucccauggagagaugcuucauauggaggcauguaucacacagagacacacacuucccauggagagaugcuucauauggaggcauguaucacacagagacacacacuucccauggagagaugcuucauauggaggcauguaucacacagagacacacacuucccauggagagauguuuuacauggaggcauguaucacacagagacacacacuucccauggagagauguuuuacauggaggcauguaucacacagagacacacacuucccauggagagaugcuucacauggaggcauguaucacacagacacacacacuucccauggagagauguuucacauggaggcauguaucacacagagacacacacuucccauggagagaugcuucauauggaggcauguaucacacagagacacgcuucccauggagagaugcuucacauggaggcauguaucacacagagacacacacuucccauggagagaugcuucacauggaggcauguaucacacagagacacacacuucccauggagagauguuucacauggaggcauguaucacacagagacacacacuucccauggagagaugcuucauauggaggcauguaucacacagagacacacacuucccauggagagaugcuucauauggaggcauguaucacacagagacacacuucccauggagagaugcuucauauggaggcauguaucacacagagacacacacuucccauggagagaugacuucucauacagugacaugcugcauguggagagauacuucccauggaaaaaugcacugugccucugucacguaaggaugcacuugcuagucguaugcagucuuuaggagacugagcuuugcucugugcuaacguuuuuuguuuuuguuuuuguuuuuuuagaaugaauguugacauuucuuuaagugcuucuccaccauuggagauuccuauguugugaauucucuguuuagcucuauaccccauuuuuugauugggcuguuuacuuuuuuggaggucaccuucuugaguucuuuauauauuuuggauauuagcccccuaucggaugugggguuagugaagauuuuauuccaaucuguagguugccgaauugucucauugacuauguacuuugcuuuccaguuucaugaggucccauuuaucaauuuuugauuuuagagcaugaaccauuggaguucuguuuaggaaauuuccuccugugccaaugaguucaaggcuuuuucccacuuucucuuuuauuagauucaguguaucugguuuuauguugauguccuugaucuacuuguacuugagcuuugugcaaggugacaaauaggaaucuauuuucauuuuccuacauacagacugccaguuagaccaguaccacuuauugaaggugcuuucuuuuuuccuuugaauauuuuuguuuucuuugucaaagaucaaguguccauaaguguaugguuuuauuucugggucugcaauucuauuccacugaucaaccuguccgucucuguucuaauaccaugcaguuuuuaucacuauugcucuguaguacagcuuaagaucagggauggugauucuccaagaaguucuuuuauuguugagguccuuagugaucagggaaaugcaaaucaaaaugacccagauuccaccucacauagaucaggauaucuaagaucaaaaacucaggugacaacauauauuggugaggauauggagaaagaggaacacuccuccauugcuggugggauugcaaacugguauaaccacucugaaaaucaaucuggaguuuccuuagaaaauuggaaauugaucuaccugaagaccaagcuguaccacucuugggaauauaccccaaagaugccccaccaugccacaggggcacuuguuccacuaugcucauagugaccuuauuuguaauagccagaaguuggaaacaacccagaugucacacaacagaaaaauggauacagaaaaugugguuuauuuacacaauggaguacuauucagcuauuuaaaaaggaggauaucaugaguuuuacaggcaaagggaaguaaaaaguauuauccuuagugagguuacucagacccaaaaggacauguaugguauauacucacuaauaaguguauauuagccaaaaaaaguacagaaugcccaggauaaauuccauagaacuuaauauuaaguuaauaagcugacgggcccaagugaggaugccucaaucccauuugggaggggugaggggggaaccucuagaaugcacuagagacuugggaggugagagacucucaggacucaaaggggggggggaaccuuagaugaacugcucaacaguggggagaggaaacuuguagaacucaccuccaguagaaagacagggcaucaaguggagggaugggguugccaucccacagucaaaacucugacccagaauuguuccugcuuaaaagaacugugggaauaaaaaugguuaagagacugagggaaagucaguccagugacaagcccaacuugagauccaucucaaggggaggcuccaaggccugacacuauuaaugaugucguggugugauuacagauaggagccuagcauggcugucuacugagaggcccaacaggcagcugacugagacagguguagauauucacacccaacuaaugaacagaaguugggaccuacgugguugaauuagggagaggcugaaagaaguugaggaggagggugaccucauagaaggaccaguacucucaacuaauccagaccucugagaucucucagacacugagccaccaaccagggagcaugcacuagcuggucugaggucccugacacauguacagcagaggacggccugcucuggccucacugagagaagcaccuaacccuggagagacuugaggccccagggagugaggaugccuggcagggguuguaggguggaggggugaggacauucucuuggagacagggaaaggaggaauagaaugaggaaccuugggagggcagaccaggagaggggcaaugacuggacuauaaaaaguaaaaguaauuugaaaaaaaagaauaaaaagauauagacuggcaaauuuaguuagaaaccaugaucaguccuaguuaggauuaauacuacaaugacuaaacaccaugucuaaaagaacuuggaaaggaaaguguuuauuugccuuauacuuccuuaucucuguuuaucaauaaaggaaaucaggauagaaacucaaacagggaagcaaccuggaggcaggagcugacacagaggacgcggaggagagcugcuuacuggcuugcuccuuagggccugcucaggcugcuuccuuauacaacacaggaccagcaaaccagggguaucuaacucagugauuucagccuugauuuugauuauguccugucuucuacuccucuuugguauacuugcuacuuuuuauucuagagauucagguguacuuuuaaauugcugauaugagaacuuucuaauuucuuuaugauguugcuuagugcuaugaacuuuccucuuagcacugcuuuccuugugucccauaaauuuugguauguugugccuucauuuucauugaauucuacaaagucuuuaauuucuuucuuuauuucuucccugacccagagaucuuugaguagaguguuggucaauuucuaccagugucuauguuuuccaguauuucuguuguuuuugaaguccaguuuuaauucaugguguucugauaggauacauuguguuauuucaauuuuuuuuuuuuuauaucuguugaggcuugcuuugugaccuaauaccuggucaguuuuggaggaggacccaugaaguacugagaggaaaguuuuaagaugucuauugcuaguagauuggaggggagcauugucauacacuguaaauauuauuuuuucccuguaguauuuuuaauggauuaaugcaguuucugcaagguaugucccaguaaauuggauugaucugcucuugagauacuguuggaugucuuagcuucuugguagggcuugggucacacauagaaacugaagaugcguuuuuuucuuaugugaaauggagacaccucuucuuagcucaccacuuucuucaaagaaaaaaagcauaugccccauuugggggacaauaagugugauucagagacuguuuggacaggcuauggcccuuuuaguaacaaggauccagggagagacuauauaaaacuuggcaugcuaugggaugaaaauauaguuuuaauauguaacuugcguaaaguccucaaaauggaggcuugguacuuguugguuguauccagcacuuggauuuaguuuuguagguguagaacaauacacuguccucuggaauuuucugcaaugggaagauaauauuuucucugugucuuccaauacagucauauauguuuuucaaagccuugauauguguuacuaugccugagagaacaaauuuuauuuuacuuaauuuucagugauauaaucuugauguuuucauuauaacccuauucuuuucaauggcugagccauuacucuggccuacuaauauaauuuguauagucauuugugggcagugcaucauucaucagagaaagaaaaaguuguaggccacacucacccguggagauauauuuuaagccagucaucacagaugguaguuaauggacaguuuagcuuauacuugccaagaguaaagucgauauagaauuuuguguaauggcagaucagaacagaagaugacaacuugaggaguugcuuauccccagaauuauaugaugcugacauucagaauuuggcucagcuugguagccaugcucugcucugugcuuuuccagggcagacuuccucuuucuuuucauuugccuugcuaacucugcacucacaugauacuguaagucugcucuuacuucugcuaugguucucucccaugggcuucaguuuguucucuugggagauggguccuguccucagugacuguuuucuugacuaauaugucagaacucuuagagcuagaugaguuuucuuagacgaccuaucaaaauguuauguggugauguagggauccagaugugaaagguuucuauagccagaauacugaggaauuugucccagaaaucagucaggauguagccuuuguacaguaugcagguuuuguugugcccugaucuuuccuuaaugacugugagacacuguccuguugaagguucagcauucgguuuugugaauuucccuuuaucaucaaggaagcaaaugggauaauuuuaaauuguacugugugcuuuuguuguuaacugcuguggacucacuuuccuucuuauggcuugcugcuauagagcuuuguagaagguacaugaaagcuguagcuauuuaggaaucagaaaaagauauugucugaugcugacaguggucacucagcuuuggcuuuauuagaaaacuccaguaugaauauuuuaguaaauaaacaacuggcuauguagaaauuugaaaugcacuuguuauauuuaauuuuuagaaaguguaucaaaagugagauauucuuaaauuuaaaguuauuuaaaauuauggauuacaaaauuaauuaacauaauauaaacuauccuuaaagaaauauuaaucauaaacuauaaaugaaauguugaucuguuuagucacuagggaacaaacagauuggugaaacaaacuaaaacaagcaaaaauggauuuauaugcugacuuccaguucuacuuuuuuauuauuguuguucuuuuaauagauguucacagggaaagaaaauaaggguauaaaggaaguaaaccagaugaaaagauucugagaaguaauauuucccuaugcugcaagucugugaaggaaagccuguggacauuguggcuuucugaguucaugcugaauguagaaacauagcucuguuugguuuauguuuuugaaauguuaacauuuucauuucagaaaaaguaugccuuaauucaugaagcugauaaaucaugucaugucaguuuuacaaagagcaaagacaccugaucauuaauauguuuuccuaaagugguacaugccauguuuuguuuguuuuuaauagaguccugugaagauaaaccaaauuagcuuggaugacaguggagaacacaugggaguguguucagaggauggcaagguauguggggaguggucauguggcggguugcuuggguagugagugcuaggcuuuggccucacgagugauuggauguucucugcuuacuuuacaccugugugcagagagccaugauuacucuuuuucaguauuggacuugcuuuugauugcucauaauuaaaauaaaauauauuuugcucaaaugugccuuaggaaaaguaauuacaagaaugucaauaaucuaacuaguauuaagcugauuaacagcuguggcagggugacauguuccccuuaaucauuacugcugugccacuuugacuucggugacuagucugcaguuccuucaagacaguaguuuaaugcuuuucucccauaaauccacaaaauuggauuuugugggcaugauuucugugggcuggugguuuucauuuuaacacacaaguuaugaauguuacucuugaauuauagaaucuuuugauaagcaaucauaguuuaucagaagaauaaaguauccuacaauggccacauuaaauaaauguaaaaucaauauauguacaguuuucuaaaaaccugguaccuacuuccugaaccaaagacauacaucauuugugcaguguacagcuaacaacuaucagugcuucuugcugauggugugcugugacauuuaguggcugugaugauugauuuucuacuugcaagaauaucuucuuuguuuuuaagucgauggaagucuuuucuaauguuggcaugcagugauaaaaauccugaugcagaguguucgagccacuucucuaaaauaacugauuaagaagaguauucauuaaaaaucaucauauaaguuuauacauuucuuagagaauagagauuucuuaauucaauuuuauacaguuuaaguucucugaauccaaugggccauuaagugaguaaauuaacaaaaauauacucagugcagaagagauuauucccauuucuaucuaucaacaguuauguagacgccaacacccauuaaucuguuaacaagagcaacacaaaagccucaacucaccccaaaagucuuuugaaacacaauuaggauguuauuacuuuuaccuugugaaauuuugagaugaacacgugugugcauaugugugugugugugcauaugugugugcaugugcgugugugugaguggggauaauuguguggaauuugaaaagaaucaucuauggugcucaaacaucuuugugcauauuaacuuuauaaagaaaguuaauguuaguuuucuuuacucaaaggccaaucauuauuuuuguacuuacagcagauaacaguuuccuuaaacuaacuggcaaguaagaauauuaagcuuuuuuuuuauuggaaauauuaguuagggauuucaguccuuugacuguucaagaauuauuagugaugugucaaaguggaaucuuugacuuccuccaucugcugcgcaguguggcagccugagaguucccauugccuuuuagcagacacugugcuuuccuggcuuagaaaaguguacaucugucuuguuuuuguaauucuaugauguauuuuaaaguguuuuuuauuaccuuuuauuaucauuaauagaucuguauagaaaucucccaguaccuguauuuauguaggucagcccugaccagaagccaguguugugaaaauugagagguuguauaaacugcuguacaaagugauuaguuaucuuaaaaacagaaggugcucuucaaggucaacuuugucuuugaguggcuauuauggguuuugcuuucauuggcuuaauaagacucauauucagacaguuuauuuauuucacugcuaaucuuugauacuugcauugguuuuuauagucaucauucugacaguugagguuuacucagguucuuucucaugacuucccagugcucagcuugugagguaggagguguacagagugguuuuguugguagguucauucuggugccaugaguuuguagacgacuuucaggauaugguuuauuuucucaucugugaaggaugccuucaugcagaguauacaaacaaauuccgaguugauagguuuucucccagauuuuagaaagagugcccucuuuauucugacacuuuguagcauacuuguugucagccuacuuuugcuuuuuaagaaaccuuuaaaacuaacucuuguccuucauaaguuugagucuaauaauaacaaaaccaaaaguaauaaagaugaccuuuuaauuugguugcuguguuacaucuaguucuuaucuguugucauuaauuucaucuggaacacacuuacuccuuuuuauccauauauuaaaguauuguuuucauuucagaaaaguuugcuuuaguuauaauuuugauuauuacuucaguucuauuuguuuuuauuucuuccaagaaauucaauaauaugagacuggaggcaguguuggcuuagaggcagaguguagcuguguuccagaugccugggccacaucccacuugcugccuuaaugguaguguauuuucuagucucucugguaucuucucugucuuggauggauugcgugcacaaagagaagcccacaggaaacgugugaauccuggcucuaauguauauuaguuaucuuuauuuccagacuuucuuuucuacuccauugcagugugaacucuuccacguuccauuauucuacccaaacuuucauuuagguagcaggauaaauggauguccacuauuuuaaaaaugcauaacuucuaagaaaaauuggauguauugacucacucuuggcauacuuguuuuacuaucacauuggucuugugcuucuguuucucugaggagggcaagcaacuucuuuauuuguuuaauuggcuuuucuuccaacauuauuuucuucuuuuuagauguggaugcauuugccauuucgcaguuuuaguuuuucucuggguaucaggcaguaugaucuagggauucaguuuugaauuacacugcuguauuuuuguggguuguuaagugagccuguuuucucccgucugagccucagguuugucuccucuguaaguugggauaauuauaacuaguccugacuacugugaggacucagugaauuagcuucagccacuugggguagucccugguaaagaacacccaugugguaguuguuaacuguccuuuuaauuguagucaccaucacucuccacaucacacucugcuguagcuucaaagauguguuuccucuuuuugaaguuuccaaauagccuuuggguuuccuuugacuccugugcuguuaagacauguuuaaaugugguuuuguuuuuuuguuuuguuuuguuuugguuuuguuuuguuuucucccuuugagucuuuggaaugguguucuacaaauuuuaaggcaucaaguauauuucuggguuuuuguuuguuuguuuuuguuuuaauuuauccuagcuagaaacauguuagcaaauagagucagggccuggcaaacccuugaaagaccugacuugauauuuuugaaguuguaguagcuacuuucuguuucugugauaaacugugaccaaaacuaacuuggacagaaaagcauuuguuuggcugugucggaguccaucauuaagggaacucagaucaggaaccuugagguaagaacugaaggagagaccauggagaacacuucuugcuucccagcuuguuccucguggcuuucucagcuuguuuucuuguacaacccagguccaccugcccagggcuaacacugucuacgugcuauagaccaucucauaucaauaaucagucucuugaauuccuugcugacaugcccacaggccacugauggaggcagcuccucacuugagguuuucucuuucuaggugacuccuguuugugucuaguugacuguaagcagcauggagguauuauagaaucacuuucuuauauccaaagaaaggcucucagaugaacuagauguuugacugaggaguuuggugaagcgcuucucuuucuaucacuucuagucccagguguucugcauuggcaaacaggauggacagcaguaaucucuccuuuuccuccccaagacagaugaagugccagcccacaagagugcccuuggccugccuccuggccuguuuuugucuggaagcugggagggugguacagugcuuuggcuaccuuagucauaguuucuggguauguggcgggcuacugccuggugguacaguugacaaauugguagaauuucaugcuaaucacaugccuucccaucuuauucauaaggguagauaaggcauguguguaucucugugaaacucauguggcucucuggguguuuaguucaugggaacuuuucaggagaauggcuguaggccacuuguuggaaauucuuauuuguucaucauccauucauauucauacucauuuuucucuguaugucuuacucuguuucucugccucccucucucaggcucuuucucucucucucucucucucucucacccccacgccaaccucaacuucaacacuagaaguuuuuguggcagguuguuagaacugcuguggcgaauaucauugucaaagaaaacucucuguggugaccuuuaauuuuuaugaucuuuaucucaaccuugaucuuuauagaagucaauacucuaggcuaucauugacuggauucccuuuauagauuaguauaaucuucagugaccaguaaccaaauaaauacagaauauggagaagagaaguggaacugcuguguuaauucaguaguguaccuugugagugcgcagcuuaggacaugacaugacugaagugaagcauuguccauaguuuuccagaagacuguaggacugccacugacaccguugagacaucaccuaugaggguacgggauuuccggucuuccugugugcucagcuaagcuuacuguuaaugaucaugcacgugguguggugguggugucaucuuguuuuuaagaaagggucucauuuguagcucaggcuggccuggaacuugagauucuccugccucagccuuccaaguacuagcguuacagguguguggccagcuuuaccugaggucucagcuugcuccucccucaguggugucucuuucaguguucuuuaacauaagaaggcacuuaacuucugaggauugucggggacaacccugaaggccagugccuguuucguaggagcuugcuuggcuuuguguuugucacaucuaggcuucaguaaguaaguaggcuuccguaagcaugcggcgcuggucuucaggaggucauucauggcucacccaacuucuaaaugguacuuaucucuauucugaugaauacccuguuuccuuuauuucuccucucaugaaagcucucuuaauucaggcacagauuuuuuuccuccacaguuugacaaccagcuuuccaauguuguuauacuauuuugcucuuuuuggcguucaugugaaaacaugcuugccuuauuugcguauuuucuauugucuggcaugauguuuuccuacaggagcuuugguacacuuggauucuggucacaucgauugauuuugaugaucauaggcaggucuuuagguuaucagcagaaucauccuuugaacaagcacauugguguggacuuuagcauccuuagcagcaggauagagcaagauuuucaacccacauuggguauuaucuguugugaccauuacagauaucacuucaacccaccagaaagagauguaguuugucuaaggugagccgacuguuaguccucagggaucuaacugcuuaucaucagaggugaggccuguuaugggguuagaguuguuaaugaguuguaguagugucugacccgagacuguguuguaaagauguugugcugggaagaaaguagauggaauugggagcuaguuguguaggcauuaacacugagcacaucacuaugggcccaugcugauuuccuccauuaccagucagugauacagggccugccuuacuguguggaaauugcuugucuccaucgauccucccaucguccaguaaaggccugacugagugcaguguuugcugagugcaguguuugcugagugcaguguuugcugagugcagugcuugacuguucugcuucagaaacaucaguuucaggaauuuauaaaaaggaagagauuucauacccucccagcagugagagccacagcagcuguggcgugugcuggccaugccugggauccauuuagaaagaauuccacauuaugucaugcucgaauaguucuagacaguuagcagaaagaacagcaaagauuugcuuauuugagucaaggucugugaauguagccacagacuggccucaaaugaacaauucuccuauuucauccuccugcuuguuggauuauaagcauagguguauugaccauaccuggcugaaagguuuuauuuucuaaugggugaauuugucuauugagagaauucucugcuugaagcuugggugaacgaaucauucauucacaacuuaugaacauuaaaacaagaaaaacauugaguucacauagucuuuuuuugaguacaaaaaaugaguuuguuauuuaaaauauuacacagaagucucauuagccuguguugauguaauaaaaugcuauuagacugggcaguuuuuuaacaagggaacauuauuucugacaacugugaacaugaggauccuggguucaguguuuggggaggaauguccucccugcucccagaggacacugccacaguccucccugguuugaaggaugcauuugucuccuuagugucugaaagcaggaagacaaaugugccuacuuagcuuucuuuauucccuuuauacugguacugguguaucauucuugagggaacauccugcaggaggccaucccccauaauaccauuacuuuggacauuggauuucaacaggaaaaucugagggagacagacauucagaccaagagcauauaugcacauggccucagggugaauuucuacauaaguaaagaaguucuagagaccagaaagaacguaaacccaucucaagugcuggagucaucaauaaggguccuaacaccaccuuuaguucuguuucugugguaacucuuacacuugccauacucuccugguaagacuaggaauuaauuagaaccaaacuguuggggcuggagagucagcuuagugguuaagcgcuguugcucuugcagaggauuggguuuaccgccuaguaacucuguaacucuagcucccagcagaucugauaaccugucuucuggcuuuuuccggcaucaggcaacaaccaugugaugcauguacauacauucaaccaaaacacucauaaacauuuuuuaaaaaucauaaauaaaugaaacaagucuauuaaauauuuuuguccauuaauaugaacauaauucuagccugugaguuaauauucccaccccuuguuauaugggccucacacauguguguaaguuaaucaggagauuaggaaaggaugucugcagaagcacugcaaacaaaguucugaucuggugccaaagcaacuggcugucaguggaaggagaacaugaauugugacaaagucacacauugucaaccucacagcagcgacagagagccagccgcugcagcauacagaaagcucacaggggcacugcugagaagggcagcgguggccuggcauguguuuccauuugugugagacuuaaauggcaggguggcuugugauagguggugguaggauucaggguaucguucucugagaaguacaguagaggagcuccuugggugggguucaggauaucguucacugcgagagcuccuuggacuugguuucuuuuuguuuuccuucuuuccuuccuccuuugcucccgcucucuccuuccagucagucagucagucagucagucucucucucucucucucucucucucuuucucucucucucucucuccuccuucccccaaccccccuuuucuugcuuucucgaucuuucuuggcuuuuuccuaggcuggacucaguccuggcccugccucugaguaagagaaucacacugacagcugcuuaaauucuccuuuaucugggugagaguugaagagucagguuuaugucacaaauugugucaagcuaagaauauucuucguauccuuuuauguucuacacauuagaccuaauuauguuuuuguuguauuucugcugugagugauugaaaagcuggggagauauaacugaauaaaauagcuuuagauaacuugaaaguaaauacugaugcagggcaacuguagccuuucauuuaccacagaauagauucugcauaagacuggaaugggucucauuuagauuauucucuggccacaucgauguguauguguguguacauucauguaugugaaugcauguguauauauguguguucauguuuguaugugugcauacauguuuguaugugugugugucuguaaagcuuauacgucugacucaagguaguuccuuucugcaugggggggggggggaaacaguucuauuagccugugagaaguucauaaaagaauguuagcaacuugcccauaucuauuucauuucugaaaguugguaucuguuuaauaaaucugcagaagguagagagaacaaagccuuuuuauuuucauuuuaaauauuaaaauauaauuacacuauuuuccauguuccuccuuccaucuucuccauauccccuuccuaugugccuaauucuuuaagaugcuuguaaaggcuucauugauacagagcucuacacugaugggauugguuugcacuggguacuucacggggcucccgggaacuuaagacucguuggaaugucucccaguucuuuugcuuucauuccuuuucuuugcugacucagcccucucugucauggucaugaugaacugauauucucuguuuacuucuuagcugcaggucuuugggcuguauucuggagaagaauuucacgagacuuuugacugucccauuaaaguaaguauuuagcaagcuuucccucaugaaagaguuuucucccuagaugaggauggcacugcucaggugucuguuaaguccauggugugcugcugccacuuggauguggagacugagaccagaugcagaguugugacuuuggucucauucugugcucugagagcuuuuauuugagucgauuaaaucucucucucucucucucaccccccccccccacacacagacacacacacacacuuccuguucugacuaagaugauagagucaaaaccagucauaauaaacaauaauucugagguaaaagaaaucaugauuagcugauuuuuguuggugguguguuuuguuuuggagugguggcuuuauagacugaguaauaucugacugagcuuugauacagaggcagggauagauacgaacuggccuuccaugugggaaagcaugggagaaauggagaggccagaaaguuccagcuguguccaguaaguggcaggaugucuugcuuagaugugcauggagacaaaagaggcaaugaaaggccgacuagcauaggccgcauuuucagacuaaggaacuuagcuuccaucugacgggucagugacucugcaguagagauggcagaucuguggguaggacacagggaugagcuggggauaucuauugugguagaguaucugcuguacucucaaaggaggugguuuucuucccggguuuauucaaauauugauugaacagucguaacggguagauaagaucugacacguguuuuagaaagcugacuuugcgagagaggaaggggauuuaagcaggagagucucugggcgagagacaauuuagaaggcugauguaguguacugaacaaagcacuaaggagcuuaguaaagggagcaagcuugaguguucaagauggggaaauggauugagacaguuuucaagagguagacguuguagccuuaguaacagugggcugacugacauuaaagaugaaggugcagagaguaaaucccguguucugcugcaggaaaucuccccaauuguauuagguaaucauuugggugaaggcauugggaaguuggucagaaauuuugagagcugggcugcaucuggugguuuuacagaaaguuuaggauuaaguguuggccuacuugguagagauugucccuuaaaacacaguugguuauuugaggugaguugagaagaaaccauuuuuaaggauauuggccacuucacagcuacagggugaaaaaaaaaagauugauguugauaugcuguagcucucaaaggacugcagugaacauaaaaauagccacuagccugagagguaguucuuaggaagccugggaaaaaugcagguuggcaauuggcgcaucaagaagagagugagagauggcagugcuguuaaaggcagccugcaggcagagcaguguccaguguuucaggccggcgucugggagcuucccgauagccuuagugagggcagcugccccagugaggcccaaaagauggagucaguagcaccaggaaagauucuucuuucaagacauuugcucaaaaaaacaaaacaaaacgaugucacucagaugauacaaggaaggccagugugcagacauaauguccauagacuauguuuugguuaauggaagaauggguagagagugaagaccgaaggaaauaguacuuggcagagcagcacugagcagugagguuggcaccuuugggagggagggucugaguccuucccaugagugagccaggcacugggagggaggcucagcccagcugaugcaggcucagagaagcagccagugcaccaaugcuccugacuuaccuuucugagucuaugugggauggagguaaggcauuuuuaaagagggaugcucauuauauguugugagagaguuugcaaggcucuuagagaguguaagacuuuggagggaucuaaugugugguucuguguugguaauuaggauggguuagggcagagcugaagagaacauuguacuaacaauguaucacaaaaaugauagaaugucuauuaaauuguccugacaauggcaguguagagaaauuauuaaccuguccaguuggaggaaggaaauauauuaguuaauuauagaaauguaaaauauauucaagugaauguuugggaaguuucugauuucauggauaguuggggaugaaaagguaaagaagggagacgcuccuguacaaagagccgggucucaagggagcuaggcugacuggagcucuggacuucacggcuuuuccuuccucacccaccuuguguucaugguguuagguaacauagagccaccagcaggagcagugcggagcagcccuggagagaccugcucauggcuggguucucuuguguacuuaguuacaaaugguugagacauggcaacuuccuuggucccuacaugacuuuaggaggggagucugcucagugagccccauuuagacagaagugagaagcccuucauucucguguagccuugacuuugcuucagagaagauacuuuaucacacaggagcaucuucaucagccucagcgccuucccggaacucgauauccugccaagguccggguucuagaucaugcugcccauaauggacaagagacugucauauacuuucaucugcgacuuuuaaaccuggcuuggguacuuuuucuuuuguagaucauugcugugcacccacaguucgugagauccaguuguaagcaguuugugacuggcgggaaaaagguaaagcugugugucucucccagaauguguggccugugacaaaugaugauguaaugaaacugagacuuugaucuccaggguacuugcagccugaguuagccaccuccuuugaaguaggggacagcugacaugugaaaagaauggccuuuccacagaaaggaggcagcauuuaaaugcaacaaaaagucauuagauuagggauuccugcucuugcuugggacaaaccuccugugggcugagguagggagaggaggguuacugcugcuccucagugccguguucaugucacacuguaggauuucugugcuaaucaaaacaggaagcgaaaccuccccaacaucuuucuguuuauagaaauaaaucccaaaauuaaagaaucauggugauugucaguuguuuucuauuuuauuagccacagucuuaaaauaucauuuuuaaaacaaacacuaucacguacuagaaaugacaauauuacuuuguauauagccauuaagaaagagguggucugaguuacuuagguagugaagcagcugugaguugacagcuuugaggcccacuuuccaaagcauccagaauauuuauggugugaguuacccgugcccuccugcucugguaugacauggagugagguggcaggauagagaacugcacaucccucuucguucucaagccaugugcagacccggggacccauucugugguacagaguggaggucacaagaauucugguuucuucuaagcaguuccccuuccuucuccuguccuguaguguuguuaguaaugggaaucauaggcuuaauuugaccguccuugccuuacacaauuaacuaccuucguugugauugucaaauuugagaaacaacuuuaaaaccccucuuauuucauuauuaagcagauuuuggugaggagacuuuuuugcauaaaaucacugagcuuugauugugaccugugcauuccuuuagaacucagugaagaugaagauuuagugaucugcagccauuuaaaacaguacuuaagacagcuugcuuucauuaauaguuggauuuaaagaguagcccagagaugggugcuggaugagggucugggcaaguacucaacagcaacuuguguugcagcacagguucugcucuggaaacauucucucucgagcucucuuuaggggccauuauaaauucuccuacauguuaggagcuucaugaaacaugcauguguccuuuauacaguauugauuuguuuccuuguauucauugaguauauuauguaaauuuauacuucauaaauaguaaaauguuacauuguuuucauaaacucugaugacauauuuaguuaaaugguauuuucaaaauuuauugguuugguguaguuguagaacucuccagaacaucgcucucuucugugcacacaguguauacuguuaacgauugccugugccacaugguuuugcauuauuguguuuuguugaaauaguugcauuuauuugaagauauagucuuauguuuugauacaggguccuuagaauuagguauguagacuagauuggccuugaacuuaaauggagcagcugucugacucuaccucucacguacugugauugaaggcauguacuaccaugucgggguuauuaacuauaucuugccuuaaaaaauauuuuuuguguaugggugcuuuguuuaaauguuauuucuauguaccacucucauaucugggcuaagaaauauaucuuccuuuuuaaaaaauauuuuauguacauagguaucuugucugcauguguaucuguguaugacaugcuugccuggugccuucagaaccuagaagaaggcaucugauccauuggaaaaaagaguuacaaacuguauaaaccaccaugaggauguugagacucauacuuguguccucuggaaaaauagccaguauuccuaaccauugagccaucucuucaguaccuuauuuuuguuuuaaguaagaaaaggcauuuauagcugauauuaaguaguaauuauuaguuuuuaauuuauuguugauuucuugugaacaucacauucccauucaucuccccauccuuugguaucugugcucuacccuuacagccuaccacucaaaagaaaauaauaaagcaaaaaauauacaggacaaaacaacaacaacaacaacaacacauacacacacacucaucauggaagcuguagugugacccacaguauacccuuuuguccacccagcuuuacuuaaaaauguucauuauagugagucauuggucugguuugaggccucuggcuccugcuacacuaucuguacugaauccucaccaggacucgucucagauauccuguuguuucccugcaucagggagauccaucagauauggaucugcaggaccggucccuucaugugcuccauauugggauggaugaacucaaagcccuugauggaucugggccuggaugauaacugagcuaguccgccugcccacucucccauacccacaccuuaccagugagaacucuccagcacugcucuggcuagcucacccaaauacugcaggccagcaaggggaaaaaccagcacuccaaagcucauacccuugggucuggcuucccaaugcucccuacacucgggccagcucuauuguacugaccaggugagguggagagcacagugcccugagugcuacaaccagugagggcaggaccaagucaucugccauagguggcuagggguaaggaaguugggcugggaaauuacuuuuacuuaggcauccaugugcuugugucuggguaaaggcaagugcccacagaggccagaugucuugauagauacccuggaacuggaguuacaggcuccugaaacuggaacuacaugagauggaugccuuaaaccaaacucauccucugaaagagcaguuugugcucuuaacuccuaagucuuuuuagccuccuucauauaacuuuccuucugacacauuccuauguaucuaucuacccugucauccuguggcuucucugggcauuuggacuuacaacaguaucuuccccuccaguggccagaagcauuucugugguguccagugguacaagccuuagaucaucaucaucuguguucaucuuugcaaaugaaacugucucccaguccccucuuuaaaaucacagguugcucaaucaucacuccccagcuuucuugcuuuguauuucuucacaaugacuuuucaacagcuggcacgggucagcuuucccauucucccucacccgugucaccacacaaagccagccuagcucuccugcacuuggcgcagcucacuggcacuccccaccaccagggccagcuaugcugugccacccagugcaguagccugcaggaguugggcaagcuuuccagggugccacgccaguaagggguggggccagcucuacagagcccuuggucaucaacauggucccaggcagcaggccacaccagggauguccccaugaccuuuggugguaauaugagccacagacguugacauagaccccugaugcugcauagccacagacccagauacaucucucagauaugggccagggcuucaccauggccucaggcggcagggcaggcuacuuauaugagacuguuccuuucuauccucauauuuccauuucuccucucuuuauagugcacaaaccauucugcuucucuugcucucccauuucucuaccccauauuugcacaucauaguggcucugcuaugggcuggccaugcauuugugggcucugggugucuucugccugcuuguaccacauggcagcagcaggccucugaaguagugacuauugugagcaguuaauuucuucugguauauguuggccaacuuuuaagaguuauuaauugaguuauaaaaguuuauaaacguugaaaaaugaggaaagcaaagacugcauugguccaaaagcaauucuuauugcuuuaacuggaguuuuaaacuagcaccauaaauucacgcaacaaucugaagagucuagcauuuaguaauuauugauaaccuuauaauaaugguaugucaugggcaccaagagccuacugaauaguguaaaaagcagaugauguagaagaaaaggaacaaaaaaggcaaauacuguguaacugagagguuagaaucagaaauaacuugauauuucaaauaccuagagaagaacugcccagauggagguaugaugugcaacacagguguuuuaccauaagaacacugaucuguucuguaguccuuuacauugugagccaacuucuauaaacaggguugaaguggcccauaggcugggaacagggaaagcaggcaggaaagcaaaggccugcuauuaagauaugugggcuauucauaagaauaccgagacacuguauuuaauauuuuaguuguuuaagucuguuuuaaagauugauuuguuugucuacuuauuuuauauaugggcauuuugucugcacaccagaagagaguaucagguccaauauaaucgcaguuaaaagauuucgagccaccauguggaugcugggaauugaacucaggaccucuggaagaacagccuauuuucuuaacagcugagccaucuucccagcccccaguuguuuaaauacugugaagagacacauaccaugaccaagguuagggcugguguauaguuucagagguucaguccauuaucaucaugacagaaagcauggcagcgugcaaguagacauggugcuggaggaacuugaguucuacaucuggaucagcaggcagcaggaaucaaauggcuugagcuucugagaccucaaagcccacucccuaguuauggaccuccaacaaagggguaccggugcacagcacaccuccuagcagugccaccuccaugcaccuguggggggggggggguuaauucaagccacaacuauuaaaguuaauuucguaaaaugucccaaagcaauuaaaauuuucauuucagaguugugccacauaaauauaggagugugcaggaaauuccagagacugccauggcccugucucauucgccuuucaagguucuagcucuguaguuuggggagaccauggcuucuccguaguggacuaggaauaguaggccggagggguuuuguuuuuuuuuucuuuuuauguuuagaauuuuuuuugauucccaaggaaacaguauaauuaacaguggacucuacugcuugacacucgagcauaaaaagcauauuuagaauuaugguuuguuuccauguuaaaaaaaagaaagaaaacgaagaagaagcccaucuuccaaacguguuguccgaggggcucuaacacaggaaccaauggaauuuuacacaaggaggaacucugauaaaugagcauagccagggaguuuuggcuuuagaugaaaaacugcaguguccuguguggaugcucuguuuugcuuugcuuuguuuuguuuugguuugguuugguuugguuugauuugauuugauuugauuugauuauaauguauggcuuucuuugucagcaagauaagcuuaguuuuacauaaccuuuaccuucaacucuggacuacccuucacugcuagcugauuccacuccuuucacaguucauuguggcacuguuuguggugggguccacuguuaaaugugagguagucagcugcuugacauuauugguaaagggaagggaccugggugcggaggcagguugcuuuauaugcugaaaaaugucagucagcagacaggaaaaggaccuucugaaugaaaagaggacagccacuuuccuguucuagguuggagucuugugguagguuuuuguuugcuugucucuuuguuugggggcugugguugcauccuacccugccuguaggcuuccaguagugcuccaggauuuugacaaugcuagguacacuguuguguacagugcagagcucagcuguccuggauagcugugagcauuguacuggggugguccgggccaccuucuccaggcgugccgugucacacaguuuaccauuauacuuuucaucggagccuuuuugaagaauuaagaacacauguugaggauuuccuggucacgucaguauuaagccacaggauagugccaagguuauggacuaguggcuuugugcuaaacugcuaaaaaaguccccagucccauccugcuuugggaagcucuguucuaaguuguguuucuguuccuagaauuuagugcugucagcacaucaacacuguauaaacacaaacuaacaggaaguaagacacaaacggaaccuccacaaaccauguuucucagucauauaaaaccaauuugcaaauuaacucuguggcaacauauuuggguguaguuuucuguauauucuauacugguugaggcuaaaaauagaaucaguuccucaaacuagaaaucauuuacgucacaacauugacaucuucuuauucauuugugccaagugucaguugcuuuccuacuguuucucuguaggauucccaguccugggauggugucuacacugcauguggaaugugggaaggaucaugcuagcuucauuugcuguaugauccuguuuaaacaggcaaucgaaugcccguuaaagcuuuucugccagaaggucaauuuuuuaaauaaauucaauaaauuuaauuuuuuaaaaaaauuuccguaugagccgggcagugguggcgcacaccuuuaaucccagcacuuggaaggcagaggcaggaggauuucugaguuugaggccagccugaucuacagagugggcuccaggauagccaggccuacacagagaaacccugucuugaagaaaaaaaaaaaaaaagaaagaaaaaaaauccauauguaauauuucuuuuuugugguucauguucacauguauguguguaugcauguaauugugucuaaucauacauguggagaccagaggacaaccucaggugcuauuccucagcuguaguccacaccucucucccucucuccucucacuccccucucucucucucucucucucucucuccccucuuucucccucucucccucucuccaucuuucccucucucucucccucucucccucucuccaucuuucccucucucucucucccucucuccucucucccucucuuccucucucucucugucuccuguauuuuuuuuaaaaagauggucuuucacugaccugaacuaugaaauacuaaucaguuaacuaacuaguuaauuauuuaauucaaucuguguggaguaagaugaccagucauugagccucaagcagucagcccucccgugacuccccaguagugguacugaaagcauuugcuugccuuccuuuacauggguucuagggaucaaacucaggucuucaugcuuauaaggcaagcacuaugcagcccuuucuaugugucauguauguaauugaccauagcacuuccuugaauccuucucuuccuggagcaaucaagccucuuugcuuccuauuuacuguaucucucauugcauauuugaauaauaaaacugguggauugaugcucgucauguuuuccuguggggcuugauacagagggacuguuauuaauauucccucuuucccuuucuuuccaaguagggcugcauaaaauaagggauuacaggaacagccguuguuagguaguaucacucagacaaaccaaagugcucauuucaaggacuacuuagcucaaaucggcuuucugagcauauuccuuugcagagggucccagauaguguuauuagugucauugcaugcacacuacuauguugugacagugggugguuguuuucaaaagagugugggucaggcaguaguagucgaaugacauuaguaagauuauuaauuagccagaaugaugaucuggugagaaaauaaauauucugaaucauuugagaaagaaacuuguauacagguauuuuuauuuguauguauauauguaagaauguuuauggagaaaucugguaguguucuuuucuuuguuuuuaagcuuccaaacaauauuucucuuggauauuuuuuaacauugaagauugaaacauacuacauaccuagauggcugugugcccuuuaucucuagaucacuaggagaacugccauagguuuuaggaagaagaugucaaaagauaaucuuugaagauggagccaauuucaggaugugauuugcaggaggcaauuguuuguuuuagaaucuaggcuguauacgaggccagagugaucauguucuugaguagcuaaauaagccuuaucuaaaaggagggaggcuacaccaaggcucagugcaagaguaacgaagcaggaucagggccuuccaucuuagaugggaugagcuuguaauuauuuuuggaaaguguucauacagacaugcuuauggagucggcuuguuuuuaccaagauccuucacgcucacccaguggccuucuacacugcuggugcucuaugaaguuguuuguuuaucagcagaccaaggcuuaccugugagugacaagccaagcucuuaacagaucaaucuuucccuuugucaauggcuuuaauaaguggugugauaacaucugauaaauuguuuuuauugauguacuuuuuuaaaguguaugaaggguccccuggcauuguuuuagaaauauaauuauguguguagguauauucaagaagggcuauacaccaaaucauugauuaugguaugucugagcaagauuaugaacuuacuuucuggucgucuuuuugcuagacauauucauuuauuuuauagaucacaggcccucaugcuuguuagggaagcuccacccauugcccuccaccucuaguguacuaaugcuaucagcuguacaacuaggcuucacugcggcauuucuguaaaacauacauuguguuuugaaugugucuauccuccuuauuuauucuuacccauucuuuucuuccuuccuauuucucuauacuugcaucucuccucccacuccauucccuucccuuaguggacucucuucuacuuacaaguuguguuuuaaaaucugucuugcuuauuucacucagcauaaucuccaguuucauuuauugucuugcauauaacuuaucauuuuuugugauugaauaggauuccuuuaugcauuuaugccauaguuucuuuauacuucugucuuaggauuucuagugcuaugaagagacacuaugaucacagcaacucuuaugaagaaaauuauuuuauugggacuggcuuacaguucagaaguuuaguccccgucauccugagggaacauuguggaacucagacagauaugggacuguggagguggcugagaguucuguaucuaaaucaguagacagcaggaagaaagugugacacuggaccuagcuugagcaccuugagaccucaaagcccaucccuagagauacguuuuguccuacaaugccguaguacuccugcaaggucacacccacuaguauuaguaucacucccuaugaaccuggggggagggggcauuuuuuucaaaccaccacagcuuccaucuccuagugggcaccuagguuuacuucauaacuuaauuacuacaaauaauacuccaguaaacauggacgcacaaauaucucuguaguaugauuagauuuuuccauuuucuugaggaccaucccuaccaacuuucacagugacucaacucauucccguucucaccagcagugcauagggcuuuuucucccacauucucaucagcauuagaaauuguuugcuuugcuuguuuguuuguuugauaauagccaaucugauuggguuggaaaucucaaaguaugugagguuggcauuccuuucugaccaaaaaaauugaaaaguuuuucaucuauuuauuggccaucuguucuucucuugagauguauuuguucagauguuacuuuuuagcugggugauuaguuuucuccugauuaaguugugcuaauugucauauguucuagauagucauuaccgcugcuugguaacugucccugucuauaugccaucucuucacuugcucauuuucuuuguggugcugagucuagcaaucauugggcacaaguuuuugucuguuguuggaauuauuuuucuagcauugauuccuuugauuagaauuauuaggucacagguuaucacuagcuuuuaaguacuugaacccauugccaaguaaacuuacauuccaagcaaugcacauucauuuagcccagcuguguacaaacaaccucagucauuguuuucccugccaaccauuauuuuucagggucuuuaacuauuagagauuuugaaaauuuuauuauccucaucuagaucugccuuuguggugugucugauacaauucuuugcucagggcagcuuuuaauguaauagaagccaggccagugaagacugaccaccugauauuuauugucacuuugaacacaaauuauugcugccuauuacugaguagccugaagccuuuuuacuaauacugccuaaaucugggauaauuauuccuguucucaagaagauacucuauaggaggccaagugagccaaguagagguugaaguguaucaggagugacugcguguugacugcguuugcagaucacgucccggggaugugaguccauccaaacccaucaguucugcuucuagaccuaccagugacugaccguguccacuuagugucaggcuucaauaaagaugagaggaaagcugauuagaacagauuaagugaauucauuucucaggcaucuguaggugcaaagacaacagugcuaaauagucuguguuucagaauggguacauugauauuuuagccuguaguggggagauagguuguuccauagacuuauaucucuucccuguuguuuuaucuguuauuuuauaauacaaaagaaacugcuccucgugggacccuuuggauuuagcaucaucuuuucauguuaguuucccaguuugaaacugugguagcuaaguagacuuucccuugcagcgauucagguuuguuuuguuuucaucuaucaauaugcacauaguugucacaaaaucaguuagccuucaaggucuuggcuucgugcuucuuaaacauuuccugugaaacacguauuugguccagaggcugugggaugccugugcauagguacugcauguggcagcagugauuggccugcauuugacuucagcacaugaaauuaccucuagaaauagaaguuugaaggauuauagcauguccaggaauuaaccagugaauuuaaagcaagaauaugcuugagaauauucccuaccgugccaugcuguaugauauucccugucugcuguaugguauucccuaucugcuguaugauauucccuaucugcuguaugguauucccuauccugccaugcuguauguucuuucuuuguggggauuuaaaaagaccaaaaaaauuuuuuuggccauguuggucuugagucaaagcaagaugcaggaugaaggcucccaccugcuccccuggcuaccugcucaccccuggcucuaucagaauuaggggccucucucagcugugcacagccaguaccuucuccacacuggauaguguuucauucaguugucuuuucuauaaaaaaaaaaaaaaagacuuauuugaguuuuaguuaugggagguuguguguguguguguguguguguguguguguaugcacgagcaugcacggaagccaguaagccaccugauaauagguauggagaaccaagcucugauccugugggagagcagugagccuuaacuacggagccaucucuccaguccuuguuuucuauuaacaauuuuauuuuugaucauucucgagucuuuuagugccaucgcaagacuuccuguccuucugcccuuugccuuguuuuccugauacugcccuauuaggugcugaguugcggagguuuguguucauaaaagauucguuaucuucuugucuacuguuucaucugacuuagccaagguugucuuuuauggucucuuucuuucucucucucucccucucccucucucuccuuuucacuuucccuuccuguaggaacaaagcugguggcuuccauaucuauuuccuguggcauccuugcugcuuagagcaagcaguauugcagggguugaagaaagcuaaaaagucacauuguucauaaacuugcaagauccugagcugacaacugaaacaugccccuuuccuuuauuaggggagaguggguuauugguaaugauagcacuggauaccagaaacacaggcuguauuacaaccugcuaggggucuuggcacaggugugggagauucugggaugugcauccuauaccacuuuguagugcaggaaaguguuagauacaucuaucagcacaaaacauagaagaauaaaguauauugcugguaugugaaggcuccuauugaaauauaaguacugagagugcugacugccagaauguggauuuaugggaaauaaagcccuaaaauacuuucuccaacaacaacaaaaauauagaccucuuggaaacagcuuuuccucucuguguacuuagcucccauugagcuuaaauugcucucaguauugggauaaugacaauucgauaauacaggauguggaagacaaaccaaauaaauuaaccagcugcuuuuaaggcuaguucguucaaugacuuaucccuaaaaugcuuuguagaacacucgugcucaguaggucucuaggcagguuuaugacuaggagaaagaaauggauuuuauuaaaugucagugaaaucagggcagauagcuuugugguacuuaaauuagugcagaauguguguaagaaaagucauuuauauuuuucuaaaucaucagugcagaacuuucuuuggcauuucugcuagaaaacauguuucuacucaaaauucccauagauuaguauaaauucguaaauggaaagugcaccaguugauaauggucuccuucaugaagugcuguguccccuagagcaagccccacagaaggacaaugacuggcagacaugugaaguugaauaccauguaaagcuuagaagcccaaacucguguguuaggaauaagggcaggggaagaggcuugaaaggaacugcugaggaaccggggacacgaugcaagggaagagcugcuuaggugcagagagccagagaaaagaaugccaucacgucuagagagccaaagagaacacgucuguguccucauugaaaagaucaucagcuacuuacauggagcaagggaagucugacauuaaaaggaguuuucaaaauugugauaagcuuuguaaaaguuacauguucugcccuugaggaaugggcaguagccugccguugugggagcuggaaaugagcuaaauagagucccuuuugacagagauguguuaacuguauccauguauacaguauagucuuugaaacauuaggaaauacagguugguuauacaagccauuauauagcucuaccaguugcaaacacauuaucuauuaacaaugagaggaguacuaagaguagcucucaggcagccuacuuccuaucucccuguucaucuugcccaaaugccuagcaaaguaaaaggugugguccuuucucuagcagguagaaggaaggaagcucagaugauagccagacccagugaagaggguaccuuaaccggaccuuggugcugugauuggaccaacaggauuguaaagcauauaccaggaccaagcaauuggagagacaugacuuacagaagaaugcuugcuucuuuacagauaauucauuuuuauuuacaaaaaguaguagugauguguuuaaaacuauuguuuugagaaccauccaaagacaaaucacauuuaaauuauagugguaaauaguuuaaaauguuuccuucauuuagugaaguuagcuuguuuacuuuuuuggguuucagccugguucuguuuuuccagugccugggacuuucugucuuuacgaaacccucacugaggaucuuugcucucccuguugcguguuacacagaugcuacaggucugaaccaaagcugacauggacugacaucugaguucuggucuccuuccuucucuuccugccagaacuccuggaagcagaacaggacaaagggaagcuaggacccugcuggccucaguuuccucugguaaccccaaacaaacugauuguagcacagggagcucuguggagugaaucugaauguuguuucuguuuacagcaagucguaaugguuuucugaagaagcugaugguauauuuuaaaauaaggauugugacuaauugcuuauaccucuucaucuagagauagugucuugugacaucuccuucauucagucuucgucaggacucaugauagguucuccaggcccagacagucugccuuuaucacauguacauagucgcaacacuaaauagacucugcagguuguacuuguacgauggcuuguguguguguguguguguguguguguguguguagcaauaauuaaaggagaggucaugaauucaggaggaagaggaaggagaaguagaagccauguaaauacaguucucauaaaauucucaaagaucuuuuaauuaaaaaaauagugguggcuucuguaaauuaauuuggaagcacauuuuuguccucuuuuaagauuucaguauguuuuuuuaucgcuucauccagcucccuaaauuaaacuugguuguaaaacguggacuucauccuuauuaaugaguuaacauuauaaaaaaaaucacaugaauaauuagaaaaauuucuauguaagauuucuucauacccuuuucuagaauuaugauuacuuuguaauauaugcuucauauuucuauacuacuuucuguguaaauauuuauuauguggcuauuuauucauauuuaagugguaucauagaaaauacuauuuuguaguauuuuuaauaucuuaaguaucuuuauauugauaauacacauauagagacagauauuuauagguagguagauagacagacacacugacugauaguccugauuuuguccaucuccauauugugcucaguaguugccauguuuuuaguuuaucugugguugucauauauaacuuuaauuguauagcaucaauuucuagguugccccugauguuuccucccuuauacuuagggccugguaguagauacacaaaacacugagguaaacugaaaggaauuuuaaaaauucucuugccaggaaugguggcaccugccaacaauccuagaguaugauggcagagggauaguagaccaagaacucuaucuacaccagcauucuaggccgacaauagugaagcucaucuccgccucaccccagaccucucucagccucuguccucaguguagcagacagcaguaacacacauacgucugguuguugugcuuucagcgauacaugcuauagguggcacugcuuaaagaguugaaguugaguauaucaagaagaauauguucucaguggaugaauuaucagaccugugucuucuucagaauuaaggaguuuugaccaguuauauuuuauuuuaaaauagucagugggacuucacaauagauucuaaucuuuauauagugucuagcuacuguggaaaauguaaagaucccaaaucuuaaagcaaaugguucauacuuugugauuugauuuacuguuaaaaagauaaugucacauuauuugcuuuggauuaaauaaaaaaaaaaaaagaugcucgcuuccaacuaaagcaguugaaccugugaugacucucuuugucagugagaaacuuaaaagguucugauuucccgguuuacacaguuaauuaguucccaguugaaaagccguccugaagcuggauucacuaaggcauuguuugccccgagucgugguguuuuggugccaucuuguggcugagacuugucauauccucagugcucgucuaauuuaaauaggaauucaggcaguucaagauauguaggggauuguuuccaaaacgaggguaucuauuuaaaauaagcauaaaaaaauacugagagcggcuuguuugucacuugguaacacugacaggcagagaggaugagugaaggaucuucugugugacucuggagaccugaaagccuguguuuugcuguguccucagcugcugcuguuugaacggaccuggaugaacagauggaagucuucugugcuacacgaaggggaaggaaacauaaggagugugaaguggagaggccaucugauugcuugggccaacaauaugguaaaggcacuugucugucucucuagcacuugcacaguggcagcagauugccagauggaaagggcaggacagagacucgguggaguuagaauucugauagguaugggugauugauaccacaccucagcuuaaggaagucagaucgccuggguuuucauacuacagcaauucccaacacauuguggacuaaaaucucuuuagaggaagaaagugaggcacagagcaacgaagaaaaugaaaagccaccuuaaucauugcagggcugcuucaggcaugugcucuggaaaugccauucacccggcgcucaugagcacugagagaagcaaguugugacuuccucuuuacuccagguauaaucaugggccugucauuugaaaaguguauuguacucucaguauugcacuuaaaguuuauuuuauguaaaguggggcuuggaggaaguuuaaagaguagucuuuuucauaucugucauguuuucugaaauuucaacacguagcugagaaaaucaguugcauuuggucagaaagaguugacauugucucaguucaacccugcugcugggauuguccucacaacagccagucuccaggcuccugaucagccagaggcacuugaagguuccauugagcacucugaagggucacauguugucuuugaauggauggguuuucagacccaaagcuuucugaaaaacuaaaacucauucucuuuccgaagaauuccuuuagaaaugcucgccaccuaucagguugaaagcaaacuuggugucucugugcaaaacauguuugugcuggauuuguguuacuuacgcccuccacuaauaacagccuuuguccagaaaggagccuugcagcuuugguucucaaaggguuuguauaaagaaaguccauggccuuguauggcuccugggcgugcccagugaacagcguuauggguuugagugcgacacgucuugcuuugcucgaucccucucugagauacaagacacuuaauuuaauguugcuuugguuuguagggugugaagguuuuugacaucaccucaaagcaaagaaucagcaaugugccccgagaugacauaagucuucgcccagacauguaccccugcagccucugcuggaaggacaaugugacacucauuauuggcuggggaacuuccaucaaggucguuuacuuggucuuucuauuaaauccaaaucauuacagauuuauuguacucaugacugguuucuggcaaaccugauauuuucaucugaacacuguggugcuaggaugaagcaccacuuuauuuuacaaguacagacuuuaagaugugcuuuccuuuucuuuuuuuuuuuuuuuguuuuuuguuuuuuguuuuuuguuugguuugguuugguuuuucgagacaggguuucucuguguagcccuggcuguccuggaacucacucuauagaccaggcuggccuugaacucagaaauccaccugccucugccucccgaguacugggaucaaaggcgugcgccaccacgcccagcugugcuuuccuuuucuaugaugggcaaacuaauugcccuuuucuguucucagaaugaugcuguauuuguugaguucuguuuuaguuucccaugaucccaccgcaguuccuuggcuguuuauggaacgugugguugauuuugguggcuuagucaaagguguugaucuucauaucauccuuucuuugucuuuaguuuugaucguucggcucauuugaguuuuucauggccgugagcugaggguaaaccuaagucaccugcauauuucauaauucaguggcauagaggcccuggcucguuguuuauaauucaauggcauagaggcccuggcucguuguucauaacgugauuggcauugugagauauuuuccugagaugauucaauaauuuccuuaguaagcgaggggccggaagggagaguagggcucuuauaaacucagaaguucaccggaaagagaaggcagcugggggaaguaaagaggagacagauguccagaagcaauuagggagaaaagcagccagucccauaguuguggaucuucaguugucugcagccaugcguuuuugucacacauuagaaaaguauucucugagcccuucacccgguugcuccugugcugaagacaaauuuagacaugugcauuaaagaaggaaucagacaaaaagauaaaacaucuaaccauugaucuggcagcuuuauauaucuagucauugagccuaaguaauguccuuaacauuuuauauuuaaguauacugagcaugcuguuauuauuuauaauacucauggauagaaauaaaaaaaugagaaauaagaaaguugaucaaauaaguuacaauaguuucucaugauacauuguuauagugacauuaaugauuacaaugguagaagaauauuuaaaugauauuuaguauuuauaguaagccuuuacauuaauagcaguagcucugugguagaguuacuaaugguguccuuagacugggauguuguucacucuuguuuuucucuuugaguuugucugcguuacaaugcuccauaguguagugauccuuaggugggugacucuaaaauaucacugucugcaagugaaggaagaagcuggucuucgacauguggaucaguaccugaccugccuucuaguucaaucuuguauggagggccaaaccuuaauaaauacacaaccaaaaacaaaaacagaaaacaaaacaaacaaacaaacaaacaaaacccuuguuucuuacuacaaaguugaauagauuuucuuuggaaaguauaugcauuuggaaagagguaagaaaaauaaauacauaguagucauagucuuaccaaccuaaaacaaaauaacucauaaugucuauuaccugguguuugugaggaaaguaagagauuauuggauagauacagauuugaucucaacuuuaucuguauaauuuaaaacaaagauagccagacucuugaaaaggugcuaguaguggaaauaguagacuucauaggcugcacgcuugcugcuguaggacaggaaaccucucuuaccuuccagacuguacuguacacaggucagcguacucgggaauacguagacagcagacucugagacagccauaguauguguguucuaccaaaacaccuccugcgugugucuauaguccuuaagucgagcuucagagaaagggccauuagaaacagcagauuuacaugaaaggucuuuuugucauaaaguguaacuucauauuggacgaauguggggcaaucuaaauaauaguuggcagacauuauucaaacuaauugcuuaauuuauuuuuacucuaaguauaugacuguuuugccugaauguaugucuuggcaggagcaucuuaugcacauaagggcauuuuaugcauucagugcccacaaaggccagaggagagcauugaauccauuagaacuggaguuauagaaaguugugaaccaccauguggguucugggaaccgaacaaaguccucugcaagagcagccugagccaucuccccaaccugccgaccuuucuguccuuuaugucuuaaguagauuauggguacuucaucuuugggggacaugacuaccuuuaaaaaacaccucacugaguaaaaugcuauagagacuucucuaucauauuuagagacuaaccugugaauuucuuuuucagauaugcucagugaaggaacgccacgccagugagaugagggaucugccaagccgauauguugagauagguacggccccucccaugguucuaugaugguaaaacauccauagagcaucugcuugucacggggaagccaaaggccacacccucccccagagccugucucucggugcuucgauagaaugggaccagaaagccuauuggaaacucacuguggaaagaacucuuuuucccaaacaaucaaacaaaauaucuuucucauaguaacuucguagucagcuuuaaagucaaaauaugugaguuugaauccugguugugauauuuaccaccaggaccuaucugagacagauuucugcuguuucaauauuuucauguauaaaaugugagaaagaauguuauaaggcagcuguaaccuuauagaauacauaagguagagugugaguucauucauguguguaccuaguacaguacugacccuuuccgacacuucucaggacucauuguugucaccacugcucuggccccaauugucaccaucuuuuauuuggagcacuacagcugccuuuucuuuuucaucugcuccacuccaacuccaaucuagucucgucuucacaaucaaagugaugcccaucccugccucucuagcaacagcucccaccacgcuucuuuguggucugugugcuacagcuacagugacuuucugaacagacccagguuguucuuuuagcgggucuuaacuacuuuguggguuccucuuuuucccacccccuuccccccugguuuuaucuguaucaccaaguaggaaagaaaggauagaggggagugggagagggaacgacaucauugaaccugauuucuuucuucuuuuaucacaacuacuaagaaacuggaaccaaucacccugccuuucggagucaguccuagcauuuacguacccucugaaacggucccagaucuucuaacgucacacaaucacagagacuauuggcagcuggcaaaaucaugccucugcuauagcaaaucauacucagcucauuuuaaucccguaccuaggguuaaaagaaaaacauauucauguaauaucucgguguuuuuuaagaaaaucagaauuccauaauucuuacuacacuuucuuccccucuaucuagaacauucuccuugcuucuuuacucuucaccaacuuuuaaucauagucaacuuuuaucauaaaucuugggugaguugcuuuccugagaaaccccacuuguuccaccugaccaguccaagcccacccauucagguauggauucaucugccccuagcuauacagcugcagcagcucugggauucuugauuauuuuguauauuucugugucacuucagugcaagcaaacacuggacuauuuuuguuuacuuuauaucuuaaggccuggaacauuauagaagguacuacauaauccuguuguuguaugauucagugccgcugggaagcaccuacuauguuuccugugcugagucuaauauaccauuacguugaugagcagaaauaagucuugccauauaagagucagauguaaaauucgcuugugccuuuggaugguggauguuguagaagugugguacugcucuguuuuccaugacacugcaaacauuguguguuaucuacuggauauguuuggugagagcauuucaaucuggguuguucuguucuugaaguuggaagugugguuuguagaguguuuguuuguuuuuuauugguuuugauuuuuugagacaggauuucucuguaucucccuggcuguccugggacucacucuguagaccaggcuggccuugaacucagaaaucugccugccucugccuccuaagugcugggauuaaaggugugugccaccacugcccugcuuaccucugggaaggaucaguaguucagauuuccuaaguaugagcagaguucguguugggaguguagaacugagaaaagcuaaggaacaagaacugacuuguagcuacaagaaagguguuugcuucagugucucucacuuccaccccacuuuuccuuugccugugaggggaagccuuuggacaucuugaugcauagcauccuaagagauguuauugaaugacuaagaugcaaaacaaaaagcucugauaauuuuuaaggacaugaaaauuugccgggaaaugauaggaauguagcuuugucguugugugaguacauuacugauauuugaccccuguagucagggguucaguaccacgggccauccccaugcaggaagcgcggcuuuuguauaagagaccuugagugugauaagggaaaggaaguguuaggaaguuuagaauggaauuugcuuuaucccugacagggaacuaacuacucucucuccuucaguggggugacaauggcauugagauuaaagaaaaucucugaggguaggagaucugugagaagccaggugcuuauuaguuagaaucacaaagggaagccaaaaugucuuucucuagcgguccuauaaaugaaaaauaauaaugauuaaaaaugaauagggccucuggacaguuucugucccaugaugguccuuggugcagcgagcuuuggaaugcccuuguucuaccaaguuacauugcugaaaguagaugugcucugugcccacagcucacuuuaaccuuacauggaucuccugcauucacaaaagauuuccaagcaucagguuuuuauggaagaguacuuagagagauaauguuucguugauaagugaaguugguguuguaaucauuuucugguguccucugccagcaacagacuuacaugaaugacuuacaugaaugagaucaaugccugacuuucuugauuucauauggaaguugaacaaaacaacugagguaacaaacuacaggaagaccuacccaaaaugucagagaacucugggguaaagaggagaagagaagccucguuauuuucccuuucauaaaacgucgucauuaucuccagcuaacugauuaugcacugucaucuggaagcuuagcguguuauccuguguucagccucuugguugacuugggacagagaccuggaaacugagagucuguuuaccugguuugggaaagcuguggguuaguucuuucuuggaucuaagugucuuucuucauaagcuuguugucauuuugaccuacacuugggagcacugagguaguucuuuuugcacacaggugacauaguuuuuccucuuaauaaaagucucaguaaggaccaugguaggugugagcuucuuuccagggguuucuauuugaggaucugguuuugagucgucuucuguuccuauuuauacccuguuugcuuuccuauuuugcauuggauuuuccuuaauaauuaacuaugaaaagaauuuuaaguauggaaaagcaucuugcaaugaaugccauaacccuucugagaugcuguuuccuuagacuguguuugcucuggagcaaugucuuuauucagucuuccucuuaguaucauagaaaggcuugcaugugguacugugaaugugaaguuuugcuuugcguuggguuggguuggguuggguuggguuggguuuuuugguuuucugagacaagguuucucucuguaacccuggcuaucugaacuuucucugcaguccagacuaaucuugaacucagagauccaccugccugucuucugcgugcuggaauugaaggcauaugucaccaccaccugguggauauuuguuauuaauaguguuauaggaaaucugaugcaugagucugggaagauauccaaguuugcaggauauuugcuauguagguagaaggaccugaguuuacaucaccaaaacuguggacuugaccaugacauucuauagccacagugguguugggaguggaaacaggagaguguaugggguuugcuggccuaacucuggauuuacugagggaauccaucucaggagcaugagguagaaagaggaaaguaguggggcagaaacuggacacccuaaucuggucuaugcaagcacacacacacacagccauuaggcagaaugcuaaauaugguauaagcagaaugucguucaauguguacaguauuccauagguaggugguauuauucccauucuauagguaaagaaaguuuucagaggcucauguaaccuacacaaaauuguccugcuccuaagcaaaagcauuuuaacucaggcauuccuauugcaaagguguuucuauagccacauguggcuccaaccugcaauccugacaguaggaaucugaggcaggaggguugacacaaguuugagguuacccuguguuacauaaugagcucaaggccaggcaggcugcagaguaaggcagggucucagaaacauauagcagacaaagaagagcagaaagagccugcaucucaugagggcagguggugcucccagcauugcuaccucagccuucuguagcucguucacuucauagauccaccagguaggaauuucccaaaauccacagaacccugcacuugccauuggugaugccugaaguuuuugaaguuuuguuucagggaagugccucauuuggagaaaugaaaaguuuuuuuuccuuaguuuguucuuagaugagcaaccuguaguuuugccugcuccauguuagugaauuucugccacacacuuaccaugggucacuguaaaguuauuucuuaggacugggagccagaaaugacugugacucuguccuccuuucagaaaguagagagcuccugucauuuaguaugugacuuggguuuagcugaugacugcgguaauuuuauacuuagaacaaaacuaagcauuugauuuagacauuguuacuuagcaugccuugaccauuucuuuuucuuuuaucugagauugauauuguuacuaaugaaauaucuuuaucacuggcuucauggggccugaaguuuaacacauuacagagaauaccaaucagauuaaguugaaacucaaguugcuuaaacugucucugagcuguguaaacucuuggccugguaugguuggauauuuaucuuauuuugucuaguagcugaucucuucagcuuuaauuccauauaucagcucugcucugugauuggcuaguuccaaagaucauaucacauuugacacgugugucugcuucagagugaucccugacgcuauuaaaauguugaugccaaagguguuuucacugaccacuggcaugccaaccaaguguccagccuacuaaaagccuccugggcacaaucugcuccuguuuuugccuacugguuaagggugggaauccuuugcuauaugacaaauagaaaggaaauagaauggaaugagagucacggaugcucuugcuuauagauuggcauuuugggagagacaauguaauuggaagggaccagaaaagaugguguaaguuguaugcccugcacuagguuugcccuuagaguaguaaagacaauucuagaaaagcacaggacuuucuaaucauaaagaccucaagucuuaaacuguuguucuuggugguguaguacacauguagccuacacuucucuguucucaguuauauuauccaauaugccaucuaucuaaaaaaaaauaaggcauugaauucugacaucuacugcucucuucugaagaaacugcgguccaguuacugaccugugagcucuguacacugauucuuacagcaugucuacacuguuuucugaguaugcuggagggugggagccuuggcuacuguggcaggaugaggccaugccacugcugcagauccucucagaucugguguucuucagcagaauacuguguguggaaacacacacuccucagggcccccggacugugucguacuuucucuguguuuccggucucaagugcagguucugucucugugacacuacuauccucucaagccuucccuucuaagccaugagcuguguaacccaacaaguuuuuuguuuguuuguuucuuugugauuuaucuuuuccugauaaucuucuuaaaugugaacuuuugucuaauuagguuuguaaaccaccugguucaaacuacguuuugcuaaaaaaaaagacaagacuuauuaaaauuauuaaaaucauuguucuaugguguagaauggaauauaaggaaagauaaacuuuauuggccacuguuauuuugaaauaaaaagccaauaguugauagaagguauuuuacaaauuuaguccauaaacauuuuauauuuuauguauguuccuuagaauaaauaaaauucagaauuuuuuccuuuacauaaguagaaauaauauuuauuccuuguacauacaugcauucugaugccaugucucuagccaucuuuucuuaaucuuagcauuaauaugaaaaauaaauagcauuuuuggaucuacaaacacucuguugccuuaguggaaagaauaaugaaaaagcaagguucuuucugugguguuuuaaggcauuguagcugcagauagcuucacacacuaauaguucacagcaggaagugagcucuguaguguguguguguguguguguguguguguguguguguguucuuuugugggucuuacuggagaggaaucaguggguggcagaguagccacagcuaaggugacagcaguuagaacucuucauugugagucacaccaaguguugccaucacuguggauuuuguuucucuaagaagagugugugugguguaagggaaugagucaacacaagggaugucuuaguuuuaucuagacgcugauaacuccuauauuucuugacugcuugcuuugguugcauacuuccuugugauucuaagugaucauuaauccacagguggugcugugcugggugcuggcuuagugucuaagugcuaagugcacaugaacuccugcagucuucucuuguuuuauugagaacauuaauguuucuagccaggaucucagagaucaugagaucucuaugccauuuauguaagcauuguagauuaaggaaaucaggguggagagugaagauuugccuaggacacuguccuaauuuaauuucucuguuuugugcauuauacuuaguguuuaaaauaccaagcuuugauauaaauugaguuacuuuuaggagccauugcuucacauuaucugucagguggucugggcaggccauaugaucuccagagggcacaguccucacagcucaauaucuaccaccccuuugugauuaaugcuguuuucccuugggcaugauuagcccgcaggcacaaauaggccugcucuugacccucaugagaaggguuuuuguggcauuucuggauuauuguucuuucccgggaccuaucggcaaggaaacuguaguagcacuucagugacagacugugauuuaguaagacagaaaucagcuccauuuauaccagcauagcuggaacaguggccaccaaauucuaucguuaauuuacuuacucuagauggaugagauuaccaucuucucuguaaaugauacaaguguggacccguguagaucauucucucucauggcuucucacgcugcacccugcacggaagcaucucuagaaacagcugucuacacuggacaugccccucuccaaacugugacuaagguagaaaugguucuuaaauaagcuuauuugugaccuugucccaugcuagcccuuuaucaaaacugcuucugugugucuugauaggacauccucagcccaagcuuacagacggaaagaacgucaguggcagagccagagcaaaagcucggcccguggauguguaucuggacaccaagcccacuccugccguccagucagugagaagggagcuacucucuccacuuaggcugggaacgguggcacuccuguaaucucagcacuuaggagguagacucgggaggagcagagcucaaagucgucgucagcuauauagcaauuucaaagccaaccuaggcuaaaaaggacggucagaaaacacuuaccucucuuaaaguuuaugguagucaucuucagucaccugcucgaauauaaaaguuaaauuaugaagcugccuguaagauaagugaggguuagagaagcagggaaccugauggacaaggaaagagaaaagagcaagaacguucucucacccccuuccaucugcaugucgguuuuaccucuuuuccugauucuucuuucauaugagagcauuucacacauagaauguaacguucguucauugaaguuaugacccagguuuauagacuucacaagcauucacaucccuucugccauggcacacugagcucugccaacucaggaaaaacaguacguccaucauaggugauagccagaagugcagcaccacucaggccaucagaggcuggcugaauuacaaaacauuugggugaugggauaagugcacacacccuccccgacuccaggagugaggauuagacaggguaucucauccauguuaaacaagcagucuaccaccgagcuguggccauagccuccuuuguauguuuugccuugaaguaagggcucaccaaguuaccucggcuggcauugaauacaugcuguagucuuugaauuggugauccucuuuccuuagccuuuggagaguugggaauguccugcacugccuggccugacagugccccguguguauguggugguugcauuugacugugugagagcacuccuuuguguuggaaccuguggagccaaaagagggaauaggguauccuccucugcaacugccuuauugucuggagccagggucucuacagaaccagagugccauuuuaguuaagcugacuggccagcaggcuucugggaucugccuguccgccccaacccaggcccucaaaucugggacuguagacacauguguccaugccuggcucugaugugggugcuggagauuuggacucggguucucaugcuugcagagucccgucuuacacacagaaccguuuccuuagugugcauguuucuuaacuuauaauaacguauuucuucuuaaguuuuaaguacacuuuugaaaagcuuauuauuuuucucuguauauaaauaaguaugcaaaaauguuuaaauaaaaugucuaaagccaaaaccaaaguaauguuuuauaauaauaaaaacauaauuguacuguuuguaccacugcaccucaucuguaagaaaaaagauaauuuuaauuauuauuuuauuauuaacaauaaucgauguuagguuuuauuguuucagagagucuucauguggugcaaugacgcucuuauuaacuuaccuggcacaggggagcacucacaacuugccauuuagggguucguuuugucuauaaugucaacuuugaagucuuuccugagauggaugguuauaaagcacuuucagugcugcauggugaaaguacuuuaacaugagacacacuacagcgcauauuuaguauaguaucauaauucagcacauacacaauguguaauaaucacaucaggggagugggcauuauuuccauuuuaagcauuuuuaaaugcauuguagcacucagagucacugugucuuugccgucaugugcacuuuuaugcuccauuuaauggugaauccuuucugccuuuuguuugcagugucucaguuugaaacugaauucuacauuaguggacuugcaccucucugugaucagcuuguuguacuuuccuacguaaaggagguuucagaaaaaacgguaauuaucuucuccccagguacagagggauauggaagaguuggcuuuuagcaucacacccaggucaggcugccugucaggggagauugcuauaauccaagcagaacuuuccaaccuaugaaauaagccuagcagaaauuacccugcagacuagcaucuuuaccuucagaggucccacucacugccugccuuuguucccuuugcugcacaaagaggacaggguuuucgucuucuuuguuuuguuuuguuuuucuuuuucaucagucacuugauauuuuagcugaaagaaauaaagguucccucuugcugaauggcaaggaaaguaugcugccauuacauuagcagagaggauagcgaugaagcuggucgcugugacaacaggggucccagugcucagagugaguuucugaaaggucagcuucaucuuuccuggagcccagacaugucuaccucucagaggccugacgguuccaggucuugcuuuggaaaggguuguugcugcuucaguuauccaugcaggugauagacauuguaauguguugcuagcggaaagcaacagcaaaaaucaaaauuuuguuuugaugacacuggaaugaagcucuucucugggauuuagggacacccaggcucccuuuaaagcccagagcaguggcaugccguuugccuuuuguuagaguucagggguccugcuggaacuggcgagaggcugccucgaggccugaacagggagagcuugugaaggauuuccuuuugggugcuguguauagaagaaauggcaauugauucucuagcccuucaucguacgcaggcaggugaaguguacacuucuuguuuaucucuuccucuuucuccuccucuuccuccucuuccuccucuucuuccuccuccuccuccuccuccucccuccuccuccuccuccucucccuuacccccucaaauggcaaggaaaaaauagggagcaaagcccagggagcccuuguugacaagugguggcugcacuugagccuuucucugagagaacacuugcauuagggagccaucacuauaguaacugaagcucucggugcccauguugcuaggcaaugaaacgcuguagacuuaagugaacccucaaaccuccuaaaaucaauaggguuggcuucuagcccuauugcaggacauccguuuauuauuauuuuauuuauuuuuugaaaauacagaaaggcagagguuccugggggaguugagagcagcgcuuucugaugaggacgguggggccgauugaggaugggauugaacaaagcaaggggaaaagcaauaaaaugggaaggggaagccuaauaaacagcugaucaaaaaauacgaagggaaaaggaagagaagccugggaaauguguguuaaugaagggugugagaaaggagaaaacccagggaaggcuguccucacugggcagaauccgcacgacggcuuuucagagaaagaaggaaguguuagcgugcagcauauggagauucacuuuauauaacaucagugugugguuucuuaaguacagaguaacaauaaaauuaggguagauggacgacagucaguuucgggcacaccauuaccaauuucuguuuucauauugaaaaucugugccuauuagauguucauuggcugcuucuaugcgcuuuucauuaauagccuccuguguuucccgugugaugccuuccguccacacaccugucuccacucuggcagucacugguccuuugaggacccuuguucuucugugcauuauucucacuucaugugcgugugugugcgugugcaugugcuugugcgugugguuuuccuugugaacuguuuaagauagaugcuagucuaucuaguuaaaguacccgaauuuguuaagccuuuccccaauuuucugcuuuucuuucccucauugauaaggcgcaugucuuaagaauuaaauuuuccccaaguacuaggggaugaugauaaacuaaaucggugcucgugagaagcucauggauaggaacauggaccauacuacugggagcaagggccguaaagugacagagccaccuuaguuacauaccccuuaacacauauaaaagacauuuucuucuuuccuaaucccagugcuaaggaucggacugcaggaucccccaccuacuuagcaggugcucugucacugagcuacacccucagcuucaaaacuucauguaugauuuaguaaacuucagcuguuuuucauuuugucaugauuuugauauuuuuuaucauuuucauuacagccaguuuuuaaaaauauuuaugucuuucuccuccauucuuuuuguuaaaaauugauauuuucuccuucacauuuuucaaagcucugauaaauuaugguguaucuauaguugagugucaguugauguagcacuguugugagauacaaggccgguauaauggcuucuugguuaacaacagugcuuagagaaauccacguucaaacuuccacaugucugaaguaagagacagacguuugggguuuguuucucacuccauaccagguccaguguguguguguguuguugcugcuuugcagguugauggcagaugggguucaugccugucaggcccauauccccaaaauacaaaaccaagucagagcccgcuugauccggaagucuacgguugaccauaaguuucaguuuuucugaacauuccagccuuaccauugacuuauuuagcuuaaaucuuauuuaacccucagucucugacuauaaaacugagaauaauaauguuuaaucgcucuccaggauucauuugagaacccagugagugagugaucuguguuucauagccuuugguccucaaaccugucaccucaccuuucccgucugucgugaaccggggcuucacuuucaguaacuguagucacuggcuauuuaugcuaauuauagucaaaucagauugaaaauuuaguucccuguucacacuaaucauauugcuuguguuaaacagcccucugcagcuaaggucuucucucucaggugaucuagaugcaggcaguuccaccgucucaacaagauugauuuagagauggauuucagucucuggcuuuuggacacuacuaauaaguuuccuuauauuagcagugauuugaauagugaacucauuuuuauuauuauuuuggccguucuuuauauucacguagcuguaguagagcuguguuugcuacuguuaggccacagguucguccuauuuuacacugcugugaugaaauacuggguaaaagcaauggaaggaagggagggaacgagggagggagcgagggaggguugguucacuuugccucacaauuugauagcuuaucuugguggggccugcugauggcugcugaucacagcacguucacuacccagaggcagagagagauaaggcuuuuaguccaggacgcagcacaagggauggugcaggccaccucagcaguggggaacucuuccuugguuacuuuuaacuuuucugggaauaucuucauccgcggcuuuaggauuggacgcugugccacucauaagugccgucauucuguacauuuucaugaaacaaucgcagaauaagacaggauuaggugguugcuuauggcaagcuuuuagaacugaggucguguuugugccaaaaugacaaauucaaaacaaguauggcuagcuuguucauuuguauuaccuaagaaacauaaguagaaugagccuucucuauuguuuuuccccuaggaaagagaauacugugcaagaccuagacuggacaucauccagccacuuccggagacuugugaagagaucuccuccgaugcuuugacagucagaggcuuucaggagaaugaauguagggauuaccacuuaggugagacagcagagaugugcuugugugccguguucugcuuauucccuucagcucauccaaaggggaauugaaauacagguacugacaggacguuagacaguacccgugccggccucugccagugagagccaggguacuagauucauaaagacugcauauccuaucagagugcucauagcaaaaaggaauguuagacauaggacaggaaccaaggugagaaauuuguucuuuuuuuguuguguuuuguguguguguguguguuguuccaucagaccagcuagucagcuaguuugcugugcugggaaucaaacccuuggcuuuaaacaugcuaggaaaucauuggcacccagcauaucccagcccuaucuguuuaaguuacauuuaacuugauaucaaacagcaugacucuguccaagccuuauguuccuggaagguuugcaguggaggcaaaccuaagcggcagugaaguccuuguguugggagcugaggacuaagacauggaaaaagucucauccugucacagggacuguggaauaagugggugacuacacuaaucacgacucagaagcaaaaggaaaacuggaacucuuuaguccugccuaaaaaguccauuguuauaucuuuguaaaaugcacuuaagaaaaagaaagacuuuaagcucuuuagaauuuuucucuugcuuuauaaacaacaaacaucuuaugaaaauauuuuuaguuuucauuuggacaaaaaagugaugacugacucuauaugcaucugguccuucuuauaugaacccucuaauuaguuaaaaacuauaagaauauauuuuggauuuuccaaaaacuauuaugauucagaacgaaaacauauagucuggguauuuugcucagagcaaacucaguuguaugcuuagaaacccuuuagagaguuuuuauaauugaauucuguagcagacacucagcauuggcaucaugggcaacaugcugaaaugauagauuauguccccagggcuugggcaucugucauuuaugcauuagauggccuugacccuggugaagaggaaacauuucuuguugacugugagauguaauuauucuguaagaauagagcaguacuauagguguccauuacuaagguuuaugcucaguagaugaagcccaguaugugcuagcacaguuaguuuggguuguauuuguucaucugaagucugaauguuaauguaguaaacuuuaauuuuuaagucuaccuuauuuugugguuguuaguuuauagucauuucuucuagcucuuucuccuugcucuucuuuugaauaguuuuacacuguggugcauuuaagagcaguccauguggccauacucacacuccuugaccuuacagcagaggcaugcacacuuggcugcagggggagaaaauugacuguugagucugaaauuguaggcuaauuccauucccugaaaugauugccacuauugauaccaagcuacccucucucuucccugcaagaauacuccgagggggaaucacucuucuaugucgugaguccaagagaugucgucguagccaaggaacgagaccaggaugaucacaucgauuggcuccuugagaagaagaaauaugaaguagcuuugauuuuacuuuccugaaaguauugacuugucugaaaaaaaaaaaaagaaaaaagauuuuuauaguaaaucuuucauauugaguuagugugcuccaaaccaaaaauguuacaauuucucucucucagaaaauagugagcaaaaagcaugcaguucaguuggccagcuuuccuguugauggggggggggggugguucauagaagggggagucagcacugacugaagauuuugugauuauuucccuaaagugcuucagugguuuuucuuuggauguguugguaaaauugcuuauuuuguguaagggaaacauaccagauguauuguuacguagaauggcuugaacucauuugguagaacagugcugucuacuucccugagcuuagacaaguuugagcagacaguguaccaacaugacugacuaauacaacuguaauagcugccaagauaguuuguuuuuuagcaugacucucaaugguuuucucuguccauugagagaaaacaacugucacuaguuuaucuagaagaacuggggcccuuuuuuuuauuaauuuguaaacuagagucuaguuguuauauauuaauaacuggcauauaaucaagcuauuacuguauuacuuuagauuaguuuauuucuaaugugucuuauaucuauuuaguuccuuauuuguguauguguguaucuguaugaauguauguacauguaugcaugugugcuuauacuuguuuaucuguucagaggccagaagaugggaugguauguccucuaccacucuccacucacucuuuuugaggcaaucuuucccugaguucaguccucagguuuucucugcuagucuagaggaaagcaaguguagcuacccuucuguauccccacccucagaacugggcuucuaggcauuuggagagacgacuggcuuguuacauggaugcaggaugggaucugagcucugaucaugauugcaaagaaagcgcucuuaaguacugcgccaucucuccagccccuagauuaaguaaaauuuuauaaaauuaguuuauguguuaaauauuuaugugacgcuaauacucaugaaacaaaaauauacaauuuucauaaacuuaauuauagacaugaaaacacauguacauucuuuccauuuauugagacauaaaugacaagugcccuuuacacagaauuugucacacagucuuagaaugacagguacccuuuuuuucccuugaagucuaagagaucuuuugcacacugacuuguaugugaaaugugaucccacgaucuuacugugggaauaaauugaagugggaaugaaaagccuuccuuugcacuucccugucucccacucacugcuguucucuuuuuccccauggcccuucucaugaugcuugugcaaauguaggaagcuuugauggcugcugaaauuagccaaaggaacauuaaacgacauaagauucugguaaguucagcuucauuauuuaagcguaacuguccuuacuaacucaaaaggaaauggagugauuuggaaagaacaacagguucuuugugucuguucauaauuuguuuuguacuaauucuuuuaccugggagggcagaauauuucauuuuaucgaguuaguuucugcuuguaaacaagagauuugaacaccugcuaggauguagcuuuaggaaauuuggaaacugcauuugugcaaugcucuuucaauacuaagcucucuaguugaucgaguggaagccucuuuauaucauagauaaaaucacauuaucacaaaauguaucauaacuggucucuucaaacuagauugcuuugguauggcccugauaacaaauucaauugcuuuuguuauggagacuauucuaggaaaucaaauacauuuuuauuacauuuuggauucuggaaaaguacaauggcuagaaaccgauuucuuugcuaagugugacagugaauuuacaggcagagaccuuacaugaaaucauauccuccacauguaaagacucuuguaguuacaucauugagcccauuacccucauuuacaagugaauacuagaaacucagccuucucuggguaguuggguuuccacaaaguuucuguuccuuucuucaucuuaaaauucucuguaaaacuguacguaugaaccuuaauuccuaaagaaugcaaaacaauaaacuaaaagaaggaagagagaaagucugaucuuuuacuuuuaggcacaguugaggaaaauaguaauucuuugcaacugaagagggccuguagccacuaguacaguauaucaaagguacagagacugaagggguucagacuucaguuaugcggggcaguugaaugaacuaacuacaaagauaauuuuaaaguuauuauaucugaagugacccugauauagcugucuauaucaggcuaugccagugccuggcaaacacagaaauggaugcucacagucgucuauaggauggaacacagggcccccaauggaggagcuagagaaaguacccaaggagcugaaggagucugcaacccuauagguggaacaacaauaugaacuaaccaguacccucagagcucgugucucuagcucaaauaaagcaacuuaaucaugauauauacauauauauauauauggcugaaugguauuaugcugcuuacaguccagguacaaccucuuuguacuuucagauagauauuuguguuguuucacagguucuggcuccaugugucauugcuauguugucaugaugguuuuaucuuacuaggcaaaauguaaaagguuccaugcuaugaggacuucauuuuaaccaguuuuugcaucacuaauguuaaaguuuguuugauuuauccaucaacacccacagguucauuaucaguuuuggaaucuguaauguucuaggcugcaaauauuuacuauguaaacaucaaggaguuaaugucaguagcuaccaacaacagcaccucuagcugccuuaggaaugguuagguuucaugcguaacaggccauuguggccauaaacucaggguuguuuguauacagagaaguuucagggaacgaaugaccugucuaaagaucuguucaccaucugauauaaaugagcuguggagcaagcaugaggugaccuggcauagcuuagggaaugugugauguguaauuaagccaacacagucccuuacaagaggcugcuucccacugcucacauugaugucuucuugugggaagaagugcuccaaggguacacaugccaucacgguucuggauaauuuaucauagagcuauauuuugagacuuguaugaugauugucugaaaggggcagaaacaggauacuuauagcuacaacugugugagguaugaugauuguuagauacuaacuuagaggccaucgaagaggcuuaguuugugguugccaccaagucugcugaccugaguucgauccccaggacccgauagagagaauugacaccuucaaguuguuauaugacacacauacacacaaacaaauguaauaagggauuuuaaacuaagguuuuucuuuuauguaacuacucuugaguaucacaucuggggaagcuauaaccucgaaggcagucaaguuugugccuuguuuaaagaaggaagcagaaacugaaugauccuaaucuugcugugugguccuuacuggguuuaucauuuagcuuuuguaaagcacauaaucuggcuucauugugacuuuuguuuuuagggaaacaaagcagacugcccaaauucugauaaccucaguucuucccuaacuuaaagccacguugaggggcucuacucccaguuccagggucaaagugaauucaucccuaaguuagcacuggaaccuguuauuugcaaacaguguuaacauuuagaaagaugugcacuaccuacaucugucuguuaaaauaucuauccaguuauagaaagucgccuugacaaaacaguucuggauggaucagucaguauguaugcaaggcggauccuggcugagccaacauugcacuauggauaaguuucuguauuuauacacuauuggacaaaaggcacuguacauaugcguguugcucucaagcaguauuugcaaaacaugcaaacuucuguaucucgaaaaguaaaaacaaguucuuguugugaaaggaagggaagguggggggggaggaaacgcugacuuucuuccacuggaugguuuuggccccuuugucaaagaucaagugaccauaaguguguggauucauuucugggucuucauuucuguuccacugacccacuugccugucucuguaccaguaccaugcaguuuuaucaagauugcuuuguaguaccgcuugagguuggggauggugauuuccccagaaguucuuuuauuguugagaauaguuuuugcuauccaggguuuucuguuauuucaagugaauuugcaaauugcuuuucuaacucuaugaagaauugaguuggaauuuugauguggauugcauugaaucuguaaauugcuuucagcaagauggccauuuuuacuguauuaguccugccaauccaugagcaugggagaucuauccaucuugugagauguucuuugauuucuuucuucagagacuuaaaguucuugucacacagaucuuccacuugcuuagcuagagucacaccagguauuuuauaucauuugugacgauuaugaugggugucauuucccuaauuucuuucuuagccugcuuaucauuuuaguagaagaagucuacugauuugaguuaauuuuauaaccagccacuuugcugaaguuaacagguuuaggaguucugugguggaaauuuuggggucucuuaaguauacuaucauaucaucugcaaauagugauauuuugacuucuuccuuuccaauuucuuucccuuugaccucugcucuggcuaggacuuugaguucuauauugaauagguaggaagaaagugggcagccuugucuaaucccugcuuuuagugggauugcuuccagcuucucuccauuuuguuugauauuggcuacuggcuugcauuauauuguuuuuuacuauguuuagguauggaccuugacuuccugaucuuuccaagacuuuuaucaugaagggguguugaauuuugucaagugcuuucucagcaucuaacgagaugaucauguguuuuuuuguccuuugaguuuguuuauauaguggauuauguugauggauuuccauauauugaaccaucucuacaccugagaugaagccuacuugaucacgaugauguuuugauguguucuuguauuugguuugcaaaaauuuuauugaguauuuuugcauugauauucauaagggaaauuggucugaaguucucuuucuuuguugggucuuugugugguuuagguaugagcaugauuguggcuucauagagcgaaauggguaguguuccuucuguuucuauuuuguggaauaguuugaagauuauugguauuagcuuuucuuugggaggucugauagaauucugcacucaaaccaucugguccugggcuuuuuugguugggagacuucuaaggacagcuucuauuucuuuagcaguuuugggacuguuuagaucgauucucugauccugauuuaacuuugguaccugguaucugucuagaaaauuuuccauuucauucagcuuuucugauuuuguuaauuuggauacugucucuggacccucugguuagucuggcuaaggguuuaucuguauuguugauuuuucucaaagaaccagcuucugguuuuguuguuuuuuuuuuuuaagauuuauuuauuuuauuuaugugaauacacuauagcugucuuuagacauaccagaagaggacaucagaucuuauuacagaugguugugagccaccauauuguugcuggaaauugaacuuaggaccacuggaagagcagucaguacucuuaaccacugaaccaucucuccagcccuuuuguugauucuucguauaguucuuuuuguuuguaauugguugauuucgucccuaaguuugauuauuuugugccaucuacuccgcuuucguguauuuacuucuuuuuguucuagagcuuuuaggugugcugucaagugcuaguguaagcucucuccaguuucuuuuuggaggcacucagagcuacgaguuuucuucuuagcacuguuuucauugugucccauaaguuuugguuuguuaugccuucauuuucauuaaauucuaaaaagucuuuaauucuuuucuucuuuuuuuuuuuuuuuuuuuuuuuuuuuuucccgagucaggguuucucuguguagcccuggcugucuuggaacucacuuuguagaccaggcuggccucgccaccacgccuggcuaauucuuuucuuuauuucuuccuugaccaaauuauuauugaguaggcuuucuguuguuuuuguuguugaagaacagguuuauuucguggugaucuugauagggugcauaggauuguuucaaucuucuuguauuuguugagaccugauuugugacuaauuauauggucaauuuuggagaagguaccaugaggugcuaagaagaagcuauacucucuuguuuuaggaugaaguguucuauaaauaucuguuaaauccauuugauuuauaacuucuguuaguuucucuguuuaguuucuguuuccaugaucuguccauugaugagagugggguauuaaagucucacacuauuauugugugagguacaaugugugcuuugagcuugaauaaaauuucuauuaugaauaugggugcccuugcauuuggagcauagauguucagaauugagaguuuaucuugguagauuuuuccuuugaccaguaugaaguguccuuccuuaucuuuuuaacuuuuggcugaaaguugauuuuauucuauauuagaauggcuacuccagcuuguuucuuuggaccauuugcuuagaaaguuuuuuccagccuuuuacucugaggcaguguccaucuuugucacugagguacauuuccuguaugcugcaaaaugcuagguccuguuuuuguauccagucuguuagucuaugucuuuuuacuggggaauugaguccauugauguuaagagauauuaaggaauagugauuguugcucccuguuauuauugaugucauuuuuauguuugugugauuaucuccuauuggguuuauugaaagauuacuuucuugcuuuuucuagggucuaguuucccuccuuguguuggaguuuucuauuuauuauccuuuauagggcuggauuuguggaaugauauuguauacauuugguuugucauagaauaucuugguuuuuccaccuaugguaauugagaguuuugcugaguauaguagccuggacuggcauuuuuuuucucguagggucuauaugacaucugcccaggaucuuuuugcuuucauagucucugcugagaagucugguguaauucugauaugucugccuuuauauguuacucuaccuuuuucccuuacuacuuuuaauauuucuuuguuuugugcauuugguguuuugauuuuuaugugacaggaagaauuuccuuucugguccaaucuauuuggaguucuguaggcuucuuguauuuucaugggcaucucuuucuuuagguuagggaaguuuucuucuauaaucuuguugaagcuauuuacuggcccuuuaacuugggaaucuuggcucucuucuauaccuauuauccuuagguuuggucuucucauuguguccuggauauccuggauguucuggguuaggaccuuuugucauuuuucauuuucuuugacuauugcgucaauguuuucuaugguaucuucuacaccugggauucucucuucuaucucuugcguuguuggugaugcuugcaucuaugacuccugaucucuuuccuaggauuucuaucaucaguguugucugcuuuugugacuucuuuguuguuucuauuucuauuuuuagauccuggauguuuuuguuuaauuccuucaccugcuugguuguguuuuccuguaauucuuuaucuuuguguuuccuuuuuaacggcuucuaccuguuuaccuguguucuccuguauuucuacaagaaguuuuuuauguccuacuuaaaauucucuaucaucaucaugaaauguguuuuauaauccaaauuuuucuuuucugguguguugggguguccaagacuugcuguagugggagaacuggguucugaugaugccaaauagccuuaguuucuguugcuuacauucuuaugcuugccucucaccaucugauaccucuaguguuaguuggucuugcagucucugacuggagcauuucccuccuugggccugugagccuucgaucuuaggugugucagcacuccugggagaccagcucucucuggauaggauuugggucaagagagcugugccacaggguuaacucuggggugcagauggagcagcaagaauauaauaucuugaaggcaggucuuuuuuguaaauaaaagcauuuguagcuggacugguguuuacauuucucuuuuggugguguguagaguauuuucuuguacugagaacacuggcuaguaggagugaagcucucuguggguaccagcuuaacuucuccauguucagugaguuguauagaugucgucuucagcaauggggucuuacugucaguugugaagaacaacuuauagcuuuaucaucagcccaaguuguuuggggguucccaugagacccuuuggccagcaaugggauuagguguaacccaauucugguacaggaagcuucauuucguaccaagaaauguucaguuucagcucugucuccccuauuauuugcaauuuuauuuacaucacccucauuuguguauauauguuaggaagcuucuauuguauuagauuuccauacuagcauuaaaugcccuugauuuuaccugucugucuccacagcuccuaggaugauagccuuccacuucauuuuucuugcaugucuuuagucuucuccuggaagaggucgcauuuaagagaagacacuggaaacagacuuuuauauccaaugacaacuuuaggcuauguuucuaguuucagguacuuucucuggaaagauauuagaagauuuucacauggaaacauggcuagaucucuaaaacuacauuauuaaaauuuguauaaagcaaauaaaagugcauuuaaaucuaaaggugcugaagugugacaucacccaagcuguaacauagacagauguuggcaaugcuucucagaggauccugcguccugucuacucagagacugacacuaagcuuuucaaguguuccaugugcauuguucauuuacuucauuugccuuucuguaggauauuggguuggcauauguaaaccaccugguggagagaggagaguacgacauggcugcaagguaauaaugucuucuucaagauuuauggcugaugaggacaacaaaaauaaguugguguuuguuuguuuguuuguuuguuuugcaauugccuuuuuucauaucuuuuuaaaagauauaaaaagaucugauguaagacacaagccuccugcauagaauuaaaggguuguacauguuagcaagauuguuauucccaguuccuacagcacagccugcagugggcaggcagaguccaccuauaggcuuacauuaaaggagacaccgggguuagaaugccuucuccagucacucuggagagaguaagcagaccuaagggaagcacucucuaugcccucuaguuucuagggccaauuuguuacacauuucauuucgaaaaaaucuagaugugccuagcaaaguacaucugcauacaguucagagacaaugguuuuccucaaaaguguaguaauuacaugaaaaugauaaagccuguaagaugccuucagacaaagucuucaguucccugagauuaugucagacucagucuuucaaagaauguaguacgcugggaauaugauuuucugagucuguuuuucauccacuguuuaaagcugaccuggaaggagcuagcacuugggcuauagugaguuucccuacacaaaguucaaauaaacagugcuuucugaauaaauaggaaagucaggggaaaccccagucuuccgaaagaggcccauuuuuuccauagccauuuuguauagauuuucauaauuuccaucaacucccuguauagucagaugaguaauggcaacauaccuucauguucauugacacuaaagacacggagcccuaucagagcucuaggaagaacuuuaccuaagucgcuguggaaauguccacuuacucuaucucugcauuuucauuuacuuuuuauuucuuccugugauguuucugcugccagaaaaugccagaaaauucuugggaaaaaugcaucccucugggaauacgaaguuuacaaauuuaaagaaauugggcagcuuaaaguaaguuauuuuuaucuucacccuuaaguuuuguucuauaguuuauuaaaaugggaauaaaauugaaacaacacaauucgugguugggaaguauguauuauuuugaaagaagaauuaagcuuuaaguuuuguuuguaucaaauguguacaugucuaccauguacuggugugauccuggugcuguguuuaggcauguucuuggggagcagugugucuuagucaggguuucuauuccugcacaaacaucaugaccaagaagcaaguuggagaggaaaggguuuauucagcuuacacuuccacacugcuguucaucaccaaaggaagucaggacuggaacucaaacaggucaggaagcaggagcugaugcagaggccauggagggauguccuuuacuggcuugcuuacccuggcuugcucagccugcucucuuauagaaccaagacuaccagcccagagauggcaccacucacaagggaccuuuuccccuugaucacuaauugagaaaaugccuuacagcuggaucucauggaggcauuuccucaacugaagcuccuuucucugugauaacuccagcugugucaaguugacacaaaacuagccaguacacagugguaauuucauuuaguagacuuuacagcauaacacuuuuuaaauuuacucaagaguaaauuuucuucccccccccuuuccccucccccucuccucuguuuuuuccuuuuguuguguugggcucaaccaagggcuucagaacuguuaggcgagugaugugccagggagcucauucccaacgcucagcugaucugugagcugcaggaggcagcucacaccccugacugcagcucugccaggaggcuuuagcgcuugaucggcauccuuaccccuggacacagcaugcacaccagucacccaguuuugauuuguuuaucaucugugagccuuuugaauacucuguugaaauuaagacuauacuguuaaauuuuauaucauguuuuuaaaaguuaaauuauaaagcaaugagcuucaauguggcauugucacacacugguggcaaugucacacgcugguggcaugcuugcuucauaagaugguugacuuuuaaaguauuaauugauguguuauaccaaguauaaggaaaguuaaaagaaguaguuauucuaauuauuggauuuucaugaauuaauuaaaaagaaaagaguaaagauuaaugcacuuuuguacuauugauuccuacacacacacucacucacuacacacuuucagaaauauuuuguagcuuccugauagguagcagaguuuaucugaaucuuuucuuaguguuccaaaguauccugauaccuaaaauuuugaagguuaaaacucugcuguucugcugucugcauguuugggacacuagugucuuaccugaaaggacuuuuccuuccuccccaggcaauuagucccuauuuaccucgaggggacccaguucugaaaccacucaucuaugaaaugauuuugcacgaauuucuggaaagugacuaugagguaaggaauucucccacaaacaaggcuuguucucagcauguguuacaaaaucuagaaauugacuuuuuuaugcuuucacauuggugucagauggauuuuauaugaaagugauuuaaauuacaucacccaaauuauccuacuaauucuuguucugaguggcuggagaaagucagccuugacugugagucuggagacuucuccugcacauugugucaugucugccucauuaggaccacugaggaagaaaucauuuuuauugucauuaaacuauagaaauaauuuaaguauuauuuuuuauuuuucucauuuuaagguuuaauuuuaaaugagugauucauauaaugaaucaaguagcaguguuucauaagaacuccccaugaaaaauguuguccuguacaaacacuaaagaucagguuguaaaaacuacaagcaaauggaagaacccuaagcucaguagugcacacucguaaccccagcugcucaggaagcugaggcaggggaaugugagucccaguccauccacuuauccguccacuuauccucaggagugcuggaccacuucucuggagucccggcuucuccguuuucuugccuuccauuuugccagucaggaaaucacuaaaccuuggcauguuagacauuuauggaaaguucauugcauaggcaugauggcuaauagagaggagggaaaacccagagaggccuugugugcuuacuuagcauucuuccuuccugggcaagggggcuggacccucugaaggugcucuuauaaugcacuauccuuuaauggccugcacuggggagugguuaaauaacaaaagagggcagauugaaacccagcugugaacaucacaguaccacccuaugaagaguguucuuuuucugcuguucuuucugguuagggcuuugccacauugaucagagaguggccuggagaucuauauaacaauuccgugauaguucaggcaguucgagaccaccugaagaaggacagucagaacaaaacguuauugaaaacacuggcagaauugugaguauguuuuaguucuugaaaucucagaauggggacaaggcccuuucauuuuccgccgucuacuuaguugggaucuuuuuucuaagucucagugaauaacuggacgaugagugugugaagcugcauuauagugagaucugucugccagaggaauggugugguguggacggguccuggcgaggagaguaccaggcucccucaggcuuucccagugagacagguucuggauucuguuauuuuuaagucugcaagucuauugcuuuuucugaacccgcaucuuuaucuguaaaauuacagggcacauucguuauagggauacuuucagacuugaaaguuagggcucagcaagugauguuuggugaguauguuuuucuuuugggaguacucccaucuggcuuuugugccauaugucugaacacaaagaugagcuagacccucaaggaaccucaggguagggcgccagaugguguaccacaggccaguccgagaaggagggccugcuacaugccuuccucaggagccacagaccucacacugcccucucugaccaauucugucagaguuggagaaaaggcugcaugagccuuggcacaggggagucaugguuguggcauccuuaugcagagcacucugguuucucucagaagcaucuucuggggcaacuggacucuuuaauacuguuaguacgaacagcgggguaauuucuggucagcuggcucuccuggcuuacaugagggacugugugugaaaacauuguuucaauggaaaaauauguuuuaguuuuauacaacaccccuacaaaugagcuccugaaauauaauguauuugucagcugaacauuauguacaggaauuaagaccaauuccucuauugauuaagaagagcuuuuccuucauucuggaccacagguucaugucugaaauauagaugucuauacaucguggaggcugagguugcaagaagaaacacuuauuacuugaauauuacacaguuuugcaaauuugaugagaggaaagucaggcuucugaaaggaguaccaggggaccaugcauuuuaaaucucagugaacacuugccguaguaaacucuucucuuugaacaacuauuucagcuuuuacuauuaugaaacauaauaucugugcauuuuaguuauaacaauuaauaaguauuaauuuuuuauuaucagguacaccuaugacaaaaauuauggcaaugcucuggaaauauacuuaacguuaagacauaaagauguuuuccaacugauacacaagcauaaucuuuucagcuccaucaaggauaaaauuguguuauuaauggauuuugauucagagguaauacuuuucuuauuacuauguauuaacuguuaacuauucaaagguuuagucauggccacuugcccaagugagucacauacuugaccauaugcuggccaugcuuaaaacccucugacgcaccuuucuuugcauaguuguugugaaagccauuguagcuuaaugucaggcacuuuucuugugguugauaggagagagauagggaucaagccuuguauauaauaagcacagcuuauuccacugggcugugccccaacaucaguguagugcuuuaucagagguauuugaacuuuaaaaacaaaacaaucuauguaauucauaagaaagaaaaacagccuauacuuucguuuauugcacuguuuuaaucuuugucucuacauggaaauuuaaaugaacuucgguuuagagccuaaauuuuaaaccguguccuagcuuguuuuuuguggugauaaagacuaaagccaaaagccacuuggaaagaaaagguugacuuggcaagucagggcuacauagugagacccugucucacaaaaacaggaagaagggaaagcaggcaggcaggcaggcuggaagaaccaagggacuaguaagacuccuuccagaguaugggggaaugaaaguagucaaaguucaugguguacuuguaagaaaaucuuuaugaaacccauuacucacagaaauacacuaauaaaaaagaugagcugcucauauauaauuuagucacagagugagugcucagacaguaaaggcacuugucaccaagccugaagaccugaguuuagucccuaggauccuugggauagaaggaaagaaccuucuccuccgaguuguccuugggccacacaugcuguaaggcgcgugcaugugcacaugugugcgugaacacauucaaauaaacaaguauacgauuuagaagaguuauaguuuccuuauccauuuuccccugugucuugaaagucuaauuacuguaugcaccagugagaaaaagaugguugaacugaaacucaucgcuauuuaaagaauuugaaccagaguuaagauaucauaguuuucuaguuagaaaaguucuuuggaauaaucaaacacacuuauuuauagagaaaaaugacaucuguaacagacuucaguugcaaagucaacaagaaccuaguguucugucuggugggcuaccaucccacuaccucuugucauaagcuaauugguguuuuaugaacgcaauagaugauauaaaaaaaaguccaccaguuuuauguacuugggaaucaggcauuucauuugucucccugagguuaaccugcucucaggcuaacccuugcucacuucugugauugugauaaugugguauucuccagaguuaccaaggaucacauggaaauguaaacuuagcugagacaucaaggggcuaaaacauguugcauauuuugaauacauuaggaacucucacauuugguaagaauagagcaucacagcaguuuaacaauauacaaaauacagcacacagaccuuggauuaagacacauuugagugugcauuccucuacagguggcauuuuauauaaggaccguuuaugaagcuaggugcuucuuaaguguaagaaacaaggccugaccuguaacuguggugguuuauggauugcaguuuguuuacuguucuuguguggcagacaagugacuauggcuguauuuauauuucagaaagcuguugacaugcuuuuggacaaugaagauaaaauuucagugagucuuuucauauguaauagguuuguucucuguugcuaauaacacaucacauccugcaggcuugagagaaaagagguuuaccugguuuacucucugguccaaggucaagaggcugcacuuggugauggccuucuugcuggcagagugacagaucauuguggggugucacauaucaggacauagggugagccugucucuugugagcgguccaguaugcacccuggaagaaagaaggcaaaugcaagcuaucuguggccaggccugcucuguuagaacuguuugcucucagacagccugaaccacuaagaggccauuuggucccuuucuaugauaaucagucaucccccacuaggcccuuccucgggaagaguggccacauuaggagucaagcuggacucaagcucgggugggagcaaggcacagucaggccauagcauguauuauuagaugaguguuugaaguacugugccuacacuaaagaguuucagguuauugucuccucauaacugcuuuuuaauuucucuuuuuccucagauuaaaaaagugguagaagaauuagaagacagaccagaacugcagcauguggugagcguuagucuccuuugcccuuuuaauccaccagcaggcaauaccugugggucuguggggguguccaugcaggaaauguuccuuagagagcacugcucagauuggcguacugcucuguacaccacagacagugugcagguauugcuagaaugggacacguggaguggaggaacuaaacauagcucaggugguuggaguuuaauuuacaauugaauugggacuuuuuuaaaaaaauauguucuguuuugcuauuuucuaccauuuuuugccuuuccucuguaguugcuauuaaauguaaucaggccacaaaacauagcacaguacaguaugaauaccaagcccuggaauucaguguucaggaacagauuuauagcuucuucucucaccuacacucuaccuaagccuaacucuucuguagagguuuuacuguauuaucaagccuguuacucuagauuuccucggaggccccuuuguuucuguguuucaugucauccagggaguaaagcaggaggggugucuuagguuucuauggcugugaucaaacaccaugaccaaaaauaacuuggugaggaaaggguucauucuuagaacaacucucaggucccucacugaagggagucaagacaggaccucaaggcaggaaccuggaagcaggaccugaagcagaagccaugagggaacacagcuugccccuccuaauuuccucagucugcagucuuccagaguuuaagaccaccugccagggguggcaagggucacaauagaugaagcccuuuaauaccaaucaugaaucaacaaaugaccuacagauuugucuacaaauccuauggugguauuucuuccaauuaaaauucccuauuccuagauaugucuuaaguuugugacaaguuaacaaaaaccagcacaaggagauauuuucuauaugcuugaaaacauaagaaaugccuugaguggccauggggaucacccuaguagggauaaucuuugcucugaaagugugauguucuauuuuaaggucagcuucuaugcagaaggcccguggaugggaguguaagcugcauauauuguggguuuguuuauugcucaggauuuaaugcagauucuauuacuguaguuuucaugaccaaaaaaaaaaaaaaaaaaaaaaaacccucaagauugccugcuuacauauaccagcugauaugacgcccccaacacucauacaguagaggacuuucaggucugaguucauucagaaaugaugcaccuaacccucaagagauuggaggccccagggaguuuaaaggucagguggggucgggggugggggcauccauguggagauggggugggguggggaggagguauagacguggaacagaggguggauggggaggggcagggcauggaauauggaguguaaaaaaugaauuacaaauaaaauuaauuuuuuuaaaaaaaauuaccugcuuacagcaaggcuccacucuacuaaucaucuuaaaauuuugcuuauagaccaacaauuucucaccugcuuaagcuauaaacagagcugugggaagcauuacucugcaacagugucaccagugaaaggguggcagauagcucacugaaauagucaucucugccacccggaaguguaauguuuauauuacaugugacuggacaucuccuccucaggggaaacaccauguccugaccacauccagacccuacuucaggcagccugcuggcaguccuuaucagacuucagcccagcaaaugaccucgguguggcuguuucaugucccuuucuugccccccagagaaaagugaacacccgaagggaugacuccugcaauacauauguaggucucagaaugaucuguagcagcaaacucagacuuuguggcaaaccgaggcucuuugucuauuacgaaccuauucccucauggcccgaguguacuuuauguggcuagugugaucgugucuuccuccgucugguggguuacaggcuugugucuguauuuaacauuaaaacugagcgcccauuuucugguauuauguaaaaagcucaagcuuuuuagugaaaagaaagaaaaauacucccuuuggagucuaacuacuugaaacaacugugccauuuuauuccuugauuuuguuuucugguaccaucaauauaagugcaauuuaauugcaaagggaucacacuaauucucuaaaaaugaauauauggaguauauaaugauuaauuuaguuccuucugugauuuuuuuuuagaacacaguuauguugugacccugugccuuuucauguaaaagacuuuucaaagacauauuauuuuuauuuuauguguaagaguguuuggccugcauguauguaagugcacuguggguuuguuggugugcaugggaacuagcagaagagucacauccccuguaacuagaguugugggcguguauaagcugucaugugggcguucugaacccaacccugucuucucccagucuucugcauugcaaugcucuuaacacugagccgucuucccagaccaagaauagaauuauugucaucuaagauggcuacccgggcagcugauuucuggagcaaguagaugaugauauugagucuuaccaucacuaacacuuguguagugcuuagcauaugccaagcgugguucugucuaagacacaaauggcaauugcuuugacagccgugacaacccagugacauuuugugcaugugaagaccccaagucacagucacaguuggcuagggauggaucuaauuuuacaaaguugucagugggggccagccaggagcuucaggaucuguucuccacacccucuuuacuuaggggcuguccuugcuucuaagggcauccuagcugccguggaaggugccaacagucaaaaguaguaaagguaaccaaguauuuauucuucuucuucuguuauuguggauuaccuuguuccauuuaguauuugcacaagcucuucaagagagaccaucauaagggacagcgcuaccaugaaaagcagaucagucuguaugccgaguaugaccgaccaaaccugcuucccuuucuccgagacaguacccauugcccacuugaaaagguaagccaagccccgacuccccacguggacccaucagaaagaguugucagucuucgcucccuggcuguguucaggcagaaaguuuacagccacucauacuaguccaucagaagcccugugaggaccccagccauucagucacagauuuccaggauuuaaaaucaccgcaguucuucaacucaaaaguuaaucauaggguuuuuaaugggauuguucauugcaagggagaugcugguuccguaacaauuucuaacaaguaccacuguuuuaaaggacaauuuguucuucauaugucugucauguuccuuaguacaucugucauacuuuguaccauauacuguuuucccuugcuugauauuguuucaucuccacaaaaguaucuuuagguggauggagguaucugguaccugacaaguugagaaugugagugugaacagaacagcuguaggcuagaacugagggucugaauagggcagcuguagauuaggacugggguuaugaauaaagcagcuguaggcuaggacugggagugugaacagugcagguuguaggcuaggacuggggugugaacagagcagcuguaggcuagaaauaggggugugaacagggcagguauagguuagaaaugggaguguaaacagggcagaaguaggcuagcucugggggugugaauggggcagcuguaggcuaugacucaggguggugugaauagggcagcuguaggcuaggacuggggggugugaaugggguagcuguagaguaugcuagggguuuuacauggggcagcuauagaccagggcuaagaagcugagggcagacauagaaacuaggccucugaaccuuaggcucucauucuucacugugcugaggaauuguuuuucagguuuaaaauguuaauuucuuagcauugcaaacaucaggaaaaauacagccucaagcaugucuucagucuguaauuuacagaugugauccugugauuuaaucaugccuaagggauguugcaaucuuuauaguguuagcagguuuauaacugaauguauaaucucuuauuaaacaguauuugugagaugacaguguguguaauuugggugaacacaccauugacacaaaguugauacaauuuuacuaaaggauuaaaagaaacaucagagucaaggcuagauaggagucaguuugauuucagugggcgaugcuccucuuaucccugagguuuccuuguaccuuuaugcugaaucaaaaagcggagucacgggcuacauuugcaucuuguugcacucaaucucucucuguuaucuuccuuuuuacuuuuaguuuuccugaaauuccugcuuucuccucuguguguguguugggggugggggggauaucuaucugucuaucugucccucccucuaaaauccucuagagggaucacaauguccacacauuggagaaucuaaaaugaagauaaugucauuuuugucaauaacagaagauaucuuuguccuggaaauauuguauuuucauguuucacgaaaauuccuagauauuccuagagucucaucauuuuuaaggagaauaauuuaaaauacucuuagcaucuuauuuauaaaugucuuugauaacuuaggaaauuuaaauuucaaagacucaguguugcagaaagcuguccucuguauaacaugaccuguugaacucucgacagcuacgguuccuggcaggagaccugcugagacauauaggcacauguaagcaguaacugugucaggcagugugcucaguaggcucugagugucuguaagggugcauaagcaguuaacauacugaccaugagaaucuaaagcauggcaaauuaauguagauugcaauauaaguggcuucuguaaugaacuguucaagugagacucauuucuggauuaaaugguacaugugacuugaaauauccuguuucaacucaauucuagacuguguugauacucccauucaucucucuaucaucugccuauuuaugugcauuggucuuugugaucagccccuacccccaccccaucucuuacaugauuuaaauauaaucuacaggaaaaauuuaagucaaacauuaaaguauccacacuagcucuugcuguuguuuccuaagguagaucacagagcggaaagggaugauuaacucaagcugggguuuuuuauggcuuuauuuucaaaacaaccuggcuggcuagugguuucuaaauaacuacuuuaaauaugcaacccaguuaacuuauucugaaaccuuuauugacuccucauuuggaaaaguauucacuacagacccacuguucacucggccuugugcugagcauagggcuuggugcacacgugguggcugcagaggaaagucacaugacuaaugugacugguuagcuuuaauagugauaaagcacugugaggccauaugcagggugaagcuggaggaaugccuacagggucugguccaguguagggucuguggcaauguuugucuccaguccuucaucggguaggaaguagugaggaggaagcuucagaaagggggacacugcggagguggucagggaagacaugcagggaaugcaggagggaggucugugagcuaauggucagacaguaccugagucaaacucuaccuuuccauggagcuugucacaggagaacaucgugaauucuucuccaugcacgugguccucgccucugcauugugccagucauagagagauaugugcucauuucucugucauccuacuugagccuccagcggacuugcugucucuucuccugcuucuugucuucuuggcuccuucuuucucuccuugagugucaucauggcaugguacugucauccuccccuuugcuuccuugguucagcauccagcagggagagcauaguaaguguaugccacuugauuuagagcgacuguguuguucaucaguacauagcccauccuuagagucugugaggaggcaguuuguacaaaugacuguagauacgguuggaagcaacgcuauaaacuccgggcaucuaguagagaguaagcuuaaugggggcagcuccuccagcauugcuucuguuucuccuuauagaaugugcauugcucucccugcucucaguucuguuguguagcucgagauucauucaccagcaggugaaugaaugcagaggucugcagagauguccuuuguuuuguucuuuuuuuuuuuuuaagggggaaaaaaaaaugaaaaaaaaucucccaaguuuguaagugacuuuaaguggcucucuuaauauuguuuuccuguuugguaguccauaguaacauuuuuccuugcuuugauuaaaggcacuugagaucugucaacaaagaaacuuuguagaagagacaguuuaccuucugaguaaguaguguuuguucauuuuagucccauaaacaauggaauggggugaggauuuguuguaaaguguguaagaacaggcacagaucuguggacauucaggccuacuuuauauaaaaacauaauacagggaaaaggccaguccaaagcacaggagagcagcaagaguuguuggagccaugugucggaaagaacaucuagcaaacguguaauaaaagaagcaacgagcaaacaaaagugugucgaguuuccuaauuguagguggacugacacacuucggguuguuuccccuuuaguuuauaauuggcucguauuuacuacacauugauauaaaacaaacuuuguuuucaaaacucacauccuuaguagcuagaauaugaggcauagaauacgcauagcuuguguacguguacacaagggaacuagacuucccuggcugcuggacugugcgagaguagugucucaugaggaagcugcacauagaaaaacugagccuucucucuggcgucgguucccugcccgccugccgugugucccacacacagcuuuauuucucacaccauuuacugucacuggcuccucuggccuugguugaaaauuaacccaggucuccuauuccugugaauagaguggcuaauucaugguuguucagcgucaacccuagaucauauuuaaaauauaaauaaaaauuuauuuuuaaaaugaaguauggacuuuaauaaagcauccugcuuagaaucauagugagaguaaaugaugucguucauauaacaccauccgaggaauauuuucacacaccgugagcacugauuaaauaggacauaaugggaaaugcuagugucacauaagaaagucagccucagccuuaucuuccacacuuugcaagccaaugaagaaauaugcuauuuccuuuuuaaaugaauggaguguccuacacuuccucaccccaccuaggccgaaugggaaacaguagaagugcccucaagaugauuauggaggaauugcaugauguugauaaagcaauugaguuugccaaggaacaagaugauggagagcucugggaagaucugauucuauacuccaucgacaaaccacguaagcagaaaggcuauuuaauuguaaaucuuuuugucaguauagauuauagccgguuauaugaggacgaauaucucaggauacagugggccuaaauuaugaccaagugcguuggucgaggacuuuaaucucuaggacccacaugguggaaggaaauuacucccuuagguugucucuaaccuccacacacacucuccacauguggaucucaaucucucucucucucucucucucucucucucucucaugcauacacaugcacacacacaaauuaauaugagugaauaaacagauacauaaauguaaugaagucuuaauaguaaagccuccacuguaaaugcagauguggcaguagugaggcuuugaacugcagcaguuuuccuuuccagccccaucucaucagcacagcacugggaggucauaaguguagcugcucacucagccaucagaacuggcucuccccucccugcaucucuucuccuuacagcuuuauugugauuuuggucaugguggcuacucuuaaguuaggggguucuauucucguguaauuagcuuacaucuacaaucaagcuugaagacuuucuaucuugaaacuacaagauaccuaacaggguucuaacuugaguuuugugaccauagauaaguuaagacucucauguccucugucuguaaaagggaagcacaguauauacucaccuugcaaaauauuagcgugccuaguaucaggaugcccagaggcccucucugcuaccugcucuuggacaguaaaaacaguuuggaagcggcaugaacaauagugaccauuuaacuuuccuaagauggucucaguuucuccuuuuagucuuagaggaaguuaguucuuaugaguguaauuuaaacuuaaagaggauugguucuugagaguuuauaaauucacacuuuuuaacacauuucuuaaaggaauagguucaguuacuuaugaucuaaacuuagauugugaacaaaguguauucuaauagugcacauguguuauuuggucuuaaccugguguuuuguagcauuuaucacuggcuuguugaacaacauuggcacacauguggacccgauucuacuuauccaccgaauuaaggaaggaauggagauucccaauuugagagauuccuugguuaaaauucugcaagauuauaacuugcagguaaguauucuaacacacaugaccaucugagugagugagugagugagugagugagugagugagugagugaguucauuucuacauaaguauuugcaggccauuuggaugccuguuacacuuugcaguuugauauuuggaaaccuguugaaauagaaaaccugaaaaacuucuccacuucaggaagcuuuuucacuauguguaaauagaucacagcacugaagaagacaugagaguaaguuacaaagacuguuugaaguggccacaaaaauuuucuuagagaaaauaaauauuguaacuaauuagaguacaucuuuaagcacucggaauaauuuugcagccauugaaggacucuguugucugaaacacacuuaagcacaggaucuaaucagcuuuugucugauugguacaauaaugcuucuuuauuagcucaaaauuugugauaagaaaaaaagaacccauauucucauauaaauaguuaauaugcuaguuacuaaguauucuaaccuuuuuucuuuaauagaauugaacagugacuauguuucagaauccuaguugcuucacuaauacuugaaacuauuuaaaauucauuugcaugcagacuguucuuucugcgaucacuugaaaguguugcuguaauagaugaacuugcuuuccuagagacaauauacagguuguaagaagaacauuaugauguagauaaaucagaucagauugcuagucacugugaagggugcaagguaaaggacggccugcugaacucaggaugaugcaccaagaaucagcgagacaaccugcaggacagauaacauccucauagcuguagugaagguauucaaaagugggguggggauagagguggucagaguugaguuaggugagaaauugagaagcuuggaccuguggaauuaaccaaacggacucuaagaaauggcuggugcagacaaggggacuacagaggagaugucagcauccucgugguccucggggaacuguggugugacugcaaggcacagcgugaaaggagaagguuucuuucuguagacugggguagacaguccagaaccuucacuuggaagcacuauguaggggaugggauuaccuaagaaguaugugccagagaacugaggccuaaucuuaggcugguaguuaugccaaagccuuuggaggguuucagauaauccuagggauaugaucugagggagaaagaaaaagggaaagagaacaagaaucuaagaacuggccaauagggaggagcagggaucagagaagugccuacuuuaugccguucccuagguaugcagaacaucucaggcuuggaaauccgcuuugggggaaauggugccauagccaaccuuguaaugcccuuaauccccugugagugagacugacaguguccugugcuuugugggcccuuucuuacugagggagguauauagcagaauaugcuugagacagcaagucuaaacguacggcagugucugaggcuaggguagcaucuguauaugauaguaggaugguuagacuggugcuuagagccgggcuuuuggggugaaaccaugcuuguguugccagucccucccuucgacgcugaugccagcaaaggcagcuggcaugucccucacucugcucuucuaugggagcucacacgcccugcugcagucucacuauucauucacuucuaugaacaaauuugcauagugcugagccagccgaaauacaaagcauuagauacaaaacaaauguuuaacauaaaaaugguccucuaaaauaguaccaguaucuucuuaauuacaaauauauagugagcuuuuccuuaguucuguaaauaugcaguugggugcugauuuuaagagacccagaauuuguuuaccaauggguucagagagccauuguuacucaucagccacuggguagaaaaacuacuacucagaggaaaagggugggagagggaagggcagagccagggaaaccacacuagugcugacccgcugcucccucucccucccccuacccccucccucuccaugccccacucucccugccccccucuccuucucccacuccccucccccugcccccucucccucuccauucucccuccccccucucccucccccucccucucucuucccccucucccucuccuucucccugucccucucccucuccuucccucccucccaccaucuuccuccccguguauguugacuguuaauuuuuauuaguagccauuuauuuaucuacuugccuaagcaaccuuuugggggaucauguaaaaauaucccaggucucuggagccuuuugcuguucccugacagacauacuuuuauuucauuguaugggucuuuguuuguuucauaaagcuauaauuuauguucucauuaauaauaagaguucaaccccauagaucccccaaguuugagggugauauuacagaccuaugaguuuccaaggaugcugugugugauauaaagcaugauaugaagagucuucacacagaggucaggugugcugcuguguacugucucagucuccuucucaaacagacugugcauugaggaccuagaguucuuuaaggcgugagagauacugcgggucagcaguuaacugagaggagaguaguuaugggaaacuccggcagcuuuugccaugugaccuuuucauacuuuauaaccugacagcucugaaagguaacagaauugagcauguucacacccucagauacugaggguauuagggaaauggaaaucagugcuuugucacuaaccacuuuguuuuugacagacauuuuagguccauaaugggucuaaaauuaucauuagccccauugcucagaguagaagacugagacuucagaagguuaaugacauauugguaugguacgauacugaacuaguuuuaaauucaggccagcagaggaaaugccagaccauuuucauccaggacugcaucaacucuaagacauaaucccucaaagcucggccaaugagaaccacuuccuggcuuuucccucaugacuacaccucuggagaaagacaggcagccgguuugaacuuguuccuaaagaggcaggaggcacagggacccagcccuggacuguaccucugagugccuguuguaagcagaggccuggcccugugcaugucagcaagugauguggaaugaguccucuucccccauggcacgcagcccucugcagaucugcaaagguauuucccucuucucagccuugcugcuguagcuccccaguaguuuucuacuuagaauugaaaacacaaaucaguuuacagaaauggaugacuuucuuguucaucguuuuuuagaggagggacaaauuucuuuuucacuuuuaauuaucuaaccuuucuguauuuuuccuaagauggauuuuaaacucucaaauuccuaaaauaagcuuuuaagaccaaauggauuucuuucuuuacauauuauuucaguuugaucuuaucacgacauuugagugaugcagguggcuuguaccagccagccaucgcuuccuugauucauuuaguucuuaaauaguuaucuuucccuuuauuuuuucugucugggcuuagucacguuugguaauaauaauccagcaagagugaaguggccauggccaggcugcagugaggagagccauggggcucggaugcuaggcagcuggcagccaguugcauucuaaggacaugcaaagugaauaaggcaaggccggcaaguugagagucuuuucaaauaaaagcuguagaaacuuggccauaguucuagcaccgcccccacagcagcugucucugcagagccauaaugauuucucugauaugugccucuuuauugcuuugugaaauauaugugggggcuagaauuuuccauuuacuugggauuaucauccauggugaugugcuauagagaaaucagguggaaaauacagagcaaaccuaaggucucuugucaguuguugacgccauaaggauguucuuacucauggaauguggaccauugauugcaguuguggcuugcuucuuuaaacaaaggacaaagggaaagugcagaggaacaagggcgguugaaaggacgaggaaaaagguugguccuuacggguagauaaucuggggacaauagaagggccuuccauaaggaaggauuucuaaaaagguaauauuguuccuucugagcaaugucaauaaauauuuuuugagauagaaauggcauuaugaaguugagggaaggcacuaguuuaucuuggagagaauucuuacgugagaaguguugcuaagccagguugauaaucaugagacucuuauuggcagauggugagaucucauagauacagagaugucuccguuagcccauaagucagacccuuuaaugcacucaucacucugaaaggccagaccccacagccugcaaacugucuuugggaaggucagcuauggugcugugauuucacagcucuuaauuugcauguucuguccugguaccuggcuccuccgugcuccuccaugguggacaguccacacuaaaaucacguagugaagaacuucaccaccuccccaaaggaaacgaaagucagacauuuuccuuuguuugggaauuuuucauguuucucuccauccccgucccaugccuggaaguaagccacuccuuccccuugaucuuccacacguguagucgcugauagagugaccugacccuuucuccuacucucccgaucgaucauagcuccuugguugcagugcccuuuuccuuaaugaagcccaucucugugucagcuccauacaugaaccaacccuaccucuucucuuucuuauuuaacaguucaaacugauuucauuucuggaagugacaucagagggaaagcagcacggaaaagagagcgcucgcacagcaguauacuguugucuaacacacuggcucccugcuugccugagacuugcuggagcugagucagacuguugccaagggacucuuaccuucugauugcugccauacuuggucaugacagugacauuuagaauuucucucucucucucccucucucucucucucucucucucucucucucucuuucuuuuuuucuuucuuugguguagacccuuggauuuugaucagguuaggcaagaaguaucauugucccuuuccuucuuauagguucuugacaacugucaguguuccuagccaauucugucugugagcaggcagguuguaccugcuuagaaagugcuuuguccuuggcuuucuguuuucuuugcagccuguggccuguguuuguuccacaggcuguacccuugaucugucacugcccaggcggugugcccuggagagugucacagugcuuccagagcccacaccagaggagcuagaacugagccgauuaguuggaugcuggaggacagcagcuucaugaacuuacugaccuauuuucugaaagcuugucagcaucaauauuuuguagauaacuuucuugcuguauucuuuuucuucuucuuucuguaugcuguagugacuucugauaaaaaccauaacuuuuuuaaauuugguuuuguuguuauuuucucuuuuucuauuauucucucucucuauuuuuuuuuuuaacaauccagucuuuaucccccuccuggucugcccucuaacuguuuuucaucucauaccuccuccccaccccaccucugucuccaagaggauguccccaccucaccccaccagaccccuccccaugcccuggggccucaagucuccugaggguuaggugcaucuucucugacugaggccagaccaggcaguccucugcuguaugacugcccuccaagaggcccaacaagcagcugaaagauacuuacacccagccaguggacagaagcuggugaccccugugguugaauuagggaaaagcugaaagaaggagaccccauaggaagaccagcagucucaacuaaccuagacgcccgagaucucucagacacugagccaccaaccaggcagcauacaccagcugaaaacaaaaguaauguuacauuuuuaggagaaucugacaggacaguuagacuuaagcacaucuguaaagcuagcauuugccaguguugggccaggaggaucccuauagaguuaagacacauuuuuauuuccuuuuuauuuuuuuuacuagauauuuacuuuauuuccauuucaaauguuguccccuuuccugguuuccucucugaaaaccccccuaucuccucccuccucccccugcucuccaacucacccacacaugcuuccuggcccuggcauuccacuacacuggggcauagagccuucacagaaccaagggccucuccucccauugaugaccaacaaggccacauaugcuacauaugcggcuggagccauggguuccuccauguguacucuuugguuggugguuuagucccugggaacuccagggguacugguuaguucauaguguuguuacuccuaugggacugcaaaccccuucagcuccuuggguccauucucuggcuucuucauuggggacccuguucucaguccagugguaggcugcgaggauccaccucuauuugucagguacugguggagccucucuggagacagauauaacaggcugucaggaagcauuuguuggcauccacaauaguuagugucugguuuuggugauuuuuuaugggaugguuccccagguagggcagucucugggugaucauuccuucagucucugcuccacacuuugucucgguaacuccucccaugaguauuuuguucccccuucuaagaaggauggaaguauucacacuucggucuuccuucuugagcuucaugugguaugugaauuguaucuuggguauuccgagcuucugggcuauuauccacuuaucagugagugcauaccauguguguucuuuugugauuggguuaccucacucaggaugauauuuucuaguuccauccauuugccuaagaauuucaugaauucauuguuuuuaauagcuaaguaguacuccauuguguaaauguaccacauuuucauaaaaaggaugaaaauggaggcaagccccuccacaaguaguaucaaaguagacguaagaagauuaaaaucacuaagccuugcaucuuacagagacugaaagccacgggugcuuuugggucccacauuugggucccaaauguguccugucauguaacugaggagggcugcagcuagcugucgucauccagggcuuugcaggggaauucagguccuugugugugguugcuguggggagccaugcuugcuugcacccacucccauacccaguggugucaguuuacacuguggaagaaaauugcauaucuagguuuugaacugaguggcaugaguaugaagaaaaccaaggugguaucagagcucauacacugaccuacaggcacaggcagccacaggcuucucugcacaucucucaucuuuaccuacugucuugcucauuauggacccagccuugucagagaguagauggguuuauugaaugacuagauggcauagaaaugacaagucuuccauucugugcaaagaucugaagguuggacucugagccauucaaaaaccaaagugccagcaaaucaccauggcccucuauggcaaccacaugcagaguacagaagccugcgagagagcaguaggauuguagucuuuacaggacuuuggaauuuguguuugauuuuaccaaugccacaguguacucauaaaaacaaauaaauugugaagaacaaugccuggcuuacuugacaguguuugaugggcaaaagagccaauaaaugucucugccauugucugauuccucagguagacgcacacacacuugaguuacuaaauggucuuucuuuguuuaacauguacauuagauucugcuucgagaaggcugcaagaaaauccucguagcugacucauugucguugcugaaaaaaaugcaccgaacccaaaugaaaggcguucugguugaugguggguaaaucuggaaggacacucagcccugaaccaugcuuuccagagaggccaggcaaauggcaaugugcuuaaccugggauguguguguuuucuuacagaagagaauaucugugaaucaugccuuucucccauccucccaacaggugagaugcuuagaagggaaaucauuucccaaacacauguucaugaggaguggaauuaagauuuugaaauuagcuaaucacugccugaaaauuauagaacuucacaguugaaggaugucagccccuuccuucccuucucuugugaaugcugcugcuucugaaggaguagugcaucagcaucugcaggguucuucaaacgcugccauggccugagagccagcacucccaacaaggcgaugcuaauggauccgguuaggggcuguucuuuuagaaucuucgaaaguaaagcaaagccagaugaaagcccaaccaucaguccuccuauuucuguucuggggggacuucaucuucauuguacuucugggcaccuagacuaucuucauggaaacuacucagcaucaaacugacugacucacuaaaggauagaagcuucugucucuuuuucuccguagauugucguaauaauaaaauggucuguaucaaaagaucauucagacaugagaaaagcaagcucauaauuugaaagucaggguacuuuaaaaugcagauucaucaugagaaagcuuaaaggugucgcugcucacagguacuaguuuuaggcacuguguguuccauagcucauagagcaugggaggucauuucacacaagcgcucuuccggagggagcagguucgaguuuucaaagcgucuguaaaccacagcgcuuuagguggccuuuccaugaaagggguggcagauuguaaaguucgauccucagcuuccccuguggugggcaguaggucuuagcagagcucaucuggccagccacacagcagagcagaugagaggaccugacuaaacagaaguguccuaagugcagagagccugggguccuaaccgaguucugccucuggccucagcgagagaucuuggcaguuucagucugugguaguuggaaucaugcucaggacacauacagggacacacauauucuacuuuuucaaauaaacaucacauuugcugugaaauugugcugcauuaguuaucuugguaagugaugcugaggccaggaaaguagccugucaauuguacuucauaggcaggugguucuacacccgcucugugcuuaggcuccuccccacuccagggccuguuguaaagaagcccugucaaauggagccuguugcuaggaaauucucucaggcugguuuaaccuuuccugaucugccuggugcacugaguucugcuccuucugucacugccccuugcagaugcagcgaagcccuucagcgugguggucuuccacugccggcacauguuccacaaggagugccugccuaugccgagcaugguaaguugucagccauccgcugccaaaugaaaaaggaagauggaaucacagcaaccacaauuacaacccaccauccuaucucuuaauucuuuuacacaagacacuugcuccucuucaucuugccuaguuccuggguucugcauccauggauugacgcuaccuuguucugcauccaugcaaccucgcaucagcaguccuaaggaaaagcugcccugucuuaaacauguacacuuuuccuuuuuuuuuauuuauucccuaaacaaaagugaaacuguuuauaagcauuacauuguauuugguauuguaaguaaccgaagauguuuuaaacauauggguaauauccaaaagcugucugccuuuguauguaaagguguucuaguuugcucguucuguucauuucgaaaaacacuaacaaaaacccaacuuuggcauaaaaggguuggggguuuguuuguuguuuuggggguuuucuuuccauuuauuuauuuauuuauuuaguuaguuaguuaguuauugccuccaaguccaucauggagggaagccagggcaggaauauagagacaagaacugaaguagagaccacagaagaacauggauacauucuuguuccgaaccuagggccaucugccgacuggugguacuaacugcaggccuuaacaaucccacaucaauuauuaagaaaaugccccaacagaugcgcccauggacugggccaguguaguagaggcaauuccucaccugagcuucccucaucucugagggcuguaacucgugucaaguugaggggaaagacuuaaaaacuaaccagaacagaaggaauugcguaucuguggguucugguaucugaaugggguauaggaguccucucagaaauauucaaggagcuaaagggaucugcaacccuguaggugcaacaacauuaugaacuaaccaguaccccggagcucuugacucuagcugcauauguaucaaaagauggccuagucggccaucacuggaaagagaggcccauuggacacgcaaacuguauaugccccaguacaggggaacgccagggccaaaaagugggaguggguggguaggggagugggggggggaggguaugggggacuucugggauagcauuggaaauauaauugaggaaaauacguaauaaaaaaauuaaauaaaaaaaagacacacaaacuaaauaaagcauagaaaacaaacuaaaaaaaaaaaaggaguccucucagaagccagcuuucuuuuuuuuuuuaucacauaaguauauuguuuacuuuucaaaugugacagaugcaguguacuauaguucacauaaaagcauacccacuugugugaacucaugcuauuggcuugaugacgccugagcagugggcuguguguuagaaaacacuuggaaaucaguggaggguuuuuggccugccuuguguggcaugauucuguuauccuggccagacaaagcuggcucuacugugaugccccccacugcaccccuuuuuugcauuuguguguacaugugcauguguuuguacauacauguagaggccagaugacuaccucagauguccuuucccuggagauguccauuugcaagagggucugcucucugggaccgaggacucagcauguagucuaggcuggcugaccagagcccaaggauccaugacuacaugggacagcacugagguuacaagcaugugccaccacauguauuuuuguuugguuugguuuugguuuuuuggccuuuagaccauggguucuggggcuugaacucaggcccucauguuuguacuucacuaacugagcggucuaaccgccucgcuuguguccuuugagcugcagagucauagaagcauguguccugucugagcuaaagcauccucuacggagccgggaacgaugcuccaucacuucagagcccucggcucccuggaugaugacagaaucacauuucugaauguaaagguagacauuuuuuaacccauguuuuuaaacuguuugcagaaugcuccugcacaauacugcaacaucuguagugcuaagaaccgugggccuggaagugccauccuggagaugaagaaguaggccugccugccugcccacccuuugccacucuccacugagugacugcuggaccacagcagcugugucaacgccagugcuguugagugacguguucagggcuccucggagcuccccgucaguuguuuucuccagaccuuccuuccagaagcugcuccuugucaccgauggagaagucgaagcucuucccaugccaugaaauauugcauugcuaaucaguauuucaugauuuguuuauuuggcuuauuuaguuagcaaaagaguucaaagugacuucguuauacccuaguuacacccaccaggcaugaacugcacuacugagaacacugccagcuacagucggccaaaaguucugcugguaacaguucuggcaugccuggcuacacuguuugucaucagcuguggguagccuccuaaagcgcauuuagagguaaaaauuaaaauuaaagguaaaaugcugagaacugacacuccuucagugacaugugggaagaccauuagcugggguacuauagccuuauguuugcuaccuacgcgcugacuagcucaguuaucugccccaucaggucaucaauauuuguugaaugaauaaauguugcccuucucauugugaauccuuuauuguguugcaagcagacaagugcucuuuaaggaauagaggugaguuuuggcacugacaagcugugguugauaaguaggaggaagccagggacccugucagaguuaagugagacucuccaaagaagggccaaggauagauuuaagguguaucucacugccuggaaggguuggcaggagugugccucacugccuugacuuuuuguuguucuuaauguuuccaguuugaugucaagguucggcuugguaaguuuugucacuucccuugcuauucggagcaggugcacggccagaaaaacuaaauggaacuccugaaggggaggauggguggugccagguccaccacaguuuacuuccgaggcaaauuccaucaauuccuaaaccacauuuggacaauaaccccuaaguacagaaaaggagggaguaagcuugcuucauucuuaauaacugagccaggaugcagauagcaaaggguguucauucccuuuucaagaaucgauuaagaucuccaggacgagaugguggugcaagcaaagagcaccacccugccucccuggguaaugcuuucuuuuuuaaaaaacugguggauaauuguacuaaaggguaauuaauccuuuccauuauuucucacuuuauaaacauuuaaauacaacaaaauauucaaaaugcuaguua

SEQ ID NO: 6915 - RNA, 518072 nt, Mus musculus
gagaugaagugugcauacugugugacauuucccucuuuuuaaguaggggacuccaaaaaagucgugggcacccaguccuaggcacugugcaggggggcgggcagcagugcgggggcgggcagcaaacgcgccaacaaacgcguguccgcgcgcaggugccgggggcggcggcggcaacuccgcaucggcugcccagaguucgcggcagcucgcgggaugcuccuagaugcaagaugugucucuggccagcaggaggaaggaagaggaagugagagcagcggcagccggcggcagcggccagcgacccgagucuaagugcgugcguucgggcagcggcagcgggcgaggaugggcacgagauagaggcagagccaccgccguccgcgccuccgagagcggcgacagagccucgggcaccggucuacgucuccugccccggcgcuccggccucugggaacccucguugcggcguccugagaccccgggcagguuuguaaaguuugcugggcuggcgcggcgcccgacucgcugaccucggcggcccgggcgggggccagggcaagacgagggcgccgcggaggcacuuuuguuuccucccggggccccgcggcgcgggcgggugggggcugcgggcgcccugcaguugggaggucugggcaaaggggcgucccgagugacuagagguacgggguggggaaaagcggacaccgggggcagcgccgggauggggcucagugcaaggacccguggaaacggccggggcagagucggcuggagggggcgcgggcgggcugcgccaccggcguaggggugcugggaccuggcagagugcuccugggaccuugcggccagcagucguggggcuggagagucaggaagcggcuccgaguuuaccagcgaggacaccggggcucucgugugucgcagacgggaggggauccccggagagcgcgcucccgagauggggcgggaugagcugcggggaccccugaaggcguucgcuaaggaagacccgccucccggggccgugcggggcuucccucugggcggcugggucuucgauagagagaggcuagcgugggagggggcguaccgcgcgucuucccgggagagcggcgggcauggggcgccagggagggagcgagcgagcugcgcgccgcgguagccccgcggcuuagaggaagaggaaacccagaacucagcccgccgcggugcgcuugugugggguugggaagucugugcugugcugagggcgcgcgccaggcuuauauuugugugugugugugugugugugugugugugugugugugugugcuggcgcgcgucauugcggugggggcgcucuccuauugaccccucggggcuuggggcucucguccacugacucuucugccuggggcccuuugaacuaggcagcuggggcaaggguuguuggacuuggauugacccgacgcugcagaguuuggccucaagcagggacagcuccgagggccucuggacagcucccgaggcgcuuugagcucaaggaaaugcacccagggacuguggaccuccugccucuggccaguaaggacaaccuaagauacagaaagaaaauugugucuugagggaaaccagggaagaauuucagauuuuuuaaaaauuuuauguacaaaauaaaaauaacuaucguuuacauacuaaaaaucuucgagagcaacuugagacuggaaaauccaguuuacuugcaauaaucguuagauugggaaagcaggcaguaaauccgguccacuaaaggcuucugguuauggucuucacgugucucaccucuucaguagcggccaaggucauuucaaggauuacugguuucacucucucaauuugcaggaguggggaucgaaccuggucacuugaaggcucguaacacagauuccauacuuuuauuuucuugccugcccucacucccuccuucuuccuuucucucccucccuugcccuccccucuuucuucuuagcugacccuuugaucuucuacuugucacuaugcuccauuugcuauccuucagcauuguaguuaagcguguacauggccuuucugacuguauuugcuacuugauucuuguuaaguuagaugguguuaugauaaacugacagaaugaccucaauuguggggccucauggugaggaaguaggguaagcuggagaaaguuggggaacaggaagcuuggggacaccauagucuguggaaacucagugccugaacagucacugggccagagauuagguggucacaugguggaugaccauacccaccacagcaauaggcucuuguuaacugcggcaauuuugacuuccuuacauuuuuuuucauguuuacugcuuugucaccccaggaccuuugcacaugcuguucuucugcccgaggugcucuccucacauguucagaugacucauccuuugccuccacuaguucucaguuuaaaaggccuugguggccugggucuucuuagguuaccagucucccucucaguauuucuuuacuaguuggcauuauuuauucauuuauucaucugcuuaucuuaucgucgucucucccauuaggauggaaguuugagcaggcuggugaacuuguucauagaucuagauuaacuuuuuagcacaagauagcaaugugcuuugugaauauuuuauugacugguggaaggagacuugcccaugcuggaagaaagcacugggaaacauacuaagauaaucccagugucaauggugaguaggaagccuggcgguuaucacacucucucaucuccuccuccacacccugccacuguucuuucagaccccuucugccuugguuagauccuucccucagaagugcaggcugaggaaagguguagagaagccauugcuugggucagggcauaaagaccaaagcacuucauuaaaagcgcaacuguuccugaucugcuggaaccuucucuccuuggagauguauucuaaagccuguguggcuuuaagccaaagaaaugccccuccugcacccugucccucucccucucucucauagggauggagccagauugaaggcagacaagagguugcuugcagggccaggagagggaggcagagggaaaagcugggagacugaccaagcagagaaaggccugggcaagggagagaauggagagaaagccugcagacaaggggauucuucaggagcugcagagcgcagagcauuucugaaaugucagcaccgcucaagugauuugcuugcuuuggguguucggugugaguggguggggaggggugugugcaggaagggagggcuuugaagcucuggcccagaggauguggcugggggaguggcaagcggugcagcagggcacgcgugcuuacuucaucaucugguccaagcccgaagcuucggagggaucaucccugcagcauaguguuugccauccucauccggaacagugggccgggagguuucucgcuccccacaggauggccugcagccauccaaguagauagcucgguuuagacauccuguugaauuuggagaacguggaagauuacuaaaccucucugccuuacaaagccucaaguguuugcugcaagaguuguguaacaucaguucacgucaacgaacacggugcuuuguucgcuuaagguuguagccuaggagaagagcccgauaccuuagcgggucugaucagcagucuaaaacacaaaugaaggcugguccucugaggagguugaggcugaaggaucuugaauuagaagcaagccuuggguaauugcuaguucaagaccagcaaaaauguagaaacgucguugauuuagcaugcaccaagucauggguucuguccuuagugccacacagaacagacuuugacucuuauauacugaaugcauagcaccauauaagguugagguuuuaaaaauaugcuuuaauaauucuagagguuuugagaucuuuuacaucaacuugccaagaaaucuccaagaagcucuuucccuuuuacaaaauauuguuuguuugauaguuaauaguuuaauaguuaauagcaaaauaguuagugaaagaugcugcuuccaguuggaccacauacagugucagcccucgacuuuacucuaaaaaugcuauuguuuuuagacuuuggcacugugccaggcccagaucccaucacuaccuuaggaggaaaggggacccaagugaccaguuguuuacugcagugaugcagagucgaagaauccucaguagcucucccugcacuuagaaggaaaucaaaaccaugcagucuucuggccaaguguuagcuuuuggaaauuuacucaucccaaccuuucauuuccuaguuuaccccugggauucaguauuugcgugaugcuaauugcuuuuggagauuugcagaggcagccauucuguuuuugguaguagccacauguuagaucagguauucgugcugacuugggcuuaagacugacuagccacaaaaacaaagccgaagaccaagagcuucagagguguuugaaucagaagagucauggaggccaaccauccagauggugugguuuuaguaguaugcguggcccucgaaggcuuuccacugcucaccauagugcauuuagguucagaaaagccagucuacauacacuaugcauauguacucagcagcauacacugucugcuguauuuccuggguaaucuagauugucuggguguuaagaaugacaccuuaucuguaguaggcugaacugaagccugccaaaccccgccacgaucaaugauugccuuaaccacuugugcuucaacacgccauaggugcagguacaaguacagaauuuugucugcagccuacaaugaggugaacaguuaaguacugagguaggaaaaugugugggugaaggaaugcugucucaucaaacggaaugagccacagcaacaaccuggcccagugcugagcagagaaauuagucagauguauaaauaguaggagauguuucuuuguguucuuggcccccacaaacacugguuuccagaaucugagcagauuauaauuggaaccucaguuuuaggaauugaagcuacaguuggacuauuuuaguucucacuguuaauguagggaacacagcucucuucaguaggaaaggcuggcaacucacuacuugcucuacucuaggacagugugcugggugggugguaucucuggauaagcaguagugggcuaggggaugggugcccagguaagaucuuaugaagcacugugucaguaugguuggaucaugagauugaugugaaucuucauccacagcugacuucuuucccuauugccaacuguuuuggaaagaguagggugguguuaucauuuuauagaugguauuacuagcagugugguguuaucaagcuauagauggugucagcaccagggugguauucucaguuuauagauagugucagcagcagggugguguuaucaguuuauggaugguaucuacaggggucaugggcucuagaacuaaacuuuauuuagcucuucugaaaauuucuacuuuccuuccuuccuuccuuccuuccuuccuuccuuccuuccuuucuuucuuucuuucuuucuuucuuucuuucuuucuuucuuucuuucuuucuuucuuucucuccacauuauauauucugguuaguuccuugucuuguuggugcagugguaucuagagauaucuauacuccucuauauuguuaggaaaucucucuacauagcagggcagaguaguuucuuccuauaacaccagccugagcaucauagacaaccccaucuaaaaccaaaccaaccaaccaaccaaccaaccaaccaaccaaccaaccaaucaaccaaccagacaaacaacaguaacaaaaaacuaaccacuccuacaaacaaacaaaccccaacgaaaaccaaaccaaagcuggcuaaggauauggcuuaguugguaaagagcuugacuuuauaauguuagaaauugaguuugauguugguaaagugcuugacuuuguaauguuggaguuccccagaacucauauaagaaaacuggagugggggacauggagggagaccugaaacuuacuagucucacaucgaaucugaguaacugggaaguucuaaagauguugucuuaaaaaauagagaguaccuggagaaugacagcugagguugucuuuuggccaccccacucaugcaugcauacauagacacacaaaauaaauuuaaaauguuuuaaauauaaaaagaaguaagauacgcccucaguucagguagggcacugcucagugguauugaugggcuugaucuacgugugaggcuuuaaguuugcgucucaguggccaugaaacaaaaacacaacaaaagaaaugcccucaguucagaggggcugugucccggguugccaugacaccuagcucuugcgauggagaauuccagaguugauccuucucugcauauuucauucucaaggugcccuuagacuugaaucuagaugcaucuguggccucuccuaucagucaagaucacaaaacuggaggacaagggcuauuuauuaaucagagagagaagggggaggucuuugccaaggaaaauguauucuuuagccaacacuuuuuuuaaaagaagauuguggaugaguuauggugcaugaacccacugggagggaaccaguugucaggggaauauacuucaugaugcacuugucagcuucucugaccauggacuaauacccaccaagggaacuggaaaccugagcccaguagguaggacggcucuucuuucugcaaugcagauguugcugcuguucuuccuugucuacuuacacacgccaccccuuuuaucuguccuuuauuuugggucucggccuuggcacuauugacauuuugaacuaaguaauccugucuuucgaggacucuuccaugcauugcaggaugcccaccagcuucucuggugcccuuucacuaggucccaacaucuccacucaggaacaaccaaaguugcauccacucuuugcaggucuauggcugggggccaaccccagcccuccucucuccucccugggcagguuaagaacaucugcuuuguuuuuugaagagaucagaacaauugcuuguaaucugaucugacuuucagcuggaguugugacuggcccaguuuucugucacuggcuauuccuuggagccuaaacuaaggcaguguacucacagauggggaccauuuauguucaaucauuugcuuuaguguccuccuuaacuucccucacggcuaagaugcaauuaucauccugagucaaauggugaugagacuuuacucaccuuccuggauagcccagguagaagaaagcuaaacagggaguuucgaucccaguuucccggcaagguuuugaguuugacugcugguuguugaauuaacugugaccuuuacauaacaauuaagaggguaaauagauggagcgggugguaagcaguugucaggguagcucaguuagaggccuggucacuuggaaucccguaauugaggacaauaucugcucuggugcuccccagauaccccuuggcugaucagcuaguaauggauaugggucuucagucagugccauaggaccucuagcaggcagggagaaacuuuaaagacauuggcuuauaugaaguccuuucucauucuggguauuaacauuucugggcagucuuguggcauuauugucuuauguaauuauaugucaaccuuuuauuugccuccucuggcugcuguaagugucaagugcaauagcugguggcuucugccacacagaaccuauugguggguaggauauuaaccguuuccccaagucaacagccagcuccgagucacacagccuguagcagcucuccacccuucuuccuuccgcccucuguaccuuuuuuuuuuuuuucaguuugagauugcauuuggagcgccacaguucugugcucugggguucaguggcugaguguacugcaugagauauauuuuccaggcuguuacacacaauuacccuuaauuuugaaguauaaugcauuucaaaauauuuuuuuuucuguuuuggggcucuuuaucccaaaugcauaaaccgcaguuggccuucagaggacauguggcuugggagguugagccagcagaguacuuuggucagacugcacauuuuuggcugugugaagacugaauuccaacaacacucaguaagacugguuucaacuugacuccugcccacccccacacuacccuacccaccaugcccuagauuuuucuaguggauugcuaccuuaguuacaccaauuauggaccacuugguggaagugacuacuaguuaaacauuuuggcuuggggaagugaggcauauucuuuccuguaguaaguguuacauacaugcucacacacacacacacacacacacacacacacacacacacacacacacuuugccugauaaugaagggcccuuugaagcagaggaauaaugaugccaucugcuaaauucuauuuucccuaacacuugucaccuuuacugaaugggaaccauguuaaagcgaauuuucuaucaagcaaugagcacauuuccauccuccuuggacccacuccacugccagcaaguggcuuagacucacuggaaccauuuuccccgaucauuauuugaucuucggcucaagaguuauuugaaaaacaucugccuggauuugcaugagagaagcauaaaacagcuuuauuuuuaaauuauauuuuauaaaagcaaugcugaguagagagagcugaggaauaaagugugggcccagggugaacaaagccuugaauucuguccucagcauuuaaaccgacacacacacacacacaauaucaauuaauaaauaagagucuuaagugcauauaaagacuuuuaaacuacuguuucuaggcuuaaccugucacaauacuucaccgauguccucaugcucccaucagucagcuagcuaugccacagcccuuugaacaguacuguauguucuguggccaaggcccuccacauuuggagcuuugcuagggaugcaugaaugagaagaagaucaguuaagagauaauuguaacuaccaguacugcagguuuguacaggcaaaguacacagauuaucauuuggggagggggauagauguagaaaaguuauuauuaaagaaagauuguuccaggagcucagcagucuugguggaggaaguuucuugggcaaggacaggagucuguucuucugggagcuaaacauccaguugaauggacaggaaagccaaagacucuuaggcaaggaaaccaggcgauccagguuuagugaggacucugucccauuguagucuggacaaaagaugagacaggaagcaggcaggaggaacuaacacguuacuaacaccgacacuaucagcuucuguuuucuagaccuauauucaaauaaacacccagucuuggggagaggaauaaauaaauaaauaaauaccgcagugagccugcuaugagggaaggcugccccaccccccacuucccuacugagaccccacagcuggcugccagccagagcagucagaggggaaggaggacaguauguuucagccacccacugaagaaaacaaauggaggauugaugacugauuggauuuaggaaaagaaaaagaaugauucuuugaaguuuggaacuagguaaacaugaacucguuaauugaggguuuaucugauuuucgagacuuagcuggggagcggaauucauuaucuugcucagccucaguuuucacaucugucagauggaguuaauauaaauccguagucucuggagcugcugacauggggacuuuaaugcugacugcgaggugugcuugcugcguucguuuuguuguuaucaucaacgccgcugguuuuaucacuuaagaaaacaauauagaaaguauacucguuuaaagacuuacauugauuguugaacuuucuucaagaggccugaacccugucucuuaaaagcucaacuagacuuugcuucauacaccacuguuucagaaacagagacuuugccacguuaggaggaauagcuuccauuguaaauuaaaugagccaacguaacagaucaugcucucagucugguucaaaugaaaacucauguaaaguccagcucaccugggaauuucacuucauuucuaauuuccacuggggacagagauuggaggaugcugcucagggcccuuccccaaccuuugcuugauucgagcuuccuggaaaaggguuguuuacagcuguccaacuauagacaggaacucugagggaaacucccaagguagugaauagcaauggacaggcauuuaauucagaugagcuguguuuuguaugauuauguuaucuguaaaggaagcccaguggcccccaaacacuucauaagcgacccuuucgaaucacuuagaaacuucuugaaagugacugcuuaaaguuucaguggaaugugaguggcugcaagguuuuaacuuucuccccuaaccaaaacugguucauuacacugucagccagguucaaagagauucugagcauaaaauagaauggggagaggagaagaaccaugaccugaagggacagacccacacagcucuguuguucuaguacaguuaacagcaucuuucucacuuuuaaaauguuccacguaggacauuucauucuaugucuacuuccagccacagccacuguuccaccauuuauguuugcuaguucuggccacgguuuguaaguaaguuccuucaggaaggcagcagcuagcauaauggcuuacuagcuccuuccacaguagcucauauauccauccaauggucauuuaguaagcacuuuugugaguagauuaaaagaaagauaaacuccaguuuagacacuaaauaauauauaauacaucauauauaauauacuauacuauaauauuaauaauauaauauauaaauauuauauauaguuauauagauacuaaauaauaaauggaaacauuggcuucagacagagaugcgccacuggaaagauauucuacagacugcuuuggaaguaaaaccauuccugcagucgugaaaagccacuuagcugagcccuggaugcaggucuugguuggacacaacaaaaugcuuacuaaccucaggauauaaaaauuucagucccuuucuguucucaagaagagugaugcgaauccuuccgcuucugcaggcguucaugcggcggugccuucuuccuaccugucaggcucagugaagagcaugaaaggcaauccagugucaaaccuauuuaaagagucacagaaagguuuguuuucauaagaugcaggauucuguugaaacugaggaguucugcucgcccucaacguagccgacaauuuaaagauuccaagcgccugggcuccauuuaccacuucucaguugcucccuuuucugcaguuuaucuuaggagacacuuccagcugucagcaucuucuccguucccgagucuguuuugccuugguugagcaugcagcucuggagcacuguguggugugggucccagcucuuggugaccacagaugagaagccauuugucuuaagagucuugccaccucaggagcauguggaagagcagucaugucaguaagccaucgccccagcugcagccagcugcuugcaagaaggcagagagaagagggcagaauagagauuccaguucucagaagacaucauucucuacuagacacuguguuguagucauugcuggcugagguucauuuagaaucuucucagauguguugcugauaagguuagcauacgaaggcgaacaaugaaaaagucugaggucaguuauggcuuaggagggcggauagaacauaagaagucacugugaagauuuccuggucaguuuuuauuucagaguucaagucuuuuccaaaggcaauaguacacgaccagaucagaccaaggcacagagaaguagaccaauaacagccuuaauaaugcauuucuucaggcugaagagauggcuuggcaguuaagagcacugauugcuuuuccagagguccugaguucaauucccagcaaccacauggugguucacaaccaucugcaauggagucugaugcccucuucuggugugucugaagacagcaaucuacucacauaaaauaaaucuuuaaaauaauucauuucuucuucuuuccaaaucuauaaauuauauggaaagagugcgguucauccaguugaaaaacaagcaaaagggaauauuuagggucauggguacaagagaauccacugugacaugccaguccuuacuauuagagagacguuagaguucuugacuuucaggagagaaaaaaacaugcacuuuuuuuuuuccaugagagaggguuucucuguguagccaucuuuccuggaaaccacugcauagaccuuguuggccucuaacucagagaucugcuugccuuuaccgccugggugcugagacuaaaaaggagugcaucaccaggccuggcuacuuuaaauucuuaauugcuccugaauccaaauuugcucucagugcauaacugaaauguauuuuaaauucauuugucuauuuauacauauuuauggaguaucagcucuguaggacuucuuccaaaauuacaaacacacacacacacacacacacaacuucuaggaaaaaaaaaaaaaagcacauucaucauuggguuccagaacucuauacuguuucuuagaaacacuucuuaauauuugcuuguuuuauucuauguguaugagugcuucgcuugcuugcaugcacguguaccacauacaggccuagugccugcagaggucuagaagagugcaugagaucuucuggaacuggaguuacauguggucgugagcuaccauauggauacuggggauggaacacuagguccuuugcaagaaacauaaguguucuuagcuagagaagcuucucucuaaccccucuguggaacauuucagaugacugaggaaugugauaugacaugacugguucuaugaagacuuguaauaggaagacuaauguugucagcacgugggaaagaaauggaacugauuuuacuggggaaaaaagagguguuccugucaaaggcugugaaagggguggacucuggcucugaaggaacuaaagcccagagcucucaagcuggugaaccacagcuuuauguuaaacuggggaggcaggcugagaaggaccauggaccugggcucuuauccaugagacaagaagaauucagccauguuuuuucccugaggaguggcagggcaauaucuaugcugugauaagcucuuccuggcuucucucuggucacaacauggcugcugcuacuacuuuuagaaucugacaauuucuaauagaauuuacucauuaguucaaaucccuuagacuuuuagcagcaauguaaaggagugaugcagugugggucuggcagcuuguacaaaugaucgaggaccuggaucugugguucucaguuuugagaaggccucagacucucgagaaacgaggaacugcaucuuagccagauucugacugcuucugauccaggggaccaggcuccaguuugugagaaauauuguccagguaggaaaugaggagagaaucaggaacccaaaguccaaaacucagcaggcagccaguagaggaugggaccagaggcuucccaggugucagcuagguuccuucucccauucuggagggauuuucuuccaaugcacuugagacagauucuaaauccuuuaaguuuccucuaauuuauuuucuaauccuuucauauguggcucuuuucuuagcucuguguauuauccuggcucacucuguguguuugccucuuuauuucauuuuguuuuucaauguuuaucgacagccuuucuuugagaguccuggguucaauuggcaggcaggcgugaggagugcccugugugaggagcugaaaggagagaggcucauggauaaagaagacuauggcuauagacugauuugcccugcagcagcuggcugaucucaguguauagggagagcucacuucacaguugccacaauugagagcuguaugcagucaaggagggacaaggggagaccuaguugagguggguccauggucucucuuuuacuugccuccuucccaugcuugucuucagaggggcuacacauaggccuucucuagcaagaaguuaacggagcucagaauuucgacuuagcugucauuggggagagaugaaugugaagggcaaauagcaagacgagaagucacauggaaagggucacauagucuguggcacuguugcucgacagagagggacucagaagugaggccacaucuccugguccacgugaugccaccggaugguccugucuucugggagccuucugguauuccccaugaugucuucaugcagcacuugucccuugcuggcaguguucaugucaccuuauuuucugguuagugacuuugucuccugguagccuggaggauuuaaguaugugugccaugcuaagccauaagaagugccaaugggcauuguauaauaggaagaaacauuguuacccaugagugcuugcucuguguucuuuuauagcccguuugggacagcuuucaaaugcauucaggaauaacugacaugugacucuccuuauccccaaguuuguugcaguccagccuugccugaggucacugugacagaagagcuugugggucagagauugugucagaugguauauuaacuguggagugucccauaccccgggggccuugguuacugcccuggugucauuccacugggcccagaucuaccuagaacuucaggagcuugccagaggaggauacuaccuuucugcuauuacauuaccucugcugaagggugucaauacuuuccugccuuguaaucaucuagucucacagagcccuugaggggcauaaacaaagaagacagcaacuggcaagaaugacaaagcuuuuuucugggucagacuuuaacaguucugucuccuucaccuuugucccuaagacagccagcguugaacuuggaaagucuguuucuuuucaugcuuccccagccccugugggugaccaggcauuugugacacacacugggggcuaggaucuuugccacauaugugguugcccacacuucauuuauuauauucuggaaggaccauggccuugauaauuuauguuucugggcuuuaauugcauauucuaucuggagcagcuaucaggguuuucagcuugcaauugaaauuugauagcgccugggcucuuccuuguuggaaugauuuauccugguguccaagugcugagcugagcccauuucuuugaaaccaaaaaaacgcccacauagcaacuuucaacuuaaaugcugaguucucuuucgaaguaacagagcagaucuggguuuuuggaaccacacgcucugacccucucuagcuaguuuccucccgcagaaaaacggacaaccccuugcuucuucaguguguggaugcugccggucacucaagaagucugcucuaguuguucacuacagaagugaagaaauagccaaggaugcuguugggcccucggagccugaccuaaggcuccuaggaccacaggaucuccauaagugccuucucugagugggccacagugggcuuuugggucucuuggaaauggcaucaucaaagccuuuguccaguagucccugaaaggcuugauucauuccuucuucgcaauacauagacagucuggguagacacuaaguacauuaugaggagagagacauuagcaggcuauacuuuuggcaguauagccaaaaggaaacugaccuggccuuuguuuuggguagccuaggaacugguugaaaugccaaagcuuuguucuuaggauuuaggcuccaccuucaugcacuugcauuggaacuuucuguucucacagaccaacagaagggucuguagccuuuugcauuagucuguuuucacauuaccauaagaaaaugccuaagguucaguaacuuuauaaagaaguuuauuuuauccccaaguucaggaguggaagguugaggguuugcaucuguuaugucugcagauuuccaugcuggcucaguguagcacaugggaggugaaagagggcacacgugucccuuucggcuucuccuucuaagaaacaaucaguguucaguuaugggagguccacucugaucuaucuaauucugauccucuccugucauuccgaccuuuaaauuccacuuccgcuguaaguuuagcuuucuacauauacucuucucucacuuuguagugggacuaaauuuuaaauggacacuuagaauacagucucaaaucaaauucaaauaauaaugguuucucaagcuuugccuccguuuggauucuaggauaccaugaucaacucguuagacccucaggccugugugaguuacacuguccccacugccauguugauacuacauccaugucguaacugugaacugggaggccugacugcaggacucugucauguacguccuuuaaacgucuuugagaaucuuaguuuucacagaucuugauuggaauaaucugccgcuguuuaggguaaauuuauaaaaacccuuaaaaguuauuuuucuucuuguguauaaguagaaauuuugaccauauguggucaagauaaaagaaaaaugucaucaaugaauagaagaggcuuuggccuugucaaggguacguuggauauaaaagcuuauaucuuuuucaauuaaucaauauguaugauuuuauauuuauauauauauacauauauauauauauauacacauauauauauguauguauauauucaaccuauccucuaaaauuguguuucuaagacaauuauaugucaccaguaggcuuacacugcagagcacuugugacuauuuucuuguauuuaaguuugcuggcaaucugaaacacaugcuauuuuuaauuucaguaggaaaaauaugccauugucacuugaaaucuuaugacaaucauaguguuuucugcacuuugcauacugauuaaaaauuucaaguuugcugccuuuucuaauaccaggcugugcuuucugagucugagugggacaggugagcaucuuucaucugucccugaugccuugaggacuguugugaaccccguuauggacuuuguugaucauuucauucuuugagcacuuaaugccgaccagagaaguagggauauagcagugauuugucccucuaagggaagaaggaggagcccuagggacacagcuaaaauucuuuggcugaugcuguccuucaggcugaguccaaaggagugcuuagugggcgcuccuguuccugguggagcucuguggaacccagugcuuaaggacugaauuaaggaauaaagaggaccuagcaucagggcugggcugccacugacucuugucuauauccugcgucauggccucuuuagcugucaguguugagggagauggcuagacgaggcugaaagguagcaaggaggacucugucaauugcuuagaugcuuggaaguaagaaguaccagugaacucauggagcucaccagaacccacucagcagcguggaaagcuuacgcuugggucuuggccccggaaauucugauuaugggagagucccuagaauccaggguuaugcagagacccaggugaccaugcuaagaagcccuuuuagcagaucucuggaugacuccuaggucugucuucuuccuuuuuucuaccugcuugcaucuucagagucuucuucauaaagccaugcugaccucauaaauaggccgcucucccuacuggaucacugcaugcuucuguauagaaaaggaaacaaaaacagaaagaaaagguaaaauucucgugcuuguccacuuccucauucccaccgcuggccuuggaacacauaagccuaaccaugguacgcugucaaucuucuguuauucugcugcgcucucucaguuccuggcacagagcaucugaucacaaggagacuuucaaagaugacacaaugggagagggcugaacuggaucagcccuuucucugccucuuaaucucuguaucaggccauguuguguuacugucaacaaacaccugauuguuugguccagugccaugguggugcuguggcuccugcuugggugaaggccucaugggugaugucaucacaaaagcaggaccacauggcaggacagaaaaccagaguucaucccugagaacuguuaauaaucccuuccaaggucagugaucccagagaccucuuaaagacauucccauggcuuccugugugaacacguaugagggcacacuuaacccauaucuacuccacagcaucaucucuaggaaagacuuaagcguuccaggucggacaagggcuguagcucuuaucuagcucaucuucucuagcaggaaacucuggucucucuaaacaaauaauaaaagaaugucucauagugccuauguauuugggauuacccacugagagaugcuggcugcuggcugcugcuucuucuucuucuucuucuucuucuucuucuucuucuucuucuucuucuucuucuucuucuucuucuucuucuucuucuucuucuucuucuucuucuucuucaguaugugacuguuacaaagguaaccagcugcauuccaucuguugaucggaagcccagaaaggauggacagucauggagggaagccccugggguggaagacagaggugcugacauuuuaaacuaggcguuuugcucugcaccgccuucuacauuacugcuagccaucaccuucuccaaaccucccuugucccacugaaaaagaaucuaagugugugcgcgugcccaaauccuucccuggaugauaggaaccuccaggagaggaggaaggcugacuuccuuguguccucccacaggcacaguucugggugccuccaucccacacuguuugcauaacgggagcuccacacauugccaaggcugcaucuaaaauuuaaacgcauucgaauaagaauagagagagccuugggggaaagguaacaauuuccccuaagaggcauaaaugccgcgucuguguuucccuucugcuuuuggauuaaggaccgaauguuaacuaaaaaguaaaccacccccacccccccacccccgcucaucuuucgagcagugauuaauuugcgugcugcucuccuuuuaucuguugagucuuugaauuuuuaaaaacacaaagugggaaauguauuuccuaggggucauucuaaugcaccuuuuaauuguuuuguuuugaucuucaggcuguguuuuagcuugaagaagagccagccuugucuaaaggaauuucaucucgagaaucuggauucuugaugauguucagaugauaggagcucccggcucugagcauacacaugcauguuagcugguucugccuggccccugucugggauaggauauuccauguagucacagcugugauccagcagcauaacaggguuuguuauuuugaguuuugcaagcucuuaugagguauuuuugcauucauacaauuuuaauauuuggggacagguuguaccacuuuccagggaccaaaagugaucauucaguuuuuuccccuuuuauuaggcgcuaauuuagcuuggaaaauaauuuaauuuuuuuuuauggauacuuuguuucuuugaccuaguucucuguuuccugggcgcuguguccucagaagaugaaguuuauaauauuaauaaugucugcuuauuaauuccuuccgaaucaagccccccccccccugcaugcccugugcauccuucacauugguaauugccuuagggaagcccaugguguuucuugaaucagcagacuggcuugaguacuguuauuauuguuccauguagcaccauuugugugugcccaggguggguguaccuaagugaaggcucaagggccuucccaccauggaagagcccgucauucauaagcaaaaagagcugucagcuccugucuccucgaacuauaauuugcugcagccuggaaauggguaacuggcagcuauuaaaagggccuuggaauacuuugcaguuaaaagcgaagauauuaccagcugugcuuacacuuuuuuuuuuccucacagaaagacuaaauauucgggauucguaaaugcaugcaaaaugccacccuaggucaauucuuacacggauaguauagaacuaauuguucuucuuugccguuucguggaccucugaagcagagugaccuucuauugggugagcucuggcagucuggcugcugcagaagugaggugacaggagcuguuugccugugauuaggucuguguaagcuuuugcuggggagggaagggcucuuguccuuggccaagugccaccaugccugccgcaugcauuuugugacguuuagaauuugaaaaaauuuuuuaaaaaugccauuucugguuacagggguugugaugcccuccucuggccucugcaaacuucguacucaugcgcugaauauacaaacaugcaggcaaaauacuuauacaauaaauauaauagcaauaauaaaucuuuaaaaaacugguggggccuguuuagucagugcucuauugcugugaacagacacuaugaucauggugacucuuacaggaaaacauugaagugaggcuguauccuagguuucuucauucucauuauggagggaagcaugguggcacacaggcugacaugguacuggagaagcagcaggcagcucugcaucuggaucugcaggcagcagaagagagacucugugacuagcuucccaaagccccacucacagugauauacaaagccacaccuacuccaauaaguccaugccuucuaauccuuucaagcagugccccuuucuaaauauuccaauauaugagccuaugggaucauuccauucaaacucuggcagagagugacuggggaacacacucgugugcauauacuugugcaccuacaaacagagacacaguucuuuuuacaugccauaucucucugcuaauuuuguauauuacagagauguuguuuuguucugucaacugaacuucagaaaagcugugcauuuagucaaagcauuuaauugcaguaacuguccauguuaauuuuucuugacaggaaaaugauguaaguaucugagcuuaagggagaguuaggcaugacauucuugccuuggaaagccaugagucauuucugaaacuguguuagucagcuuucauaugacaaaaugccugugacaaucaacuuaaggaaguaaaguuggugguggcucacacuuugauaguaaccugggccaguugcauuuuggcuugggggagcagcacaacagaguccgggacccagagcagagcuguuaaccucuuggcagccagaaaauaggagggauggaggaaggaaaggaaggaggagggucagaggaagcagcagcagcagcuggagucuccacacacccuucaagagugugacuccagggacuccaccuucuucccuaaggcugcacuucguggcucuucuaucaccuucuggucaugucacagguugacaacaugggccuggagggaacauucaagaaccaaaugauagugauguguuaugugugucaucugcucagaugguaagugacucacaaguagcuucuaacuaggaugccucagguggucuggaucaccauucugccugggggagggcuguguguguguguguguguguguguguguguguguguguguucucaaaggucagcuugaguuuucagaagagaagauacagacaccuuggugacaagaucucggauggaaauuccagguuaauguuuuucaggauaugggggaagugaguuaggcacggagacuggcuuuucaggacagcuggcgugguucuuuauucauugucaugugcguuugaaaaaguguaacgagcacauuguaucucugauuucauugacuucuugugugagauagcacuaagcuacaguaauuuuaagagaaauauuaaguauacuugagcuggaauugaguauuucaaggggagucugggaggcacugaugucaggcaaagccaggaagcugcagagggucagucuugcugauuaguaugggcugcugaccucgggagcguuugcugggaggacgccaucauuucuuuauguuacaucauuuugucucacuacagcgcuucaauuacuaguacucuugucccauagaggagaaaacugagucuaaagacaguguguaauuuuccacaggccagaucuagaggggcugggcuggcuggaaagauggauagcauuucuguccauccuuacucggugacaggagcuaacaucaaaggagaccuuuaagaguaguuccguugcuaagugauuaggcaggcccuuggaaacaaauauuuauuuagagcuaaauuguugcaggugcuagcgaccucagacuucuucuugagccucuuguccagagaaagcuuugcucucuaucaggaugguagacuguguaggacacccucggggaacuucucuacauuaauaugccgagaauggggaaccuacagucauaacucuucuuguuucuguaauauuaaugauucucagccuuguuuuaccauagucuuuucuccuccuccaguuaaucuugguguaguuguagacuuuauauuggaugaaaagcccauuuaggacacagugugacauuuuuuuuacucauuuuauauauggaauaucaaagguccaugauaacuugguaacaucuaguuguuggcagaguuuguguuauuucuucauucaacagauacacaucuauuguuucccauguaccaaauauucuacuaaccauaaugaaaaauuaacaagagacauacauaagcagucauauaaacauuuugugauagcuggagugagaguuuacuguacccacuucuccaauaucauagucaugacugugagagaagguaagguguuaggacgugaugugguccugcaggucgggaucccagagaacccucaucaccucuccagaguuugcaguguacaaacuggagaaccuuccccagaaguugaccacacaggcacugggcucucagacuuccagccuccagaacugagagauaaaaaucugucaccaaagccugaggucagggcaccucuucugccuggauugaauaaaaaaacaaagaggguggggguggggaguaguggaaaguccgcuucgacugaguauucucaagacagagggcauguccucuucaccuuuaucuucuguugcucagcuucuuguaugagauagaggcaacagagcuugaauaaauauuuauuagauaaauuaacaaucuguugaugaguuggaauuuguuuccauucauucuguaacugaaguuaaccuaaucgaaacgaugcuaauguaaauuuguuuuagaauauguuauucauuugcaaauuaaaaacuaaguguuccaagagguccccagauugaaguagguuugucugguggucaccacaguugagaagcccaguucuaaacagcauugaccuuagacauucauuagaggacagguuguuuaugcaacaaguuguauuugaaagucuucuccauagguuucucugcauugcuaacuuguguaaauuuaggucauauauguugucauuccuagacuuuugauuauguuacuaagguaucagucuucaaggccucaccuaacuugcugcuaucaaccuguugguugggaguguaucauuuauucagauacaaauggaagucagaaucuuagggggacagucaauccuucauggguuaaauuagaggauucuaggcaacauguucagcuggcaaauuuucggaaagugcauugccugaagauuuucccauaaauacugagaacgaacugacgguugcauagcuucccuccccaauggagcuaauggcauuccaguagcagacaacugugagccugcccagugugcuagaggcucugugcauccaucgcugucauugacggcaggaaagguggagaaaacugacuguccucuacaguuuacuuugccuugcaaagagaguggaccuuggucugcacuuaacuggggacucccugcuuaaguaagucuugucuccacaagguccccagauuaccacacagcagagcugaacagguccuagacagacaguuaggagaagcagaucauuuaguugagggagaggugucaucaguuucagagagugguauuuuagagacugcuggugcguucucuuugguaaaaggacacuuaucauuuaggaaaagagagggggaaucgaaccugacauuagcugucaaucaucucuaggguucuuguagaagcuuccuuccucaagagcggggacuucccugagagggaaugacuucauuuuuuguggcucuaaagauccuagaacaccagacauguauauuuggaguaauguuugaguaauaugguaaauggaaagcaguugguuugcuuuggcugagguggggaaaaccuuuagaaguuaguauagagguguggguuuugccauaccuguggucugcaccagguuguccgaugaaauggcagccucucgcugcugaagagaaacagcacaggccuucucaugguuaggaaagaacuuguaauggggaagacuagguucagggaaagagcauggcacccgggagccugaaacaguugagacuaucaacugaguuagcuguggguuuaugcaguguucuauagguucacauuccuucucuguaaaauggccauaauaauacagaccauagacuuuugcugugcaguauugaacaugccugggauacaauagcguccaacaaaugguagcuuuggcucugaagcuguaucagucaugcccuugccagguccagaaaggagcucugaaaugcccuuuugggguaccugaggcucagugaccucauccacagggaccucaugguuuagugaggucugguucuugccuuggggcauaugacuccggaaucauuuuacucauucuaaaacucugcauaaauugauguugcucacccuucuguccugauacaccuacuucaguauuaguaaaauccaucaaaacauugaaaaugcugaaagccaagccucgugaguaaacacaauccuguuuggcacauuccugccagcagcuggacucuucuaaagaaccagggaagcuacaugaacaucugcauuaaugccagucauaugcuguggcuuguacugggucccugaggccaaagcaaagcagagauuggaggugggguuggggccggagguggggcgggugaauuaagccaaucauauccagcuccucagccaggaagauguaaauaagacuuccaggcugaaaacuuugaugaauaaugcuggcuuguuucugugucacauuucuuucuuuggaugucaagcacguaaccaacaaucgauaaauacugugugcuuguuuagugaaucacauuggggugagaagucuguggcuaauuuucucaggccgggauuggcuauaaucuuguuagccagauguucuaagcaucagagcacagcagucugacaagccacaguuaucucuguugcacaaugcaauuggaucgugaacugcauucuuuaaaggucacuauuuuuauggggucagaggcaccacaugucuguguuugaagcggauuaugugcuuucuggucucacccaggacagugcagaaacacugcgaccuucaccuguggcuccauaccccuguaguuuguagccaccagcggccacagagaacugggucccugaaaggaaagcuagggcuguaugggaagcauagaugagagaaugagccaagacaaaguucucugaucaaggcucaauguuuaauucuaaggucugaaauuuaaggggggggggaacccaucccccacuuugccaaggaucuccucgggaagacaagcucagcugcucggccgguaguggcuucuugcuggaagcuggcaggacaauagacuucaccuaggauggaagacuccacccugggugggcuagaugacuguugcaaaacaaggucugaauuagccugcucaaggcugggggaagggcacagaaguuaauuuugcugcaccuguacacuuugagaagugggacugauuugggccgguguaacuagcuaacccucguagcuagcccgcuucugcugaagagacaaggcuguucucauccuggccguuggaagagcauucagugaagcuggagcuaucccuuauuucaauaaagacuuuaauuuaucaccucuuccuuugaagcuucauccaccuugcuucauauucaaaucccaaagaagcuagugcugaauggaguuggcagcuucaaaaccgccuggaguucagaagucuugauuauaugcgagaaucucuaggcucaaguguucuuagcuuugauaucugggggacuauccacaugggcgaagauguaucgcauaugggggcgagaacauugcgugugucccaaaugaaccuugauauuuugcuaagaccgcuggagauagaacagaguggguuuguaaagggugcacacagacuugagcccugcuggcugguaauugcaaaauaugugugccccagagaucagaaaguauucggugggcaagguaaagagagucaagcuggauggauuaagaaaauaguggaaaaagcugagagggaacuuggcauucauuugguauuugugucuguuuuucucuugaaaugggcugauguguuggcagcagcuucugacuguugucagagauaugaacaucugugcuucuuugcagaaaaacucaggguucugaacugugugguagaaauugugcaaugcugcugcccuucacucugcacccucauuagaggggcccagccucugugcaaauagacuugugcaagggagguaaugagcauugcaggaugcuggcucuuuuggucuuuuuuuuuuuuucccugcauguuccaacaaacuugauuuuccaacagugagcucuaaggcuuuugcauucacaugugcacacucuguugcuugguuggaaagaagaacaaaagauaccaaguuagcaagguaauuggggugcagacguggcagagggagccauagggauguguagaacuugagugacauguucuuggaagccuuugcuuccuuagucacuuaguuaaugcuaaaugcuguuacaaauguuaaaaggaaaaucucuuagacuaauuaauuaaauucaacagaguguagugcagagcaauuaaaagcaaagcaaaacaaaacaauuagugaauugguuaguccacagaugcaaaacaagaggaaaacucaggccaauaugaucaggcaacauuuagagucagaaagcagaaauuagauauagagaagaucuaauugguuauagcauaauugguuaauuaauuauggcucaccauuuuacauuauucaaauuagcuggccuucugcaauuaagugaaguucagcugcuagaacugaccaaaaugggcauucacaaaaguagauuccuaaauuagugaguuuauuuagcaugagugaauaccaauuuuuauugaucuguuagggccagaaugcuaucauggcuuuaugcaguggcuuccuaaacauuuuacucaguauaaauggcccccaaacauuaauaguguaaugcagugggaguguagugcuugauugcuucaaagucuacugcugggcaaguggguugcccuggguaacaguguuuacuugcaggacacccuguguucuucuagucaaugacauuuauagcauacgaagagaauucugggacauaaaguuuaguaguguguuuguagaaagugcaacugauauauugaacaugucauguugucucugcccuacugcaaauuuuuccuaaacagugcagaucuagguugguugaaacaaauacuuacucuuguauucccagguaaguguacagcucucaacccucaucaaagaauuuucuuuuugcaguggucagauaucauuccuaaaagccauaacuggucuaaauguagagaucaagugacuguugggggcccagccuugauuaauacguuuauaaagcaauccuuauaccugaggaucagggaacaugacagaagaaacauggaaagauuauaagagccagaggaccagaauaucugcuuuaaguaguuaauuauuuuuauuuuauguauauugguguuuuguccuuaugugugucuguauaccauaugugugccugguuuccagaagagggcauugggucuucuggaacugggguuacagcuggcugugaaccaccacaugggugcuaggaagagcaaccugagucaaccugguucucuagaagagcagccaaugcucuuaacuacagauccaucucuccagcuccccuuaagauagucuguucuuuagaaauaaauggacaggaagauggugaggauagggaagagguguguguggggggguagauccgaggggaguagggggaagguggggcugugaagaugaucaagauacauugauugacauuuucaaaaaauuaguaaaaauagcauauuuuaaaaagaaaaauaccaggcaguaaaauccuugcuuauuuauaaugaggaugagcagggcucggucauuugaaaguuuuuuuuuuuaacugcuugguaaaugcaucucugcuucuugauguccaaauaugaaauguguuuucucugauucauagccuaauaaaaguguccuugcuuggcgccccaauggagcacuuagugcuggcaggggugugccggacagccacccucacuuugcccuucagaguaaaaacuguucuagcuuuucugggaaacaaucugggcaugugucugaacacucgugacugugacugugguccucucagccucugccugccugggagggauguuugacagcgcuccaggagaugugaagcccacugcuccuuccauuccucuacacagaaaucuccucucagguacgaaacagacacaagcagagcgugccuauuggggucuagaggauuggggucugcauagaaaguucguaaggugcagcagacugucuggaaccuaggaagugcucccucugucgcugucugcucuagauaaagaugcucaaagaugcuugcccugcauuuggacauaugggaaaaagaaaccaacugugcagugacaguuaccuaauacuuuuacuauuuauaaaguauuauaacaucauauuucauauuuacugaaauccuaaaaggacaacaaggaacaaaaaaaauugcauuuuaaaacagaaaacagauaaagccaauucaacuuaccaccaaaaacacugaguuaaaauccccaggaggcauagauucagagguuccaucuucuuccuccuguucccuaauuacccuggucucuaccgaggagccuaacccaggggcaguguggucuccugucaaugcagagcuuaaguccagggauuuggggcagcauuuauucaggauauuuuguauggaaguucuagaacacaacuuagugcaugcuguguuugaagaugguuuguuccccagaagucaaguugaaguuuagucucuagagucuuuuguuaauggcaucaagagaguuggaacuuaaugugaggguagaauucagaagugaggucuuugggaaaugauuagauucguagccggccauucagguagagcugccguggcugagucucugguaaagagagagcaccaacaagauauguaugcuccugccauggugcuauauggccaaggcagacccuugccagagccugcguccuguuguucauacuagccuacgcaauuaugagagaacuacaugacuuuuuuuguauaacauuauucaccucugguacucuguuauaguaaccacaaaacagacuaaaugugauccuagcauugauuuccuaggagcagcuuuggaagagcacagugggccugagggugacagcuccuguuccuccucuuccuacucuacccagaagcuuaacucugcaguugaaaaaggacuuucugugaagucuguaggacuguguacucacgccagaaauaucucagcuccuaccuagccuggcuggcauucugcauguaguuuagucuucggccaaauauuagaagucuagcaucagagcugggcccuugacucuuacugguuuccuuguccuagccaguaauccuugaccauagaaacugaaauuucccuuucaucccagcuuggugaccaaugaccuuucuggugucuaccuggagacucuugauucugccugucuguugauggaagaaucauauguuccugugucugccgucuccacgccaggcucggcccaguacuucuuauuucaggccuacugaugcuggccugguuacugagcucauucugacacauccaagggaccaauauuccccagacagagccccacuagggcagcauaugugcucccagaugcugaagcucucucucagucugagaggcauagcuuagggaccggauagacucaauuucagguucugaaaucuccccaugggccuaaccucauuguagugaacugggccaggccacuagauacugcauuuggugaucuguuuuuaaguuccucauugccgguguacuuguggaguugcaggcugcuguugagggagcaggggugacuaagcugcucucaauggcgcuccgccuacaaagucuagaaaagggacaggaaauagguguuuuaguuucccuuagcacacagauugaauggaguggcuagugugaauagugaggaguggcugaugagcacucugggacaggucguucuguuucauaacaaacugcagcaaauaggauaacugcacccaguagaaacugccacuguuacagcucuggaaacucggucucaaaggguugagagauccaaccuccuuuugaaacuuuccuauuuuuuccagcucccgggagccucugggguuuacugacuuguucagaaucuucuccucucuccauaugacuguccccugugugucuuuguuuuuaugucgcguugcuucguuuugauaaccacaccucucacgauggaauaaaaccauuccucaugaccacauuuuaauuugauagugucugaaaugucacguuuauagacaaaggcugaggacuugaauacaucuuuucuguggacacaauuuaacauaucagcuaccuaugauuuuaucuuccugccccaucuccaguuguauggccacuagcagaacaguuuccuugcucuacauguaggcaauaacgguaucuucuuagggguugcuuugagacuuaugaggucauguuuggcucugucuggugucugucaugcuaagaaggcguggcuuagcacuucuucccacacccuucuagucuuuugguuacacaaaggaguuuggaagugcaugggccacacacagacauuaauguugagauggagccagaaagugaauguuuugaauacugugacacaguuuuuuguuuuguuuuguuuuuuucuuuucugcacucaaaugcugcugcaggcuuguugucagcgcguauuaugcauuugguugugaggaaucucuucagcuagcugcucuuuaaagucagugccagggaaucugggcauugagcugaacagaguguugcucuugagguuccagcucggaggccuguguacugugcaccuucguuccuggccuaccauccaagugcugcucuaugugcagaggcgcagcugcacugccacucagcuuguggguccuccuugggguuuagugagguuaagagugguuuguuacuguaugacucuugaaccacgagugacaaucugcuuguuuaauuauguagugggacagagauuucugauuccaaaaaaaaaccccaauauuccauggcauuaaauuugaaacuuaggcauuuauuuacugagagucaaacucuucucugcucuaucuccgugaggcuugcauuaucaguuucauagauagcugacaaaaugggugcuuuguggcaaugccugaugggaaaagcaguugcuacuuuugaaggccuaaguaaagcuucauuucugagaagcccaauuaaggaguuaucagcagcuccuuuauguuccguacagaucaguugcagaucuuaaaacagaacccagacuuuggaugcucauucaguggagcugauaaguggaacugcaguuugcagauuucauuuucaaugaucuaggaccuuggauuaagaggcguaaagauuccauuauggcauauuuuuuaacuugauuguuucuuuucuggaaauuuuauucuuaaucaucuucuggaggcauaguagcuacuggucugugaguuauugagguuuaacuuaugcuaauacacucugcucuguuuucuucccaaagcaaauaaucaaaaauuaauguguaaguugcauccauuuacuccacauugagaguuguuaucacuuaaauuuuuuuauuuucuuuuuucuauagucuugcugaccuuuuggaagauacacuguucauguauuaauauauuaauuauuuuucuucucagugugaaugacuacaacccuaccauguacauguuaugcaccuaucaugauuaguacuguuagaguacuuuagauagauugcuauuauuauuucuguuuugagacagggucucacucuguagugcuagcuaccuuuaaacuauaaaaguuacuuagacuauguuggccuugaacuucuacaucuugaaugcugggguuagggacuuguaucaccaagccugguccugauguucgauuuguauaucaguucuccucaaguccugcuuugauaacuuucuguauaugauaauuauaagugguggcacagagaaagaacuaaacuagauaguucugugauuugcaaaaaagauuuauuagggagcaaacugucaucaccagcucugggaguagggggugggagguaggauugggcagagagaaaagaaaaauggaggaaaagcaaucagauuuuauaugacagcaaagguggcgaucugcugugaugcaggcucucuggguugacccggaacuagucccuugccaguaguugaccucuagaggaaggcuaaggaggagauuccuggaggauuaagggagguucuccgugauacaaaaugccuuaagaggcauaauuuuccaugaaaacucuauuuaccugauaacaauccuucaauugucugaccagaguccuccaacacugcugcuuugaggaaaggggucuuuagaccugacgauaguaaucuggggcuuaugggaaugaccuugcaaaggcuacauguuuauaaaugguagguccagaacgugaaccuaggaugugaugcugaacccuuagauccuaagcucuauacuuugguagacuuggugcaucuuugcauuuuuaggagagaaauaacggugcaauccagagacuuacagugcuuugagugggcuccgaauugucuuugccgugacacaugauguuuuuuuuucuuagauauuuucuucauuuacauuucaaaugcuauccccaaagcccccuauacucucccccucgauuuuucuuuuuuacugaauuguuugguuuagagaggacauuugugcuaaguuaccuaggcaguugcuaaaaaucacugugaauuagucaacuaagccuccaaguugcaagcgaaauuguugugaacuuaaaagauuuacgggccacacacagauaagggacaguugacucaggugcuacuaagaggaucacucuguccuagaguauuuauuucagaaugucacuugguacuugaguuugugaaguaaauagcacuaaggucaaagcaauuuagauaacuggcuuaaaaauuauauauauauauauauauauauuuagcugcaggcauuucucaagguucuuaguacaugcuguguggugugcaggcucggagagaacaaagggggcgucuguguuuucaagugguucugauggguguuugauuguucuuuuuauucuggcaggaugagagucguugacugcacuuaacuguuauuauggaauuuuccaguauaguggcuaggaugaauuugaagguaacagacagaaaccccaaugcugauuggcugaagcaauagaagauugaccaggaaagguuaaagaugaggggagcugcagaaucaggcuggcucaaccacucucuagaucauucaggacuugguuucuuucucuguuucugucccuuucaggcaagguugagccuugaaacugggaauaggcaaauuccucaucaaacaagcaagguagucauggggaauagccagaauaagagucuuauaccuuuuuggaagaacagauguugcgugguugcuagaaagauggcagcaggugucuaugauaacuggucacuugaauacauguuaucaauuuauuugugaguggugagauguuuuugaugaaucuuuuaauaguugccccuauaaaaaagugauuucugguggguucuauaggcugccugucugcauucuucagccugccuucggcaauugcacagacugauaagacaauuagugucaguucuucacaucaaaggcaaguuucaguuuuaauuuucuuaacgaaaugagugucaugauuuauugcugugucauuugcauuuguacuuguaucaauuucugauaaaguaucuugguggauauaaguugacuuuguuuuauuaucuuucacauuauuaccuacacagugcuccucagauuucgggaaaugcugcagggugcuuuaauguaccccgggcuggagcuuucagcagcaagaaaugcagucugggcugcagcuugcaugccauaugaguacuugcuuuuggccauggggauuucuuuugagaagugaaaacuguuugcagaucacucgccucauuuggcaguugcuguuugccuucaagcaccggcuuguaucucuguacucugcuguucaguguaucaacugauuauaguuacgggugaggcauuuugugugaguucaaagucgaaggagaaaugaaaccuuccuggucauucauacuggucacggagacgagacagucacacagaaacuuuaaugaucuaguaugaagugaggcuugagcagaggucuaggagacucaguggagugaaugagagaagcacauuugauugggucagggaggagaggaauuuggacauguagguuauugagaaaagggugaucuugccuagcaagagacuaaauguuauaaagcaguuaaaacagaaaggaaauaagguaaugcuuuaaagaaguagugauuuauuguuaugaaaccgguuacccucaagguauuguggcucgaccagcagugagcuucucucuguguguccagagcucuagcugguuaugaauccaggggcccugagcugggugcuucccaauaaggguccuuuacuuaagaggagauaguuagauguuacugaggcacaauuaucugaaguaccauccagggaugccagagucauuccagagugagaugcucacaugucugucaaauucugcaaaugggggauguuguuugaugggggaaugcugugugaacauccuaauggcacagcagcuggccucuagagaagaaaccagucaguuuacggcugugugauuuuaugcccgagucuuggggauuacaagaaucccuaccuguugcauaacacucaguuaugaagaaagggggaggggacccgauucccgccaaauauucucggaguccaguaacagggugagcacguguguggcuucaaacagcaaagcggcacgguccaacagugggcguggcaaaacgaaugaacaaaaaacuccaccccugagcaagcagguuucagacugggggaggagagacuacaccuacccaaauguccaguguguuuggaaagacucagagugucggccaucuuuucauuacugugauaccauacuagaacccgucaguuuuguaagagggaagggugguuuugguucagcccuagagauuuaaguccauggucacuaggcuguguugcuuuugugcauugguugagaaagugggccagcucacaauggucgagaauccaagagagaagaagaggugccccugaaccaguauucacacaucuaacuccuuuccacaaguugugguaccacgacuagggugcuagccuugcaguuugggccucuagggggucaguuacuauucagaccacaggggcugcugaggaagguugaggaagagaagggacugacacuuuuuuuaaaagggaaaagugucugaaagaaugcagacaccuugcaaaaccaaaagcacacagaacagaaacaaaaacaguaucuguagcuguguuucuuuaaacuaucuuuacaugaauauucauaguugguucaguauuguagcuuuuuugguuggcaaaccacgguaaaaauaaugucuucaucuacuacuuuuuuuuaauauuuauuuuuuuaaaaaaaaaaaggauuacauggacuggagagauggcccagugguuaagaccauuggcuucuccuccagaggucaugaguucaauucccagcaaccacauggugguucaaaaccaucaguaauuggauccaaugcccucuuuuggugugucaacgacagcaugcucauaaaauaaauaaguaaaucuuuaaaaaaaaauugagaacugaagcuuuguacagaaaauagggaacaugccuuuggagcacauguuagaaaugugggaaugacugaggcagagccucccucaguucccauguuggucccacaaaacucuggcaccccaagaauggaguugccuggaagccacucugugaaucuauccauccaucgaucgauccaucgauccauccauccaucauccauucauccauucauccauucauccauccauccauccauccauccauccauccauccauccacccccgguggauaagagcacugacugcucuuccagaggacuuagguuuaagucccagcauccacaugacagcucacaacucaaugucaccacacagacauacauguaggcaaaacaaugcacaaaucaaucaaucaaucaaucaaucaaucaauuaauuuggaagaaagaggaccugaaauacaacagagaaagucacccacuagagcacauugccucuuuuguuuguuuguuuuuuuguuuuuguuuaacacaguuaaagggaaaagaacaaagagaaacaacacauuaauuaaagaauauugagguugaaaaguguaagaauguuaacuuuuucuccacuaucauuuucuacuuuuucacugcuacaauucauggugcccacuugugaguucuuuuuaaauaaagaaugcugugcuuaugggaagcauaggagaaccaguggcuggucuuaagaguuuacugacagaggugugugggaaagggugcccauuaacaauucagugcgcccuugggauuucccacuuagaauauuaaggaaguggaauuucuguagcuugguaauuguuucuuaaaacaauuugcuaaagccagccaaaugcucaguuaugccuccccacuucccguucuggcugcugggguucuauuaugaaaauggagaagugggggagggagucccaacucuuccuuagcagagcacagcuaggcccaggcugccuucucuuguuuugugcucugaccucccguauccaaucagguacacuggcucagaaaguucaccguuggcuucacuggguaaaaacuuuuucacucagggcuucuuuauuuguauuuguauuguucaucuugauaugugacccauugguucuguuuuucaccagcacuagcgggauuggaauggaaccgaggaggagggaagggagagcaggggagucuaccuggucucacuauguagccuugccugaccuggaacugcuagguagaccacacuggccuggaacacacaaagauccaccugcuucugccuccugaaugacuaaaagcaccaucacacaguaaaguaagucuuuuuuaguaaaaucaugacagagugugauuuuuguagcauuaucuggaaguguggauacgaaauggacuuguggggcagagcaaaccuugauccugcagaaguugcugagcucagcaugagccugcagaacucagcugcagacccaggguuugucagcacaacugggcuucuaugaugaaccccacgaaccucaccaguucucugcaaucugcuggacacuacaaguuucaggcguguaccucgagguugugaucuuccaggagucuaaaguuggucuaaucuaacuugaucaauguuuaucagggucuagauggcaacuguccuagugacuuacugauguauacaaagaagccugaaacccaguggcuucuaaagcaaccaugcuugcuuuuuuauuuauuaucuguuugauuuaugcuuucugaagauggggccucauauagcucaggguggccucauuguuaacagagcacacucuauguacuaugugcuuugauaaaagaucagccaccauacuuagcaacaaaguuugauuuugccccugaaauuacacuccugggcagaacugagugaguacuccauggcugggcuuauguggaguucaccaggaccagugagugaggacuuucugggaauuuaggccccuuaggagcccccagcacuggggaauuccucugucuuuccucaccucucccugucagcuacugagacuuuuauugccucuguaguuuugcuuaaaaaaaaaucugugaaguugugauccaacuuuucauagacuuuguagacagauugaugcgcuagcauggcggcucgagucucagcagcacacuaggccaagacaguuccauggggaagagguuuuacugggagggagagacaagguggcgauaggaagagaagagggagagaagagagggagggagggagguguguucuccuuauuuaugugaaaaaugacuuaacacagguaaaggugggaggugagccaaguguauucugggaaaaugguagcugucaucuugagaacaggucuguaggucgcacugucgccuaugugaugucauagguuugggaggucccgaugccaacacagauugcuuccuuucuucagaaauaaguguuugagauuaacucauguuuuuguccauggcuugauaacuuccuuucucuugcucaaauuucacuguguucaaauaccuacaguuucucuguuuauugaagggcauuuugguugcuucugaguuugggaagugauggguaaagcugguguaaauauuugugcacaugcacgcgcacacaugcacauauuacauaagagucagagagaaggagagaaaaauauccuuuaaacccaaucuuuuguaaugaugauauuuuacauaaccuuuucaagagcaggaaaguuagguuccgugacacacucaccaguaccucuucuauauuuggauguuuacagcccaaaggaauguuaguguuugugugcucuccccagcugccaaccuaaucaagauucugaacuguuuuagucuacaaggaaccucucuggagcugccauuuuaaaauccauagucuaaccccaguccucuucccuggugacugcgggcauggucuacgucuuccaaaacugucuuuagguuggccugaaugaacacucgcaucuguaaaacaaggagcuuccccccucccagaagcugguucuaaggaaguuguaaucugcaucuguuuucugcagaaacugacacgucguuauuaguguuaaugcggcagauggaugaggcugagauuauuuugugauagggaacuuacacaagguucauuagcaaauuccuuuaaagaacgacccacuuuaccucauuuaaaacaugauucaauuugcccgaacauaaugugugaauaaauuuuuagagggaacaguaauuuguauucacuaaccagcaaaugauaaugugguuaaaaaacuagcaaaaugagagagcauaagugagcugggagaguggaggcgaccucagggaggcaaccucagggaggcgaccucggggcuaugcaggugccagagagaguuuuauugauuuuacugauuuauuaaugaaauucauuaauucaccguacuguagacaagauauauguuuaggauaucaggauuauuuuaacuauugagggcucagagagcacagcaaugugcacgagaagccaacguagcacggcuuugaaaggaagaguaagaguggcccauuuugcucugaggcuuugaccacagcgccagucuccaggcagugccuggugugguguaaauaucuaccuggaaaucaacguuugugccagaaaauucuuuaguuaaauugucaaaacaacuucacuccagaguuccaaagcaugguuuuucaaccucugcaguauuuacgcuuugggccagauaaauccuuucggaugagcauauuaguuuucugucagugugaaaaauaacuaagaaaaucagcuuaggauagaugcauuuuuuguucuugcuuuagcagucccagcccauggguggcugccaccauuuccuuuugggagugcauggcagagcaggguuguucaucucagggcagccaggaagcagggacuucagcugucaccgguuugccucccucuucucugcuguucuuacugugugccagccucaauaugauggccucaaaacacagugacucuuagccuccaggucauguccuaugccauuugucucugggaacauauucgcaaaguccacaaaagugugcuuucguaacuucuuaggcaucauucugucuagucaaguugauauuuaaaguuugccacuguaguggguaguguaacuguuuguaguguggugugauugucaauauuguuggccagugugcacugguuuccaccagcacuagucucucagggcaggaagcaucacuccuggguaagaagcacuucuuuaucgugugugcacgccagcacacacacacacacacacacacacacacacacacacacacacaccaaacauuccuauguagaguaaauaauuuauuuuuggauuuauaguaaagaucuggugcuuagaugauguuauuucucuugcuuuguucaugcauuauuucugugauucagucuuguaucuagcaguuuauacuuuuuauuauuauuauuauuauuauuauuauuauuuuggguuuucgagacaguguuucucuguguaucccuggcuguccuggaacucacucuguagaccaggcuggccuccaacucagaaauccgccugccucugccucccaagugcugggauuaaaggcgugggccacuacacccagcauaagcaguguauauuuuuacuguaguucauuaggugcuagcuuguggcugaauugcuuccuaccauguagugaaggcuuagucucccaucuguggaacuuuuuggagauggcuaugccuuuaggagguggagccuggaguuagucacuggguguggccuugaaggagcuccugagacccucaccucuccugguccucugucuuccccucugucaagagugagcaguuucccugucauccuccaccaaaacacaccacuccccccaugaugcacugcuucauuacacagcaagaaauaaucgggcuagccagcucggcaaaaucaaccuuucaccuuuguaaguuggcuuaucucugguguuacuguaacugaaagcugacuaacaaguugagccacuucaagacuguguucuacuuuauuuaucuauugcuagacacacagcuugcuuuuacuuucaguauaacaaucucauucuuuaaugauuaguguguguguguaauccugaacauauaugugacagcucuggacauugaagaaaagcaccauaaaguuuauccaacuuuauuauaaaccagcaagcacauugcuuucccgagacaccacgcuuucuaccuccuucgagcagugucugugauccuguuuacuuuguaucaugauugguguuucacacggucuuugcccaucugaagagucacaugcuauuuuauuguugcuuuauuguguuuucugaucaccacugcaucaucaucaccaccaccaucaccaucaucaucaucaugcugucuugggaaggacucuuaagaucuguagccauacauuuuaaacaugcaaaaaaaccuccaaaacaagcacaaaacaaaacaacaaacaaacacaaaguuuugaauauuuuuuuuuauuuccacucuuccuucuaucucuuuccucggaaugccauugcuucccugguacaugucccucauuguugucacacugacuuuggcaucucaucaaauagacuuguguaaggaggcuggcuaguauuagcagaaaaaaacaacuaaggacuuuagcaacacacauuucucugcuuuucuaauuaaaaauaaauuauuuuaugaguguuuugucugcauauaugaauauguaguguauaugugugugacuagugcucauggaagccaaaagagaguguuguacccucuggaacuggaauuauuguaagccgucaaaugaguagugggaaccaaaccagauagguccucaucaagaauagcaggugaucuuaacuccugaggcacuucuccuguccccuuucacaacuguuucccugacccuguugcuugcuugagugguggaaugagcccuaagaggcaauaggugcaggagacagucccaaaggcugguuucucaacucagacccaguccacgcagccgagauuuccccauugcugcccgcagcugcagccgacuggaacugcagauaagagaauaaagaauugauauuguccuugggagaauggaggccagucuccuugaggcaauccucucagaagucggcuguugggauguucauggcuggaguuagcggaacagguggguuccucuguaaugacuguggaaucuuggcaaaagcuggcagucccagagucagccaguccauguuuaaacuuccuaaggacaaccuuccucccagcaaguccuccuacuugacugcagugccgcgggcacacaugcauguugcauugguuuaugguggccagagcugggaaaucaagcaguacagugccugggaggcagcaucugugaccuugugcauuugucacaucauagcuaugugcguccauccaggcaaacuaaaaguguauuuguuuuacuugaaagaccuguuuuucuuaaguuucuauuaaacuuggaagugacugcaggcaagcaggccuuucucagagcucagcuuugugaccuuuguguguguguuugugugugugugugugugcuaaaugauagacacugugugugcaaauaucuuaucaaacuuaagaauaugucuugcguacaaaagacuguccuuacgaacuuuuacagccuacugcacacaggccuguuggagaggcccuucuguuccuucugcagaucuguguauugagcagacaucugugggugaccuaugcuaggcagcauacugucacagagaggcccuguccucgacagcucccugcaaacagaugcuguagucacuagagagaagagagguaccaggcagucucgggcagagaggaagaacugaagaacuagucuggggaaauuggaaauguuuccaauaggaggaacucccugcuguauccugaauacuguagccuguggcugugacggagagggugggggcagggugaggccuguaggggaggagacuguagggagagacuauuaaagacagaggaaacagucugugcaaaggauaggagacagcugacuuaggauugaaacugugucucacugggcucugcuggucuuuuagucugagguauucagaacacccaugucccacucuugugggugauucaucgcaagagaaucuuaucgcucagaaugaugcuauaacccaugucaguacccagcugguggcuccauuacuauugcuucauugagcaggccccagugaugccucuaaagggaacuuuggucagcaaaggcuuucuuuuggcauauuucauggagcuggaacucucagugaggccuccuggucacgugccauuugcuuuuuauucagaaaaaagaaauucaaaaggagaaaaaaaaagggcaagagacauagccaagcaauaauucauuuaaaaaaaacuacuuacaucugcaaucuacuuagaacuuaguauuuaaguuggcauuccaaaauacaaacaaaaauguaugagcaacucuccaggaagcuucuggaacuagaaaaccuucuuucuuuucauaaugagauggaaaaccuagcuacccuccacagcagaggaagugcugccccaagcccgcgcagccccaggccucacaggugggcgugcugaaguauguauugcauuaucaggaccucugcggaagccaucugggagauuuauauuuacuagguuguaacuuccagaaacaaagggagccucugaaccuauucucuuccugccaaaguugucauuauuggugggagcccuugggaugggcuagccagcugggggaauggcaaagagcuaaugugaacaggagaaggaagcugugggagcgagccacugacacugcugagggcuucccuuaccgguagcaggaaguggggagccacccagggauggggcuggggcuggggcuacuuuuccugucucacagaaaucaugggguucaacaaucccacgguaucacauguccaccuuuacagggucagaaagacuaguucuuuguugugacuauugucucugcucacucuccggccuccagaccccuggcaauuaccauuuaugaguuucuacaguuuuuuuuuucuagaauggcaaaaaacucaagauuaugcaguaugcagccuuuucguacugaacuugaaagaacucaguggggaaacccccacucagcucccgauucggcgugcacccaagaaucacgaauagaacacaacaccuugauguaacaacaagagguuuuuuuuaauggcggagcuccgggucgaaacguaucucacacaacaggagacaguggauucgaccacgaggcuuggaagcuagggguuuuuauagaaaaggaguggggcugggggaggaauuggcgcgguuucacaugauugguccauuuaaacaucagcagccuguaacauuuaacuuaggucagaggggugggagcuagggaggcgaugggcuugcccgggcauguccuggucuguucugcuauguucucagguuucaaagcucagaaacaacucuuugggcuauuuaacauacauuacaugaauuacaguuuuauuuccuuucaaacuggccuucuguugaacagcucauguaugugccuacugaaggacacgucgguagcuucacaguucacuucagcucacaaugguuucuuguggauauacauacagucuugacucuuuuacuaaggaaucucaaacgggucuuaaggucuuuccagcugacagaaggcagccacuaguucuuucugaaucucucuaaugucuguucaugauucccagcuaugaggauauguuagcccaaaguccgcugcuacagugaaaucccuaagaugauaugcuaggaagaccaaaggguuauuugguucacggauggcuuuagguuucgagguuucaguccaugguuagcuggcucugcucuuggggcccugguuagaacaguuaccuuauggcaucgagcuuaauguagauccaccuugacuaggagauggagagaaagggagugggcacccucgcugaucugccuuccucacaucagccuccuuaaagcuuucaucaacacuuggaccuuucugaggacauuucagauccaagugauaguaaugauuaguugcaccaacaagcaggccucuuauuuucaucagggcaguauugcagugggaaaauauguuucucacaccugccuccagguucauauuucaaguuccuauaagaaaagacagacuaauaauggagaaacauucagaauaauuuacuaugagcuuaggugaugacgccacaaaucaggcaagucugugucccugugaauagguuugaggagagacugugacguucuggaugggcagggaguuuaggaggacccugggauggauuagugaaauaaggagacugcaugacucugugugugugugugugugugugugugugugugugugugugugugugugugauggguucuccagcacugcaagacagaaagcuuggcugagaucucugaagagagaaagaagggcccauaugucaaaggugggagacuuuucuuaaacuuugugagaaucuaggagauuuuacagcaagagccuacagccagacacucugaucccaggcuggaugcaaggaagagguuggaagcaggauauaugcccuuccuuccaagagagcacauaacuccuuugauguuaauucacuucccaggugagaaaucccaggugacccugggacacugggacagucuguaagcaagggaaccccagggucucaguagggugucuauugugucugugaaggggaaugcugcuccagauaguguggcuugagccgagguuagauucuagcauccuauggauugugauugcauguagaguaugauccaaccauaaugaacuggggcaacuuuacaaggccuguuguugguucagucucuugucagucugcagcuucaggcccuuccugcugagcacagagagacaccucucacuggggguuauaugacuugcacagcagggaaggucuaaaagucauuucuaagcuuuaugacucauuucaggagggaaugaugaggagcaggugugagugaccuucuugcuucugcugugacauuuuuggggguaguaugcccaggccaccaucuccucaaguuucagacaugagcuuaggaaucccuacaggaaguaugcaggugguauagcuuuggggccucuuaauugaguucauuuucucugccaguaaaagaauuaaaagauaggaaaauccugagagcaacagguugcagcagagaaauuucaagauauugcagacaacaucagacaaagucagcaguugaggaaaauuguuuucuagggaucaggaaaugcauacaugcagcagacacacaggaaaagacccucuguaagggggaagcugaaagauccagucucuucucgagggcuggggacuuuuaagucucugaagaauucuccuucccuaacguaggguuguucaguuugauggaagauaggcucauugauuggcugacaacugauguguaacauguccugaucagggcuugaacuuguugagccagucuagcucacugguggggaacaaaagcaugcaaggcauuuacugcuagguguuaaacccaggaccaaaggcugagaugcugauuaacauaucaaaguggacccuggcugccagguucucccagcauccaaucuuaauaggcuccaccuggcuggcaaacccuaccccuuauccuaaacuucuugaggccagaaacugggcugggcuuccuuuaccccagcuccucuggucccuauauaauucugccauuuggcuaugugauuuuugauucauggucagucucuuggcccaaccccaacuuuguuagauggcagcuccucuuaugcucucuucccuacucucuccucacauggccuuguucugucuguccaucuuuauucuggacucucuaaauguccuugcuucugccccuuucuguauucucccucauuucuacaguuaccuucuccuccaccauaccuagaagcaacugugucuuuucucuuuuucauucaccaggccuuugucucaagucagaaaggugaaggagaagcuggucaucuuggacguucaucaccuuuauuacuuaaccagggaucuucucucuagcuaucugccuaccagggguuaugucuagcucccagcuucucaccaagggaaguguagagagagcuaggcucugcuuucacacuucuuucuggacgugcuugcucuccugguaccuuuagcccauggaauuccuuaauuuccuuuggauggcucuguuacagcuccagcuaaggauacagcauccagguagaucgaaguuucuuuugaggcugagccuucuggaugugugugugugugugugugugugugugugugugugugugugugugugccaggacucuucuaagucccugacaaaaaucuuuaugagccuucacuugagaaguuugcccauuuaaaaccagauugagagaaaauuucacagauccauucccagagggguacuugcuuaacaucuguaaaaaguugcagagaaauggggucugauuagucuuauguugaaaccuaacaaugacuggguuugccuucuagccugaaaacagaggauucugugucaucuuuaaagugguuuaaaucauaguucuuccuugacaaggcucuggucuggaaggugugauaaggagcgggcugaggcuccugugcuaguuacuggaguggcaggcaggcaggcaggcaggcuuuccccugcuguuuuaagagagcuuauccagucuccccgagugcaggcaggcguggugugugaugucuuccuuccuuccuucccuguuucuccucuauguuuaugagaaaucuguagacuuuucaaaugagcacucuauauuugauguaguauuuaauuugugcaaggaaaugccuguggcuuuaaaaucauauuuuaguuaaaaugccucguaauuggcguuuaugcccuaaagugauuuguaugaacuuuuaggaauagguaaacacaugaaaauaaaaaauaaagcguaaugcuguacuuccuaagggggaauguacugcuguguggagcagaggcuuuuucuguuuuuggagcugacccuacuggcuucacggcuuguuuacauggcaucugugauauaugggcaauauacuaauagccauucugcuccugucauggggcaugcuggcuucccaggcucacugggccauauuuaaguaaagaaucuugcugagugacagcuaaagggccucggagcucagggagcauaugcuagcugauguucuuggcucaucucacugacagcaccuaacucucccuggcgcugagugcuaucccauuuugcgguggaagacagugacacacuaaacuugugccauauuaaauagcuaggaaacggcaggccuagagcuaaaguguccccagaagcccggacauuugucacuaaaucaauaacucugcuucuggaaaauuaauuggcauucaucacaugauguaaggagagagaauuagcaaguuuggggacacauaucugugccaaauaacuugcauauuuauauuugcuuaaucuuucugaggacucugggaguccucuggagaaagggguuuaugcugguguguggcggaaaggauuuuauuauccccauauauaacucacaagauugaggguugaaaagugaagaaugagguuugucaaaaucucccaaguggguuagagaaguggugccgcaggugacuuuagugccagugccuuuggucuuugugaauuuguaaaauuuccauccaaauggcuugcuguuccaacguugucugaaaggauggggacugucugccagaggaaaagaguagaagacccuucuuccucuucugcaucccucaguguguguguguguguguguguguguguguguguuagagagagagagagacagagagagagagagagagagagagagagagagagauuuuccaggauacucacacaauagcgaaugcuuuggaugcucaagugucugccuagaaauggugcagaauuugcauguaaccuauccacacccucugggacucuuuaaaucaucucuacaugacuuguaacuccuaaugcaaugcaaauacuauguaaauaguuauuacacuguauaauuuagagaguaaugauaggauuuuuuuuuuuuacaaguucagcacagucgcaguuuuaaacccacauacuacaaucagcagcugguugagucaauggggguggagccuauggaggaagcugcuguacugggcuuucccucugccugggcuggacaggcauuugguguuaaguagaggaggaaccuguguuggugcacagucacuuugcauuuuccucuugaaugugugagacuuggcccuggugguuuuccaccaugaguucuagaccuggaagcauuuacagaauucagauuuauggacaagaaaaaauaacaggccucugugagaauuuccucacccugagaguuuguuaacugaguuacacaugggauaugacaacaucccucacugucaguuucaggcagacucuggagagaguaucaaagcaggagucagaaccuggaauaucagcuaggucuaaggaacuuccuuuuugggagaacacacucaguccgacauugaaggaagaucuuuguuuagccaagaugcaggauuggguguccugacuagcgguuaccacuacaggucuuacgaugaguguuuggcuugaauuggugaauaugcuucguuauucauguuuccacagugccuuguccccugagccccugguguuuacgagcuuucccuugcuucuuaggggggagaaccucacacauaagugcacaccugcucaaguugucuagagguucaguugucucuacacagugacauugugaccaaugacagaaugcauauguaucagugaacgucuaauguaauaacagggcugagauauuccuauuagagugacauuggaguguaaggucauagugccaugaaaaauacccaugcacuggugaaguuacuguuaacagacuacaugcugacaguuguaucaaggucacuugguaauaaauuacauuauuggucaaaguaguuacuaaauuuucuuauuuaauuuaauuucauuuuauuuuauuuuauaugcauguacucacaugugcagaagcccauagaggucagaaaaaggcacgggauccacuggaacaggaguuucaggcaguuuugaaucauccuguggaugcugggaaccaaaucaagguccuguaaaagaauagcaagcacuuuuaacacugaaccaccucuccagccccuccuauagugugcuuucaaucaucauuuuagaguguacucauaguguguaucuuguuucccaagucucuucaucaccucaagaggcuacaugcaggccuaugccauauguauuuguccagaaauauuacagagaucaguucaccuaaugacacaucuuaggaugcaucuggcauguaauaaugcauggauguuucaaaggauggcacugaucauggucaaccuucuuccacugucuaagaaggauuagugggcauugugauuggacugcuaaugucuccccaaaguacauguggugaagacuugggugcaguggacgaagcugauugggagaugauggaaacguuaggaggugaggccuaguuagagucacgaggucauugugagugugcccuuggagaaugcacugggauuccccuuccuaucuaucuauccucugugauuccucacccuaggaugugagcugcauugcuuugacaugggaucacuaccauggcauuugccuucaccaugggccccacuugaaugaagccaaacaccuagggaccaaaucccugacuuaaguaagccacuuguccucuagguugcuuaucucacgaauuuugucagcaaugcaaggcugacugacacaauggcugacuguaagcuccccuguguuaugaugggaauagcaauccauucuguccucugaccccucacccuucucuggaggauggggguccuuguuccccuacugaucacuagaaagguuuuccauuauuucaaguauccaggaaaugcuugcugagagggaaacuuacagacagaaguauagacaguuggugaagcauccuuucuuauucccuaccucaguuucauauccuguuucuugagugaaguauauaguaucagaagaaagggacauaauaauuggguguugggauuggagagauggcucagugguuaagaacacuaauugcucuuccagagguccuaaguucaauucccaagaaccauaugguggcucacaacugucuguaaugggaugugaugcuuucuuuuggugugucugaagacaguuauguguacucauaggcauaagaaagaaaggaagaaagaaagaaagaaagaaagagagaaagaaagaaaagaaagggagagagagagagagagagagagagagagagagagagagagagagagagagagagagagaaagugaaagaaagauacaucuuuuaaaaagaugauuggguguuuacauuuaaauggcauguggaccaagcucacaguagaaguguuaaauccugaaggcuaggaagggaaaaggcuagcaucuuuuacuuucuagaugacugugaaucaggcuuaaaagccuuucacuacauuuuauguguuuauacaauaauaaaaaguaacccugggaguaggggagggcaguaaacagugucucuauuguauugguagacacuaugcugggcacuacaaaucugagguccuuuaauucucuugacaguccuagugaauguauauuauucgcagugcucaugagaaaguugagccucagaggagacagggcagcacagagggaggucaguguggagcagggcccacugugugggcaggaaugugcucaacagccugcuggcaucugcugugaauggccucugcuuucccucuugauauuccugauaugugugcuucaaggaagagcagggcuuucuagcaguugcugugaaaucuuugauaauggaaucuuuuuauuuucaguguaggauguuucuuuaaaguacuguuguucuaaagaguaggaagacaaaagacaaaugaguuuuagaaagugucuuuuucaaagaagccuugaaaaaaguaauccugguuucuugugcgucuugcacuguuucagauuuuuauguacaggaaagcccaauuaauucagcugacuauauauuuugcaaauaaucuagcuuguucauuaaagccaaugucauggcugacuucccaguuagcuugugucuucugaggcacuguuuggucuucagucuguacccugugucuucugggcucagcuacuggauauagacaaaugauucuucagacuggggugcacucaggcuuccuguuccuuuuguguaucuuagagcagccuuaugagcuuuagagcaucgcuaugacuuuuccucuccuuacucucgugccuuauuuguguauuacaucccuucacuacucucccaagaugccccauuuuguccagugaugugaacuuuucuuguuuccuugauuuugguuacguuauaggucuauaaggaguaucuccauuacaaaugauucuuguccaugaaaaaagauaaaaggacaauucuaacaccuaguucaugacgacaugagaaaucugguuuaauuacuuuuucuuuugagaauugagcauaauugugccuucucuacuguaacccuuagaacccaugucuacacccugccaauggugacaucucauuaaaccuaauaugucuuuaucgagggcucauuguauguuuuuaugaguuaagucaacucuuuuauaaaagaguucuuuauucaguguguguguguguguguguguguguguguguguguggucuguacggguguguaaaugugcuuugguacaugccaugauacaugcggaagucaaagaacagguuacugcuaaucugcaguucucuuuugucuugguuuuugaggcagggucucuauuguuucuacuacugcagggcuuguuauacacacuuuugccaauucucugcuuaguggguuuuguuuuguuuuguuuuguuuuguuuuaaauggguucugagaauugaacuaagauaacuaggcuugcccaacauacccuuuuauaccuccugagcaaucuccuuggcuacaaguuuuuuuuuuuccuccucaaaacagaguuuuucugcauagccauggcuguccuagaacuugcucuguagacuaggcuggccucaaauguagauauaugucuaucucugccuccugagugcagagauuaaagguguuuccucccaccauccaguguaccuggccucggguguuuaccuuuugaaaauugcagaauaacacuaggcccaggcuagaagccuccacuuucauucuucaguuaauguuuugcaaguucuucuugggagagcuuauugaggucuccaguggacuuacggagccuaggagcugaaaggcgcucaagcugcugauggucaguccugaagcaaggcccccugucagcucuccuaugcuccauuaucaugaaaacacacuggugucaggaauggcaggcuacaccucaggaugacacagugagauaaaugacaaaaaaacauggguucuaaggaugaaauuuguggagggaaaagaugaaaacugcucaggaaauauuuaugaugcugugggguuuucuuuguauagaacaaauacaguauggaaucgccugugugacuguuuugguucacuguggcauuguacaggucugacugugacauuguacaggucugacugacuguggcauuguacagguuugacuguaguauuguacagguuugacuguggcauuguacagguuugacugacuguggcauuguacaggucugacuguggcauuguacaggucugacugugacauuguacaggucugacuguggcauuguacaggucugacuguggcauuguauaggucugacugugacauuguacagguuugacuguggcauuguacagguuugacugacuguggcauuguacagguuugacuguggcauuguacaggucugacugugacauuguacaggucugacuguggcauuguacagguuugacuguggcauuguacagguuugauuaggaauguccucauucuccgucucagacuugaauacuugacuuuugguauacgaggagaagugauuuaaagaaagaaauaacagggggcuggagagauggcucagcgguuaagagcacuggcugcucuuccacagguccugaguucaguucccaguaaacucaugguggcucacaaucaucuguaauggcaugugaugcccucuucuggugggguugaagacagcuacaguguacucagaaauaaaaaacgagagagagagagagagagagagagagagagagacagagagagagagacagagagagagagacagagagagacagagagacacagagagagagacagagagagacagagagagagagacagagagagagagacagagagagagagacagacagagagacagacagagagagagacagagagagagagacagagagagagagagagacagagagagagagacagagagagagagacagagagagagacagagagagagacagagagagagacucuugcuuuuccugaacaaaaucacauacccauuauguagugagagaaaaagaucuguaagugccuccugauucucaccaaaugugagauugucacuucucaauacguaaucauaaugaaaauacguacagucuccucauuuagcucuuuaccacccuggcgugcuugcagcauuuuacaggggccuccucaugaaaucauacaauugaacauaauuugcuaugcuuaaaagaaaauacaugagauguaaguuauaaaaccaaaccauuaguaggcugcuccaacuccagugcucccagaauuaauuguuagagaaauacaagaagauggcaguggggggagggacaagaagaaucaacaugucucccagcccucccccuuuuucaauauuaugaaagugcuuccagcucugcccacaggacuugcugcagcagugacacugggaaaucauaaacuggaacccagcaugccaugagguccaggaacucagacuauaacuuaagauagccuggcucucacgaugagaugcugguuguauguuuaagagauuagggggucgguuuuuuaucugccaguguuaaguuguucacacuuaacucuucucauuguagucaaaggcucccugcacuauguacuuaacacagaagcccucuggccuacccugaugucucccuguccucuaucccuuccugcucuguauaagcccauguagccuauauuuucacagagggagccagucccuguuucugcucuacuguuccugccccagauuaacccuuuuggccuuugauggcaucuggaagacacccauucagaucucugcucgugcauguacaugugcagcuugcuuuccuucuguuuucuauuaaugccuucugcccagcucagacagguacaaagaagucccuguggccuggccacuuugcuuccaacccuuuggugguucccaucgcuauggaauccucccuuugcauauagucaggccuacuucucuguuuacgucuacuuucagguuucugcaugugugggaaagaauugaacccuuuguugugcuggacugcuuuucuuucaaaccggcuuggguaaagcauccuaucucaaugcugucccauggcgaguuagguacaguauuccuguaagaagaccuguucuccuuuggaccaccauacccuauaaugggcacuggcaucacucugccuaaggaagagacuuugcauaccugucuguguuaacaaaucaauaaaggaagagcauaacuuuccucuguuuucuccccaagcauauccugucaguucuuuccuuucaccaguuuaucgcaucucagugucaaggcagagugcaccauccaauguagaugugcacaagacacaccccgagacccuuuuuguucugcuggcucauggucagucuccuugggcuuuugggaaucugagcaaagcaaacgcuggagaaggagucaacaauagugacaguggggcaaaccaccaggcaccaccugaggacacccaaggaaaaguucacugcuucaccagucugugcuuuccuuccccaaaugcaugagcugaaugagagcggagggaacauucaacaaaaccaauucagagaggccuuaugcaaaacaguuagccugcaaucuucacaagugucgagguccgaaaaaugaacggaagauggaaagagguguuucagugugaacauggcuuggagcuagagacugagcagggaaaagcacuaggugaaucugagcugcauccuuuugcuaucaaggacgguugcaggcgauggguggaaugugcuuggggaccgaggagcaaauggaacgugcaguaaugucucuuuucugauuuugauggccauguugugcuuauaauggaaugagcauuaaugugcuuguggcugaugaggcaucugguuagcagaucacccuuacucacauggucugagaugaaugacggcucuuuguacuguaguugugcuuuuaugauuucaaacacuuuuaaagaaagaaaucaaucagucgcuguggacugucgccauggugggacguccugcacguacccucauggagugcgugccacuggagcuuccguggacauuggaaugaaugacaagugaaugugcgguggccaagaagaaccccucauccuguuucaguaaacuguagcagcagguccagacugcacggcugcuccaggacgaggcgacucccaggucagguguaaucaacaugcuuccuggaacugagagaccagagacagacugagaguucauugugucaacuggcaaaguuccaaccuguaggcaaacuucaagggaggcagaguagaggccuggagagugcuggguaaacaggaacugggccaugguaaucagggacccacagacaucuauccugagcugcuggaggcccccaucugauaggccucaugcuuggcuaugggacauggagugagagggaugaaccaggagaugauggauuccaccuuaccugggauagagcuguggugacccaacaggcuucuguuuugucugcuuuaacucauggccaccguuguuguuguuguuugaccaaugugcucuuuuuuuagggguggucauagucucaggcagcagaacaaauuaauaguuucuguuugacugcagagccccuguugugcuggauaguuuuugugucaacuugacacaagcuagacucaucugagaggagggaaccucaauuaagaaaacgccuccauaagaucuggcugcaggcaagcuuguagggcauuuucuuaauuaaugaugguaugagaggaccuaggccauuguaggugguggcaucccugguccuauguuuuauuagaaagccaccuccugaacaagcuaugaaguacaagcuaauaagcagcacuccucauggucucugcaucagcuccugccuccaggguucuacccuccuugaguuccucucuugacuuucuuugauggugaacugugauguggaaguguaagccgaauaaagcuaaguugcuuuggucauaguguuccaucccugcaaugggaacccuaaguaagacaaaugucuuggcggguucgcagcugugcccagcucuuucugaguuggcucucuguugacuuagaggcagcuuauuuccuguucuaucauuacuccuugucauacugggauaucuuacauggguagaaacuucaguuagagagaagcuaggcuuuggagccucaacuuaccuguuucuucuuguauugaaauauuuuacuuccucuaaaagccuuuaauuuucuugaguugcaccugaccuugagagauuuaaucaaaauggauaccuuuaucaggaacacagugcuucccugacaacacgagguugucagucacccagugccaaguuugugcugcagagauuuguguguagagauuacuuucagugcucucucaguugaaucuccugcccuccugcagcucacuggacucuuccuuugggauuucuuuguuccuugaacagauggcuaugucucuugugugagguccccuggguacuacagagcccuggagccuguggucccuaauggcuuugagauaaaauucguucucugagagguuuuccauggcugcuugagauucggaggcugauucuggaaagcaugaccuggaagucaguccacaucugagggcauggugcggcucagugguuagagaccagacagaagcaucuggguucuccugugagugaccaaggccacgugugcuagcagguauaauaauaaucuuaucaauuuugcugugacuuucagaugguaaacacacacuucaugcacauacacacagagacaagaugugugggugauggagggagagaccuauacacacuuauacacagggugagggagucagaggggagacugagacggaaagacugccuuuuacuggugaaaaguucugggcugacuauaauuuaauauucauuuuauccuuuguuauaucaaugcuuuuacaaguaacugcuccugugccuggcuugucuuucuguguuguauauguugaaccccaauuucuaaacuuaaagcagaagucccccuuuuccuccacucuguaccuauagagugagacaacaccuccauuggggucaccagcucagcuugguaccagggugagaccaccugggcucuaagggcugaugcuggcaaccagucuguucucuuuuuguaaagcaucccuuccgaggggcuccuggcccugagcacucagagacagagcaguggccuagacagcgggauaguaaacagacacaagguucagaucuuaaagauuugcuuuccauuugcaaaggaaacaugaaagcaagcucuguguggacagaggaucaagucagacaucugcuugaguuagggacaguggugagucucaagacauggagcaguggaaaggguuagaaauggaaucaccuaaacacaagccauucagggcaguuagggccugguuucccuuuccuuuguaugugggcuucugugcauuugagaguuagggcaaagcaggacagggcguaauaaacuauguguuccuugagguaccacccucaguccucagcucuucccuucccauccccuauggugugggauagagaguucuguugucugcugccagaugaaggugugcggacuugauaagcagccuaucacuucaugcaagucgcagcugacagggcuguaaggacacgcuccuugaaaggggcgucaguucaucauagucgacgaaucagcuucuggaucccagugacagcugcggagugcugauguguggaggaccaccaguccugaaucccaaucaccuucugcaucuucugaccaguccugaaucccaaucaccuucugcaucuucugaccaguccugaaucccaaucaccuucugcaucuucugaccaguccugaaucccaaucaccuucugcaucuucagagucucgguugucaugcuacugauggcccuggugcugcuugcugccaugauaagcucuguacagcuagcccaucgcugauauuuccaacuaaauugcuugcagacugagagcucagauauguacuuaaugugcagcucuguaggaguuggaaaugcuggagaacuccuuauugauuuuaggagucgagugugggaggugggaugggauggcuuugaagauuugggaguugggggacacacagaagaugguuuauaaugaugauuuuuuccccagagagcauuucuauaugacagagguugcauaugccuaagaguuaacguaugauuuugagaugcuugugcuuggugcuuugugcagucuuauagguggagauggaaacaucuggucugguucggcuauaaucuugacagccugcuucuugugauugagagagagcuaguuugccaauuacagagcuggguuauagggucuugaaacuagugugucccugucccggagcccaagcugucauguguccccuuuaaaugcuccacaagguggcaaaugggaaguuugucuucuggcuugucaguucuucauuuggagacucaaauaccugagcugucuagcaguauaauauaguguuaccaguaauaaccaccuuggaagggauagaagaaaaccacacaugcccgucagcacagcggggaugagaauccagccucuugaagcagaucccuuuaaaacgucaccgagacugcucggugcuuaaaaaacuucuucugagucuugaaagucuuuuucuccauauguaaaggaaagguuuuauguggcuguuuugcuuaaugugggcuguuuuuauucuggacucuuugaagcucauuaugaaggcuaaaauucugcuguguggagaaguaaaaaaagaagggaauugcugggcucggguugugcuaaauuaaagugacaaggcacagauaacaaggcacaauguggccacagauuaguccucucuaauuugcuacugugggaaguagugcuuugggcuugcauaguaauuucuuuccuugaauuaaaguuuuaaaaagaaaacauacuuuuaugaaaaaaggagaaccugaaaaaaaaaugcauugugguguguggucuggugguucccugugcucaggguucuuagaggaaguccugccucaaacacauguaaaugacaugcuguuauuuugggaaccuuaugucucaaaccagccccagaguauuucaugugcuguuuuaaguaccucuccuugguggacaguuggcagcagugugcucugggucuuucuugugcaucaugauacacuauguugcagaccuagagugaacauuccugaggaaugagggggagaacaagaucagagucacuuucuccaaguugauuaaguuccagauguuagacugauacaugugagggccagaauggcauuugguuccucaaccacagcaugcccugccccagauuauacuacuucauuccuuuugccugucuuaacuucucagggggccgaagaggccuuccuugugacuggugaacuuggacuguagaaucacaaaacaucagcuuccuaagaaggguaucaaaacucaggauuccggcuuggugugauucaguggugaaaagguuagaaggcugaaggcccugggaauccaucuccagcacaaaacaagacaacaaacacccuccccccccucgcaaaaagcccaaguagacaacacagaguauagguacauuuuacuacaacacugugaaauugcuccucuuggggcacagcgaguuagcuuuugaguauccaugacuguuuguugagcuuccaugccagcuauuuauucccaagcuaucaugaguggcacuuccauucacaguaaccuuccuuacaucuguccucauugucauauucuaccuccuccuccucguucucauccucgagguccuccuccuccuccuccuccucuuacuuucucucccugcccccuccuccccucccccuccccuuccuccuccuuuggaaguauaagcacaugcuggggaaccauuaacuaaacucaggcucuucuugccucuucugguuugaguugugucccacacaagggauauaagcaugcgccugucaucucaggaugugacucuuaguuaauugggucauugcagauguaauuaacuaagauuguacuggaguugugguuguacuggaguucagugacgcuucagauccacugaaauugcuguaagggggacuauaguacaaagcgugcauggcuugaacugaaguccgcacugcagaaaggaccuagcagaggucuggcagguucauucucgcuccuucaggggagcucagcucugcugacaucuccaucuugcacuacaguccgcacaacacaaagcagcgaacagcugcugcuugagccgcagguguguggagcuuuguuaggucaguccuuaaaaacgcguguguuuuuccucuuggcuugaguuaaaauugggccuagaccacaucccuguccuagacacuuccuaacuagucucacagaugccucaccucauccugggcugauuccuguaagcucuggacguacaaaacaaggaaggggugaaugugugugugugcauguauguggaacucagaagacgugagcugugcgugucuuccucugcugcucucucucucugccuuauugagauggggacugucacugaacuggacauuugccauuuggauaggcugcuugggcagugaacucucaggaucuggcugucuccauuucacagcgcuuauguuacagaaagguacaguuguguccagcuguuuacugacauucugagguugcagaacaaguucucuuaccuguccucuaacuccugaauauuuucuuuaaaauaccucuaaagaaacagggaugaagcugugucuguggugacaagggacaggugugugccuccaaguuggauaacguucagcuaacaaacuuaguuuuuguuuugauaaaugacauuaucagccguguggugguggcgcaugccuuuaaucccagcacucaggaggcagagacagguggauuucugaguucaaggccagccugaucuacaaagugaguuccaggacagccagggcuauacagacaaacccugucuugaaaaacaacaacaacaaaaccaacaacaacaacaaaaaacaacaaaaaaagacauuauuauaagaauuagcgauacuuagagggagcuugucauaguguacaucacacuuaauuucccaacugugacaaugaugcugugguccagcuggccauggugcugugguucgacuauggaccugugguuguaagaggacaggcuuuuaaguagacaugcagguaguaggacagcaauagaaagcaagguggggcaggugucccucacaguaugcuuuucuguaggucugaaauuauuuugacuuaucagcuggaaauuauguuuaugagaggacguuuuaauuuuuuaaaaauuccauauaaaaaaccuuugaacuaauauuuucuaaauagaagguaauuuucuuuuuuucuuuuuucuuuuuccuuuuuuucuuuuuuaaggaaagcaaguguuuccauugaauauggugggauguagggagugugucuuacauacauaauucacucaagugguagaaaaggcuaauaugcaacuuaaaauauuuccuauaagcacucagaaacuugcagauuaccagcuaugauuacugaacacauuuuaaaaggagaaacaaaacuuuucuaagaagaaauucccuucagaaggaauuccccggagaagguguaaaugaauacuguauuucuuaugcuauuaaagauugacucuuacacaaucuuauuuuccuuagguuacauguaucaugagagcaccuauuuuacauuuaaauugcuauugccugauuaacucucacuuaagguguugccuuaggcuguuuuguguuacuguccuagcuacuucuugcuuuaacagaauaucucucaaaggcaauuugaggaggggacgguuuaguuugucucacaguuugaagguacaugaucugccauggugagagaggcaccaggaugguaggugugaggccacuggucacauuuuguaacccaucaggaagcagagagaaaugaaccuuguuuuguucucaacucccuuucuucuuuucagucagcccaggacuugaacccauggaaugguacuacuuacauuuagaauugguccucccaccucaaugaaucuaaacuagaaauucccucacaugcccagaggauuguugcuuuggugguugugaaucccauuaaaguugauggucaagauccaccgucacaguuaccaaaacagaacaaggaagacucaguaguuuaugaagagcagagguuugucuccuguuugugaagccugagacauaugagaccaagggcugcaucucauaagucacucuuccugcaugugacacaguagaaggcaugcuuggguaggaggcaaguggcuggacucacaguccuuuuuacaguccauaccaaucuauuacugagaguggaguucuaaagaccuaaguauuaguccccaccucuuaauggucauagggauuuaagucucuaacauacauauugagggguucauuggugucucagagauggcagcagccauuuccuguguuucucuucgauacuucaggguaguagaguacaaacucauuuccuagauguuuuuccacuuugagaaguuuuguuuuccaaacuugacuuucuccucaaucuaugguaaacuagcuccccaccacccccaggaaugauaauguuacuaaacauuccauacuacauuugaaggagcccucauugucuugauaagacuugucuaguggaagaacuguuagugaaguuuucacaccuggguucuguuuccacccaaguacagcugugaaacuuuaaacaagucaccuucugcacuuauggaaguccauuguauuuaagaacuaauaauugacaguaucuucuuuuaaguuuuaagaauucuuacuuguauauuaauggaugugcauucaaugacuaaaaccauuuacaacacaauggauuuaugugcacuguagaguuugugggaauuccagggcuaaccugaauuucacugucucacccugguacuucagucaccaaccuaaaagcuccuuuauuuucccacagccagacaggcggauggaagauguccucuauuauuuauuuguagccaucuaaucaguguccauuguguuuuuguggucaugggcacaugagcaaugagcagaaaccagaaaucuccacuucagagcagaguggcuaaaagucuucuaguaggaaauucccagcagagggugaacagagccggacuugucucccuguaucaucaucccucauauagcaaacacauggcauuuugguugauuuuggauugucuuaauuaagauuccuguugcuguaauggaacaccaugagcacagcaaccuggggaggaaaggguuuguuugguuuauacuuccauauuacuguucauuauugauggaaguaggacaggaacucaagcagggccggaaccuguaggcaggagcuaaagcagagacuauggaaggcgcugcuuacuggcuugcuccacauggcuugcucagccuacauucucauagaacccagaaucacagaccaggguggcaccacccacaauggucuggguccuugaccaucaaucacuaauuaagacuaugcccuacauccagaucuucugaaggcauuuugcaacucaacuuucuaccuuuuugguaacucuauccagcacaauuaccuaguuuuuuaauucuuuuuucauguuuuguacuuaauuuuaacuuuuaucacccccaaucccuuugggacuagaaauugaaucuaugcauaauagguaaguguauagccacccaagcauauuucagcccaugauguaagccuuuacaagggccauaagugugggucuugagugcuguuuaauguuucuguauaugcaagguuauauugcauuuauguaagcuugagcuacagaguucuuggccauuacuuuagaaguacaugauaucuguauuaauaaagauucucagagcaucaaagcuaauagaaugaauauauguugcaaaaggagauuuaguaggcuggcuuacaugaaucagggugaauaguccaacagccagggucuauacacuggagaggcauagaauccuguagcuacucaguauguggagccagaugcuuaacuauucuaauguggggcugacaacuugguagguucuggaagaaucacuagacuucagcucauacugguacccaaacauacaggacaucgaugacagugaagaacuucagacauggugacauacauccucaccaaagagagcugaagucucuaugguuuuuucccucagagcucuguuuacauugcugugaagaaacacaaugaccaaggcaccacuuauaagggucaacauuggaguuggcuuacagguucagagguucaguccauuuucaccaagagggaaagcaugacagcguccaagcagauauggugcuacauauguucuacaucuuauucugaaaggaaccagaagaccaucucccauguggcuaggaagagugucucaaagcccaaucucacaaugacacacuuccuccaacaagaucacacuauugcaaaaaggccacaccuccuaauaguugccacucucugagcuaagcauauucaaaccaccacacauucauacuggaagaauaccucccuuacccaguuaaucuucccuggaaauggcaucucagaucccuccagaggcauuuauuaauuaauucuaacucuaacccagugaacaaucaagauuaaccaucacagugucuuuaauaaaugugagaacaaagcugagugcugauuguuuguuuguuguuguuguuuuaaaacaacgucauuuuucuuuccaggagcuagcucugugcuggccuuggggagucaguacuggguaguugcgugccucucuugaugugaggacagacuguauuuauuauccuugucuuggcuuccugggagguaaguugacuauauuaauugucacacagcccaggaaaaucaaagugagacauugucaucauuuugccagggcaagggugaagucaaggacuguuggacagacuggucagauggccuucuugucccagcugauagggaaguuaaauuacuuccuuucgauagcauucagcaaauaauuucaccuccuacgguucugcguacugugcuguucaguggauaucagaaggaaauaaacccagcauguccccugacuucauagagauuacagccuauuagaaaaggaugauauaaaaugaauaagcacacaaauaaaauacauugcucuaccuuuugauugguucuagaaaggaaaagaacaagcuggaagcagaaugacugucugaggagcugguaggugaaucggggacaauuucucugaaaagaugcaguuugcucuaaggggacagaugaguuucucagguccaagaggcugaccugcagaggggaccuuacagccuguaaagugugauuggcuaaucugccaagacaccggucuguggcggauuugaaaggcauuggaaauccacuggaagagucucagucugaagggauguuuugugcugugcauucucugagauugggaguggagggaaaaguaguaaaugugagacaccaguuggucgccugcuucaguggcccuggagcaugcaauggcuucggugcaugcaguggcaguagaagugaagagagauuggcaggcuugaaagggagguucggauguuggacuuggaaaucuuggcagcggggcuggagagaugucucagugguuaagagcacugacugcuugcucuucaagagguccugaguucaaaucccagcaaccacaugguggcuuacaaccaucuguaaugggaucugugugccgucuucugaugugucugaagacagcuacaguguaugcauauacauacaauaaauaauucuuaaaaaaaaaaaagaaaaagaaaaucuuggcagcaaguaugaauguucaggaugaaauaaauaccuucugggaaugaguguaguaggacugcuuggauugggaugcuauuuucugaaggggaaauguagauuguagagaggcagcaucaagauuuugccaaggucuggaaagauggcuuggugguuaagagcacuguuuguucuuccaaaggacccgaguucaauucccagcacccacauggcagcucaaacugccuguaacuccagcuccaagggaucugauagccucauaccacugcccauuaaauaaauuauuuuuaaaaaaagauuucgccaaauuaaguaaguauaucaacauagaaaacagucuauaacuagugguuucuuuuugccauuuuguccuggcaaugggacuuaccucccccuccccccccccacuuuuuuuuuuucucucucucuguccuagaacucacuuuguaaaccaggcuggccuugaacucagaaauccaccugccucugccucccaagugcugggauuaaaggugugagccaccaccgccuggcucccucacccccuugauguguguguguguguguuuuuuuuuuccuuugcccuuuccccuguggaucuauaugaacuggagaacauacuugcuaacuuuucaucagcucucugaugauucuuaugcaucauucggcagagaguuaccaggcaucuuacaguuuugcccaucugcgagcaucuucagguuccaaggugcaaguuucauauuugcuucagggugucaagaaagaggaacguguucuucaucuguuugagauccucuucaggguaauuuccgcugugaacacauuccugcuucaagugucuuuggaaacuuuaagcugggcacuguaagaacugugagaacugugggugucucuaacugcggggugcuuaaggggagcugugagucccaguucacagacuuccugugccuuuugauuguuaguaaacaaagaaaaucaaaacaaaacaacaacaaaacacuuaaaccaaaacaaccaagaagcccaccacucuguagugggucaaguuuaacagagucccuucagcccguccccuguguggugcuuuggggcaaggaaacauucaguguuugcuugcugguuccuagggugaaagcuaucccuguuauuuucaguuacugagacuuuagcagggaacuaacuauauuguuuggagauuguuagguggcuuugagcacuguugugcuucuguggagaagcaauguuggcaaccagggagauggggaugcagaucgaagagcuauaggauuagagcucucauuagggaacauggucuuuuuauguguccagugguagugaugcuuugggucuaguauauugaguuguuagugagaguuccaggaacucacugguaaauucuuggacaacacggagaaacgggagcauaaaugauugucuacugacaggaaagccuuacccacagcccccaucuguucugagauggcgucugcauauucuugcccucauccauuccaacugggcauuguauacaccaugcuugguuaaacucagaguacaauaguguagagcuugugggaaaagcagaaggaaggggacccgccgcuagaugagcuguuuaggagcuaugcguagugcccuuagcccauacaugaauaaaagggaaagcaauuagacaauagucauaaagaaguccagcucagugcagauucccccaugauaaugacuucaauaugauuuuggaaauauuagauaacucauuaugugcuauuuacacacugauuugcaugcucagacuuucuggugucuugcagaugaccugagagggagcaucuaaaaauccucuggcagaggaggggacacuuugagcuucuauaaguagguguguuggcugacaagaaguucaauuguuugcacagcuggcauuaaggguuuuugauaauguguugagccucuuagaagaaaagcccugcuuaaaucaaaggagcuccauaaacuaauaaaccuuguauuucuuuuaaugagucagggagcaaaauauuccucauagggauuuacuacaugaaugagugugugugugugguuuuuuuuuuacucuauuaccuugcccauuggauugcugaaaugguuugcucauggccucugauaauuaagugccuuucggacguacgucugccagcagcaucuugauaguucaccugugccaguccccugcugcacuguuaaguuccaggcaaaugugcucucucaggaggagucacuugucugauguuucucuauagguccagcgacuugcaagccacugcuucucaagugcuggccuguacaagccucaggauauauggcugcuuuuagugcuauuugccaucauuaagagccuguccgaguggaaaugaugucucaugauaaucacuccgccuacccgaugccagguuggaaaaaaagauaauuaugagcaagaaugcccaagaaaaguaccgacugccggauccccuaaucaaugagggguccaucuggaaacacaaauggaacaacuuugauuaaauauacaaacucgcugaccagaucagcaaaagggagaauggcagcuuuuuauugaaugcuugcauguuuuuuuuauuacuuugaaauguucuugcauauguuucucuuggccccgaggagaaguaaaacguugauuagcacaauucaaaguuauaauaagggcugacgauucaguugagauggcuuucaagauuagauguguaggugagggguaaaugcaaaacucuaucucuggaacauucugcuguagaccugcugggcuuuggaaucucagagaguaaaagugaucauuuauugagcuguuauugugccucagugacucauuuggaauuccuggauucaguuguuacuggaacaacuuuaggaggagucagugucacucccauuuuacagaugggaaaucuuaggauaaagaauuuauaguguuacgugguuggugauagaccuaggggucugucuaggccuucuugcuucagagcucauccugucacucuugguuuacauuuauugguugauuuccuaauuuuacaaugugggguuaagaacagacuccuuguauccgaaccugaggggguagccucuugacuuuccuuuuucauuuuuuccuccuuuucaaaacugaagggagcauagccacuguuggucacacacccuuuguauaggucauagauugacucaaugacguucaccacuuguauuuguagcaauuuaagucauugcaggauuuuaucuuugacaauuauuuuuaucaguuuuagcaacagcagcuuggggagaugguguuucugaaccugcagcuuaguccuguucugaugucucccucagugagccuucucucccaucccugucaccucccugucaccucccuggagcuacuaaaugauuucauagccagccaagaggguugggugcucugaguaacuccuaaagguagggaagacugaaaguagaagccaagggcgaugagggcaucucagggaaagaaccuaagagaugagagaggugccuggagagacugcagcuacccagugcugugcuauugcgaguugcuuagcuguacaucuuugggaacucugugucuuuaccccuuuaggaaggaugugacucuguagcccauuagagucuucuacacugcucagaguaucuugagacagugcuacuacuaauuuaaauacacucaagggaauuuaggguuuuuuucauauuuauuaguguaggcaggccuccuuuguuauucuuguuucuugcuuuacauaaguaaacuuuccuggcaaaucaaaaccaaaagcuacaauugauaauaaauggugauggaauuugaauuuucaaugaguaugcaaauacauuaaagagacacauaucuugauucugacaacagagccuaauacauagaucaucaccaguaagugauucaaauaagaaugacucagaauacuauuuuagugacuuuuuaaaaaaacuuuucuuuaagguuacguaaauacaaagaauacauuuuucaacuuuaaaaaaugcaauccuccccccuccaagaaaaauaucagugguuugcuuaacaucagcaucacacuuuugguuucacccauguugaugugucaguuugguucaguuugguucuucagagaauucucaaaguuuauaugacuagagaauguuuccucccagagucccaucugugucugguuuccugcuguuggagguggauggcuccguugucugcuucuuagagcagugguccucacccugaagcugugacccuuuaauauauuucuucguaucaguuuuguugcuacuucauaacugaaauuuugcuacuguuaggaauuguaauguaaauguuuuuggcguuagauggugggaacuguggcucccaccaugugugcccaugugaggagauucuguccugagaucacaacaaccauacacacuuuaguuuuacugggcaaugucaacauuuucccagaacaguugugcgaauauaccucucacccggaggauacagaaauuccuguugcuuuggauacucgcugacacuuggguugucggcuaugugcaguuucuguucucugugguuuauucauuauaccguucaucauugcuaagucugauguaaugucuuacugacuaccaguguuuguuuuugugauauacaacauaauuuuauucugaaaaaaaaaaaaaaaaaccuggacaaaaaauccagaagaauaacaucggaaaccuaagggcagagguaaaggcgcucucuuaacuucuuauccuugguaaacuucuggguuguuugcuugaccuuuggauuguccugcucagcaaagugucagcuuggugauucagcagucagauauuuucuuaucaaugcagugguugugacauuuguaggccuuaugaugacgacugaccguuucacguuugcauauuuguggaacuuaagauggauguaugacaacuggggggugggaggacgggucuuacgcuggaaauucugagucucugccuguggcgagagacaaggggugagcugagcugauggcugaaguaacugagaacagagaacuacgcuucagagaaagaggccuucucaggcugucugccccgguuaaucugucagugagucaggcauuaucucagaagccacauuucccccuggguuugaacuuucagcauggcugagaucaaauguuucuucagaagaaaggaugacugagaugguggugguagaggguggaccucuuggcacuucugaagaugucagcuucuucuuccaucuucacuccuggggagagcuuccccuugagucacugcugcgcagguugcuggugguccucgcuucccaggaagcugcucuggaauaggcaagcacuggccagaaggagcuugguaccagccauuccuggggagcuccacagccuuucacuuugcucuauuucagccacacuugaguggaguccccuguggcgaguggcaauugaccaguguucaccaacuccuuucauugccaauaccccuuugagaaacucuucgcucuguuaacauucccagccuuugauucuccuaagaguuuggacauaaaguggaauguggucugccauuagaagugacuucugugacuccuguuuggagcagacagagcaauucgauugcuuuccuguucucuguagccucagaguaagccugugacaguaaagagcuuuuguugauaaaagcuaaaaauugcacccccaagccuuaccuuucugaugagguuggccacugcugucaaauauaaagaugucugaacacauucugcagaugaucuucaaugcguuccaagugacuugacauauagaguucauaaaaacauccagaguuuugucagggucugguucugacccgccuuuagcaggauucaccuccugcuauuuuuccaucaaaggugccaggaaagcaaaugucccgagcugucaggcaguguccgagcagagugugaacacgaaggcucucuucguccaacccaaccugcccgcucuuaagauagcuugagauggugaaaugaugagagaaaauauggugugacuuggauuguuuucucuuaauuaccaaagauaauuauugugaaaauauuacaccagagguaaacuguaccuuaaguugucaaaagaggaagaaaguaggucucugguuggauuaauuaauguuuauguuaaagagaaaaaaaacguucucugaauugaaacuauucaggagagcuaugacuucauaauaaguacaucaacauuccagcuuguuaugugagccaagaaccuguucagucauauauauauauauuuuauuugaacagaguuuaucuuagacauaccaccaugugagagguccuuaucucugaaguuugucuuguguuaaugaagggacaguuggaaauacuuucccacuucaguucucagggaaaagggucuggacauuuugcuuugcugugauggaaagaugagggauggacuugugcagaugucaucucugucuucugugggacaggaaugccuuaugucgcaguguccugaugcaggacaacuuuagcuggaacagaauugagggagaugcugcauuucucaggacagcgucaggcaagcucuuuccuggcugucagucuccauucuaaaguguaauuuuccacugaaacugcuccuugauauauauuuuuuuuaauucuuagucacuucuaauuucuuucuggaauucccagggccuugagguaugcuuucuguuguuguuuucacuaugggcguguguguuuguguguguuggagucaugugaaagggaaggaaggaguaucaaaugggauguccucauucugacacaggaaccagagaucccccaaaugugccacaaugcuaacagcagucucaaaguugucuaacauaggauuucagguucuaccaaauccacugcagggcugugugaccuucuaggguaucagucuuugauaugccauggucuaggcugucaucauuucaacauagcugugccagggaagcaaauacacuggucacuauauccaggcccuccagagccuauuucuauucaugugucuuugguacuuuuauccaugugucuuugaccucaguaaauuauacacacacacacacacacacacacacacacacacacacacacaguuggccuaaccuaucagaagcuagaaguauaauccccuggugugccuagaaccaacccccuuuuuuaauguaagaaucugugaaagagaaacugaugauaaguguauuaucauaauauuuaaugguacuauguuauaauuugauaauauauuugucaaaaauaauauuugagaugcuucugggauauauaaguaacuauguuaagugagcaguugaauauugggagauggggagaaaaaaggauguaaggaagugagagauaagggcaaguagguagucucgggcuuuuccuguacagugugugugcgugugugugugugugugugugugugugugugugugacugccuaaagagucuagaaaaauugaagcccuacaaaugauuucuauauuaguuaagcaaggcuaagcacucagugagucugaauagccuucaccucuggugucucacaggcucacccacguccuugggacagugugaggccccaacacaucauaaccuccccauauggacagaaaugcagucuguuuugcccauguuagauccuugguaccugagaaaacaucugguaggagguaacaguuuauaaauagcauauuuugauucaucuccuauauccaucuuggauggcuuuaucaaauaguaaagugaaucagguuuuauugagugucauugaaugccucuagacacaugaucaucaccagagauaagaaacuggauuuuuaaaaaaucagccccugaaguucccuugucgggucucuagagagauggcucaaugauugugagcaccggaugcucuuccagaggacucagguucacuucucagcaaccaugucgcagaucacaacugucuauaacuccaguuccagcugguacuacauccuugcacagacauacaugcagauaaaauaccggugcacauaaaauauaaacaaauaaguaaacaaacaaacaaaccaaccaaccaaccaaccuugaaaggauaaaagaguccuguguguuccaugcagacuuucauugccucagcagucacugcugugcuuuauagcaauggauuuuuuucccccacaguuuucuuuaaauagaauuauacaacauauagucuuuuaugucuagcuucuguuguugauuaacaaaguuuuuccauugagaccaggcaguaaauauuugaggcuuguaugcaauauggucuuuguugaaacugucaacucuguugucugcagugcagaugguuucagacaauacuguacuguaggaaggugugcugccuugccuuaccaauuguaagauucucagccaauaaaaaaaaguagaaaagaugccuuaacaagagaaaagcacaaugccuuuuauuuaauuaaagauuuaaugauacaggagacuucaaaauguggucccaaagaccugcaagagagcuauguuuaugcucuguuuggugagggcuggacagcuauguagacauuugaaugggccagagagucugcucuguugguaaaagacugagagguaaaccagcaaggucucuuggccccuugguuucuuuucauccuuucugagguguuucuuccuauuggauaggacuucacuaggaugggggcauuuaaagauuuaaaaaaauugggggaagagaaugacuuuuguggguguaauaacaaauuuggagggcagcaguucuaguauuuauaagaagucuccaggaaaaaaacaaaacaaaacagaaauaaaagccuacuuuccaugaguuuuuuuucagggguugagacugagguuagacacaggcagugggagagggucagagaaguacacuguucugaagccccacuuucucccuuugcugauaguaaucagucugggauaauauuuuuugagccaagcaaucuauaacagagucgaugugacuguacucuguaccaguaaaacuucaauuauaaaaauaggcagacgaccggaucccauagugugaacugucaacacgcaccuuagcagaaccgacuuuuaauacucuauacauucauaauucaucauuuugaguugcugaguuacuguccacgguguguacgccauucugcaguuugaugcugcacucauccuuugaugagcgucugagaagucucuaugaauaaaagucuacaugucuugguguagacacauuuuaaaaagugaauuuuaaaaaugaauuccaaauuuguuuaucagcaauacaugaaaauuccaagcuguugccauuguaguauauguauacugauucaauauguaaacauuaguagaaguaaacuauggaaugccagcacuugggaagcagaggcagguggauuucuguguuugaggccagccuggucuacagagugaguuccaagacagccagugcuacacagaggaaggaaggaaggaagaaaggaaggaaggaaggaaggaaggaaggaaggaaggaaggaaggaaggaagagaaagaaagucgugaacguuuucugaugucacugauucuguugacuuuuugauacuuguuuuauuguuuuuaauuauguguggcauaaccacaugaugccagugcuugaaggcaugcgaucccuuacacgggaacuuguauuuuuguacaaauacccuauccuuaaauuuuuaaguugucaauaaaaauuuucuaguaacaaaacugcagucaccagcuuuauggacagcaaugaagucagugcaaauacuuaaguacacaaguucaggcaggacacaguuauucugcacucucugaagauacuuagauugcauaggucuugcuagcugguugagcugaguauugguugaaaucccuuugaaauuuaugcaaccuaauuugaucccauuucuaauagauggcugcuuuaccuccuuugaauacagccugcaaauaccauaggcauaugcugauuuuuuuuuuccuaaaaaucucacuugggucuacuauguccagagaguuuuguguucuguauguaugagugaauuaauuuuuacuugaaaaaauuuuaaguagauguuugaaaucuugaccaugucuuuuuuccccuccuuccucaguuucagucaguuuuauaaacuuccacuuuaagcuggguaacuucccagugaacucucuuguaccccagugaauugauuugcuauuuauguucuuuccaauaauaagcucauuaaacgcugagaccuacuaccaaaaagugauuauuucaguuuugagugcuuguucuggggcuguguucugaagagcuagaugucaauuaagauuauuucuuauuaguggaaauaaaaucauguuaucugcuuauaaaagaaucucucuguucuuucucuaggugaggagguaaauucagcucagacaaaguucaucuacucauucagugaagaagugcaaagauagggguuauggaaagagccuguuuuaucacagucgaaacuagucugagccuugagguguuuuggggugucuuuccuacagaacugugucucugaggugguguuaaguugcaaauucuaucacaacacuuagaacugagucuuuguuaaguauggaaaucccacaccuguccaaaaugggggagaggaaaggggaggggaggggaggggaggggaggggaggggaggggagagggaagggaggggagggaaggagagagacggggaggguaggggaaaggagagggaggggaggggagaggagagggagaggagagggaagggaggggaggggaggggaaaggagagggaggggaggggagaggagagggagaggagagggagaggagaggaagagcauguuucugagcaugguuacaccuguccucucccccauuugggacaggugugggauuuucauacuuaacaaagacucaauucugagaggagaggggaguggaggggggaggggaguggaggggggaggggaggggagcggaggggaggagaggagaggagaggagaggagaggagaggagaggagaggagaggagaggagaggagaggaagagcaugguucugagcaugguuacaaccuguuagaauuguguuagaggacugacugguuagccauaaggaugugcuuggccuccugucggcuuuccugagagucagguugauuguugcucacugugcuguagugggggcucaugcagugcuuguucuugcuuugggcuaacacugauccaugugcugugcacuagcuuagaggaaauaucaugccauggcucggccugggcuuuggaguggcacaccugcucacugcuauucucagggaauccauuucuucacuccgagagugagguugagggcagcacuuguguccucuggcuguuguguggacagaguguguaaaucugugugcacugcuaacagucaguuacauagugugaauccuaucacugucaucuuaggauucaucagugcucauccuacagaaccugugagcuaggugccaugguuuucuccauuuugcauuugaguaaaaucaggugaagagauccauuuucuagaaggugguaacacucaauuagaagauaggcagggagcacugaggccugucagccaguccuggaucuaggaggagacugcgggggcucuauaauucucuccugaacuauuggcuagugagagauacccggagagggacaguuauuaucuucaguuguguacccaacagugagccuaucagacgucacuggauacacacagaugguccuaguuaaugaugagggagucaaaaauaaaaccccaaauaggacaacaugaaagugggaaagggaccuguaaggugacagaggggcugacagugaggggaggcagagaagaccguguggaggggguaugagcguaagcuggaugcauuauagacaccuguggaauuguugggcaggucaauuaaagauacagaaagaacagaaucaucuagaaagcaagaaaggagggcucaaaagaaaucaaccaguuucaucuccuaguucagauauuggagcuaugagaaaauacaguccuguuguuuaaaacaggaggaagauaaaccggguggugguggugcaugcuuuuaaucccagcacuugggaggcagaggcagggggauuucugaguucgaggccagccuggucuacaaagugaguuccagagcagccagagcuauacagagaaacccugucucaaaaaaccaaaaaaaaaaaaaaaaaaaaaaaaaaaaaccaaaaacaaacaaaaaacccaccaaaaaacccaaaaaacaaaaaaccaggaggaaggaggaagaugauuaugggcaggaggaggaagaagaggaggagaaugagggagaggagaaggaggagggggaaggagagacagguugaguccagucuguggcuguuacuggcuguccuuugcuuuuuugcugacugaggaggaaauggccaugccuuugcaugcaaccuacagcagaacagcaacgucacugggaagaggacagugagacggagguccuuuuuuuuaaaaaaaggauuuauuuaucuguuuguuuguuuguuuauuuauuuuuaaggaucuauuuauuucagacaacuguagcugucuucagacacaccagaagagugcacggaucccuuuacagaugguugugagccacuaugugauugcugggaauugaacucaggaccucuggaagagcaaguagccaguguucuuaaccacugagccaucucuucagccugagagugaggucuuauacuaacugcuuggacuuguccacagguucuccaagagagucccugccccuguugacucuggucaucauauugucuuaagaguccaaguucugucuggaauagucccaucuaggagaggacacaacuauuuguacucuuaugaaagcuggaugcugggcuuccaucaacuguagcaucucccuccuccacaagucugggagaaccaccuuuuguuucccuggauacagaauucacuguuauuggccauuguguaaaaccuccucaaagaaugucuaucugugcacaccaacaaucggcuuagguuaaaucaucucuggguacuuauaaaucuuaguacaguguaugugugugugugugugugugugugugugugucucaucuaaucagcugcuguauucuauuuuugaacacuuguaauuaaaauauaguuucagcuuccaguuguuaaaaucaugaguggagagcucacaugugugagcagcagggaacuguguuuucuguuugaucuuuccugagagaauuucugauagcuucugcacaaagcaggguaaccacaauacuuuuagcccucacugaaccuagaguauaguagggcagaaggacuaaacagguccuaaugggccaugucuagccucugucuucuuguugggauggccuguuacaggagagugcauggcacugugggaagcuggagggacauaacugaggaaguugagccauuugaguggggcagguccccucugcaugugcuacuucugcggguauucaguugcaucuggcucaagacacuucauggggaggaaggaucuagaacaaguugaguccaggucaugugucuuagucaggguuucuauuccugcacaaacaucaugaccaagaagcaaguuggggaggaauuuauuguaaguuuauucagcuuacacuuccauacugcuguucaucacugaggaagucagacuggaacucaagcaggucaggaagcaggagcugauguagaggccguugagggauguucuuuacuggcuugcuuccccuggcuugcucagccugcuuuuuuauagaaccaagacuaccaggccagagauggcaccacccacaagggaacuccccacuugaucacuaauugagaaaaugccuuacaguuggaucucauggaggcauuuccuuaacugaagcucuuuucucggugauaacuccagcugugucaaguugacacaaaaaccagccaguacaucaugucucuuacaggaagaaagucaaccugggguacuuaguucugaacuaguagagaaaauuggccucauguucuaucaugucgcuguccaggcaauacugcaagggcagcugguccuccuggaaucuuaccuguaauagccacccuccaauuuuccccaugcacagcuuucuccuagaacauucugcauucuuuaaaacccagaagaaaugcucuccgaaucuaacaaacccuuccuggaugucggugaagccagccuuccuggucguaggugucaugucugagucugaugugguucuuuugaguaggaugguucccaggccaugaugccucugugcaccccuauuagaugacauuaccgguguguuguccggguuacaaucauucagguuccccguggcugguaauaagaacagcaggcaggugcuacucucguugcuuuauaaauauuucaucuucauagcagucucaugagagagaugccuucucucacccucugaugggccacgguggacacaccaauaaaaacaaggagagaaaaaugagacauuuguuuugucaaaguucugugugucaggaaauuucagaaauauagacccaaagacaaaggaaagcuugugguguagcuucauggaggauggacagcuuucaaaaugcgacggaggaagaccauuugccuugcuggugauggauggacaggguccagcagaacucuccagcgucuccuuaccuuccccugcagcacuccugguuuaaggaaguccccgucuggaaugaugguuuuacuggccaguugucaaccugacacaggccugagaaaagcuaaaccucuuuugaggaauugauucccaucagauugacccaugggcuugccugugaggcauuucguugauuaaugagagaggcugcccuucugcuggaauguacaagaagacaggcugagcaagcuguggagagcaagcuguguuucuccaugaagacugcuucaguccccacuuccagaaacugccuugacuucccugauaaugaacugucauuuugaaguguaagaugaacuaaacccuuuccuugccagguuacuuuuggucagguaauuauuaucccaggugcaagaagcaaacaaagagaauuggcccuaggaagaaaggagaagggagaggaugacuuuccaggauugcgucuguagguuugauggagacaguccuugagucuaugacuugcugagagaaaacaaugccugguuucuauggccugcuuccgggaauaaaggaagcagaaaaagaagagcaggucacagaggaccacugaccuucagaucgaagucccaggcugcagaguaacaacaggcuugggcuguguuuugcacuaacacccaggccacucucugacccuggauaaaccuguaccuagguggggaaugaaggucaaaggacggagggaaggaaguggugaggaauagugccuguggacugucagaauaccuugcugcugaggcccacuauuuuguguggaggagcuagccagcacugugugguagugaguccuccccaccacucgaugcaaacaacuuuccgaggcaggcuggcccuagaguucuguguggcuggcugagguggagaacaacgaagggaggcuuuuuuuucuguuuguuuuugaucagcagguuuggaaacuuugagugcuuggcugagagcugguggaaagacugcaguguuuccuguggccgucagucuggcuucugagauagggaauuggaccuuggcucugccucuugcagggggaugugugcagucacugagggacaggccuugcggggaggagggaagcagaggcguuacagccgaggaaaaggacuuugaaaagcaaauaucccaaaaagcagagcaagggaggaagucugugcauuaguuugcaaaauaaugaacuuuccaguagaaaugcugauucccaaagcccggagcccagagugaggggaagagacccagcaggcucuccagucucauccuguuuuccauugaauuucuucuucaggaggaaaagagucuggaauaggccucucugagccuugagcugcuggcucccuuucuguuucuauccaaggagacaaccuaauagcuguuguauaaaaaaaaaaugcuggagauuuccuggauuuuaaaaacaaaccauugacuugaguuuaaaaaaaaaaaaaaaaacucucugcauuuauauuuaaggagcaagugauucauucauguauucguuugccuggaaaauuuugagcuguucugagccauggcaucuggggcagccuggaccugcaaaggugaagagaaagaguuucuucuacucuccucccuuugagcaacugguguaaacuaauagagccaggccagagaagagcucugguauugugguccuuccaagcacccaagaacaugucuuuuggcaguuucuaccuucaagggcucugaagucuacuuucugugggaagcugcugugcggugcuggcugggauuucuugaaacagaugcagggaaaaaggaagaggaaacaggcagccuuagaacacagcagccauugguguggaaagagcagacaaggaaaaaccaaccugguacuuguuugguuuuggacccccaguucagggacuaagguauauuuugcaauaucaaagcagaccuggccuucagguucucccagcauccuuuagucccuaccuggcacacccuguccccagcucagaacuuuccagcccaggggguucccccagagaaggauucuucuuucuccuuucugucucugucucucugucugucugucugucugucucuguuucuuuuucucccucucucccucucccuccucuguuuuccccauggugacuccccuagccucaauccucaaagccagugaacucacucacccuauagcagcuuccugauaaacuagccuuuagucuagucuaaucuaucaguggagacauaaccuaucaguacauaggacuagcaaaucuuugacguucauagaguuggggaacaggaugguuacuugaaagcagggugugaaaaguuuuauguccaaaccugaauucacauuuagacaaucaaggcuggaagugagaugcucagauucaaguaaaccacaaauaaaaguauucgggucugucuguuugucugguuuagucugucugguucauuuuaucucaugccaauguauagcccagaagcuguaguuaacuguauuagacuguauugugugaauuggaagccauuacacagaagcuuuggaaggcuuuccuggagacagugucucuaccgggugaugaugauucaguauggaguuaggaaaaguuuccugccauguuccauuaacuucugcccuaaucuauucagcaguucuccuucucuugagaaccugagaagacaaccugaauuucuuauuuccuaauaucccaugcauagccagugccauaagaugauggucuguggaggaaaaauuuugggcagauacauuugcaaauauguauauuggcuguggaaaguucccaguacacauguguuaagagucucaagaagucccgcagugaagccugcuguauuagucagggaucucuagagucacagaacuuauggacagucucuagauaguaaaggaauuuauugaugacuuacagucggcagcccaauucccaacaauuguucagucgcagcugugaauggaaguccaaggaucuaggaguuacucagucucacgcagcaagcaggcgaaggagcaagagcuagagcuagacucccuucuuccaauguccuuauauugucuccagcagaagguguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguuguucauuccaaauauugucaaguugacaaccaggaauagccacuacaccugcuuuuuaaaagaaugcuccagaaaguguaucauggguugcuguuucaggcagguguagccugucuucugauguauguggaugugaggcauaggacauguugcuuggccuguaaugguacuuauuucagaccacuguuuggaaggguauauaguguauaccacaguuauuaguagcuacuauuugauuccauguuuuccaagacgcuugacucucuccccuuccucuuuuucuucuuccauuacuuaauaucucagagaagucauguugugugagagaugcugaagagagaccaguuccagaagugagcuugcagucccagaguggaaaacagcuccuaaggccugaggacgaggugguauagaaaucccacaauuggaggaccagagucuauuaccaccgaguggcaaacauuaguuguauaaguggacuguguuuuaugccagccaucuaaugacaaaauaaaaacucagggcaggaaacaagugugauaagaaccauggaucaggagucuuucaauuccaagcaacagaaccuguguucaaauucacagaaaacaagaaaauucauuuguuccugcgucuaggaagggaauuuagguuggcaaagugauagaaacuagaagguuggcagcuaggaccuugcccucccaucuucuugccaucccucccuccauuggcuuuugcccuucuugccucuuuuucuucuuucaagguuuuaccacacaugaagggcacagaucugcagacaguuuuagcuucccaggcuuggggaagagagagagagagagagagagagagagagagagagagagcaagcuuuuuucuuacacuucuugggcagucaccaaaaccagacuuguuugggucccauuuguauuuggugccagucacuggugucagagauggggcucgcagacguggucaggcaguagcagcuggugugggccuacuacccuaaagaagccuuagagaaguuggaugaacagaguucccuacagcugugagugacagaauugaguuagcuuacgguccucacaugaagugcagguguucacaguuucccguugaauucauuuuccuauuggcuuuuagcagcuugaaacagaccacuguauuucuucaacaaauucucacuucacaucuccucuccuuuuuauacacuugagacuauuaauguccacuuuuuuuuuguuuuuuguuuuuuguuuuguuuuguuguuguuuuucaagacaggguuucucuguauagcucuggcuguccuggaacucacuuuguagaccaggcuggccucgaacucagaaauccuccugccucugccucccgagugcagggauuaaaggccugcgccaccacgcccgacucuaauguucacuuguaaggcgagucuguauaaugagugugcucaaaagugagauuagaaucaaccuccuuuagggucccagucccuagucaggggagucucauggacaugcccaucccccaggggcaguugguuaugccugaacauuuuguuaugucuugaccuggagguucucuggggagcagaggcugaggacacugucaguagcuugcagugcaccacuuccucaaguaucauuuggucccaaaugccugcggggccuugguugugaagcacuugcucgugauuuuuauucccccuugagugucagaguguauacauagagggaggaauggaccucacuuggcugggugcuuucugcgcuccgaguuucacccccagcacugcucaaaagcugcacacagagagagguauaugcucguaagcaggaggcucagcaguucagggccguucuuggcuacauagugaauuuaagucaguugggcugcaugagaacuuacauguaaauuaauuaucaugugaacaugauuuuuuuuuacauuuuuaccaaucaauuaacuuuaaaaaucaauaugauugucaaacaugcuuuaugauuuuaauucucaucccuuuauuaugucuucuguguaucuauuacucaugaaucuccuguucucgagauuguguugcucauuuuccucagacaagugucucccuaauaacaaccucaggagaaauggcugcagaggacagugagggcagguugggugcuauuuguuccgacuauuuucucagcuugucacuguagguaagcguccacagcgguuuuugagugcagaacucuuuugucuucuuucugugaagccauuacuuaauguccugcaguucuugaggauaaaguucuaggauacaauguccuuagagcugacuccuucugaggccuccugcauuggcuuccagccucacacgcuuuguccugugugccugcugccacuguccucauucuugucagggcagcagccaugcuaggucaaagcucucauucuucacuccaucuuugguucugaagcccugucuucacuuccagucacauucugaggucuugggggguuagaccuuaaucagaggaaccagcauggaggguucacagguacuacugaagagucuuccucacaguguggaaaccuuuggaaaaaugauuuaaacuuaacaagauugaguguuaacauauuuagagcaaauaacuccuuucaucacacaguuaugacaaagaguaaauauaagaauguacccagccuuugccuccuuggaguuugucccuguccugacaccuguccuaugccacucauggugacacgugaaggaagauguuggaaggaagaucuucuguccagguuuccaacauguuguauggcaaugagaguaaauaacacauuucuugucauggcaaguagauagcccugauaauuacuaaaauuacuggccaugguguuugucagcagcauuuacauaaaauaaaacaucaaguucauugauucaguuucuccuuuugcucauuuucuuuugguuguuuucauauucugcuguguucccuggucucuaaggcucucuaguccuuucuucuguuuuuuuuuaaccaucuggggccuaaguauuaccaccaggucccagguaacaauagaaucaaucuguagacucagccuccauuguaugugguucauuggagcucuccaguguagggagauacauauucuucucuuguucucauggacuuccauggcagacauuguccaucuauuugaucuuggacuuccauggcagacauuguccaucuauuugauuuaucaaaaagaauguccuuugugaacacauuucagaagaaaaacaaaggcaggacucagcaauucugggaaucacagcccugacuccggcuaggugauagacuguccccauggcuucauuauaucauggcauuacugcaucccugcaucacagcaucacuaugucacuccaucacuguaccaccaggucacuguaucauugcaucacuguaucacagcaucacuauaucacuaaauuacugcaccuugguaucacaguaucauugcaucacuguaccuaugcgucauugcauuguuguacaguagagauguugcuagucagacaguuccuagaacugugacaacugcaggagccaaacaauuuaugaagcaaaacuuuucuucuuuuaauuuugacucauaguuuuagagauuucagcacacagucaguuggcucuguuguuucuaugcuauugugaggcagaacaucaugguggagcaaaauugcucacacugugaaagucagagugcaagaagagagaaaggagugggaggggcuagugagugggaaggagacuagcuauggccuucauaaguauaaccuucuaagucacgccucuagucaccuaauuccucuuccuaggccccacuucuuccuaacaucuccccaaauugugacaccaacuggggacugugcuccuagcacugaagucugugguuauuuaauccguagcagacaaugagaugcuaucggucuguuuggaauagugugguagagcaccuggaacagagcucuauccacccuagccugucugcgcaggccuucuugagguacaaugcccacagaaagccguaaccucagacgugaaaacuggagagguccagaaaaauggaacaggccucagggugaccugagacuacuuucaguggaaguuccuuccucuuagcacaguccaaggcaaagagaaaagggaaccagucaacauuuuaaaaacaagcuuaguagcuccgccccucuguccccauaggcauugucccauccucagaaauaauguccaggaguaggucagaggaaaggaaagaaggguucaggggagaccugcugcugcuucgagguucugucccacugcuccaaccuggccuccccugugugguucuuucacagcaaugaauugaaagcaagacagacgucuaguaagggccggagugauuucugucucuugucuuagaaacaugacucaagaaaacuuucauugauaggauggaccaaccagagccgugugcauccaagauguaggcguuaguaagcugacuuucuagugagacagaucuccucuaucacauacacgcaaguauaagcaaacaauugaaugucuguauuaaggucacagacucuuaguaugccacauggaauuauguggagccagaaggcaagcagggucacuuuagaacucuccacccacuccaagcugccuccagagauuuauaguuaccuuggaaggcgugguuagggugucuagccaacugccaaggcugcuuccucuauuguuucugcccucagugauccucagauuucagucucagugagaauuauuauaccagacuguccaugcugauugcauuaacggggcaaugucaggaaaccuguacaguccuugggagauguggggugugauaaacuuaguuuuccuuuuguucggagcucucaugaaggguuagucaucugacagccauuauugaaaaugcuggcccugggaguguaacugcacaugggaugagucuuccuuuaggguguuccuguauauucccugaguguuacacuaggggaagcaaaagguaccaggcgaacaaacuuguccagaaaagacuuaaaaguauauuuucuucuucuucuucuucuuuuuuuuuuccuuuguuuuuuugagacaggauuucucuggauagcccuggcuguccuggaacucacuucuuagaccaggcuggccgcgaauucagaaaucugccugccugugccucccgagugcuaggacuaaaggugugugccaccacuccuggcuuucaaaguauauuucuaucuguuaugacugaccaaaaauugagucagucugguuuauguguugauaguugcuucagagacaagaagggcauucaccuguguagcuccaguggcacggcccugaccauuagugaucuccccagagugugugcugccucaggaccucucagugaggagaggucagagauccuguccacccuguuacagugcauaggguggaggucuggcagaggucucaucuuucucaagugguagccaaagcuacugagauaggagcagcagagacuguauucaaggccaggaugagguccucugaggauggaaaagagggaaggauugcucauucugcaacugugcucccugccugcucugcaguugucacuacagggagagcccaugaggccuagcuggccugggaaggaagccagggaaguccuggcuucccccugucaauggcugcuuugugcugcuggccuccugcucucaaggggagacacuggagagccugccuuuguguucucaccugcucagcagguuuuccucccagaaagaaagaccaguugaagugggaagaaaacaagagcggccuuugauuucuggaagguuaagucccuucuuucuuaauuguagacuguuucucguggaggggcgggaccgagggcuguucaaugcaguuuucuuucugugaucuauucucuugaucaccaggguuggguguuuguugacuugaauccaguuaccugauacgcacacagccuguguucauggcagacagagcuucuuccguucuuuucauucuaggccauauauuuggcuguggaucucuuggguugaagugauuugguacugauaggguuuguguugugaguguccucggguauucaagcagggcggagaccaugcagagccagccccauccuuagcuuacuuuggugcagaauggggagcuggaguuauuuuauaaggucauauuguuuucagcuuugagcgguuuuaaacacaaggaagacuuaguauuguuuuaauaaucaugucuucaggauaucauccuagaagaauuaaacuuacuggaacauaaugcaagccaucagggcuuuuaacacagcuggcugaaggccuucuaaacagcuguacaggaacagguacuucuugccuggagagugugggcaaggaaccaacugcucccugaugcuuucucuuucuucuuuugccucuucuuaauuggcuucagggucuugcuuauuuuaagacuauuccaggaauguuucugccucagagcuucuacacuuacucuuucccuaguccauggagcgauuucucagcucuccacagggccugcugucuaucacauuucucccaggucuuuacucagccuccacaggcucagucaggcuuucucugcacaguuuuuuuuuuuuugcaaucgaggucccuuuaucuaugccacccccaaaucagcaacaccagccugcaccgaugagccccaacccacuuuauucuucuugucccuugcuggcaucuaacacccaggucugcaccuguguucucagcacacaaagcaagccuggcacccaaaggagggcaguaaugauuuguggaugaaagaugaaaccacugcuuuguggguuuguccuugcugggcgccacugauuagcacaacaggguugcuaaucauccuuagccaggagcaauagcuuuguuuggguuuaguucauuuccuggccagcuccaccgcagcuaguuauccacacaacugccgguaucacugagguguccccauuaacacugccaugccugugaugcucacuggccauggaaaucgggauagaaagggacaaaaaucuaugcuggucagguaaagaaugaaagaaguguuauagauuuuguuccugagagaaaagggcccacgaucuacagaaacgggcagugucuaaggaaggggacaugugacuuuccauuauuauguuuagcaaugagaagaauacaaacuaaaaagugcacugagguguggguuuucagccugccaagcuuuuucaggcugggacucacuccaucuguuggugaggcugugugcaagcaggcugccgcaggcuuugcuagaaggagggcacgggcacguagguggagccuuaaggagggacuuuggagaugccuaucaaacuuuaaacaguauguucucuuugacccaacaaguuuacuuuuuugauucuauuguaggcauuaaccuuuacaggugaagaaauuauauaagcauaacuuuaugccuugcaagucugguuuguaauaccaaaggcaagaaagaaaucauggaagcaccccacagcagggaccuggcucaucagggaggucacacccuggugaccagcugugaaaagaaugagugugcgccagcacuguaccauacagaggccuagaagagacacuaaguuaugaaggguacaggguucugcuuuuguauaaagaaagggggaaaagucagaauauauuuuuguuuuuguuuuccauccaugaggguguucagaaggagagcauuaagagccaaucacaccacagcuguagguuagaggaaaggccugauggguggggugacauucgggaaguaaccacauugcagauccgggcgcugcaccuuuugaauugaguugucaguaagcuaacggaauggagaggcaggggaggaaaaucagaacuucuuuugugagagaagggaaggcucuccugaaagcucccaggccucguggauauucucccacuggaagacuggccguggggagggagugugagcacgugugaacuccuggggaauuucuccuuccucaugauauccugguugcuauagugcagaucuauuuguaacacacagaaaaugcuuuaaauaaaagcuacuuccugaccaugacuuccugggcaauguguucuuccggagacuguugaacgccaaaguuuacaagcagucugagcgcgaacccugcccauucaggucggagcaccauugggagcaggguuccauccuguggucaggggguugcugugcuccugaaaaaaaaaaaaagaaagaaagaaagaaaagaaaaggagaaaaaagaugcaggaagccgaacucccagggcagagucugcuggaggcuuugccuccagugcuuaaguguagccuccaucuuucuuuggggacccagggcgcgguuggcugugccgcuguggcuucauucucuggggcgccaaggggagcauuucucauacaccagugaaaacaggaagugaugaugaagcuaguuugccuugcaucugcgcugaacuacuuucuuuuugucauucuucauuagguuuagacacgugugccgguccacgcgguaggaccuccguuucuaccugcuuuguacuuccuccagucacacaaugccgccgccuucggacaucgugaagguggccauagaauggccuggcgccuacccuaaacucauggagauugaccaggugaguaaggcagguaggacuggagagcucacaacaguuuucuucuucgcacugagugguugcagauuuugaauagcuucauguccuuacucuaaggggcucugaaauccgggcaguacuuacuacaguguggucuguguauauacaauggcaguggaugggacuuuuauagucuugccccaucugcuggauucugucaauacuggguuccuaucugaagcaguagugauagcagcuggagggauuggguucugagcaucaggacagauggacugucccauccuacugcugggacucgugacggagcagauuuuuauaugggcaauguaaaacuuacuuuaaaaaaacaucuauuuaucuccagaagaaccaacaaguguuuuguuauauuaacaacuuuauaauaaaauuaguacagaccacauuaucuggaauaugguacagagucagaaaauauguaaugaauauaaagggagauucaucuaagaaucaugucgucuguggguauggaugauuggcggucaugugaccugguucugacucugauuacagauuguccagggaauuugcuuuguucucauuucacugaggucauucuagaacaagugauuggagggaagaaggacgagacuuaauuuauacuuacaggguucaagagguauaguggcauucuauacuuucaauuagaauaccauggcaacgccagccauuauacucuugauacuauuuuauaauuauagucacaguucuuuuucuggucggauuuuauuaucagguugaagaucaccggccagaguuacauggcauuguguagauucaaaggaguaaucuaaacaaacccuacaggucagaucagaauaauugggcucaaaucugcauguaagaaagguuacauugugcagaccgugaaagagugaccaucacaccagcaucucacugucauuuucacucaauggagaaacaacucuuacaaguaaagccugcaccauagcuuugugcaggugucaggcagccagcacucaugcuucagccagcacucacacuucuucacacgaggggcccaggaccacuuacauuuugccuuuaaagagauuaucuagugauauuugucauagacugaaugugguugggauuaggugugguguguccaaaagaaugacaaccaagguaaaaguggucccucagucacagcaguccugugcucugcagaggacuggggcacgguccauucugucucuuugguuugcuuuaucagcauucaggguucaggaacagaugccugggccuuagaaaugcagauucucaggccuuuccuagacugcugacccagauaugcaugaugacaagauucccaggguauccccguguacaacuaagugacaaguggcacccaagccagggugcacauuagagucacugucaccgucaguuuauucgaagagagucucauuuccugguucugaugaacuauuuaauuuugguuuaaucaugauugguggaauuuauggcuucucuguuaaggcagccuuagauucauauuccagaugccuggggagucaauagaauguucucugcucuggggauggccuucucuguguaugggaguuucaacaauuuaaaaagaaaauaaucuuuguacuuuggaacaauuuuagauuuauagaaaacugcaaagacucuaugcguuuccauugauucccuuauauuuuguauucccuaacucuaacauuguugcacaauuuuagaccagaugcuugcuccauaaucacauuaaauacaguauuaguccauauuuauaucucaucauuuguuucaguaaagucauuuauagccauuuuucuaugaugucuaaaagcccaccccaaaucaucuacaacauuuauuauuauaccucuuuugucuccauuguccgaaauacuucuuuagccauuucuggcaguuauuuuauggaaagcacuucagcuugggguucccugguacauucugucuaguagauuugaauuuugcauuuugagauaaaguaccagggaaauggugccauguccucuucagggagacacaucagggaacucucccaugacuuucuuucauucuuguucguuauuccagugccauggacgagaacaugggcauucagagaagucauguuaccugucaguuagugagaaggcugggucaggacugggggcuuccuuuccucucaagauuuaaauuuuagaugguugucugaauuccaguccucguggcaauuccacacugaggcagacaaagaaugaggaagccaggcucuuccugccugggaggacuuacaguagccccacagcaacacugcagucagaucuuguuuccugauacaaugcaaacuuggcaugagacuuggaaacauacuuucacaugcacugaauacuugaaaugaugacuagcaggaguuuccccuggucugcugcaucauucaguaaggcuccuacugucugccugccccuugcacacuuguuagcagaaauguuggaaagcgcauugcuuccuuuaaacccagauaacuacuauuucacucacagcuuuuugguaaagguuggguuaggcauugcuguuuuggggccucccgccuucaugcugccaucgucucaacucugaguagguguccuugaaccuugugcuggaauugugcaggaaguuuacccagaguauacaaugcugagcugcagagaauuuuauucugucaacaagggcagggaugcacuuaacauaauaagcaccagugacuaggagugaacuugcacuuaaaggcuguuucuccaaugucuugugaccacucuguccuugauagauggacacuucgccagugaaucgugguggaggggcuucugcugugguaguuaucugggcuccacucuacccagcuguccucuaauggcaccuguucccaaggacaucugcuugcucacuguggacuuguuuacauuccuucaaagucuugagcagauuccuuuuguguuuuuuucugcucaacaggaagacucgcuaggaucuucucgugaauggacuuuugcugcaccagauggcacauuccaaagucauccucucucuugguccaguacuugacccuguuccagccaggcuguguagggcuaaagaggguggucuucaagauggcagaagccagagugcugccacacuuucuguuuuaguuaucuuuccccuaguaaauacugcauaacuguggagucugagcaucuggccagagguucuuccugaguggcagugccaguguagagggugguggggugagggugggggugggaauggugugcaguagagauguguguuguguuugcuggggcagagcaggaguacugacuccuggcaaggaucuuugguuggaauuucagcuacaguaacaaaguacuuuagauggaauaauaaacagaucuuguucuucccauuuuuggagacugggaguugaagaucaagccaccaagguugaggaucugguaggaucugcaguuaccaaagguuugcuuccauggcccaugguacaggcugacucucugggucacaguguaaggauggcuuuccugacuuagucaccuaucaaaggcuccacugcccugucccaccaccagaggcuuaguuucagcucagacugagaacacacacauuccaagcuaugcuaucuuaggguccugguuucuggacuagcucaguuucugacauugagauuugaaaaccugccuugugaaagguucucugucucucugucugucucucucuccaaccugucuuccuuuuccaggagagacagaagaggggcuggccuuucagccuauuccagcccaguccaucucuugugguucuuagcagccuuucuuugaaaggcuuuggccccauccagugcugcucccuuuacagacucuuuucuccgacaacaagauucuuacuguuggaaauuguccuguuggaacucugaucagccauucccuuacaguuccucuacucucauacuugcauggaugcuuucagcauauuagcuaugaugucauggugccuucugugggugaacagcacuuuccuuuccuauggagcuggccuugcugauauacuaucuacuagcuucaguccaguggucuucccucagccucauuuccccuguaauacuacacagaauacuccuacagcccuauccucagacaucagucaguccugugagacuucuucauuccuugguuauucuggaugaaguuuccuccuugauccuagucuacuucuguccagaucuuuucuauccucagccuuaugguuugugcacucaccguggaugggaaauuuugaucuuaauuccaugaucucccagauguuaaauaugaucccugucuaugugauaccugcucccaugaccagugugggguauuaucuggcaucacuuucaaaucucuguguguuggaggcaugguuuuccauauauaaacuacucuuaccuacucuuaccuuuaaaaggcauacagaugguuggugguauucuacacuuguaaagaaaauggucucaggggaucaaauauaguccaguggaugggccguauacuuuguacaaggagacuauuugcaugucagacaaagggccagucaucuucacuauguguguuagggaacugcugaucaagucccagagggugaugauguuugacaacuuuuccuggggagacauaauacacacucacuacagauugguagcccaugguagacccaacuuggugaacauuauuauuagagcuaguuacacaaacacgagugaaggguugcuuacagaagcagagaugacucaaagacagcugcaugaacacagccaaugucagcauggguaacagcuuauaaaggcuagaaaucugacccucacuacacagcaugaaggcagcccagcagguugaagaguguucucuucuggugucucaguucuucugagcaucccccaggcagcugcucugcuggucauuguuucuucuaggcaguuuggccuguuguuuucuccaggcugcuaggcuuggcucccuguuuucuuuguagcuaggguguucugagagaacucucaagcagucuuuacuguuuccucuugaggagggaggagccuagugaaucuggucaguuucaggcacuuccugaaaguauuuugaguuguuuacuacuuccugucuuaagaagcuucccuuuaggcuggauacccaacagaaggaaagauguccuuggcuuccagacuuaauuuggcagguucauaauugguuccuggauuuucagggccuccuugcucauuccugucagagugaauuuguauuaggucauuuuucuguucugaggauugagagaaggauuuuguuugagaacagugaaauauccuaaaggaaaaaaaaagauuaugaaugauuaugauuaugggauuuucuagugauucucagucucaaaucaauauccucagcauagcuagcuucauagccuccugucauuuccucccauugaucugugucugaggcaucuguccuucucaaguccccuccugcuuccuaagugcagauucuuuaguaugucccugcguggucauaggcuuccucauuucuccagugucccuccagccguuuacggcucugaaacccucccaguguguuaccuugccugccucugcugggaaccuuagcucccacugagcucugccuccuuacccagcucuuuucuuagcacauugucauacagucuuuuucccagccuuucauuuuuugagccauuuuuacugccugcuguuuuuauuugcaguuaauaaauucuguaugcaauguaauuuacauuucucuugugaaauugauuagaagcuccuaguggucagccuguggccuggggccuaguacacugaucucuuuugucuguguguauaccuuggacaugaauuuucaacagcuaagauaagaauaaaguuuugaucguuuucauuugucacauuuuaaagaacaccuuuccauauauugauggcaaguuuguuuccccagaagaaacacagauauauguguuuuuuggguaaccauguauacacugccuguguuuuuuuccccaguuaucauguuuuuguaguauguuuaagguauaauucagcaggugaaaaugugaguuagauuagacuuuuuaaaagagcauuaauugaguaaagugcauucagaguuuggcauuucaggguuuugugggucauucccguaacaguagcaacaggaauaauaauggcugccaucuagucaacauauacugugccaggcagcauacaugcucugugcaucgaguuuugucagauuccuacagcccuaaaguuccacaaagguguccuuuuucauaauuauucacaggcccauccgcugggcccccaggaggaauucugcuaggaaggugcugcauugaauccagcacuguuggagaagcugugcaggcaggcauuaguaaaucuaggucucucuguuggcugguucugcuaucgccucuccaucuauuguguuccuccuuagugauucuucccagugacggcagucugguuugaacgaaaacacacaccaucauaggugugccugcuccauggcuaucacugacaucuucaggaacguguugagugaagagagccaagacuccauuuucuuaaaaaccacaggugaucugccccccgggccaugcaagcccuacaggcucagacaggcuagcaugcaggaggugggugggcuccugggcaacagauuagcagggcgcuuaaaauauggacuugguggagacugauuggacuaaauaaguuagcauuucccuuggguauuaccaggagaggguuccaauuuuguaaggaagaauuggcaguauuccuaaguccuuucuugcuuacauggcucugugagggaaacauucugcucucugccuaaugaugccaccacuauuagcagccagaucucauucuccuguuauacagaauagaaggagcaucucauguuuuaggcaaaucucaaaccaauaaucaaaauuucuccuugaauacauuaaaccagaucuucagcucgggaagcugcaaaucucaagguguuuaaacauugauuguuuggucaaaagcaaccgauagauaccaagcuccaaauaaaaacagcugaauucagaugaggcucuuaagauaauguaagaugagaaaaaucaagacagaauugugacagaacuucuuuguaaccuugcaguguuucucucuagcuccuggguuagaugcuuaccucuggugcuuugagccugaugaugcuuauuuuuggggcugcccuguaucuccuggcacuuuaaggacauccuagcuuuccucauuagcugccaguaucaccucucuagcagugugaugagcagaagugucuagacauugccaaauauuccucgggcaggggauaaaauaucuauccuccuguucaaaaugaaccagaugagagaucccuagcuuggcuuugcauuaggauugcucgggagccauugaaaauacaaagaggauggaugagugguuuggguccauggauuacuguuuuuauccaucucccuugggggaugaucucaugguuuguguugcauuugggaaacacuguugugagggcugggcauuuacuggcucugcugcaaugugucuggcucccacaguaaauuucaaugccucccuuaaagcagaugaucuauuucugcaucaauaacaguguccuaauaauucugggccucuccuugcuuuaugcaguaaaguaaggaguacaaacaugacacccucaaacacucucuuaaccucaggugggaagugugugauaagccagugauacuacaguaggcuuuuucuggaaugcugcuggugggggaagucaucccuccucugaugguugcaaugcuucaguuugguaauguagcagcuauuucuuaaacuuccuuuaaaauaaugugauugugguaguuccuuuucugggucucucucucucucucucucucucucucucucucucucucucucucucucucucucucucucucauaggguagucuauagaacuacauaugauagaauauuacaugaauaggaaaagaaaagcaacuaguguauuucuccccucaacugaguuuaacaauuguuggaaccaggagugaacccuggcuuccaagccguucuuuuuuuugaagaaaaccauaugauuugcaugcucgcugguuggugugggguuauucugcagccggccuccuccauagaaucuaugcuuaaugaaguuugggcaacucagggcagaguuuugagucaauaguauucgacugaaacuucgugaguaaagcuuucuuaauuucugcaacguuuuguaugugucaugccuuguguuuuguuuuuaauaaaucagcuagagauuagugugugaugagacacacacagacacagaucaguuugugcgugugcaugcacacacacacacacacacacacacacacacacacacacucacuucaguaugaaggacccuguguccucagaaugaugaccuuucacuuuauaaguaaagacagcuucugacugagguaaaguguguccagagcucuggggaggagaagacagucaugggaauggaacaccugcuugcucuuuuuuauaucuagcaaccauucaguugcuaaguguguccuuucagucauugcugucucuaucauggugacaacuccuugcaucucccacacuuccucaaagaaaucagugcuggaaagucucccuucugaauggcucaggacucugccuauguuggacacuguccuuucuguggcuucuagaauccguguccuuaucccuuauauggacuuugccagccuuuguagggccacaguggcuuaugucugucaucauaugccacauucccuccauguucauacagaguccuuuccuccuuagaaccauaauaaaucaaguuuuucugaacuggaacucaggugccuugcuucucugccuagcugacauucacucucccgucucagaugaagccuagauuccugagggaggucaugucugacucuuuagacuagauaaaugagggcccugugugcaccugugauaccaggaaggguucuccuugccaaccuugaagcccacugugugaucuacauuguucccgagcgugccuuguacuugcaaagucacagcuguaugcccuguuagcagaguaaaggagagagaugauguuacuguucucuguuuauugauaaauacaguguaguacaauugugaaaauggauggcuuuugacagaguacuacuuuccuuauccucauuaaggauucuaaauaugagagccucaugagaccgacccagugacugugggacaaguuugugauaacaugguaggauuuaauacaguuuucgucagugaugggaugauucuaauuucuagccgauaucccugacuucuuaauccauauagaugccuagacaucugccucuuugcccuucuagaaaucucuaguucuucaauuuuaaaaugucuccacuccaagguuucuucugccacuguguaauucucucccuccuuccuccguaaggaugggcaucaccuuaucccuucugcaucagcgaaacugugaguuuuccuagauuccccugucccucgguaggcaugcugcccaccagcccguguagacagcuuuccuuccacugugaucucauuuccugcuacugaggccuuccuugucaguguugaggaaaacacccccagaaaacugaaacauaggacagcaucaagucucgucaaaggaagaacuuuauaagaaaggcauuaguaacuauaaaaacaaagacuauuaacauacaguuguaaaccaagaacgaguaagcaugaaaaaaagccaacuagaaacccugagaaggaaagguugcaaauagguaauaaaauacaagguacaguauaccaaauauuuaaaagaauaaaaaacaaagugauuuaacuuaagagagaauugguuaaaaaaagauaaagauaggauuuguccaaaagauagccuuuaaaaaggaaugcaaauuaugaaugucagggucugcuggcaaagucccaauugugaucaauggucaguucuacuaauugugagagaaugaaggcagcagacgcaauauuuaaagaagcgcugccuaauauuuuaucccuuugguacugaagaaaauucugccaugagaaagaacaggauuuugaugauugaaugacacauggcuuucucuucuggaaccucagagacauaguucucuauggaaauggaaacucagaggcacaggggcugcggugggugagguagugcuuuguacuucccaaucgucccagggccacugccgcagcucugccugguaauaagggaggcaaaaggaucaagagcucucuccuucagugcuggcaguacaauugcugugguccuuuaauaauguccuucccucagcaauugugcuucgggcuuggucuuguucaguggcugccuuuuucagcuuuccauuagguuuuuacuggcuucuccaccuccagcaaaaucugcuguuguucaagaauacaacccaguuaugccccuuucccguuucaaaaccuggguugcaccaagcuuucaagauucuauauaugauccuggugguucugcuuuuagcuuuccuuuuuuuuuuuuuuuuuuuuuuaauuuuuguuuuucgagacaggguauuucuguguagcccuggcuguccuggaacucacucuguagaccaggcuggccucgaacccagaaauccgccugccucugccucccaaguacccagaaauccaccugccucugccuccuaagugcugggauuaaaggcauucaccaccacugccuggcaccucuuguauucuugugaugauggcaacucuuccacauuuaucauaggaguccauuuagcuauugcuuucuauuuguuguacugacagucagaaaugcccgaggaucuucacaggcuaccucuuguugcuccucucuaucuauauucagaauaaagagaaauguuugugguguuuccucaaggugaauugacagaauugggacucaacaccacaauaggaaggauaggaaagauggaauauucauuccagcucuauuuuuugacaagcuagaaagagacaaaugcaaauugagaauugagaguguagagguaauaguugaguuugagcuugugggugcacacacacacacacacacauuugaagaggccugagacaaggaaggaccauggugcaggcagcuuggaggugaugauuuaaauauuaaaagcuaaagggagcugaaguggagagcugaagugcagaguuccagaguugggcaggagagauagauggcucagcaguuacgagcacuggcuacucuuccagaugucuugaguucaauuccuagcaaccacuugguggcuuacaaccaucugaaaugggaucugauggacucuucugguguaucugaagacagcuacaguguacucauauagauaaaaugaauaaaucuuaaaauaaaaaaagaguuuuucaguuaguauuaaguuuuuagucaugauuccuguggauaauguguaaggauuacccacuagucuucuggacauguuaaaaaauauauaaaccaaguaacauuuaucaccaagauuaagcaccaaggugcuuagaaucacaauguccuuccauucugauggugucaucugugcagcauggcucugagcaucuuccuuacacagccucauagaguuuucucagcaguacaguaggcuuaguccucugauaugaguaugggaucagauagcagccacuguugcuaaauauuacagugcuggucacauaaggauagacagucaagucuuauuaaugcuuuauugaaggcaaaggaauaugaagacuuugugcccauuguuugcauauguuagauuuucuuuucagagccugcuuuaauauucuucaagcccgcaguucugcuucggguugucacccucacauuaauagaacauuuguuucagauuaagaagcccaacguuucuccagugccugcugguggacaucucagcaaacccccugcaauuaagagaggauaaauuggcauaauauguccacagagggugggaacuugauucuuaaaauugccaccaccaucaguucacucucuuacucauuggacugccaugugcuaaguaguuuuaugucagcuucauacaaguuaauguuaucugagaggagauuuaggaaaauaagacucugcuuccauaagauggggaggacccacccacuguggguccugcuaccccuggacggagaaucuuggguucuguaagaaagcagacugagcaagccuuggggagcaauccaguaagcagcaccccuccauggacuucacuuccacuccugccuccaggucucugcccugcuugaguuccugucuugacuuccuuuaagccaacuaaacccuuucuuccucaaguugcuuuggucaugauguuucgucacagcaauagaaaccuuaacuugagacaagugccaucucucacuucuaccuucuuugcaguugacaaagcuuucucugauuucugaaaaagguuucuuuaauauguauaguguucugccugucuguaggccagaagagggcaccagauuucguuauagguaguuaugagccaccauguguuugcugggaauugaacucaggagcaaccagugcucuuaaccucugagcuaucucucgagugccuggcaagucuuucucaauucuguguuuaaauugagccuggauccuacuuugccaugagaacuuaggugacuuauucacaucuagucucucauuccagccacuuucuaguuaucaggguagacauucauauuuuugucauacuggcaucuuauguucaaacugugcucauauauacgguuaagauucaguauaugaucuuggcauacauaaguggauuauuugacaugaaggcagguaagcagaccacaagaccugaaucaauuuacagugugaaaagaacauuuggucguaaggguggggcagcgugaagcaggcugcuauugaggcuggagucaucgugaagcaauucuuagaaagcuugauacugagaaaaguugagaaugaguuaggaaggaagaaaucgguucuuggugucagagauaaugagauguaguaaauauugguaugagcaaaacgaaagagucagcaguuggaagaagucucaggaggucauacaugacacaggaccuucuguguugugguugaauugucuucaaaaauuggaauuucucuuucauuucaauaggaaaaaccucagcuucuacagaauguauuagagccuuuaaaagagauaacuuuaucaauggcccacuaauguguuggggugagaauuauuuaugucuuugcuuaucuucauagcccaguauauuuuuuuuuugaaaaaacuacacuuuauguugguuaaaaaaauacuuuguuaguuuaugaaucuugaaacaaguaccauauaauaagccaauuuucaaguaaaucaucauuugucaagaaauagcuggcaggauuugucaucuuauuuuugauacuuuggaaucuuguuuuggugacucacauugcaacuguugucaaaauacuuauuuugcaagaacuagcuauauuugccucuuggaagugugaauuuuguuauuuuccuucagaucaguucaguuuuuguuccgagaacaaccaauguauacacacaccacucucagagcacaccacauagcuccauacuaagccugcagcucaguguggagccgucagaagaccuuuggaggacaauaaagcuaacagaguaacuggugucacugaccugguuguuggggcacucugcaacuagaugggccauuguacauuaaaguuuuuccaagucauauugugcaaguuacagucaaccuucgaacgcauccucugugguaccuuggcguuuggcagcuggguuucuuuucuuucugggcuaacacacauaacugcugugcagaaucuguucacugaguuuccaucuauaaagcaaaggaaaauccccagcgcugggcaguacugcuucaaagugucagaauaaagcggcugccagguucuuuuaaagcacugcagaaaggauuaagacucuaggaccaaaaaacaccuugagaucuuuauggaaaauaguuuuccaauuaaggggcugaguuaauggcuauaugggaaggugggugauucauggggccuagaggucccuuugcacucuugcugugucccuccucagcuacuugucugcacuucaggaaaagucggagaccacggauaaaagaaguuacacuccucaggauucauaaagagcauacggugugcacugggaacugccagagggucucagaggcuaccaucuucaaagcaaauagacucauuggucaaauauguaaaaugccuuuaagaauaaagaucaggaugaaccaucucaggcagagucacauuagaacaggaggaagaauucgauauaaaggaauuugcuuaauuuuuuaaacuauggguuauuauuauuuuuaaaauaaguaucugugaaugucuaaacauggagauuacauugaauggaccuauguguaggugacauuuauaucuuaacuaugugccacgugcccuuccaagggucuugccucauggucucaauuuuuaugaugcuacugugugcaagggauagcuuuuaguaugguuuuuggaaggguaaacacaccgagaagagaggcaauguacccaucuuuauaaagcugggggcugcagagauagggugcugccccuggauauuuuucugaagcugcucagaagguccagacagagagaacguuggggaacuaggagguaacuacaaucccaagugacuuucaggggucucuucccuuaaucucauccccugggcaugcuuuucuguccagaaacuauucugagcaaauguacuucugacggaguugagaguuuuacuauagagauacuugugguacauagggcaucugggauccuaaacuguggcuggcagauuuagagaacugcggcccauaguacccugucacugacagguguguggguacaucagcugggcugcugccagcugcagcaggcagguggcaaggcagaaacguggacagcaacagauuggaaagcucgaaggugaacaagggggcuggguaaaguccccaagccaggaguguugguuggcagucaggaacagguggcuguguagccaggagcagccaggaucauccugugcuggacugggaggaucucugaugagggauagauaacagcugagaggucuccugggaaagugccuccuggcaggcuagccuggcuuccuccuaaacaaacagcccugaacaggucucucaugccuucaagggacauacaugcccucaguugacagaguggucauuuuucuaaaagaaaaaaaggcagacaaaaggagaaagcugguuuuguaaagagaaagguuccauuuuaaggaucucugcagggccauggaucugcgcagggguuauuuucagaaccaaaccuuagaagaagcaucaggaaaggagaugaggauucugaaccucgcugauacugccuuuuucuaaaggaaauggaagaggcagaggggaggagggggagauccagcacgcacggaucaagagcuaugccagagaugcagacuggagaugagcugcuagaaaaggggacauuuuaggauucuagcuuauuuuauggaaaguggagagaagucuuuuuauggggaauuugcucucugcauuuaccuacuuggaucaagaaaacaaaaucaaagaauuauuuuggagaauaaaagauaaaaugagaagaguaaguccauuaaaaggauguuaccuucuacuggugguguagcucaggggcagagcacuuaccuagcaguugcaagguucuagguucaaaucccagcauaaaagaccuagguaaaauucuuagcacauagcuccaaaguggaaaagaaaacuaaguuuuuaauuguauguauucguaucugauguccugccaggcugguucauaugagaaugcacaguucauuuaacagaugaguuugucuugaaagauuaaacaauucaucucagagugucuaaaagagaaggagaaaagguuguggcuugggccccugugcauguagaaauguggccauggucucgugguccugcguguucuaaaaugcagggcugcucuucugaccuaggcccacuguguaguuuaggaagguacuuuuuaacuuccaaagcaaaaaguuucagaaauuuagcucgauuugguuuuuguauacauuauaaaaccauacauaaacaguugaaauacuuuacuuucaacaugugaauucuaaugauuuccaauagagucuuaaaacugauuuugaguucuuuggguggcuuuggcauuacaucuuagauccaaugcuauuugcuuuuuaggcuuuuuuauuuaaugaauuuucuaguuagcuuuaauuguaaauuuaacguaguccauagucacccaagaggaaagccacaagugaggaacugccugggucagauuggcccauuggcaugucuguguggcuugucuugguuauuaguugauacagcacugcacgucuuguugguaccauucuuagccuggacuguuuaagaaagcaaguuccugagccuaugagcaagccagcaaacagcauuccuucaugguuccugccuccauguuccuuucugugugugccuuuccugauuucucuugagaccugaaagugugagccaagccccuuuccuccucacguugauuuugguuauaguguuuuaucauggcaacaguaaggagccaaggaaaaugaacgaaaggagaguuagucaaugaaucuuaggaagccauggaaggaugugcugcucagaccacuauacucccaaucuugaagaacuagacaaagacagaaagcacaaagaugugcuaguggaacaucuuagccaagcguuaucuaucuagaggagacucaauguuucuauuaaauggaaacccauauccagcuauugucaaagauggcgauuggcuuacaagucacuggucagucagcuaacuaaugcgaaacucaacguuuauacaggaaaugagaaaacuaugauaccagccgugugcuuuccaguuugguaucuuauguugacuugagaguaacuuggcuugccuguuggguauugcuuaaugaugguacuggauccuggccugugucucuuuuaucaucugcagaauugucuucauucgcuggcuggcuccaagucauguauagaguuucuccugagauuggauuuguacagaguaaugacagcuuuuguguaucugugagcuuaugaccagcagcugcuaagagccacccagcaguggaauauuuucuuagaauaguuuauuaucccagucucuccuuucuaauaguuugcuuuuuuacuuacuuauacauccuuuuuuuuuucuuaaguaauuucuuaauuacuugacuagugauuuuggaagugaacccaggguguaguuuaagcaggcaaauguucuuugagcacaguuuugguuuuaaaagaauuuacuuauuuuauguauaugaguacacugucgcucccuucagauacacuagaagagggcaucagaucccauuauggauaauugugagccacuaugugguauccgggaauugaacucagaaccucuggaaaagcagccagugcuuuuaaccacuaaguuaucucuccagccccaguuuugguuuuuaaaggaccaguuuaugaguuuccauuugauagaaacauugaguguccuuuuagauucuacuagugccuacauacugugauacuaacacugaggguggagaaugggagaguuauagaugaauuaagaugucuuuuucucaagggacaagaagaaaugacaauaugcaaaguacucaggugugagucaucuuuuguuccaggugaagagagagaauaauuaugucuuucuggcgagaucagggacauguacuuggagaagguggcuuugacgugggugauaaauaauugguaagaucucaguuguuauagguagaacaaagagaaaggggacauuucaacacagcauaugacagugaaaauguggauuuagcauauuuauuuuaaucauacacaaaauucagaaucaaggguuauuuguauagaguagaauuucuugacagcagacucuggaaggccuuacaucuuaaacuuagggauguauacacuucauagcuaaaagcgaucacugaaaauccaaggaauauguuagaaguaaaaucucagagaaaaguugaauuuuguuuaauuaugguugacauggugauuagacaauaagacuagagauguagagaccuaacuugcuggggugacacccaaguucaaagugguaggcacaacuugaaaagagaaaggucgucaugaugguagcaacacaaugagaaaaugagaagugguaucuuguaaguguuguguccuggaagggaucagaggaaggugaaagcagaacacauucucuaaaaugugccuggaagaccugccaaaggcaugggcauggaguguaggagcucaugggcaggaagucggaguuaacuggcaguccacacagugaagauggagggccacaguggauuugugccauagauagagagaggagucauaguggguggaguuccacugagagggugaagggucacaguguuugggaugccucaugacagugaagggucauaguagacuggugacacagugaggugaagugucauaagguagcagcuaaagugggggugaagggucauugugagcugaguaccauagugaggugaaggaccacagaagguggggugcuaaggugagggugaagaagggucauaguggccugggugccacagagagggugaauggucacagagugagagguguuccagugagaauaauggaaggucauaguggguaagugccauaggguugagggugcaggauuacccugggugaugugccaagugaagguaaagggucagaguggaagaggcacugcaaggagagugaagggucauagaagguugugugccacacuaauggugaggggucauggcaagguaggacaaggaggacgugagaggugugguacacucaccuagaugcagagcuagcuagggaaucccagugaagccaucuugcucaucaucaaacugaagcaguguuuuuaugaucugugcaacugaauuuugagagagauguuagcaacagagcuaugcacuuggaauuguuggucagugggcacuaagaggguugaccgguaaaagcaugggaaaccagcaccaaaucuuggacucgggaagccuaagguaaagggaggaaggagguauguuuuggacuuuauugaaaggguauauaacacggauuguggggaaaguagguuaccaaaggaaggaccagaaacaaugucaaaugaagcugacaggaaaaggaaggagugaagugcuguaggccauuagauuaagguuugauuagagcagcuaagagaagggucagaaaguggaccauggggccagccccagccuuauguaacagccguuuuaauuggcugagaugcauauuccacucacucggcccagccuuauguaacagccguuuuaauuggcugagaugcauauuccacucacucgccccagccuuauguaacagccguuuuaauuggcugagaugcauguugaguguucagcucaccguuguuccuuucccguuccugcggcugagaguuuuuguuuaaucuuucuguauuggguuugugagguuauuuggcuucauggacuuuauucuuuucauauuucuaacuucagaauguuccagauauaauaguauccccgugaugccuguucugaaucuauggaucagauaggaauuaaaacccaagucacugucugaauccuggauuuacaggguuggcuugguucagaacagggacuuuggaaaccuugugcuauugcagcaaccgcucucuuggcuugauuuaugacugaagccuggccuuguuaccaguaucuucucuuugagggcacaagcuuuggggauacgggacuaauaggacucauccuuacacccccauauuuugacgggggucugccaacuagaaauacauaguuguuaucuuauuagaaagggguguuguuugguugauaggccuugguuuuauuuuugagauagucuuauuguauaacccaagccuaucuugaguuugagauccucuugccccugccuccagcauucucaaauuacaggccuguaucuaugaaaauuuuguuuccaaaguuuuuuugccacuugguuuaagaacacauuugcuuuccaguucacagaugcaguuacugcagagucccuggcaaaggcccaggaguucuacaguguauaauuuaacuauagaccucagucaacauuucuuauucucaaaggcgaucaacucaggauaaaaaauucucaagaauucuugguuucccugaacauuauguuaagugaaauaaguuagauucaaaaagccaaauauacguuuuaaauuauaugaggacaguagaauaacuuuaaguuaagcauuaaauagcauucaccagagacuagaaagugguacaggcacagcauggagaaagaugguuaauggggacaggggcacaguugaauaggagggaccaauuuaugggugugcuagguauugaaggaugguaugugaugugauaucacuaaaucuugcucuagcacaggaaaaauaaucaacgucagccaggcagugguggcacacacuuuuaauccuagcauuugggaugcagaggcaggcggauuucugaguucgaggacagccagggcuacacagagaaacccucucucaaaaaagccauaaauaaauaaacaaacaaacaaacaaacaaauaaauaaucaaugucuaauguuuugaagaacaguagaauaacuucaaaaauaauuagcugaaaaaccuugaaacagcuaguaaaaaugauuuuaaguauccccagcacacagcaaugauguaugucuaagaaaguagauguguucuuacccugagccaauuucuauacagugugaaacauguauugcaaugcgugcucuuccccauaaaagugugcaggugccauacaucaauucaaauguaucuaaauaacuaaacaaaagguaaacuuaaaagaaaaauaguuucccacccacuauaugcauagcuguaggcagaaacagacccugcuuugcgcccacagagggggacauggaggugaaauucgcagggcccccugugaaucagcucaggagcauuuguagacagguagccucuuguucaaagccaaggaugagcuuugucagcaacacuuugucagcagcgcaaagaaccuaaccauuuuaagucucuuuuugcacuuuuaaaauaacuacuauucaguaauaaccauuuaguguucauaacagccuuuagggguggguagcggcuaccuucauuuacagaucagcuagugauguuuagaagauugcaguuuacacugcagacacaguaagcucggugucugagcuugcuagccagagucacgguuucucccacaccgaucuuuguucagacgggcaugagcacuggguaacuuuggcagccccuaacuucucuguggucugucuuccucuguucccuaugucugucccuugucugggaucuguucugggugacacaucccucucaccccuccuuucuugcugacaggcagugucugcucacugccuuccuuguguuuggggaggcagagcacagcugugcccgucagggcaagagcacagcuguggccagccaccuguugagcgcuuuucucugguggcucaugcugcagaauaaguggcauuuacuagggccacacuugagugaaaacucucuacauaccugcaagaacaauuguucaucucccccaaucccaucugcuacauguucuccuaagaacaucauggaucagggguuggagaggcagcucaguaguuaaagucuccgacuguucuuugagaggacuugugcuccauuuccagcacucacacuggguagcucuuaaucauuugcaacuccaauuccacggggcuauagucaccucuguauacacacauauacacgcacagguacucgcacucucacucacauagacacauaauugaaaaauaagucuuaaaaaagaccaugaacugaagguuguuugcauaaaaccaacagaaaccuugccuggcucauucacagcuugagcaacucuggguccaucuugaccuugcaggcucccauuuuuuaauacgacaaacuuaaauauggugauaaugcuaaguauagaaacaaggaccauaaugauaaugaauaauuauuuaaauuugauaauaacacuuaguaauugguuaccuugagaaaaaguaagagaugcauugacagcuaagaggagcaacuguaaacuuuccucaguuaaacauuuuuauuaguaguuucuccuuuuuguuuguuuaaaaucaugaagugaaacuaacuguauuuccuuuuccuuuuuuuuuuucuuugcagaaaaagccacugucugccauuauaaaggaagucugugauggguaaguggaacuuggagcuuggccgaggcuuucuagucuguacauaaaaggcaaauaaaauauuugcagcagaguggugagcauuauucacaguacuauaaauaacuauaaccauacauauguuccuaacacacugcucauucugcccagagucacucaguuccugugugugaguggcacccgaucccgccacucuuagcuauucuuccuccaagagcagagcgugcaggagcuggggguggguccugcacaggaggcuagcauuccuugauuuuaggaagcuguucuccuuuuggccuucccagcagggggcaaucucaagguucccguggcuaagcacacacuccaucugaagaaacugagaggauuucuaggccagagaagaugaggagccucacacgcccccgugaggcuugccacuuugcugccugagcugacaaggcaaggggaaaauucacuugaaaguuaccucagaugggugacuggcacagcagagcugggacucugguauauuccugauaaauugcacaagaugcagaauccuuaauuggagcguuuccaaucugugccagguggaccagaugagaguuuaguauucagagacaacugaagaauauuaaauguaaaauguaaauuguguuuauguccuuuguuuuucuucuccuugcuucagucuuuuaaaagaggaaagaguguugcuuuuaauguuccacccacccugccucugguguuagagaugaacuguuaaaagcaggaaccggccuagucagucuaccugugagaugguaggcuccauccugguagagagggcaggcuaaugccuuguugucuuggaaacugccuuauaacaugguacuguacugggccaaaucuaaaucuagauuuaauucaucuuaacccagaaaacccacuaaagcagaaaugaccacuuccguguuucugaucauuuccucuucuuuuaaagguggucucuugccaaccaugaauauuuugcacugcagcacgcugauaguucaaacuucuacaucacagaaaagguaggccauaacccagggcucguacaccgaagggugguaaaucauggcuacuucuuccguuuagagccaguuaaaauguuguguccuuacccucugugauaauaaugucuauacgcaaaaccugcuucuuuaguaucaaaaaaauacuguuuaggauauucaagagugaaguuuauuaaucccagcacuugggaagcaaagguaggugaaucucugugaguuugaggcuagccuggucuacauaaagaguuccaggauaggcaggauuacauagaggacucuaucucaagggggaaacaaagagugaaguccaagcaggugucugagucuuguuuauccaaccacacuuacuuucuuuauauuuugaacaaacaaacaaacaaacaaacaaauaacuaaacacaguuucuuuauuugugugugaggguauggcaagugaggguauagaaugugaggguauggcaugugagggcacggugugugagggugugguggucagaggauaccuccaggagcuggcucucucuaccaccugguuuguaggaaccaagcucugccagucaggcuugcugacaagugucuguaccugcugagcaauccugccucuacagcaaauacuuuaucuguuacuucucuuuuuuggaguuuuaucucuuuccauuauuuuguuuuauauugaauguacuuacuacaaugacaaaaaacauugugagaugugacaucaucugaacagugacccuuccauggcucuuaggaacuuacuuucuuccuaggucauuuugacacuguuuauuaaguuugguugagacuuagugauaugugaagacuuugcaugacucugaaagaaagaaaaauguguaaaaguccucugauagggaaaggaaaacuagcaauuacugaucuucuguuuuaccuguguuugcugaucuuuuucaagacuaaacuccaauauaauaauauugaacuugguuaacaggugaaaaaugagccacugaagucacaugguuagaccaccaucuugacucuagaguuaagaaggagcuuuagaucuuuguacuucuagaauuucaucuuuggaaguuucugaaacacucuaguaucccacugaauucuugagagaacuugcuaugguguauaggagccguguguccucauggauguggggcugguggggaaggagggaaacugguaaggccgggccaccagugauucccuggcugaugcuggaaccagggaauacaugaugcucucgagauggagaagugggugaccucaggcucugaaauacgguugacuucauuugucccaaucggcaguuuccgggaugaccuuaggaaugucaucauaaaucagauggaggugggaaguggaaacagugguguguccacuugugucucaguugcuguuccuccagacaguagucuucuguagguaggagcccuuuaaguuagaugccuggaacugccuucaaaaauugccuuugucuuuccaaaaggcacacugggacuuucaagagugaacuaguuuuccuuucauauuccugccugcagauggcgaggaagcauggacuagauuuucuggcaggcgcugauuaucuuuuaguauacccuuggcuacuuaaacuuaguccauaaauaauuaaguuccauuugauuauuuucuuaauauuuuuaauuuuuguggcaccuauauaauuugcaugcuacccuuugugagauuuggagaguaucaauaaauaaaaguugaacguuggcagugacguuuuaucgcugugguuucauucaucagccauggccagugcaguugauucagaugguugcaaagucuuuaacacgaggauacaacagaauagcucagggugaaucuccugugguuuuugugaaauauuuuucucaaauacccacauaucaaacauguagauugaacugacucugcaaccugugauaaauaagccacugugucacugaggcccugccuuugacuaauguaugcggacuguguucccuaguggcugacauaucccuuguuaucauugguuaaaggccuuaauucauuguucauuggcagcuaaggaagaccuagagcguaauuaucucagggagauggggugagggauggagagggacacacacacacacacacacacacacacacacacacacacacacacacagagagagagagagagagagagagagaaacagacagagagacagagaaccuuucacaagguagguuuucaaaucuuaaugucaaagacugaccaggugagcuugucaucuggaaguuuccauuuaaacuuccugggauugcuuccgggacuguccugggaaugcugguauaguacagccagggauuucuuaaggaagaaagaacauuggugcuucagagauagacaggucuccuuucuaaagccagaccuauaucugugggaccugaugcacucuaacccaaaguaguuacaagguuggguugaggaguauauguacuuucauuucuuagaaugauuuuuauagcaucagaagagauuuaauggcauuuuuuaguuaaaagucauauccauccagauaauucaaacugcuaagaguagggggauguucauuaguuuuugaggcauuguucucauuuuuggaggggaauauuguuugccuaagacauucuuucugcuggguuucuaaggaacuucccucuuccgucugucaucaguucuucagcacguggucacaacgaucagccuuucacuacgaguuuagagacugagaauacucauccucccagucauaguccuguguuuguaaauaaugugucacagcucuucuccuccagcugugugugccugugcaaggcauagagcuagacaugcaguguaggagaccaaaauguaccuugacccuuuaggggucaaaccugggcuauccucugucugcaucuacguucuuguaaguuaguucucuccaaaaauagagacccuuuuccguucuuaaaauagcauaguuacaauucuccugauacuuacaacccagugaauuguuagguaauaucugcaucaccaugguaaccagugacuaauuuuugaaggucuauaugacauuaguuucugccuuucacuuacuaugagaugguuuuucucuccuugacaagagucaccuguaauuuaaaagggaaauauuguguaggccuggcccagcaugagaacguaugaagucacugagggaugcuugaguuucucucaaagauuuucaggaaggaacccauccucugccuacuuuucucauguuaucugaacccauuuucuaaaacaguucucauuggcuuauugggcuauguguaguggguuaaggaacauuuuguagagguguaguuugaaaaauuguagacaauugugagaugcaucuauuugcaaauuccaauucugucucagaaacauaaauuucaggauagaugagugguuuuguguguguguguguguguguguguguguguguguguguguuugugcaaguguguacgugcaugugcaugcaugcaugcaugcacuugugacuguaucacugaaauuucucuuuugagacagaaugguagugagagagugcgcaugguuuuagugaucgcugaucacugucacuguaaucuagugagguaagcaucuucauuuucauaagggaagugagaccaagaaaaguuaugagacaguuuguguagccugacacacuagaagugaucaagcccagccuggccuugguaggucugcuuccagagcugcgggaaugccacugcucugcugucugcgcucccuaguguugaugaucgccugucuuugcugacauggugauccugauuccaauugccucaggagucacagaacaacagaaccaucauuagcagugucaguaugugacuuucuuguacuaguguauuaggggaauugacaucaggcauaaccuccauuaacuuacuagagaguuacaaaccuuuucccugccuuugcuauagauuaucugaccaucugggauaaguacugugauuguacuauuggcauuuuucuucuuuuuaagggaaaugagaaaauugccuugcccuuuuuuaauaaguaugcagaaaggggugggccccuccaaacuauauacaccagaggaagcauuaugagugauagacuuugaugaacugaggccgugccguauuugcagaaugguauuugcuccuucucugcuaagaccaacucaauuccauaugaaguagagagauccauccccauaaauucaauaaaugcuguuucuuguaaucacagaugugaugagcuucaugcaggagcucucugcaaagcugccccuggagccucugggaggaagugaggcucugugaggaacaccuguguuccccuaucccccuucuccuggugcucugguuuuucuuugaauguuccagauuccugacagcucuguguggccucugggacagggcauccuguccuacaaguuuauugugcacauuccauugucauugucauaagucaucagaauaaaaccaguaugcagcaaacaccaacacucuccucucucugcagagaggagcaaagcuugcaguccucauuuccaucucaggcuucuuuuuccuguguuuccuccuugucugaggccagucagcccuaccacguaacugaaaccaccauggacugacugcucuuugugacugguagaccgacaaccuucucaaagauuugaacgugagcaaaugaaagcccagggagguuguaaaauuucuggcacagggagguuuuucuguaagaaucaggauucuuaugaucaagaguaauuguuacuuccucagcgaacuuuacaccucaguaagguauguacagauuauguucacaccugcagagcuggguagcuccuccagaccuggcucuuagcaaucaugugugagaggggagaaaagcucuuguaccccacuuuccccugaugcuuagcccuuguggguuucccgacuccaggcauuucucuccuuggccuccucuuuccuucugacaccugaugcaggugucuccucugcagagcguaugcugcagaauucucugcuugccucgugaugaaacaggacauuuguuaacauugcuuuguagaggcuguguuagcuacuugacuaucuauucgcagacuuugucaagcacaggacucuggaagacaugguaaguuccccaguguguuccaggcacugcgcuaagugcuaaguuuguguacaguucaacaguuccagucuuccugauucucacagaccccagucacuugauuacaauggcaguaagggccacagacgaaaaaugugccugaacuuaaugaaguccucaacaaguguuauuuaagugaaagucuaaagaaaacaggguacuuguauggacaacaguaacaugacucagauuaguagcuggcugucaauucucauggcaaggccuugguaagaguagugcccugcauuugagaccagccuggucuauauagcgagauucugucuuagauaaaacaagucaaaccuaaucaaauaauaaagcuacacaaacaaaacacaccuggguuguuuacuuacaaagaacaggcagcaagagccaaggcuaagggcuaaauauggcuggaccguguggcacaagccacaacuuuucaggcccuuuuaggguguuguaagauguuuagcuucauucuaaaauuauaugaaagcucugagguaauuugaagcuggacaugaccacaaauguuugggcuauuauuauucugauugauuguguuggaagcauaagucagucaauggcagaaauuaugaaaaaaaaaaaaacaauucauuguggauaggaaaagaauucaggguuagcuuggaaugcacauagacuagcauaaaugcugguuucuauucuugaauucaaggagaaaaugggaccagauagcagagucgaaauaucuacuuucaucaggguguguuggcucuugccuuuaaucucagcacuuaggaagcaaaggcugguagaucucugaguauaccuggucuucaagagagucccagacuagcuagggcugcaaaaggaagaacuaucugccuucaugaaguuuacuguucaucaccuccuuggcaacauauuugguuauaaagccugcacuugcauaagaaugauguuuaguuauuucagaugaucuuuuucuaagucuauuuuccuagccacauaaaauaucagaauauacuuacccaacuaaugcaccaacuucaacuuacuguuuagaauugacuucuuguauagggguuccuaauuuuaauuauuuauacuguuucuaacuuguauuaggaaaacguaggaaaauagaugcaauauuuuccuguagaucagugugcagaauauaggaaggaggaauuuuucucuuauauuugacagcucaguguaugauggauugaguaagauaacuaaaaaaaagucuuuguucccauuggagguuucagucugaagacagauuaguugauaucccuaaugacugcaaggucuggguuuuuaaagaauauugugaauauaacuugaauuagguagguuuauaauugaaccacuuuaauucugugucuuauuugaacauugcuguguggaaugcaacacuucuacucuauuucuuuauuguuacuauggagcgaaaauucauacacccuaaauauaacugucucagugauuuuuuuuuuuuuuugcugugacaaaacacuauggagaagaccacuuauagaagaaaaaaauuuauuuggauauuacgauuucugaggaugauuuccugaaucaucaugauaggggcauggcaacagauaggcaggcauugcacugggucauuagcugagagcuuauguuucauccguagaacuaaggagaaagugagagaaaauagagguggacggagggaggaagaauggaggagagacagagagaaacagagccgaugauuaugugcaugcuagcugggauuggaauaggcuuuugaaauuuuaaagcucacccucagucacauacuuccucuacgaaggccccaccuucuaauccuucccaaagaguuccaccagcuggggaacaaacauugaaauguaugagccuauggggaccauugucauugugaggaccaacggaccuacaacacagugguuuucugucaugcuucauuguuuuuuggggguagcaaagccuugauauucuguaggauauuucugucuucuaaaacaguaguuuucagacuuaauggcagagcuagagauuuauuuccagcauuccauagcaaaugcccuagcacuuuuaaauagugcaggucuacauaggcuauugcuacaaccugguggguggaaguguacccucugcaucugaggaucuagaggcaaaaaagacucaucagcuuauaugcauacagaaguuuccagaaaggaagacauugacccugacuugaaaguauugcugacucccuucccccaguccacauacuauuuuucauuaaauagagagaaagucucaacacacccugugauacauuuccuaagaagcgugggaacauuuagacauaacuguucgcgucagccacugggaacacagguaggagcagaccuggggaaaacaguuggaaacaggucaggucuucuccuaagcuguuugcagccugugaaccaggagcgagaauuagucugucaccccuacccucacacauacacuuucaguuucucuaacuggaaaucccaaagauugucaguauaaauauuuaccuuaagagcacauugguuaaucccagcacucgggaggcagaggcagucggauuucugaguuggaggccagccuggucuacaaagugaguuccaggacagccagggcuauacagagaaacccugucucaaaaaaaaaaaaaaaaagaaagaaagauagaaagaaagaaaggaagaaagaaaggaagaaagaaagaagcacuuuggauuuuucccaguuccauaguugacgaucaaaggcagggguucaaucaaaggugaagugcuaguuacagagugugucugguacuugguucuggaaggaugauugcaguagaguagagcuacuacuguuggacccucuuuaccuuuugugaauccaucaagcauauacaaauugaaacacacacacuauacacagaccacacauguuacacacauuuacacaugcauauauaccacauacaugaacucacacacagcacacauacauccauaccccccacaucauaugcacacacacacacucccucacaugcaccacaaaccacacagaccacacacacacacacacacacacacacacacacacacacacacaaagccuucagauuguccugacuuuauccagcccuggcacuggcuaugcccguggaaagcuaaucccacugcugucaggggcacuccacuuacauucuguuagauucuaguguccuugcucuuagugacucaacuaaacuggcaguagacauucugaaaucucuaaaaacauuuuugggugguuuuggaacuuuguaauuacaguuugagaacuggauagaagcccucauuuugaauuacucaguguuuuuccuuuagcagggacuuggacgugcauaaacuucaagaugaagagaaaaggcugucuaaguugaaucacauaaaugagagggggugugagccagaagggcagugacgcugucagcauuccucagcuggcaguggguuccaugacauguuauuuaaguuucccacugacucguggauauuggcuauaacaggaugauuacauagauggaugccuuguuugccuggguucuggggcuugugcuugguaagauauggcugcuucuagaauuacagggaaagauaaaugccagaggucaucaugauuccauguucugcaguucagcuaccaaaccagugaacagacugacuccgguucugaaacauuuaacuguguggugcucagcugcagaaugaaggacacauucacuuucuccaaagacagaguuccucccagacuucugugaaagacacguuuuuugucucugacuguaaaugaccccggaagcagcagcucacccuuucuaaacagacaggcaaaacucauuagcgaaccaaucaguuccaagcuugggccugugucucuuauauguuccaaagccagggucuucuugaaaggcuucuaaguacaacccugcuccuguguuuaugcuucagagagauuuauuuuaaaucagcauuagauuuucuuccucaguuuaggaauggagacccaguguguuugcaucuuuauuugugaguaauuguguguuucuguguguguguguguguguguguguguauaaaaagccauucaugcaacauuagauacuuuguugcuucucuugauguuguuuuuuacuguauuauuuuuaccuugcuuuauacauuuaaagcaugcgcuaaaccugucaaaagcuuuuuaugauuaccagugguuguguuugacaguugggcgaccauuucauuauucucugcucucugugaccaaaaccaaagcuagaugcucccagcuuguguuauucaaguagagaugggugcggacaagaggguaaggggaaggagcaaaggaagaaagcuagaggugugucaggagacuguggggagagcagaggaggauuuuuuuuucuguccccuggaaagcagcaugccugcaacaccacagaguuggcauauaggccacuugguugcuauucuuuccaucauggucaguuaagauaauaauuauuguacaauguuuuuuuuuuucuuuccugauuucuaucguucuaguuaucaacugaucucuccuaaaaacacuucacaauuaguaacuuaaaauaaaacucauucuugguggcugugauugguuucacugaaguuucuggucaggaauuuggaugugagaaagcagagccaguggcuuuuuauuacuuggugccugggccacagcuuagaagacaugugcuggaauccuugucuuuaccuguaggcuauggugacuaaaaagacuccuucucaagaugccuucuucuggcuucuuuggguaccaggcaugugugugacacacagacaucccuauaguuaaaauacccauacagagguacauacaggcaugcauauauuuguaaugcauacaugcauucauacauacaugaaugccuucuucuggacucagagggcaugauaacugaggucuccucucccuacuacccguucaucccuguauggccuaggcauccucuuagcauggcagccacagaguucucuuaugcaccuacgugggauggagacuguuugcagagaguaagacagcaguuguggcugggcagugguggugcacaccuuuagucucagcacaugggaggcagagguaagcagauuucugaguuugaggccagccucgucuacucugagggugaguuccaggacagccagggcuacacagagaaacccugucucgaaaacaacaacaaaagcgaacaaauacaacaaacaaacaaacaaaagacagcagcuguggagcuucuuguggcauaacuguagagaucuuguugguuagugcacugugcucugcugaucugagcacuccuggucugcccagauucaaggggcaaggucuagaauauucuuccucauauauugaguaaagaaaaaaaaauccuugagggcuuuaugauaaaauguccuaccauccuugacaucucuaucagggaaaaauuaggagggaggcaucguuuuuccagaggguaucagaguagaaacuggcuucuaccuuaaguagcgaaagaagaaugaaacaaaaaauagaagaaaguuuaaguuguaauauggagggcaucagugaaccacauuuccaugaaggacacacaagaaaggauccguggggcuggagacaugacucagugguuagagcacuugccuuuacagagaacauagguuugauuccuagcacccgcaugaugguucucaacuauuuguaacuccaguuccagugaaucugaugcuuucuuccagcuuccuuacacaccaggcauccaugugacucacagauauauaugcaugcagacagauauacauacauacauacaugcauacauacauacauacauacaugcauacauacauacauggaugccuucuucuggucucuuuguugggcaccaggcauaaguuucagacacagauguacauguaagcaaaaugcuaugaguauaaauaaauaaaucuauuugaaaacauuaaaaacacaggaagauucucucugcucuuccugaacuggggaggaggaaauagcuguguccuauguucucagaagcauguauugggccuuuugauuggagaggaaguugccauagguucuucccucucugucuugguuucaguaacugcuugucacugugacacuuggugcucuggagcagaggagcuauggggaccuuggcccaguuaugagccuuuccagccccugaaugugagagaaguuaggguagccuugguuaucaaguauaauaaaacauaccuuguacuuuuauggaaauggguagggaggggacaauaaaaguaaaguuuuaaaaguuaauuucuuugugcuggauuuuguggaacacaucuuuagcccagaauuaagaagcauaaacagguagaucucugugaauucaggauagcagucuacacagaaguuccaggcuauccaggaugacacagaaagauccuguguguguguguguguguguguguguguguguguguguguaagggagugugcaucacaccacaaugauuguguagagguuagaagacaauaugggcagaagaguucuguccuuugaccaugugggucucagggaucgaacucaagucuuuaggauucugaacaauuccagcaaaccugucuagacaucacacuuggccuucugucuuccuuccuugguccuuagacaaccucuuuugcaauuucaaagcuuagcagucauguucauauuuucugaugcuaaacagaaaucuuauacuacuucacuaauuuaaaaaaacucauaaaacuucuuuuaggaucuuuaucucuuaagcaaacaaacaugaaaucucacuauauuccugaaacauuuagguagagaauaaauuuucaagcaaaauaaaccuaaaauuucaaaauccuacuuauuaaauuauuaggauagaacuagcauuuugccacauaaacugaaauauuuuauauaaagaguguauuuguauuuguacauauucauagguuacauuguaguguuauauauaauaggcauuuuaacauacuaguuaauauacagagucuacuucauuugaaugaagauuaaacgaagugaugucagcagaauagucuaguaucauagccuguaguccucccacagcgagccaggcuuccuauuuguccacguuugcaaaggcugaccaaaucccaauuuaauucggaugauaccuuauuuguauuuguacuuuugagcuguaccacucuguuuuguucuuucucucugcuucuaaaagauggugcugaagcauuucauuuauagaguguuuuagcaaaucccuaauuuugcauauaaacuauagguagaaguugaaugcuaacuuccaagaaauuaugucacccagggucaucgguagagucuguucacuggcaagccuuuaggugccaggcacguuuaggauuuagacauucuagaacuuugaggauuucaggcuacacagauauacagugucacaauuagaacugaaagcaggauccucuguauuucuaaacaguugaagaagcaaagaauaggagcuuauuaauacaaucuuauaagacauguugcuuugaguuguuuaaacacaaguaaaaugaucaacugaaacuccaauagaccaacuuaacuguuaaugauagucagugguccuuaugaccaaugaccuggucacauugauuucaguuacuucaauaggaagcauuucauuuccuccucccuggugcaugcauuuacagcuucuacaaaugcauacuugauuggaaagacugcuuuuauuuuaagucaaacauuaauucccucaaaagaauuagucuaagcuaguuaccuguggucccugauacccuuggcuacugggaguuagaugcuggauuguguuggccugaggucauuucagauguccaagaaagaugaaaaaccuaguugcauuacuauuuguaaguuuuuauugguuuuccuguauguguuuuaaagaaugacaguugugauugaacauuagcuaugcacaauugaaagaaaaaaaaaaaaaagccgggcgugguggugcacgccuuuaaucccagcacuugggaggcagaggcagguggauuucugaguucgaggacagccuggucuacagagugaauuccaggacagccagggcuauacagagaaacccugucucaccccccccccccccccccgcaaaaaaaaacuugauccaaaaauggccauggugccguauccuuguacucucagcagugaggaagggacagcucagugucgccucacauauugguuucagcccuagagucccagagucaaugauugcucucaggcaggcuagucuucugaccaauagaaacuugacacugugauaaugcauuagguggccuuagaaaacuaggacaccaagaaggaaugcagaauccuuccaccugagccagaaaacagaacucaaaggcaaaccguauacagaauauugguauaugauuauaacgaucagguguaucucuuguuauugaacuuuaugucaauaagaaggucuaacuauuguugauuauaucaauaaaacaugcauuuacaaaccuaugagcgcucgcugguaccaaugcaaugcuucuuugucuauuuuuguuucuggggcaccaucugagauucuuuuuucacccauuucagaauaaaauggguuccauuacuugaaaaccacugucuggcuaauaggcacuuuguaagcagacuacauuuguggugcuuuaagaauguggcuguuggcaaagggaagaagagcagaauuguaugaggcuagcuuagagccagcacauugcuuuaaaauauauguuucucuuuaauucuucucuuauuacaugcagaguaauguauagcuauaagaaacccagcuacuaacguugauucacauugaaguuuugcaugaguaauggugguuuccuuaagaguuuaacuuacuuaaaagcagaguuuaaaacuuuuuuccuuuuccuuucuuuccucuuuucccuucccccuuccccuuucccccuucucccuuucccccuucccuucccuuugcuucccuuuucccuuuuucuuucccucccucccucccucccucccucccucccucccucccucccucccgcccccucucucccucccucccucccucccucccucccucccucccucccucccucccucccucccuccuccuuccuuccuuccuuccuuccuuccuuccuuccuuccuuccuuccuuccuuccuuccucccucccucucucucucucucucucucucucucucucucucucucucucucucucucuuucuuucacucuagauuuuuaucccccuccugguccacccucugacugcuccauauucuauaccucgcacccccccaccccccaacgaggauguuuccaccccaaguuugaaacuuuuuuuguuguuguuuuguuuuucuagacaggguuucucugucuagaaacucacucuguagaccaggcuggccucgaacucagaaauccaccucccucugccuaccaagugcugggauuaaagaugugcgccgccaugcccggcuaaguuugaaacuucuaauugggccaaauauagcaaaaguauauaaaauagaauagcagacaccuucacauuaccaccuagaugauaauaguucuuagcacuuuggcuacugccacagcucugccucaucauuuucccaguuuguuccucuguucuccccuccacagcaguaaaugcuggucugaaggcagugggcauucuccugaaucuuagauagggcuucugcauaucuguauguucauauauaauacacugugcugcuuaaugugcagaacuuaaaauaauugggaaagggaggcuggggagaugucgcagcaaugaagagcacucacugcuccucuagaagaccugauuuuagcucccuaaauucauauguugguucgcaauuuuaacuccaauuccaggggauugacauccucuucugggcucugccgguacuguacacacacgaugcacacacauacauucaagcaaaacauucucauacagaagaggacaauaaauauuuuuuuuuuaaaaaaaguaaauaauugcuauuucuugaaaguaaccauuuacaauugaauuuuuuucauuggguaaauuuuauuuuuuaacaaaguaugguguccuaugacacacaaaaagcaguggccaugacaauuuucuaacaaauaaucaguugcuuccuugcuucuguuggugcugugcuaucaauacguuuguguggaaccauuugaaaguuuuucuagauuagaauacagacacguacugggucaacuacaacauggagugcuaccagguuuuguggguccacucgcuuuagccacccccucacauugcaaguuucuauuuccugauaugaacuaguguggucugucuucugcuauccuaagccagcuggauggggugccacgggacuuuuuguggcauuaacuuacauuuacccaacugcugaggcugggcauaguuuuucuuauuuauuuucuacucagauuucacuucuaaaaugaccaguacaaucuuuguccguuuguggucugcgagugcuggucuuaaggaguugacuacgguguuuccaaauagaccuuuauauaaauauuuucacauuauauucuugauucacuuuccauugucauuuggcuucaguauuuucaaagcacuuucucuuuuucacguacuuucaaguuauucucuuacauuucuuucacuaauuugaaaguuuuaauuuucauauaagucauuaauccaguuagacacucuguaucauaagauacaugugugugcaugaaggaggcugggauucacuuuaauuccuuugaauggaggcagucaaucaucuuagcauuguugauugggauauuuuuugucuaucucauccugcacuuggcuugccuugucccuggugcagcuugucauguuuuugugaucaggggccccuacaccucuguacuuuguucuauuaccagguagcuuugacugcuugcaacuucguaacgcgacuuuauuucuaggggggcggaauccauuucuggggccucuccucaaaacccuacuccuuuacucuucuccucuuccuuuuuuucauucuucucauugcaaaucagcuuucuuaguccuuuauucuaccauauacacuugaacaguugcuugccaaaucccauuaguauuuugcuuaaaauagaauuuuaauguauggcuuaacuuuuuguggagauugcuuucuugagguuauugacuauaucucccaugagaacauuagaacauuagaacauugauuaauaaagcuuuaucauuuuuccuuaaaggcuuuguguauauugcuuagcuagcucauacuuuuguagucuucguaaauaguaccuuucuuagcuguuaguguacuauuugcugaguguuuucucacauaaaaaaauacuuguaagccuacauucugcaaagauagaaauauuuugugaaucaaauuccccuuuugcauauauuaauaaaaagaaguaucaaagagauaaagacguugacucagguucuguggggacagcuagcuaucuggacauccuaggcuuuuacucuguuuuaucuaaaucuuccuauuuugcuagcaucuuuucuuuucagauuagucaguguuucucugauucauacuaccuugcuuagcaggaucuuuuuaugguaagaaacucaaaucucauuucagaccuuucaugaacaaggcauuuaauuuacuaaauagauguccuuaauaacaauuagcuaauucauuugggcaggcacauucauggcaacgaauaagucuacugaauaaauguuuucucuggucauuaucuuuaguuagguucuuaaggaaaaugccaguccuaauuuaauuagcuuauaaaaaaccguauucacugcauuaauaauacucguguauauguagggucaaggccccuugaaugacagacagcugugaaggcuuguccuagcacucaguguguaucuccagagaaaagaggcaguguucacaugcuaugcugaauuccacaugcauuuuauggcuuuuuuuagugggcauacaauuauuuuucuuauuuguaguuaagauauuauauuuuauuguguauacaucauuuuauuauuacauuugcuaugcaacaauuauucuuuuuauggcuaagugguacuuuguaucuaugucugcucauccacugagugacaccuagaagauuacuacccuggcuccuguuuauugugcugcccuaagcacuagagugcaggugucuuuucagcauaccagcuucauuuccuuuggauauauacucaggagugaaauuacugcuccauaugguaguucuauuucuagcguuuugagaaacuuccaaacaauuuuccauaaugucugcucuaauaugacaucuccaccaacaguguugaaguucccucugauucacagccucugcagcauuugccaguuucuguauuuuuuaaaaauagcuguuggagagucugggaauggcggcacacaccuuuaaucuuacgcuugagagcagagguagagagaucucugugagcuuaaggcuacccugcucuacaaaggaaguuccaggacagccagagacucuugucucaaaaaaaaaaaaaaaaaaauuaaaaagauaaauaagugagaaaaagaaagaaagaagaaagaaaggaaggaaggaaggaaggaaggaaggaaggaaggaggcagaaagaacaaaagaaugaaauaaagaaggagggaaggaaagaaaacagccuguugauuaguuaauuccuuacuguguaaauauuaauacuuuuaaaacugagcguauuuaauucuuacuuuaaaugugccacuucuagugucuucuagaaaugccccuuuagguucuaauuucucuucuggcuucagcagaagagagaaacgaagggaaggaggcuggaguggagccucugugaaaaccagcaugcucucugauguggauuccugggcuggucgacuguagcucugagucuauauccuuuuucucugaaucaucuuucuggcuuccucuuauauaagggggcuuuucuuuagggcuggagcaggugauuuucugggaacauaucuugacagagcuugaggcucaaagcccaguagugguagaugucuggggcacuuuguaacuucgcccugcagaguguuggagcaugacugcuuguacuugggagucucuguagaagcaugcaucacuuguggaacauuagcuccguuuucaaugauaccugugcucaauacaauaaagauucacuggaucacugaagguuauggcuuagggaagggcuggagacuuaacuugugggagaaagauuacuauucuugucuuuuaacuccuaaguggccuaugagcuuuaguucuuuuuuuuuuauucuuuuaguugcauuuugccucuucuuucagguucugccaugauuaaaauauuuauucuauucacugaaaaagcauauacugaguaucucuuaggcuuuggugaugaacuaaacacagaagacgcucacucuuccccagcacacauuccuguggguguaggaagcagucgcuuuuagaaaaugaacaaaguauucauuuuuacuuagaguuggcauaaggcagucauguugguagaguaugauguguauuucuauuuuaguuuauuccgagagcacugcuguguacucuagauuuaagaauggaccaaaauaagauuugucuagcuucaagcuuacaauaaagcaaauagaaaugaaagacguauagauggauguaccuguucuugagaguuguggacuuacacggcucuugguucucuaaccacaugagucucaagagacauucuaauuaugcagggcuucugcugccaggacgugugcugccuguagcccaggccugugcucugggucuguguucugcuuaugccaacucuggaucgacuuauauuccccuggaaggcccuggcuauccauccuggccaagauugcugugaagcacaaggggcucucucuuuaaaaagaacaaaaggaagccagaucauagcacuguagagcacagaacaggcaguacuaaagcccugaagcaugaaagaacucgguguguuagagaacaaaagggaacgggacauugggcuggcguggguggggugucagacaugaguguaaauagugacucgggacacacugggcugagucuucuuaaaccacgguaggaauuuuguaaguauuacggagggccuuuaguuuaaccuguugucuaugaacgugaaugaaaaucagcuuaagauuacuccaucaggaagguacccaucaagugauaagcaucauauaaacagcagaugaaccuuuggaaccaggaggaaccagagcucucuccuacucuuaucuuauuacaggaaucuuaaaaauaucacucaugaucacucuauuuuauuagaagucauuauacuuuacuagcucuuagaccuaaaaccuauuuucuuucuuuuuuuauaaacauuucuggguucagaggucaguaucuuaagccuaugaaacaaacccaugcuguuaucuguuugugcauguuaagauucccgaugcuuuguggcucacaacacauaaaauacugucuggcucuuuauaaaugacgucugcacaccccuuuguugcuaaaguagagcaugcacuacuaggagacaauuuaaaaauauucaaguagccauuugacuuguuugcaagcuuauaaguuuuauuuuacgcacucaaaaacauuguuucggcaugagauccauggauugcagauuccugagacauccaaggucacaaaagaaaugaaggagcguccccaucacggugucuuaggcaggaguuucgaaggaaugggcugaccuaugcuugguuacucugaaacucaugccuucacccauggcaguuccuccauccucagagucugucccuaaacugccucugcuuugugaauauagcugaguacacgcauugaguaugucaaucagaggucugguuuaaucuagcaguagugcuauguagugugauugugacuaucuucauuuagcacuuagggauguuauacacaugcggucaucacuuuguaucuauguuuucugcauucauggauccgaacaacuuucaaaguacgauucacguaggaccuuucucccuugucuacauucucuauacaguacaauccaacagccauuuucaacacugaauuauuaucauaaguaguccugauuuaagguauacaagagggugugcagagguaagauacaaacgcuguaccauuuuuagcaugugucaugugucgcaaggacguccucugucaucccacaugaaucaagaugaucacucacagacuuugccacaugccaauucuguguaggccauuuugcaacuaagguuucuucuucucaguugccuucuagguugugucaaguagacaauaaauucuaaccaggaguggacuggggagauggcucaucaguuaggagccccguguacucuucaaggugauuugaguucaaggguauccuauacccucuucugaucucugucagccuuaggcaugcaugugauacauagauauauaugcaagcaaaccacccacacauauaaaauaaauaaaaggauuaaaaugcaaacaacaauaaaacuaagcagcaaaccaugcugugccagccuucugugugcuaggaauagugaaugcucagaugacaaagcugcuaucacuaaagccagggacugagucaggccucucugacaccaucggcuuggcucaacacaaggaagaaugcucuaaugcucagaauuucaucugacaguacacuagcucacaccuggaaauuuuucuuuuccugaauuuuccaucauuuuguuccauagcuuuccagugugaaggacugcauuccauuuucugucuguagacuuguuggcacuggugcuacccagaacaggauguggaguugguccuuuccaaacuguuagagucccugugaucacugcuaaugucacuggaacuggccuuuuagaaugcuucuuccaagugugaguuucaauuuucuagauguggcugaggaacuuugugggguuucugggaguacagguucuaacuugccaucauaacucauuuaaaccuuagccugugcccuuugguugaagguagauuaaaguugaugguaucaucuggggcugacaauuaggucuccauuucggugauauuagacuguuccauguuuguuuggaguucauuuggauucuucuguccuuaaccuuaauaaucacucucuuauaaaacgugggcaaggcauugugugccaggcauucuucuuauugucauccuucccacguugcagaagaagaacacauacauaaguucaacccauggggcaucaguaugucuucagcaugugcacuuagaguuauauuccaguguggcuugcuaucauuucccauauucucaugcaauagaaaauccuguauucucaaacauuaaacauuccucuacaguaguacuuuagugaccauauuacagaacuagucugcuuggcuaucaauucuuuaaauuucucuuuguuccaaggaacauuuggaagacuuacuauaccagucaaauguaaucaggguacagaaaacauaucaauggugaaccaguaggaauucaauuucuauaggggucuacuaguaaaagcuggguaguuaagacuaucagagugaaagggacucugaagagccuagacggaauaguugcacagaaguggcuguggcccuuagucuuuggaagaagaucugcagaagccuacacucaggagugagcaccaccguucccuguguagcucugggaagagaggcaucuccaacagcccaccauucacagacuggucagaggaaagcaauuugaacaguggaccugugcuagaccauagagcuguuuuaaugcuggaggauuggguugcagagcuucuuagaagggguuucugguaagagucagucuaaggguuuaggggcauguaagaucugauucacaugagauaauacugggggaggaggucuucauuguccucuccuggugaagcaucacauugcccccagcuggccaagggaaaggcucaggucuggcuuccgugccuaaaagcagggcaaaguuuugaguugaaacaagaagaaaaugacuaaucugugcagguuggcccuuaccuucuuacucugcuuuaacuauggguauaggaacaucuuuuaugaaagauuaccugcaccuucaauuuuucuuuaacauaaaucuuugaauagauguugaguuugagcguuuuaaaggcuuuugucagaugugacaaaauuuauacaccccccccccaaauguguccuuguugacuguccuucaugccccguauggaaggaaagggauauuuuuaauaucacggaacucacugucuauucacucuugggaucuucuccucgugucuuggauugcacacuaugauagaggggggugcuuagggccuguaucucuguacacaguugcacaaguccuuuguccccuggcuuaguuuucugaacuuugccccucccagucuaauucacccaucugacagauuuauuucucuaagauuccuucaucauaucaguaauccugcucaagagccuuaaauauuuccucucugcuugcucuaguaagaauaagauacagaguauugacguuuggcacugggcccuuugccuccuucugcugauaaggaaacaagccgauuuagcagcuggcccaggcccaagcuggagcuuccuuccucuuaguccauuguaccaucccgagcgcgguuaguccagcuuccuugucccaccgcuguucuccagcacagcaccuguccccagagagauuugacugacaguugaccucaccaucugcugcucccacuuugucuuugcuggugccacucacccagauggaaugcuaacauugugugaucuucuucauguagacacugccugcacucacuuaaguauuuucacaaucacaucuagucucuauuaagcaaauuacauuggauagcauuucaggauguuagaugggcaggguuuugaaauacauuguacuugaauuuagguccaaggcccggcacuuccugcucugugaaaauaaguuuacuuucccacuuuggggcauuaguagacguugaagaaugccuguuccuuuaagacaagcuuguuugucuccagaaaaacauguuguucuuuaucucuggcuuuacucuugauuaaaauaccaaaggauauaggcagucuccuccugccuguucagcuacucagauugcuugaucuaggacaccagugggcuucugggagcugcugccucccccauccaauccuucagguccagaucuuacagaaacuacugucugaggaugucaguucugugcgaccuuaccaucuuucacugcggacuucagaucuuuugaacguaaacaucucugccaauaggccuuguucuuuuuugugguguuuucaguuuucagacuugagaacuggauuauuagacuguaggugaaaguaugaaaauagacaagugagcaugacaaaguggaggaagaaacugccaagggcaccuucaccgggcagaggugacagcuggcgugggaaguguagcaucucugaccaucacucuggaacauguccguuguaggaaaagggcuacuuuauucuucaaccccacuucuccacccccagaucacugggggugcauucauaucuuacuuuaguguauuucauacacuccuuccuaaagguccucuguugucuuccaucuacagacguugcucuguagcuuagcaacugaugugucauauuacuacugcccuuacuggcuucauuacccucaagaugggagagugaagcaaauggacauaugauaaacuaauggggccguguuuauauucagagucacuuacugaugcuuaaguaaaggggcuaaagaacaguguuaccuuggaguagaacaucuaaaaucagggccuccucacaacugaaagaugcaacggacaacaguggagagaggaggcugcaggcggccauggagguaccugccugcuaagggccaagccuucuaauacuggcagugucuggauuuccugagguucucugcugucuuugguaagcaacagaugaggcacaauuuaugguuuugaccagauguaauucuagauuagccuaaguagaacauugguguacuaaggaaaauggauucuggaggagaugauauggcagcaauggcaugccuccucaggauccuaccacccaggccucacagcggaugagggaggaacagaaacauagacaucucgcccgggugagcgcugacugcaauggcuguguggguaaauccaccagcaguaguggcugcuuuccccugcugcuugucauucuuuccaugcagugugugcaggcccggcaggucccugcagagauggucuuucugcuuccuuucucuuuuuuauuuuugaggaggugguaugagggagccuguuuaccgcagccaguguuauuucgggguucaaagugacuguucuaaaugugucuuaugauggucuguuuuuccuuuuguagaauuuaaauaauuucuuuuuguuguuguuguuuuaacugacacauaaaaacauaguaguuacacaugauuuugauacuauaugauguuuugguaugcguuauagauugggugauguuugaaucagggucaauaaucuauucccccaccccaccccccugcccccuguguguguguguauguguguauguguuuguguguguguguguguguaugcucgcgugcaugcgcacauguauggguacacaccacgugugcagaaguguuuguguauauguaccugugaggagagaccagaggucggccuugagugucaauccucacgagacauuuaccaccucuauuuuuuugcaggccauuugcuggccugggccuuauuaauaugcuagagugaccagccagcagugccuagugauucacuagugucuaucucccaaguauagcauuacagguaaaggcuacuacuacugacuuuucugcauaggcacagggauugaacugacguucucaugcuugccaagggguaguuuacugacacaacugucuccuuagcuccuacacaaucgcucuccucagauacucaucauuucugaaugcugacaauguguaaauccccuuuccuaggucuuugagaugcacaguauagaacaguuauauagucucccuauguagaacuucaacucuccuagcuugcacacagccauggcuuagcgucgcuuuagcaaccucuuuuuacuccuucccucacucucuugcuuccccucuucacagccugagggcaccgccauuuccaccuuccaugagaccugcuugucuguaucucacaucugaaugaagucaugugggauuuguuauucugcgccuuguucauuucccuugcuguagugacuuugguucuauucuuguuuaaacuaauacaauuccauuucuccugacugauuggucuuccauuguauuucuguguccauucgucacuugaugggcauauaggcugcuuccauguuugacuaccaagaaugucacuacaggaaaaauccaaguuuagauguuuuuuacaugcagugacuucauuguuuauguuuauaugcuaggcucuaagggagauguucuucccaguuucugagaaacuucuguuaauauagcuauacuaguuaccaguugugugcaguguuucaucuuugucuaauuauuaccagcacuucauuuuaguuuuuaaaaacuauuuauuuauuuuguuuuuuuaaaaaauauuuuauuuuuauuuauuauauguaagcacacuguagcugucuucagacacaucagacacucuagaagaaggcaucagauuuuuguuacggaugguugugagccaccaugugguugcugggauuugaacucaggaccuuuggaagagcagucggcacucuuaaccgcugagccaucucaccagcccaaacuauauauauauauauauauauauauauauauauauauuuguuuugcugcaggauuucucugucuagacccggcuguaguagaguucauguuguagaagauacugaccucgaacucagagauccauguuccucugccucuugaguguuggaauuaaaugugugucaccauguuuggcuauuuuuuuuuuuuuugguagugauuauuagaggauugagguaguauauuacuggguuuugauuuaaacuuucuaugaugauuaguuauacugagaauuuggaaaugacuucauagcaacaucaagaccaguauuugguugaaugguauucaguccccuuggcauaucagagagccuaaucaagcugcggcaaccaucagagaagagcagaaacugcugagaauuaaaacuuugcuuuagauuuuaaacguguggauacacuccaacguugguagaaacagaaggaaaauuugaauuggagucaaaagaaucuuggguugagcagaguugauguuuuccauuuuagaguuucugggcuuuucaggaaguucuugcagugagcuuucauacuuugaccccagcaggagauuccuggaagauuaaaguuguuugggucaggagaaugagaguuagucuuguuucauuuuggauuugucuuaguguuucauuuaugaccuggaacaugguaauguagccauuuauccagcggauguuuacugaacacugacaagggccuuuguagguggagcgauccuacugugguacuguuacuauuacuccuguggagacgccuugauccuacugugguacagucaguaugcacucccauggagaugccuuucuagaaugaagugauguaacuaauggacaacacgaagaagaugauaaguaaauaucacacacacgcacacgcacaggcacaggcacacacacaggcacacacacaggcacacacacacacacacacacacacacacacaggcacagacacacacacacacacacacacacaugcacaggcacagacacacacacacacacacacacacacacacacacacaggcacaggcacacacacacacaugcacaggcacagacacacacacacacacacacacacacaggcacagacacacaugcacauacacaggcacacacacacacaggcacagacacacacacgcacauacacaggcacacacacaggcacacacacacaggcacagacacacacacacacacacaggcacaggcacacacacacacacacgcacaggcacacacacacacacacacacacgcacaggcacaggcacgcacacacauacacagaggcacacgcacacaggcacacacacacacgcacacgcacauacacaauguugaugcuuggaagaaugcauccaggaggacugaggggcaguagagugacugagaggugcccagccucugacaugaagccacucuaggacagaauucccccacagcuaugcugaucugcuuauugacaggacaugucccuauuaauauguauuauccugauggaaugugcuaaugucuuuaggguaauauagaguauacugugaaauuuacuuaucaggcugucuguuagucauuuuucaguugcuguguuaaaauaccaugacuaaaagcaaguuugggaagaaauguuauauuuugguucuuauaguuccagagggcauaugaguugucauggcugugaagguauggcagcaggcgugugaggcuggccugguacucaggaagugaguggucacauuuuauguguauacuggaagcagagagauagcaggaaauggggcaaggcuguggaaccacacccccuacucuagugauguccuucuaguaagguucugccuccucaugguccagagcuuucuccaacagugcuaccagcugggcaccaaauguucaaacacaugaugagccuacggggccauuucccauucagaccacaacuggguacacacaaggacuagcuauaaacaugaaaggacucggcaguaugucuugugggugcuauuuuuguguuuagccguaaacauuggacuuuuuccuguguguuuucagugagugacuucuauuuuaaacagcauugguggauuagccauugaguccuucuaaugaccuggggaagcggggccagcugccauccaugcagguugcagcaggguucaaguuuccacucugggcaggcggcugcuaaaugagucccugugcuaccauggugggaguugugaagcugcaacaacacaaccuuucccccguguuaaugaauuuuacagccaggaugcaagagguggggucugguuggucuuccugauaggauguugucccggcagcaaggcuguaugugccacugacauucuuuuugaguucaguuugccuugucucgggagcuaaaaguuuguaaugaguuagcucuucugccuuucccuccuuuccugucccauccugucccccacccucaucucuauccaaaaucacugauuagaaagaguuagcuguugacccaggggcaugggagugugacagcugucauaguaagaacaagagaaacugcuuucauuucaaguggacaaaccaaccucuuccuuucuucauagaagucuugcucugauugcagaaagugaagaccccacacaggagccugggggcagauuucguucucucccaguccagcuccuacuagaaccccuggaaccucuugcaggucuuucuuuaacuuccuucccacuucuuugaucucauaaaagcuugcugacaguugggagugcuccaggaaggaagccgacaggauggacaggcagagcagugugggaucaccuaggacacaguccuccagucuugacccugggguuggaucaagauggcucugguuucugaucuuuaaaaugugcauagaguuauuguggugguuagauaaacacuaaagacgaacaaacaaacaaaacaacaauaacaacaacaacaacaaaaaaaacuuuagcucaaugccagaguauuagcacuuuaaaaaaaacagaauaaaauacccaacucccccacucuaauuuuuucaugagaaaauaucucuaaauuuuucuguuuucuuucucgaauuggaaggcguagauccagccuacuuuuucucucuuuggaacacggcugcucagucucaccugaucugaggacuuucugagagaccacuguucucuagaaucccuaguuaagaaggauuucaguuucuucugacucugucuccucaguguacucagaggcuggcccuggaggagagauugcguauauccagcucccucaguacuuuguaacuaguguuugcagcuagcuggcuuccucuucagucuccugcaugcauuaagcuugaaaggaagugaaugaacacugcucuucccagccagccugcccuguggccacugcuugucccugugguaauaaaacgauaguuuccuauagguuucuguggcuugguguuucugggacguccuagauagugaugaagggauuguguugggcuuuauuuuuuacuggggauggguuucaggcuugucuuugugugacaugaaguauccagaaguacuuuucuauuuuuaaaauuuuauuagauauuuucuuuauuuacauuuuaaauguuauccccuuuccuggucucccuccaaaaacccucucccauuauccccuuccuccucccccugcucaccaacccacccacucucacuuccuggccuuggcauucuccuucacuggggcauagagccuucacaggaccaagugccucuccucccauugaugaccaaauaggccauccucugcugcauauguagcugaagccaugagucccaccaugccuacucuuugguuggugguuuagucccuggaugcucuagggguacuggugagaucauauuguuguuccuccuauggagaugugaaccccuucaacuccuuggguugauucucuagcuccuucauuggggacccugcgcucaguccaauggauggcugauagcauccaccucuguauuugucaggcacuggcagagccucucaggggacaucuauaucaggcuuuugccagcaaacacuuguuguuauccacaauaguguuugaauuuggggauuguauauggaauggauccccagguggggcagucucuggauggucaugccuucagucucugcuccacacuuugucucuguaacucauuccauggguauuuuguucccccuucuaggaaggaucgaaguauucacacuuuggucuuucuucuucuugaguuucauaugguuugugaauugcaucuuggguauucaaagcuuuggggcuaauauccacuuaucagugagugcauaccauacauguucuuuucuaauuggcuuaccucacucaggaugauauccuccagauccauccauuugccuaagaauuucauaaauucauuguuuuuaauggcugaguaguacuccauuguguaaauguaccacauuuucuguauccacuccucuguugagggacaucuggguucuuuccagcuucuggcuaugaauaaggcuauauuauaaauaaggcugcuaugaacauagugguguauguguccuuauuacaaguuggaacaucuucuggguauaugcacaggagagguauugcuggguacucagguaguacuaugaccaaucuuccgaggaaccaccaaacugauuuccagauugguuguaccagcuugcaaucccccagcaauggaggaguguuccucuuucuccacacccucgccagcauuugcugucaucugaauuuuugaucucagccauucugacuggucugagguggaaucuuaggguuguuuugauuugcauuucccugauaauuaagaauguugaagacuuuuuuaggugcuucucagccauucgguauuucucaguugagaguuuuuuguuuagcucuguaccccauuuuuuaaugagguuaucuauuucucuagagucuaaccauaaauacuuuucuuuuggaaggagugcucaaccuggccccugacagcuuguucuuuguagagaauuuauuguguauaacuagugaaaauuagccauggaaacaagugauggaugggccuuugacacaucagggaggaauuuccuaucuccucugcacuccugcugcaucgcagccuguggccuguuuuacaggauguggaaaauaagccucuuugucucagcuccuuggggcuauggccagggagaguccuucuagauggccaccuucuggagucugagcagggugcacacacucugguuggaagaacuggacugaucagugagauccaacuuucacugcuaaggaugcugagggaggccccaugcuugcuucuuacuuuaagggaucacgcacaaggaaccagccgaugcccuuuaaaacugcagguuuauugagauaugcuuuggagaacaaaaaugaacuauuuuagauauauucaauuguauuuuuuuccauuuuauuuggagagaaggucaagugacugauacaaugauuaauuuuaaaacuuuuuuuguuuuuguuuuuguuguuguuuuuguuuguuuuuucugagacaggguuucucuguauagcccuggcuguccuggaacucacucuguagaccaggcuggccucgaacucagaaauccaucugccucugccuuaaaaacuuuuuugauuugaguaaauauuucuguagauaucagucuagaaacuuuuauguagacauguuuuuaguucugaguuauagaacuucuaggcgcuuuucucugauuacacuuuuacaguuauugcuuugcuuuggauuuuggggucucauauuacuauucuuugaguuaagcuucuuuguagaaguaauugaaaauuacacaaaugagaacagagaaaaucuuagaaugcugcauagaaucaaggcugaguuauagcugccuuuuucuucucuuaucaagcuucuacuuaaaagauuuauuaaagcuuuucuuucaucuuuugcagaaucgcaacgaaauaaaaaauggcacgauccuucgauuaaccacaucuccaguaaguugaucuuagcuuauggcuuuucauuaaaauccccccaacucuggucugcacuauguaacuguggguagggaccaacaagugugacuucuggagaaucuggguacaguaaccucccagggaggcucuacgugcccgggagcagucuaccuucucuuuucuacaacaggggcgacauugucucaggacaauggcaagucaauggauggugaggacuucaccuguggcagucagcccagcagccauucucacaguacagugggagaguggcugucugaucugguuagcccauuuuaccucaugucauaggacagauacaggcaaugaaaaaacagagccuacuauugccuuuccucuguguguguaggaugggguggguggguauuggaucauucucuagcuugggucuguuauuaaagcauuuccuaaaaccagcucaagaguauugccugcuuaugcuguuuuccucuggguuaaucuauauaaaacguuugaaggucucugaauagaagcugcuaaacaagaugccgaaauauauuuagauuauagcugggaucgugaucucucuuauguguggagaugcugcauagcaacauuagcauauuuaaaguacauuucuccaaaaugcacuuccuugcuuuccugaaaaauaacaugcacaaaguaccccaaguguuacuauuuucacacugcaaaugugaugaaauguguaucgucuaucuaucauucucaguuuccacugcagccaugugcuaggcuaaaaauaaaauuaaaaauuggggaaagcaucuggcuacaaucaacauguggguacuguagcuaccacaaauucuucucauugaaaauuacauuaaagccugaaaaacccaaacauuuuaccccgagccaucuugaaccuaacacagggaugagcucugugggcugccugcuggacuugguggagccgucuuccagugccuucaugccaggcauagauuugcaucuggauuugacuggcuacaauaugagcugagccgauuuucaugggcuuuucacaggccuucauucaucaggucgaauugcugcuaacuugaccuuagaagcuaccacgucauuagguuucugggcuucuacuucauuugcuaauuuccagcgcagcaaggcuuagugcuguaucuaggcuggcucucugugcugcugcccuggcuuccuaacuauauuccauaugcagugaugaugugaaagaggaggggaaacuguccaacagagggaguacugagagggagcgggagagguaaaggguguggguaggaauagucucaguguacacuaugcacucccaugagaacaaucccaugcaaaaaaaaaaaaaaaaauaacaaagggcucaguguaagggagaggguuuuucuguaaagagaauuuuuugauaaguugucaucagagacaguggauguguccuugucaaagaaugauucucaaacuugggguucugggaaagauagucaagggaguguacaagacacuguuauaauauaguccauucacaagggaccacugcauauucuauaguaguggccucuacacuaggacagcugugggacuuagagaugcugauguuagccuugcaaauggggcaacagagugugagaaugcggcccaggcaccugcacuuacgagagccucuuccgauugggcugaagccacagggucuauaacuagguguuagugcacagcaguuuauauggaaauggaaaguuuuauucauugcugaauuguuuucuauuaguuuguauuuaaaugaaaacgggucauacaggccaucucacuucaaacaauaaauuuauuuauguuuuuaagaugggaucucuauaucauccuggcugcuguguuccuauguagccuaggcuggacuuaaacucauagacauuugccugcuucugccucccaagugaccuaauuaaagguacacgcuaccaugacuggccugacuugcuuuuuguguauauaauaaaaaauaaagaagugucuacaucaaauuuguuaggcaguauuagagugcuauaaagaaaccaguauuguuuuuauauaacucuuuuauaugaacuuccuuuucuucagugguugacugaaaauagauaacaacauauauacguguauaccaaguuacguacaugauuuuagacauagacucacauggacacauguaugcgugcacacaugcgcacacauacacacgcaggugugguacagagugugugcauacauauacguaggcuccagagcaggccugccagcuucaguagaagcugacuugugccccuguccaccugcccuggucauacgcagaaccugacucugaggacaugcaccauauggaaaacauguugaguaaauuccuauuauaggagcuauuaucaaaagguugauacauuuaacuauccaaaaauaaaaucuucaaaaccuuuguguuuggaaauaacuccagcuacagcaucaggaauacuauaucaaaaaagaagugguagucugcaugaccuaggguugacuucuaauuuacauaauccuuuaugagugcauagagacugcuuuuuaauauguguggucauagguauaguggaagcaaaaaugagaaauuauguaucuguaugugcaugcauacauguagaaaggucugagucuuuuuuaaaaaagggaacaguuuauguucuaauuacugugagcagaagaugcuguggaugaguauggacugagguagcacuggcauguaaccuugcuguuuccauccaagcacauuacauacauuaacuuuggucuuaauucuccuguuaagaauguaccugaugaguagauccacaaaaccacaggaccacacacaugugcauccaagcgguucuucaacugauuaaaucuggaacccaguuaucauuugaguaagaacuuagcguguagcacucuagaggcaucucuaaggaccauuacuaaguacaaaagcagauggcagaacagcguguguacaacaaugccuuuucugauuauagacaugaaaaaagauauauucuaauaagaggauccaaaugucucucagaggucuccacaggugcuuagcagcacacuagcucuuuacugcauagucucuuacugaaguacgcaugcauaucuccuguggucguaccccuuuucauuaaacuuauuauagauuuaucauaguauguagaaaguaaaucaucaggucgacagccagaaacauuucugcuuugcagucuaugugacuaugugucgagccauuaaggcacauggacgaguuccuucuccuccugcuuucucauuccguuccuuguuuagaggaaacccucacugcuaauuaaguacccauagugccuuguggucuucaagcauaauccuccuggcuguucucugguguuccagguccacucugagaaucauccagaucagaaggccugucacagugauuuugggggcuaguuccuauggugauaaggauuuugauauaucagucauucuauagauucucucauuaccuaucauuaucagagauuguuaucaacaagaauuguaguauuauaaaccugcacggauuuuuaaaucugcacugguuugaaaagugaguggguucucucuaacuguaacaggccuucagagagacaugauccauaggagacaagaaagcaguucugcucacugggaaccuagaaccugguguugguucaaacuucugcagucugaucgcaaaugcuuuauuuuaggcauauguaagcauagaacaauuuggggaaaacucuggugaucauuaaucaugcaugcccaacaaagcauacauaaaucucuuugaggaacaaaauacacuaaaauaaaagucagauguggcuacacagaaacuuuauaaaguaggcaugacaccuuccauaaagagguuguauagauugacugagaaaaacagacuuaugacaagaguccuggggaggguccaguguugucucuggccagacagguagugcaaaggucuccagucuagaaagcucguccauucccagccuucuggguagauaacaaguauuugcauucuuucucuugaagguacagcacuguguguuuaauuuuccaagguucgccuggugcuuaucugugagcacaaggccucagugccucccacacaaaaauugaaagaguuacacagugucuguguucuauuuuccccagugcuuuagaagccucaaccugaagaaccuaggugagaggacagcugguagggucagcgagggccagguuacauguucccagccucauccacauggaggugcacauggaggaacuuaggaaaagcggcaaaguguaaauuuaaggaauuuucagaaacauagaaaaucucccuuuuuaauugacuuuaucgggcuagaauuaugcuggauguuuggaagggaguuacuugaagagcacagauggcuuguucuguguauguguacguuccgucccuuccugugucucuaggugauuccucguggaucacuguucccaagcccagcaccaguccauccauuggaacuauuugaguggcuugaaaugaaacuuguuuucuguccuugaaacaguaccaggaaauaaaacuaacuaucugauacgcucccugauaaacuccuaacuguucugagccugaaaaaucggaaccaaggccaucuugcuuuucauaaucaugguucuuucaucucaaauaugaaagcaguacagaaccauuaugguguaauaaaaccaagcuugauaccaggaaaauuaucaacuagucacauuuuaauuugcaauauauauauaaaguacuuuauuuagugacaucuuucaaacuccuugugagugccagguacuguugcagauccuaagauucuauuuaacaagucuauucuucuccuggaguugaugugcuaguggacacaaacauccuuguaugcauguacucugccuuuacaaacagacugacugcccuuaguauguuuauuaaaagcuauacuuaucuaucucacacagcuauauucuaucucauauuuucuuggaauuugguuaguaauuccacauaugccauccucugucacauguucaacaugaacaucugcugugggaauguaaauacuacuuugaggucuccuauucauuuggugcagcaggcauccacaguagauguccaaaugcgucauuucccagaagcacgucaccucccaagaagucccagcucuccauacccuggagcacaaaggccuuguguccugucaccucuucugucccuucucccuuccauuuguguuucauccuuccaggagccuucuugccuauccuuccagauacuccaggcuugcuucaccuguagagcugcacuuaccagcccuucugucuacugcauccucccaacucaauaugcaugcuugacacugccuuccuuaggcagcuuguucuuggaucacccuaucuaaagaacucucugguguuuucugccauagcccuccauguuaguauucccauuggcaacauguuauuuaauuuuuauuucuauuauuuuaaaguguccuucucucucuccaaaauggguaaaucuuguuuguugcuguauuucacaugugugagacucagaauaaacuuuccagaaguaucuaugagucagagaauaaggauuaugaggcuuaacuuuguuuuaaaauagaugauuaaaaaaaucagagaagaguguuaagcaaaauugugugcuuuucugucaucgauugauauuuagacaagaaauuucccuuuuuaaaacccaguuugaucauuaaagacuuuccuucuuuagcuuuauucuguagagugaaaauuuuguaucuagaucuguuagagauugggaaagaugaauacccauccgaccucuuccaggucccucugcacaggugcugccuuaacagcauccugucaguucuauaugauauuuugauuggacggcacaucugggacucacauauauagaguccuucuccuggcccacucaugaaggagggugggguuucugcuuagcugucacuuuguagguugcagggaaccuucaauauaaucccaucccaguuccuggguggauuuacuuaugggaaaauaggucucaccuggagugaucaguggcagagcugaugucucagcuaccaaggagcuuugaccacauuggauugcuucagccccacaagucuucuuugugcccucucccaugcuuuaugugagcccugagaugaagaugaagaccucucaaaggcacacaaggaaaguugggagcacagcaccgagcuuuaaguugaguugcucauucaguaaauuccaggaaaggagcguggcuugccucaagggaaaaacaccacccaggaccagcacacacagucuucaggccuuugggccaaugagaacagaguauuuucccagagaaauguauagggccuuggggucuguggacucuagguagugugaauauuuggcauaaucuguaggagucuugacgucucugcccagguuuuacuuguugucccucuucccuuauuuuaaaugaacuaauuaauuaauuuaccuugaaguaguucccuaucaaaggcauaacuaacgaacaagaaagagucgcacaauauaguucuacucagccaaaggucuuugcugaaaacugcacagccuuaaagguggggcagauuuucuucuugguacaguggagcuggaaggcuuuacaguggccuggaugggaaggacagaggugggaauagguaauagaaccagaguugcauggucccaccauugcugcaaggugcugaaucuuauuuguguggagcaucauuucagccugggguugggaagaggcagcaggguagcccgagcuuguucaccagauguuuuuggagaccccaacccaggcuuucaaaccaagacauuguguggcugaaggaucuguggcuuuagaagcugucuggaucagguguguucugcaagccucuguugaaugcugugcugcagaguugagcugcccugguuuuaucucagccaaugaugaggagcugugugagccggggcaugucugucacuuagcuuccaugucacuucaguuaccuuugucagaugaagaaaauaggaagugucuauaugauuagacucaguucagauuaaaugaauuaguucaucaagguuuuagaauaaggggugagaacacaucgugcgugacgguuagucguuaauccuguucauaucaucaaauacugcaauuuuaaucaaugaugcugagagaagugaggugauuucugaguuguuacaaucuguagagaaaaugauauccuguggauaaaaauguaguuuucaaggaauucagagugacucacuuugguuaauuaugcuaggacaguguuauaucaguuuaaaauauucaucaaaacauccaaauuuggaguacccguugcaauuuuauguacccauaaauauuuggacaaaugaugcuaaaagaccgaguggucugcauccagcucucuuaggucucuuuguaagccaauggacuuugagugacuuauggcuuggcugcuucccaggagugagucucauccuccaucccggcuccaaugucuuuguucuuuucugauuucugcuacugacugugacauaaugggaaaggcugguacacucugacuauacuaugcaguaugugcucucucucuagguuccaaaacaacuccuuggaauuccuuucugucuuccuuuucucuacaggggacugcuuucuacuccuaauuuauacucuauuggagcacaggguguucuucagcuguuuuguaacuaacuucuguucagcagaguuagcugguuguugauauaaaauaauauguauuaugcucuuucucauuuuauaaugaaauacuugaggcuggauaauuuacaaaaaacaugaaguugguuuaguuuauaguuccagagguucaaaaacuuggcauuguuaucaacucaacuuuguucaggcagucauuguggaagccauguuagcgagagccugcaagggagagaggugaggugugaaggaagacagacagagcaucaccaguuaggggccagaaacaacacucccacuaagccccgccucccaaggucauaccaccuuuuggcuuguccuuccuggggcuccaucucccaacacagcaaccacugggggacaaaugacuuccaaaccauagugccuccaucuugcuguauccuuccagugccacaaaacaucaaaggaaacagcaaaugccagaggagccugaguauggcauauguuaucagccacuaugguuugaagcuaaauaacuaagaggguggggccugcaauuugucccacugccugccccgcuaaaggcagaccccagcaaaccuugaugagaagacugggacagaugcucacugauucuccgaagcuuagcccugcuaaugccuuugcacuccucucugcucugaaugcagaagccacagcaaggagaacauuaguucuaggaagugcuguuaauuguacuuggaguuauucuguuuuaauuucauacagcaaguagccagugugugagaaauacaugcugcuggaaagugcagagacucauuugugugucuaaugaagcuucugaaugcaggcaguuauuacucagaguuuugacugaauggguaaucaugauguauaaauuuguguaauugcuuaacuaagcaaguggcuuuuugucacuucuagauaauaaauuuauugaaaaaguaaacauccucccuuucucuuccugucugucacacccuaucaguuugcaggcuuuaauauucaugugcacuugcccuuguuuuucauucuuccaugaacugggcccuguuguucuccuccuggaaggaaggauagagugauggagggaggggucuuucugauggaaaccugcugcugaagugccuugcugcuaugcacagggagccugugcuucugcucugugcauauucaucucccagggacucauggaauuugugcuuuuguacccacuccacacacagacacacagacacacagacacacagacacacacacacacucacacacacauacacacacacacauucacacacacacacacgcauacacacacacauucacacacacauacacacucacacacacaugcacucacacacacauacacacacacacacauucacacacacacacgcauacacacacacucacacacacacauacacacacacgcgcauacacacacacauacacacacacauacacacacacacucacacacacacacacacacacacacacacacacacacacacacacaaauauucauagccuguacuuauauucuuucuguuuuuuuuuucccuccucccugaaggcucagaaugcccagcagcuccaugaacgaauacagucaucaaguauggaugccaaguuggaagcccugaaggacuuggccagccucucccgggauguuaccuuugcucaggaguucauaaaccuggauggcaucucacuucucacucagaugguggaaaguggcacugaguaagcauguuucguccucgucucucccucugucuacucuagcacuguggugucugcuaccuucuuuauucuggcagguuccagcuuuaaagacuagacugugaccagacucuguggaaaaguggcuugaacauaucggcaggucaugguuuugugauucccguagcuguauccuucagacaccaguuaugggguggagcaugcuaagagucccugcacaccugaauuuucauaauacuggagguacauuaaauacauugccucaaaaggccuaccccacauuaaaccuauaauucucuagacuauuaaucccucaaacuccuuucuuauccaagauagcuucauuucucugccuggaauaaaaaucagaaugugaucauauguuuugaggcauuuagagcacucuuaaaauacuuuucaaaaggaauacuuuaaugauuaaaacaugcauaauuaaaaacuuaaaguaauauguauuuauugguuaugcagaaugguggcagaauuuuuucaaugugagccucaucuuuccagaauugguggagauuauuauacaguuagaacugaguuaguuauuaauuccugcagagggcagagggcuggaggcugggccgcuuacaucucauccuuauagaggaugagacauugaacaugagcuggaggaagcuuguguucucaugauggagggguguguuagcauuucugguagagagguuugucucuggugaaacuggaaagacuaaggugcaaggcugguccagcuuccaaucaucaguuccaaucauccugaucaucagaugccaaugggaaggaagaggaccagaacgauuggccauggugucggcugcugguggcacgggcagcacgcguuuggcaagacugauucaguuaguuacacauuagugcauugauaaggauagcuuuagaggaagaggaggaagagucacugagaacugggccuaaaggcugguucuugacucuccuucuauucucaggaauacaaagaacaaaugggccacuguagacauuggagaccugugugguuucuccucccuccucuuccuggcucuccguccuuccacacuagguaucauuaggcuuuugcaguuagcauuagugaaagauucuuugguuuucauucaaagacaguaugguuuuacaacaacgugagccucccccagccuauaauguucucuagaguuuagaauugggaauccugucuuggagacgaguaggaaacauuucucagaccaaauaaaaaaccaaaucaaaccugagaacauugacaaguguuggugaucuggacaaggccaccguagacaguagcccugggcugcugguuugguuugugcgaugacuaaacuccccuuuagacaugguggaccuuaaaacagccaggaagaaccugagaaugagucagaagcaggagauuugaucaggaagagaaagggccuccucugacagaagugucagaggaaaugcaggauggcuguggucauagcuauuuuucuguugcuguaagaaaauaggcugacagaaaggagagguuguucagugguuaagagccuaugcugcuuuuccaggggacccauaucaggcugcccacauaaccagcuauaaauccaguuccagggcuucugguaccuuuuucuggguuuuuauggcacccauacuuacaagugcacauagcacacacacacacacacacacacacacacacacacacacacacacacuuaaaaauaaaaguaaaguguuuuuuuaaaaaagcaauuuaagggaaaaaagguucaguuugacucaauuucaaggugaagucuguaguccaucauggugaaguugccauggugaaguuucucaugaugagggaaugcugcucacauugcauccaccgucaggaagcuuagagugugcucugcucgcucacuuucuccuuuucguacaauccagaaucccagccgugggaauggugccccuccauagugguaggccuuuguacauuggaggcguguucagagacccauuuacaaggugaucauaaagcucuucaaguucguguugacuauaacagguuuaccguccuuuuauuuuggauuccagugcgcaguggagaaucccuuuugacugggaugaguguguccuuaccguaucuccucaccggauggccacugauccuccuggacacagugagccuuuugaggcuucuguuucagggacauuugcuagccugcuagauuaaguuagaaagcugcuacuauauuugcugacauguuccagugguaauauuugcaaggggaauguucuaguggcagaggugauaccaacugcuaagaguaaguaggauaucuauaucuaugucuauagcuaucuaucuaucuaucuaucuaucuaucuaucuaucuaucuaucuaucuaucuaccacgauaucugggcacuuuagcuuuuuaaucuuuacaguuugaaugaguugugugcauccauuugaauuuacaaggauggcaauaauaauuacaacuugaauaguaacagcccccaagucagggguccauguguuauguauguaucacaaauacaagguuguggcuggccacuguauuugaguaaugaagccugcauauccagacccucuccauuuuacugucccauagcuaagaguuccauaacacaauuccagagacugguuaagcaacaaaaaugcuccuccucccccuuucugaaggcuggaagguguuacuaugguuuguuucuucugaggucuaucuuuaccauacagauggcugccuucucccuguguucucaugugccuucuccauaugccuauacauccuaguaucuccucguauucagacaugguccucucagagacaccugccagauuggauuagaucccaucugaaugcccuuauucugaaguaaucagccuuugcaagauccugucuccaguugaagcuccauccuaaagucccggagguugcagcuucuacauaggaauuuuggggaggucauaguucagccuguaacacucaucaaaggaccacuaccacuuuucuuugucaagaaaagaauguccauaccuugcuaagauucucacgucucaccuauccuacugccugccuccacggauugucauagccugcuguuguauucagaguaaccccuaugccuagcuccagauugucaaaggcaggucuuagucauaucauggcgcucauuuacacugagagaggauauuaacaccagauguuccuugugaacaaagaauacauuuuauacgugagcaguacaucucaggacuuauuuuuauuuucaaaagaacacuaauuaacauagcaaucccuguauucagccauugcaacuugacauguccugucaaguuucagacaguuuaagcagcaggagacccgaucuuggaugccuucucuuuugcauuuuucuuccacauucccaucaugccacuuuccuggaaagagaggacaucucuugggauuugucuguguucccuuacuguuuugcauaaaaucaaagccaugcuguuuuugaagacuaaggaaguaggcaugcaaccccaaggccucuuucuccccuuugccaaucccacaucucaggugauuuauuugauccccagacaguuuucugaucuuuuacucaaauuaaaaggaaaagaaaaagccauuuuucuuaaaaguaaagugaauucuugguuggacauugagcaauauuuuaauuaauaaccaggaaacuuuggaguagaaaucucugcagcuggaaagccguucugucaugccuuccuaggcagagagccugcugggaagguggauguuucccuagcggggcuuguggaaaaucuuaagaaguacugaagaaagagcacugaaaaauuucuccuuacuuguaguaaugaugccauucagacaguuugagcuacuugcccuuacccagggcuuccuuaaagucccuccgcagcuguugccaggagaggcucggggugaaauacauaacaaagcgaagcacagugccacuuuggcagagagcaggacugcgagccuggaauggauguuuccauccuuguggaguguugaaauuuuaccccugcauucuaacugaagcagguauggaaacaaauaugguuguggggaaaacacauugccuaacacaagcaaggggaaggauguuagugaaugguggagaacaaaagaugacuauucggacacugcaaauaauaucucugacuugauuccagaaaaggaaaauaugugucauucagucaagucucacacacacacacacacacacacacacacacacacacacacacaacugugcagaucacucaucaccccucccuauucaguggccagucauugcuggggacagacaacagaagacuuuuccaagaacggagggcagaacacuuacaguuuccuuccuacuuggcaguuugagggaccaugagagcauaggcaugugagcaagccagaacaccgccccggacagcccagccaagaccaaagaaagcaauuccucugcuucucaagaacccagucuuuauagauuaacucauugcuuaugaaaucauauuuauuguuagauauaaaaaaaaaguauggaaggaaaaaaauaagaaugcuuacaagcaaacauguuugucaucuucacauaucacccuguuauuuuaaauauacauaugcauacgguuucuauguuuuucuuuauuguaauuuuccacauauguuuuuacuuuauagaagauaguugaaauguaguucauaugcagauaauacacuaaaucaaaggauaccuguagugguuaauuaucccuguacuguaagggauuuucaucauuuucugguuauuuugugaucuuuuucugauuacuucuuugaacuuacaacugugacuauuuaaauaccauauaggaaguagagagauaguuuagaaaaaaugagcuucauuuugcagaggacccugguucaguucccagcacccacaucagguagcucacaccugcuugugucucgaguuuuggggauucagaaguucgcuggacucugaguaucugcaaacauguagugcacauaaacucaagcacacaucacacacacacacacacacacacacacacacacacacacacaucuuuagaugguuuuguuagaauaagaggacauaggaauuuuaaacuguuuuccaguaagaagaauucagcagcuugugggaugcccugauacuuuaugguuccuuugaacacaucugugccauugcugagcugguaauccauauacuuucuaguguuccuaggaauagugauauauuccaggggcucucucuaaacugugaaauuaauaauucucgacuaacuuguugggcugagauuauuuuucauaaauuuagcuuuuuuaaauaaaaggauguuuuuauaaucauuuagugauauggaaagcccuuguguauuaucuuuaaaauaucauguauccaaucaucccauccuuugccaggugcugugugcauauguguuguguagaaguugcuacuguagugucagaguaaaccucauugcucaaaugguuuucgcuucccugaacuggagcugcugccucuucugaguacugugagauugugguggaaaugacugugcacggugacugauggcucuguggcuuuggaguuguugacgcgcacacugaggaagcauuuguagaccccauuccuuuagucaaguaugugcucuuugaguguugcacagaacuccugacacagaggugugugugugugugugugugugugugugugugugugugagagagagagagagagagagagagagagagagagagagagagagagagaggacagagacagacagacagagggggggcuaaauucuauauuccaguguggacgcaguuucaugauguuucagaguaacagaacagaaaaucaaaaaucaaaauacguuggugaaaucaucagagaggcagguuacccuaaaguuggagagccuauuagaggccucugaggcugucugaugccacucuuagcuuugggguugguagagacuaguagucuacuaguuuaauauauuugaaaugguuucaucagacagucacaggauauuaggucagacacaagugggaggagaacuguuaacaauggggcuaaccaguacgcuagucuugcaacugcuuuaggagaggcauacguccaggaacuuccuagaauauucaccaauagggcuggcucaauaguaaucuuguuaaagauacucuuccgagagagguagcguugugacucucauguaaauaaagacaugaccauguguuaaaagaauuuacuuuacccauagaauaugagggaaccagacaggcugaaauauuuucaaagaaaagucaaaaaggcccagauuuauagagagcaaaggaaugcugagaggaauugcaaauggauacaaaaugguuuuccacaagccugaggaagccaauuaaaucacuaccagacaggacaauagcaucauuuguuaucuauaggauacagagcuguaaaaugacuccaggucagccugggagagccugauagugcagaaggcuaugcugcccacauuugcacaguuguccuuggaaaccuggguguuuuccuccagccuuaucuacuuuuuccucaagaucagacccauagccucucccucaucauaaauaccuguuaggcccuuuaaaguuugguccucuugaggccacaggaugucucuuuguugcauuuggccacuuaauuaggucuagguaucuuuauugccacauuucuuuaaaauuuuaauugcauuuuuugaaaacaacuaugaaaucaugcaaaauggaaccugucaccccaguuucacuccagaucugacguucuuuucugaguggcuugugucagugaugguucccacccgagugcucugcagcaguacugucucucaugguguaguuagugccuuccgucuguagcacagacucuccggucuaguguucgcuuguuuuauccuuuguuaaugagauguuugccuagcuccuugucauuucuguauaacuguucuagaugugagcucaaggaugucauguugguauuuuaaauuggccgugcuuagcacagugacacaacaaagguucauaaaucagguuucuaugacuaccccagaguuucuguccuuaaaguuuauggccacaucacccuuuacagccaagcagauccuuuauuucuguuuguucaguacauuguccucugccacuaguauuauuuauugcgugguccucuucuuuaggcuugacccgugguggcucugcaguuucuguguccuucugucugucucccauuauuuucagaacguuguuuucuuuuuugucucucuacaauguaccuuuuauuuaaaccuuaguccugacaugagacauuuuccaaagaagugcuauuucccugugguuccauuggguucugaaaaugucccuagcauaugucugcucaugccagucuucccuacuucuuugauucugccaaugacuuuuugguaaaggaaggaaguaaaauaauaaauauuauuuuaaguaaaggaaggggaaauggaagggaagaggaaacacuuacuuuucuguuuuauuaauuacauagaguucaaccuucauguggcuuuuuggguuccuggaagaauugccagcagugugggaacagacauaggucgauagugucacccucagcagccuguaaccuuaucuuuagaucauugacacgagccaaaaccaggugcuuugcuuugacaucuguaguaaugaaccagauauucaggauuugaacuugcugaaacaaugacgcagaguuggagacuuuguucaauacauuuuacuucaagucucagcuugacaagugagaaagagguuaucguggaaaacguaagcuacgccuaagaguuugggccaugcuuuucuaagaggauaagacacacucaagaguggguaugaguuagucaaaggagucauagaaguaagacauaugcaauuguguagguaucggcaucucuggggaaagucacagaguaagaugugacagauacacaccaguguagguaugggccccccaagaagauuccugauucgucaucuuaguauuaggcaugcauaccauuuugcuaagaauccauuuuccucuuuccucuccuuuuauaacugagauaagugagcaugcuuuggagacuccuaaccuggaguuagggucugguagggagauucggccaggagcuucugugcuuucacaggcauuuaccacaugcuccuccuugcaaacggacuccuagugagauuccuagaaaauugacccuuauaucuaggaaggaaaaaugcuaaagcaguuguuaacgugugggauucuucuuuauuggcaagagacuucaaccagaucccuaggugaggggccuauucccuucucauguacccucaacuuuuccgaucauuuuuucuugacucgggguuacauuucgacauagauuguaauuucucuugaagagugaaaucauucagcaaccacucaaguacauaagugcgugcauuugaacuuccgucccuuucuccucaugcaaagcccugcucuucaaaggacugaaaggcagugagcuuagacaugggauggccuuugucacugaagaugaggaaagaaaaucaggugcaaggcagucuccuauaaguauccuaaaagucagaugauggggggggggggggauaugugagaaauaagauaauaacaacuucaaaagacuagugaaaacaaaaccuuuuucuuuuaaucacaccagggucuuuauucacaagcucuagcuuggggcuucaccaccgaguugaaucugaauauaccugugggaguucccuuucauguaacaucccuuucaggaaaccagagagauugucccuauggaucuuauaagaccacaaaauacauaccacuuuuuuuguugagcaacgugguuugaaaguuuuuaaaacaaaacauucuuuaaaagauuuauuuuaugcguacgaguucacuguagcugucuucagacacaccagaagagggcaucagaucccauuauaaugguugugagccaccacaugcuugcugggaauugaacucaggaccucugcaagagcucuuaucuacuaagccaucucuccagcccgacaaacauuuuaaauauaccauuuuuguagaaagugacacugguucagagaaaaaaauuaaaguggccggugggcuuaucuggcacaaaagaguguauucuaaagcuacucauucaugagcaauuccugucuuuucccauaggaagauuuuuuuuccccaucucaaaugacuuaagacacaaaugacuuaagacacucauuggcuuaagacacaaaaccgaauccaaaaaaaaaaaaaaaaaaaaaaaaaauccggagcuugagacuucuuccuuuuuuucuaguggugugcucagucacauagcagaugaucuggaauuuuccaagucucagaguucugagagaagcgugugccagcuuuagcuggaggagagaggugcccaaugccuucugcucguccauaacugaugaacuccaagcacaccuuauacugaaaggaggccaucccugucuguuucuuagagaugugaccagcucuagggagggauagacccuagauagucagugaccuuagagaugggauggccugguccacuacuacggucuagcacaccacaggaagauuuaaagcuugauggaucuggcugacuugaggaauggaaggugccuugagagaauuagagucuuuuaagucuuuaccugugucuucuugagccuaggaaguuucuguugcuccccaaauuccuuuuucucaguuuaguaauccuaacacuugaggcuggaggaugauugcaaaaaaaaaaaaaaaaaaaaacaaaaaaaccuuaaagagucuuaaacgagugagcauaaaacauuuuaaaauaguugaaaugucagguuugucuguggcaagcuccauucucagccucacuccuagcuuccugacuauauugguuccuacacuggcucucaagagaugaagaccuuguaaucaguguagacuuuacugaagaaagaaacuaaguuacuucuagucuaguccuucugccacagcuuaacccauugcaaagucacccauacuugcuucaugggguuucuuucuccauugaacauggccaucuuguuucugacuguuaccguuguuauagucaaaugauuacuguggcuuauguguuucgauggauaaguguuucuacugaacugugucuaauccugauuuuuuucuagauagguuuauuacauaaaaaucacgguuuugaagcucauaugguguucuuacuuuugcagacgauaccagaaguugcagaagauuaugaagcccugguaaggauauaucuccugaugugauuucauaauuccuuacugugccuaccuaauuaaauccugaccucucauuucauaauuaugcaucuagauauuuugaguguuucuccgcuuuguuugauguucuuuuaaaacaauuuaagauaauuuaaaaaaauuuccuuuugcuacuuacuguggcagaaaggguauuuuaugauuguuaucucuaagugaucaaagcugaauugcucccuuccuugagcaaugauagauguaauuuuaugcauuacuucaaauaagauguucuccuuuguggcccauguguuguugaacguuagggucuuugacuuucuucugugacucagaaagcaaaagauucauauucaaacaaaaaaaaaaccaaaacaaaacaggauuuguacauagaaugaaaauuauuuaagucugaaaaagaaaguuuucuugcucaucuccugcauauuaaguccaugauagucgugucuggagauguuagaaguuaucuuuuuaaaaagauguuuuccuuacuauugagaauuuacuaguguauuaaaauaugaucauuugcauaucugaucaccuaccaacuucugcucugugcccugacacaaccacuucccaguuuguuucaugcuugcuucuauguuuguauguuuugauagccacuaagccaaaugacccguguucauacauacagagagggucauccacuggagcaugaagaaccucccaguggucacacucuugaaauagaauaauuuucccuucagugagauugguuuguuugcuucuguuuggagcaggauaccugcuggucccaguauaagaggcaccagugaggcucaguguuacccuguuaucaguuuggagcuuacagacagcuagaauauuaacgagaauccauggaguuggaggaagcucaaauuaugcaagaugccacaccuuaugacuuguuuaggaauccaucacauacuacugcaauguaaaugugugugugugugugaaccuccaggaagccuggcuaaauaaaagcagguccugacugaaagcuggaaggauuguucagaguugugagcugucagucacugcagaguguaggugagcuaaccuacuagaacaaaagucugaacuaugaagcuugacaaucuuauucagugucuaucacacaauucucucuaucuauaucuaucuaucuaucuaucuaucuaucuaucuaucuaucuaucuagagucauuaagacuauguacauaguuaagagagggagaaaaaauacuuaguaaaaaaaucaaaccaaagaugaccagauauuaaaauugacagauaaaaauucuugaacuuuugaagacaacaguaguaauaguaguaguaguaguuccuguuguuguuguuguuggugguggugguggucaugggucagguauuuuuuuguauaugauagagacaaguggguaaaagaggcuaauggaaaugugaauaugaacagaaguaaaaugaaaggcaguaggaaaaugucauaaagaaaguuguuagcuaagcggaaauuaguaauaguaaagauaugcuuaaaguauuaguauagugaaugaacuuuugggaagucuuuacagagauauagauaacaugcaacacauaucacuuauaagacuaaaaaaguggagacgagagagaugacuccaugguuaagagcauuggcugcuuuucuagaggaccuggguuuaguuuccagcacccaaauggcaggucacagcuguuuguauuccaguugcaugguaccuacugcccucuccuggccuucaugaucacuacaugcaacuggugcacagaucuccauguagguguaaagaaaacccucaaaaaguuuaaaguggcuuagaagaaaagaaaggaaaaaaacuucaaagucuaaaaaguacaauaguuaaaaugauaaaguaacuuuauggaauugaagguagcagugugaccuagcauugaaaucuguaauuauucagucuaaaaauagaaaacugaauacuaaauacuuuaccuaugagguaaaaaaugugacuuaaaauauuuagcaccucaaaaguacucucaaaaggagagaaacauguaugggacagaaaaguauuuguaaaucauuacaggaaaaaaauaaaaugcauagagauauauaaauucacagaauuaagaaacuuaugaaacccaugaaagaugaauacaaaggaaauuauaccugggaauauaaaagcuuugaaauccauguuaaaauuaaaaccuuuagggcagucagggaaagagaacuuacuacauuccaggcauaaaauuaagacugaagacugaguucucacuagaacuaaugaagaccagaagacaucaugugaagaagaagagggaggaggagggugaaaaggaggaggaggaagagaaggaagaggaggagaaggagaaggaagaagaaggaggaggaggaggaagggagggagggagggagggaggaaggaaggaaggaaggaaggaaggaaggaaggaaggaaggaaggaaggaaggaagaaacugugaacaccagaauuuuguauuugauauaaaacucucccuggaagugaaggugaacuaauaaucuuuuaguuuccagaggggggagauuaaccagaaugcauuauauggaauuuucaaauaacuaacuaaaaagacaacuuauugcuagcauuauaugagauaaaaagcaagcucuucaaauggaagagaccuaacagcagauaaaaauugggcuuuaucugaaaguaugaacaagggaaacugucaaguguauaacuguaugaagauaaacuguacuuuuuuauuugaagacauguaacuguauacaaagaaauuaaaauuccauuuuauuauaggguuuaugucuuauguagauuuaaaauauauaacaguagaagugcaacaggugaagacauuaaaaagauagucuaaaaagcauccuacuguguaauguucacuuuguaaaauuauaaaaguuguauagcucaaaauccaguagaaauauuaaacugagcugcaaaacaaaaaauauuucauuaauucaaaagcaacauacgacauaucugggacagauagaaaccaacuguuuauugauauuuuaaacuuaacaauacaguaaauguaaauggacuauacacuuuauuuaaaaggcugggauugugagagcaaauaaugcaggaugaccccacauacagacuguguauaaaauauuagaggggaccaaacagauuugaaaguuaaaauggaaaaauacauaucuuacacaugcuacuaguaauaugagugguuuuauuaauaucgagagauauaagacugaaaggugauauguugucaggaaaaauguucuaaauaauauuaaaaauaagccauuagaacucaauaaauauguaugaaucuaacauaagcugcaaaaaugcacgaagcaaagcuacuagaagcaaauaaacucauccuguuaguugaggauuuaaagacccugucucauaaugaguaggaaacuugguaaacucaguaagauaaagaugcuguaauugacauuaguguauauuguuuauggagcgucauccuuacugagaggagaauauagaucucaguauaugugaaauauucgucaagguggaucagaugcagaucaucauguaucucaagaaguugaaauuagcuugaauuaugcagauuaugcuuuucaucccaaggacauuuacaagaaaucauuaauaaauagcugaaaauaugcaggugccuggaaauuagaaauuagaaaucaugcuuauuuuucuaagaguugaggaacaaugacuugguugaaaauacaaaauguguguucagguaaaggcaguguuuacaguggauuguauacucuuaaaugcuuaugcugaaaaaaagcuaaaaauaaaaggaacgacacagaauuggaagauuaaaugggaaggagugggaaggcaggggaggggagggaauaugagugggaacuacuaacacuaaaggccuuggaaacgccucauggaaaccaacuccuguagaagcuuccugggacaaauacauacacgaaaggaauuugaccagagucaccauauaaugggcuuagggaugggauaaugaccuagcuagacuccuuaugccaccaaauaaaaccuccagugacagcaauggguuacaacuuguugaguuguuggccaggcccaaagggucccauagacaacuccaagcuucacaggcuauugccaaggguacuggucauucucuguaaccuaguagguaaggucuuauugccgaaggcaacacguuuugugucaucaaguauggagaaauugaacugaugcccagccuaagguucaccccuaccagcuagcauuccuguaugcuacuggaugagaaaagcaauaauacagcucaaaccccuaaaaccucaaacugguuuuaaccugugcuucgcuugugcuugcucucacaguggcugaguccguauguguaucaggucuguuagauauacuggugaagugguggcacaaauguuauagaguaauacacuacuuuuuuuaaaaaauuggauuuaaggaauacucccugagauggaacccauaccugacacugcuacuguggccaagaaucugagaccagauaggucagggacauaggagaaaaauuacgauucugccaagggagcauagcaauaaaaugauuucuaaugacaaauugcuuuacccaucaguacgcgccuugguuaacccucacgagagaaguuuguucuuacaguuaauggggauuaauacagcaacacacaaguagacaaugagcagagaaugagacuuuacagcacucaguguuaaaugagaugucuuuaucagaccccucccuucaaggcucaggggucugugcagaagaagagguagaagaggcagaggugguagaaggaaacguuucuaaggaaacggcaucuuuucagauuccacagggcugauacuuauauaaacuuacagggacugugacagugcgaacagaaagcaguuucaaaucagacagaauuaaguaacuauuuacaacacaaagaagcuauuuacaauugaauugauaacugcuggaaaaaugaaaaucaguucucuaguggaguguaacugagucuguuaaacaaauugcaacacaagcaggccccguucccagugcuuugugcccaggaguagugggccaacagaaaauggacacuauauaguugaggggugggggugggaguugggagacgcggggauggcauuugucuuacauuguuguuuguuuguauuuccaauuuuugguuuuguuuguuuuuugagucagagaaauaaccagacauugguaugugugaaggugaggaagacaugggaggaguuaaaggaggggaaagaauaggaucaaaauauuuugaaugaaacaaauuuuaaauaaaaagaaagaaaucagggauauaauuuuauacucaggggaguaggagaacagcaaucaaugaaagaugaaaaagacaaagaauaaagaaauuuuagggaaaugaaauuauuuggagaccuucuggagagugaaaaaaaggucguuacggagaugagaagugagcuccagaagcagcagagaguggaucgcugcagagccugcugauuugaaaagcaacaugagggcacacugcaaauguuucucugcugguaaauuuuaaauuuuagauuaaaugcacaaaaguccuuaugaaauagaaaucacgguguguaucugcaauggaaacacgugguuugauccccuuuccagaauaccuugcugcucggucacaggagagucguuucugaacaguuuucagcuauagggcauucuaaauguaugccagcuuuaaaccauggcugucaucucccagcagccucuuucugcccauuauggacucuuccuggagccauggauuguuguaaaauuuauuauucaccacuuuaaaguugcuuuaaaguuuucuagaaguuucucaaguugacuguuaggucuucaucaacuuccucucucgauaucuaaucuacaguauguucugcaaacuccaugccuucggcuucaccguuuucuuuuucuucuuuuuuaauuucguacaaguaucuacauguguauggaggugugcauacacagagugguguguguguguguguuucuguauguguguguacgugugcuuguggaagccagauggaaauguugaaugccauccaugaaaacaaaaucucccacgggccugaaguucaccaacuaggcuggacuuacuggugagugacccccagggacacuccugucucugcuuuccuuagcucaggaguuucaccuuccacccaucauacugaucauuuuaugcauguacaggggugagguguaucgaacccagcuucuuucccucaaaagauaggcauuuugcugaccaagucaccgaaggcccaggcuaaggccuuuugucuuacacagucguuaucuaguuuuccaacaaaccccuccaucuccuaacucuaucucaacuucugcuucuuagagaaauaaaaccuauauguuaaaacugacucuuagugaauaauugcugggagcauucauguuuucucaggaguuaagaucacuauaaaaaaaaccuugguggugugaaaacugauuacauggguaaaauccauuauacauuguggaagauuuaccaaauauauaacaaaggaggaggaacaguuuauagcacuuucauguggccugcaucauucgauaucucaaucugacuaugacaauucaggaauuaaauauuauggacaaguuuaccagugaacagagguacagaagaccccagcaagauauuaacauagagccaagaaauacauaaagcaauaacauuuccugacuugugccagcucuaagucaaggcuguuuacuccacagcaacaaagucuaauacauuggcuagugugauuuauaacagaaacagcuuaacaucugaaaaucaaucaauguuaggcauuuaauaaaacacaucagauaaaauuauuuuauaagaaaaagaccauaaaacucaagagauagcucagcuguuaagagcacagacugcucuuucagaguccugaauucaauuccuagcaaccacaugguggcucacaaccaucuguaaugggaccugaugcccucuucuggugugucugaagacagugacaguguacucauauacauaaaauaaauaauuaaaaaaauuuuuccagcagaacagccugaugaagacccauauauaucuauauaucuauauaucuauaucuauacacacacacacacacacacacaauaguauauauguauauuauuggugggaaaccuaauguguucuaucuuuaagauuaucaaaaagacacauguuuuauucuguacuuuuugggggcugaguuauguaugagcuuuugccauuugugagaagucaagaaagaaguuaaaaggcccaauaucagaaagacauaaaacuaucucuaugcauagaaggcucaauuauguagaaaauccuaacaaagcugccgagagccuggcagaugugauaacauaccuaccaacaucuugagauagaauaucccuacauaaaauucuguguacuuucauuuucacagcaaacaaaaagaaaugacauuacauuuccccauuuauaaagugucaaaaggagaaaauucuuuugaauaaauucaacuugaauuugcaguuaucuguucauggaacaauaaaaauuacuaagccaguuuaaagaucuaaaucagugggaacagaccauuuuauggauugauaaacaauauuaaagauaacugcuucucugcaaaucucaguuuaauaguaugcaaaucacuggaaaaaaauaauaggacuugugagaugguucacuggcuaacggcacuuuuccugcgcucaguuccugggauuuucauggugaacagagagaacugacguuaaguuguccuuagaucuacacaugugugcaauauugugcacacacauggguacacacauacacagguacauacacacacagucauacacacagguacacacacacacacacacacacacacacacaccaucaucaucaucauccccaccaaaacuacauauacaauacauaaaaguaaaaauuaaaaaaaugagaacuuucuaaaauuuaggugaaaauacauauugcauaaauagcuaacaagaaaaucugagagggcuauuaggugccuguaagcucugcuguaggacagguuaucacagcagcaugauacugaccuaagagagaggcggguugauucauagaaauauaaccaaguccaguguucaggaaagcagucgugauuaugccuacuaauaugggcccagcagguucuggaggauaaguagagugucuaauuggggauuuaguuaucuacagccuccaauggaggcaaguguuacccacaguugauggacauaggaagccugaacaggggaggaacuguagccuuuaguaagggucuguuugcuacuguucaugaauggcuuuaaaaguugccuuuauguuuauuauuccgcugcugguugugucuugggcacaccgugcuauggaaagauuugcaaggacugugcuuuuacaaaacuaccagcuuacguuuacaugcuuguuuuuagacuggcuggguuuuccuuggaaugagggcucauccucacauugaugagaaacauuuacuugagucaguccagcacacauggugugucagcugggagaauggaagucgaccagugcagcaggcaguacugcagacuccuuagcacagcacuucauuaaaaaacaaggaaagcgucccagaaugugccucgugguuccuuuacauuuguaauucuuuaaaggcuucccccuccacucugcauugauuucaaaaguagaaucugagccuuugucuuuccucugugguguuugagucaguccugcaggaguggaaguaaauauugacagcugaguucgagaaaagcugcuagcuccaccucacuggaaagaagucuuuugauuuaaaauagaauaaaaauuuaccaugccgucuuuaccuuacaucugagguuuuaaaguugaauugugaaaaaaguuuucauggaagcacacuacgccacuuagcaguuagccacaaggaguuauauguacucuguggaauauauguauauacguauaccauaauguguauuccguguauguaugcuauauauuguaccauacuacaauacuauuuaacaauuaauauguuaggaggagaucauauuauaugauucuuucuaucaaccugucaaucaucuagcuauuguguuagugaaagggccaauucugaccagagagcaucaucuugauagucagguugugugacacagccuuucuuuuccuuggcagucauuauuguugauggugucugaguauuacagagcuugcaaugugcaaccugggaauuucugcucuuguuccucaauagcuauccagauuaaagccuuagacagcucauuuggagguucagaaacccgcauaguucucuccauuugucuccuuucccagguucuugaagccugucggggaucuguagacagaucuuugaaacagaaugauugucucccuuaggccauuuggauugagauuucacugcgcagguagcugaggcgcugaaucauauugccuuuagauccuuuagaaggaguguauaugauuuauuuaccauuuuucaagacuaauggagacggauguggagccuaaggccuugggugcuccagggcucagguagcuggcugggaaggaagaguugagccaucaggggaugcuuucuuuggcauuguugguucucugaucaccaaggcagguaugucuaugcugagugcaggcuguggugacaucauucuacuucuccguggggcauggcagacccuucauagacacugugacagccucaaagaaccaugacccccuaaaggucuaugaaccuuuaucauaucagguauacacaaaugccaaagaucguuuuauucuuuguauguaaauaaacaaaauugccauaauacuucugaauaauacguuuauuguauuauuguaugccuguauaaugauauucucacagcaaaacagaaaccuacccaguugaguuauaaaucuuacuaauugaaugugcuaccugucucuauuuucugagcauuuucuccuguagggguugauaaugggcuuuuugugauucucuuuuuguaggguugcucuugcaguuuuauuuaaacuuccuugguuuuaauuuuuuuuaaccuauuuucuacucuuccuaaguuuuugcuuuuuccaguaauucuucauauucugcacuuccuuccgagguacacucgauccucugaugccaccuagggggcaccugcaagauuaggaucuccguguuuucccugcuucuaugaacagagcaccuuuuccacagugggcuguggaauguuugaaacccuuagcaucauuugguuuucaaaauccuaacuuuguggugguuuagccaaccucucccugcugcuuacuuuucuucuccauugcuguuugaagggcuggaggcaugucagcuggcuugcuuuuccuaaauaacccccaggguaggaccauugucaccaccacuggcuuccucuucccuagcuuuugaaagccgggagggacagucaaguaauuugcucuguugagcgggaggccaacccuuugcucugugacuugccaucuccuaauuguuucuuuugagcgccucucuuucccucuggucucugaguuacuguccucuuugaugggcuccuuucagcaugaugaccgccaaaaugaaaguugauuuuuaaagcuggacugagcagaccagcagcagggagggcuguggaggagacucuguucauaucuucuuuuucacuguauuaguugauaacagagaacuucaaccuaaauuuguuuugagacuuagaaauggagaaauaaugugauguguuauucugaacaaccaaauaaaaacugaguauggacguauacauuauuguauaauguaguauaggaguucugacuggcauucugggauccuugcuuuggugaggucauucaucaugguaggaacgugaaguugagcacaaaccccuucccaugcucgaaacaggaugaggcuagggccucgcugcccucuucaggagcagugauguaaagacagcucauugagccccaucucucagguuccacuaguucuccauagggcuaagguggguaaaguauuaaacccacagaccucugggacgugcugacccuaaccacagcacaauugaaucuguguuugaaggagccagugcugagccagcaagcccguucuguagucauuaucuccauagaugugcgggucucuguguccaccauggcuagcagaguaaugaucugugggaggcaagaaguuaguucagcucaaaacgauucaguggcuaguguugcuucaaacuuuaagagucuaaccccaaauaguuuauuuuaggcauguuuaagucuaguguaacuuggugaaaauuuuuccgauaauaacucaaucugugcgcaccauaaagcuuaaggaaugaguacaucagaacucucuguaauguauaggugacauauuacauaaaguuggguucuauagguugacuacaugugacaucuuccauaaagauggguucuauaggcugagaagcucaugauaagggcccagggcuuccccuagcacuuaaucugggaacacaagaaccucugugccucccacacauagacauuacuuaaaauacaauaacuaaauauaaaauccuaacucauguaaaacaagugagcuacuuacauaccuauuugcacguguguauacauauaguguauaugaauuccuuuugugauaucuuuugacuuguguguauauguucauguagguacaagagcauauggaggccacaaaagggcuuuggaacccuuguagcugaaguuaaacuaucggugguuguaagccauguaacaugggugcugggaacugaacugugguccucuucaaggacaauaggaacacuucacgacugaaccaucuuuucagugccuuugaauccuguguuaagggcugguguuauggggagcccaccagagaugaucacucaaccacguuucuuagccaacugaaagucuugauuccggcuggcugggacuauacacagggauuuggaucaccaugaaacccucagcauuuagaucaaggggauuuuaaaggggaaaagugcauccuguuaucguccucagcagcugaaggggaaguuuguacaagcaagcagcuuaacagaagcuaagcuaaguuggcuggggcauuuuggucucagguccuagaacagaguuggauuauuuuccacgggauucuaaaucaaggagaucaaauucuggguaaacaugaaauugucugucacauuauuaauacuauagguuugaguuuuucuucuugauuccuauaggccauaaaguuccucucuuauuuaucugccauuugcugagaagcugguuaagcuaacauuaccaaaagaaauuauucuuuuacacuuuuuaaaguacucucugugcagccuuuugcuauacagcaauuauccagcuacucgguggaggaaacagaguugcagaggggugaaaugaaaugccuggugggacauagcccuccaaagugugucccaugggagaaaaaccugucgagucucuggcucuacuuggugauuucgaguuccugcccuuuccccuaccuuguaugugaauacuguccuguuaguguccugcuucuuaccccuauggucuuugaaaacuugacucuccuucucacuucuacaucuuuccuggugccaagcuguggggucugugaugaugaugaugccucuuguuuugcagcuuuggagacaugcuguccuucacucucacagccuuuguggaguugauggaccacggcauuguaucaugggauacauucucaguggccuucauuaagaagguaaggcagugcuucccuagucucucgcccuuucucuuuucacauagaguucucugcauuguagguauuuuauaauuguucuuuuaguuuuuauguugaaaguggugugauuuugguaguauuauauauguggggaaacaaaacccccaaaugcuguguaaaaauugcauuuugucccaacagauaucauaaaugguagcguguaagaacccagaguuaaagagcaaucaaaguguucugcuucaauuugcauaauauaucuauagaucuuaagaccuaacaaggcagagagagagcuaacugggaaugguguuggcuuuugaagucuccauguucaguuucagugauacauuccuaauccuuucuaaacaguucaucacuggcagaagugggaggacuaagcaagcaaauauguagucuuugggcaccauuuucauacaaagcaccaccauuaagagauaauguuguguguuuuccauuugacauucaucuuggggaacaauuuuaaauuaaagauaggagagagacauagucucuggaccaaggguguuggcaaucgaagccccacaggucccaugucugcaggaugugguauguuuauuuaagguaagagcuaauuggaaacuaagggacuucuugguauacuucuaaaucuuucuuuuucuacaucuacaaauucagagguagagguaaguaaaagcgaaucauacuguuggcuaaauugcucagaagaaaacucuuagaugaucaaagauacugaugugcuacaaagaucauucaccugguggcggggguaugucuucacuuucuggaaaaaguucuagagagauaaauccacacaugaaugauacuggguuaaguggaauuuuauacuaaaaaguuuaauacuuucugaauuugcagcagguuuuucuuucauaaucugaauguccuguucaucaugugucagagaccuucuugcuggauagugacauugcuguucugcauagagaauuauguauguucacuggcauuagcuuucuggguuuauuguaguuuccuccuccuccuccuccuccuccuccuccuccuccucccccuccuccuccuccuccuccuccuccuccuccuccuccuccuccuccuccuccuucuccuccuccuccugugugugcaugugugaaugcacacagucacaugcacacacagauacacacagagacacacacacauaacuaaaccaagcuuacgucagcagggucauacucucuucaguggcauggggccacuaucuuguacugagcuguccuccuugaccuacccauaacaguucagggauucuugcuuccaucugaggcacacccauagccugagauuuaaaaaaaaagaaaaucauauaaguugaaaaauagaaggagcauggugaaauuugauuuaaauauauuuccaaggaaaugcucauuguuaugagaaaguaauaauaaaacuuuguuuuuuaaaaugauuugaguuaagugcucagagacgauucagguuuuuaacuaguuaagaugauuccaauucacuuuaaauuaaauuuaaaacccgcauuaaggcuaaggaagcaaaagcuaauugcccuugcaauuuaaaucaaaauugaaauauuuuucaaggcagcauccuaguacauucuuuuucuaauuucuauugcauugcuacuuagauaagagaguuugaaaaaaaagcagaaaauugauuaugcuguguaaguugacccuucuuauccauuagcuagaccaaauucagcauucugagcagcuggauuugugugcagggcaucuucagcaaaacuccgcuaggaaauccacaaagccaaguaaaauaccagugcagugcuuugucugacagggaagggcaaaacaacaggcucugaggaccuggcuuacucugcagacaguuuccauucagaacaaacauucaggcauuucucuucauugacccagugaguuucgccuuuuggagagauuuaugagcaucuacaaggguaauuuaaaauuucauagugcagcuuuaucuuaucuauagauggcccuuuuugccuuuuuuaauguuucauuuauuuugaaauuaaauuaauuaauuuauuuauucacuugacaauacaauaucagcccuuucucuccucccaguacccccucaugcaaguccuucccuuaucccaccucugcgggucacccuucauuaccccucccuccgcacaucaagucacuaggagacaggguguauccucucccacugaggccagacaaggcuauccaggggcacccagcccauaggcaggcaggaucagggacaaccccugcuccaguuguugggaaacucaugacgcccaagcugcucauccacuacauauuuuagguggccuggguggucuuugguuggugguucaguuucugggagaccccaagaguccagguuaguugacauugucgguuuuucuguggguucucuguccucuucuguugucucaaucuuuuucucugcuccuaaaacauccuucagauguuuuggugugggucucugcaucucuuuccauuggcugcuggauggagccucucagaggacaguuaugcuagguuccuguaucuucaggcucuauggaugaccuuuuacaguuuagauaguguucaagaaauuggagaccugaacaguauuuuugcucuccuuguuuuauguacugcugaugccacuuauauucuguauuugugguugggucggggggugagggcaugugugggguguguaugcauguggguugugagggaagucagaggucaucuuugaguguuguuccucuggagacauccaucuugguuucuuuagaauggaugucuuacugggacccaaagccugccaguuagguuaggccagcaagccucagggauccaccuguuucugucuccccggugauagaaucacaggcacacaccacuacacuuggaguuuuguuuuguuuuuuugauucauguaugugaguacacuguugcugucuucagacacaccagaagagggcauuggaucccauuacagaugacugugagccaccaugugguugcauggaauugaacucaggaccucuggaagagcauucagugcuccuaacggcugaaccauccuucuagcccuacacuugguuuuaaacaugggugcuggggaucaaacacaggaccucaugcuugcgaggcaagcacuuuaccagcugagcugugcugcagcccugcccuuagcuucuuaaaaguuccccaaacauugccccuacuuaccgaugaacaugagugcguguccugaagaagucaaaugcauucuuauuacucauugcuccagugucugucucucggauacagacuugcuuucaccagucugugcuguucugaccucagcuggcucagugauauggcgaggagaagcugaaagguacagaaaaagcacuguuaauguuguguaugggguggugcagcauuguaaaauuuaccuagguaaccuguaaucucccgccacuauacucucuucuauaguuuacaauguggucaccaggauguuuguagcuucacuauuaaggaguuugucucuagguuccuggaggaagacaguuaguacauaugcuuaaaucacuucugauggaaagaauuggaccauuuaagugucugguuacaacugauggauaacaacaggggaagaugucagguucaaagcccaacuggugcuugccuuaggacugugugaggacucaagcaaacuggacacauacuuuacaccaggccuguucccagcucccaacuggguuuauguaagaugcucacuaggugaaauacuuuagggcugcagaaaugacugauauucuuuguuaaaggaggaaugaaggugaacaauuaguuucauggaugagacauacaaagacauggcaacuagaaaugaaguaugggugaagaugcuaauguucuuaaaugaaagcaaagaucauuggugauuuuaccaccacucaguaucccacuggguguaggagaaaauuaauauuuuccaaagaacuuaaaaucuuuuuaaagaagguguccuuuaucuuggaaaacauucaagaguacuaaaugaauauuuggggggaguaauuguuguuaaaggauauuuguagaaguaagugguaaauuuccauuuaaugagaaacuugacaggggauagagagacggcugagcaauuaagagacuggaugcucuucuaaaggaccaggguucaauucccauuaaccacacugcugcuuacaaccauccguaaccguaguuccaggggaucugacacccucucuggccucugugugcaccagguacacaagagagagagagagagagagagagagagagagagagagagagaggagaaggagaaggaggaggaggaaggaaggaaggaaggaaggaaggaaggaaggaaggaaggaagaaagaaagaaagaaagaaagaaagaaagaaagaaagaaagaaagaaagaaagaaggaaagaaagaaagaaagaagacacgaaggaugaggauagagggauuugacaauaucagcaacagguucucaggaggcagaugcccaagacccuaaggcacaucucaacaaagagaggcaugaagaguagccagcaauaagagaauuuguggaaagauaauaagaaccauugcaaugaucucuccuuauauguuuccuaaugccaguuuuacauauuauggugugauaauuacauggggguugaaggagaaucacggaguuuguacuccauuccaaagggacgcaucuuaaguaaacagccaugagagcugugagggcaguuggacguccaucuguaaacaguggauuuaaagaaagagaggugcuguucacauugcagauuuuguagauuggaacagaugugagaacggaggcaggagcuugccagggacaguaaacacauucgcgugagaggagcugagauggucuuuuaaggaucuuaaaacuuccacaggcuuccuguaguuugugcuauaaaaacaguuguggagcguaaaaccuccuguggcugcuuagcuccuuuauuaccucccggugccugaggugccugaggucccguggaucuggcagaagagagucccuuucccgccuuuaccaguggccccugagcuagcaacaguggcaugggagguagcuggaaauggccagggugccuuggauuuuaucagguucaggaauggaggggcuuuggggacaagggugugugacaugacacaaaggaaagaagugguguugacaguggaagcaaaguguguaaccaucauagaaccaagccaggcagcuuuuaagucagacaucuuuuaagccauccuuguguggauguaauaaucacuuuuuaguaugagcugucaacagacagcaauaacuuuuaaugagaucucuaaaauaaagccuuuacagugcucauguguuaagacugcauugagccguuauucuaacgcuguguucugucucccucuuacauugugauuuauuguauuuaggcuuuugcugcuuaauuucuuagggaauguguuuuacauauuaugcuauuaugcuaacauuucuaauuuaaaugacuucuuuuugcuacaucucagaggggacagaagaauuuacuuuagcuacagcacacacacacacacacacacacacacacacacacaugaauagcgagaagaaugggcaggugcagagcauugccuguugaauuauacugacaaguaugauuuaugugagcuccuuaagaacauaacaggaauacaauaagaacauaaaagucaugggucuggaccggguggaugcaggagcagccuaacacuuggcaauguugaaguugcuaucuuaacacgaaagcucuuccuugagagcugaaacucagaauaguaauccugggaaaaccaggcaggcugguccuuugaagaugucccuuacagaggcagucaguuauugcugagucaugagaugaguaacuauauuuugugaugaguaaugaacauuauugacugcaugcauuucuugcucuuuuguaguacguuuccuucugacuguauuguucuuuacugcgcucccagcuugcuuuauuugccucccccccccuucuuucuuucuuuguuuggcuucccauccuagcaggaguagucauuugugaccuaauuguguuuucagauagccagcuuugugaacaagucugccauagacaucucaauccuccagcgguccuuggccauucuggagucaaugguucucaacagucaugaccucuaccaaaagguagcccaggagaucaccauuggccaacucauuccucaucuucagggguaagcaugcuaggcacucuugugccuuguuucugggaaacucacugugauggccugggaaacauugcgaacugguuaaauuacgugcacaaaaugucuugacuugggagcaaauuagccuuauuggucaugauacauccccagggaaccauacaucacuccucagagucuaaaucacaggauacauucagcuuugguaaauuuugguagacauugguugaguuuuacuuuuuauaagacauaauaggauacuuucuucucuuagguucucgauaguaucuguauuaccuauaauauuaccugugauauuuucugugacacugcauuuucauaacuguuuuggcauuuuaaguaguuaguuacuucagguuacauauugaaaccuaauguuuggagcuaggauccauauggggagagaagauguggcacuuguggcuuugagucuaggucaccuuaacuagaaauuuuuaaaggcaggcuucuuccauuaccaaacuucagccuugaugaauaaaauagugaaagagccaaacacaugcaucauuuucuuaagagccuggguaagauauggaggauaaacaacugcccucaaacccugccauccuucuggagguuccauauuuucuacucuuugguaaacuagaagggugcuucuuauaauaacacugagagggacucuguuaugcuguguggcuuguuuuauuuaaauagugguggguguuggguaguggaagaaacauugugaacuagcucacauaagaagaguguugguuggaaggauaugaggaugccuuguaaugucuggaaaugauguaaggcaauguguuuuaggaaagacuuugaguggcaucaaggugacucccaccucuguucucuuaggucacauuggcuuauucuuauagugaaccugauugaaccacgugggauguguguaacuacgucuaggaguauggauugguuaggccagcaguucucaauacacugaagaugucugcuuuuguuuguaguguaaacgacaaaagugcauuagaugguuaauucauuuggagguagggugugagcagaauuuacaauuuaugucagggaagcuguggacuuugucccuagagauuuagcucaaucuuagaaggauggguuuugcauguagcuucacuuaaaaugacauggguuucacugucucguaauuggagcaauguugacuucacugucugaauuucuguuucugaaucucagaggcacaaauguucauuuagaguacacuucacugaaaaaaaaaaagccuguuguucaccaaguacugugcuaaggauggagguguggugucuaauuccauccuagauacagcagcaguaggaaacgguaucuucccugaguguagcucuuaggcucuuggcuucugccuuaagcccuuauucacuguucaccacuuggcaucccuuggaauuucugcccucuuucuagugaagaacaaaaucuuaaacaaaaaguucuaacauuuacuacuguuacagcacuaguguuugccaacaguauuuuagaauaugaaauguugcuaugggaacaaagcuguuuucuuuuagauaagcccaggaaugcugagacaucuacaacuguuccaauacauguaucaaacauuggauagaaaaucacacacacacauacaccccacaguaucauggcacuugcuuuuaauucagaugaagaagagagaguaaggcagcuggcgucauguacuucugggugaucacuuuugauaacugguguaauaacaaucgugugacuaccuguccagcccagggauggagggaauauguuaccaugucacccauggcugccuauauuuucuagguccugccuuucucuucuguucaaggacugcuguguuugugugugauacugagccuuaccauggcugacucuucugauuuccugguuugugucuuuacaggacagaccaagaaauacaaacuuacaccauugcuguaaucaacgcacuuuuccucaaagcuccugaugagaggagacagguaggucucaguucuuuaguccugagacugggaucaguaugggguuagaaacuccuucuuccccucugggaguucucuucacaggacagccaugccuugaaggcuggcuggggcauaggaggagggaguaaauuaaaucauuuaacaaaccaaucuaucuaauaguagaauccaucauaaauuaagacuauccuaugacuaacucagucucagaaauguauuagcaacaagauguguacuuucuuauugaaaguuaauguugacucuaauaacccuugacuuuaagacgugcucauuagaacagagauaguguuacaguguuuaaauuuaaaauaucggagugauuaggacagugagcccugaagaucaguauccaaguucacaaugaccuguuuguggauguucaguggagaccuagaaaguggaauucacaccaucuguuuaccuggaugccucuagauugugucagcuguggcagguguacaccuuuuucugaacuugaccuuagauguaaaagagcguuugagcuggucuacauucaauauuggcauuuuuacuagcauaauuuucuuauuaaaggaaaggcauauucuuuucacuuaguggaugaggaaaacgagguuccauggaguaaagaaccugaccaggucaccagaguggugagaacuagggcuggaagcccaaccuccuacuugguuuuaacugcaaagaauuccaaugaaugcuuggcaaucagagaaucccagaagucaugaggaaaugaggcccacuuucucacuccaauagauuaaaauauuaccuaaguauuuauaccuugaauuuuacagaacacccccuuuaaagauugaugauuaagccugggacauuguauccauugugcuacuauugaacaauuuguuguccuguuuggggccauacaaagucauagcaagccauugucaggauuuccuuauuaaucuaaauguaugaaaugaauuuggaagguccaagcuuuggugucuccccuuggcgccgugguccugcugguccuaugcgcuggcaaauccuuucuugcugcaaggaugaaggaaugugcucuucgguucugugggagaaggcacagcugcugaguggccagauggaucuuuuccuuugcuguuauuuuaaugaaagauguguugagacgaugucuuccaaauuucuuuacaaauacuuaauagcauuauaagcacuauuugaaaauaaccuuucguuaacaaauucaagauggagaaggcugaaggacuuuucauucgggucccuggguggagccuuacaguccuugugcucaaacauacccauagcaugguucucucuuuauucuguggacauugcuuucacgugugcauuuucccaccaaagggagccacccacccaugugcauuguuuuuuauuuacagaccuauuuuaaaagccuacaaagauacuuguggccaacuucccaugucaguugaucuauagcuacaucuccaucugaauguuuaugccauccaaggcuauacuauccucccugugagugcucaugguuauugcaacaguucacuuagaguugacauauguccaccaggaggacaaggauccuuuugguuucucucuaauccagcuccuccucuaaaggaaaauuguauaaaacacuuuugauuuucugucaaucccuuuuggucugcucugugcucgcucaacacuuucucuuauggguggaauacaggaaugaagcauccucuauguccuugaggcguucauucagaaaaacacuguggauaaaugauuaauagucauugcaugaugaaacugucuuauuucuucuaaucauguagaccagugagcuacaccuucuuuuccuguuuguguuguucugauaauaaugaacagcaauuugaaaauaauuuuauaaaguuuuaagaacuaauuaaaagaauugugagauucuuugguccuucuguuuauaugacccaacaaaagaaauuugaaacagaagaagccaguggaccauuguuuaggugaaaggaagccuucuuucuccaauguggaaggacuagccuucuggguugucauuuugccugcuucugggggugugcuuggccugcauucuugauuuuaagagcaugggagaguacuuccuacugaauuuggacauuacuaccaccucaccauccaggaucuccugacagaauauccacccuuuccagugcagagggucaguagggugugacacugaagcugccagcuucuaacaguugcucugaauuuccauccccucuucucucccacuugcuuuccuuucugugguggcgauggugccuuagguugauguagagagcaauguugacauccuugauugcccucugacuguaagucuccguguuuccucugucagccucgauaaccgggccugcucucccaguccgcuccccuccccucccuugccuguaugucuccuuguuagcuucucuccccacgcucuugauucucccagcuuucugcaaauuuacuuuucaucuugguagaacuuaauaguuuugcuuuguagugguaguucagcgccuucuacuuagugagaauugcaaugccaaaaaauacuccccagcaaacacaaaaaagaauauuuuggugucuuccugaauauaagcaguauuuuuuuauauucuuugagaguaucaaagcugucuuucacuaaauuuccuuuaguaucugcugguacuaugauuauaacaacacucugaggcucaguccucuuccaguuugcucucugauaaacacaguggccaaaagcauccuggggaggaaagaguuuauuucaguuuauaaguuacaguccuucguugagggaaaccagggcagaaacuugagcaggagccacugagaaauucuccacacuggcuugcuacaaagcccuucaucugccagcuuaaacauccgagccccaucuaccuagggauacgacuaccuguaucagucagccgucaagaaaaggccucacauacaugcucacgggcaaaucugguugaagcaguucuucaguuaagguucccuuuuccuuaggugugucacauugacaacugacguuagcuauugcaaguccauuugauaaagcuagccccaaauccucuauaccagucaguaagugccacagcccaaaauacagaaaagaggcuuugcuaagugggugugaacucuacugcauagcaucugcccuucaauaauccagacuucaguaauccggacucuguucacuugcauaauuucccccacaucuaggggcugugcccuucauuuucagcuuguacagauuaaaaggacuggcuucagcagacguuagacuuuugacucuuucuuuccaucuucugguugaccugcuuauugaacaguacuuccuuuauaaguaaauguauaaaguuuuaaaaaaguaaugaugauaagagccaucaaagacacagagagucucagagguguggggacacuuuuguaguguuugcguuuuuaauucuuuuuuagaaagagcagacauuuuuuuuuuuaaauucuacuuugcuuuugguccuggauuuuauaauccaaaccgaauguacaaaaauuaauuugaauuggccauuucccaagaaauacugcugauauacaguugagaagcacacccuaggaugagguagcuucuggccauccugacgugagccuuucuaacggaagccuuugugggcauguuuucuuucccaggagauggcgaauauuuuggcucagaagcagcugcgcuacaucauuuuaacagugaguaccccguucacugaauccaccauguuagggagaaauguccuaguuagugucuguggguucuucugugguuccacacuggaguuugaacacuagggccaaucuaggaaggggaaguaugcuuuagaacuggcacaggcagugcucugcugcagccacagccucggccugcuggacgaggcaaggaaacauuuagugcaccucagcuuaggugugcaggcaaagaaaaucagaaacuccuuggcucaaaaaaaauccaccaguaugagcucuuuuugaugaggaaggugguuggaaauaugggagguucugggagaagggacuuaaaauucaggggaaaagaaguuugcaaagucaucuugucagcguuuagagaugaacccuuuaggaaggguuuuuuuccgagcuauucaccaguuauuggaaggaagcaagauuaauacuuaugaaacuaacaaacagcaacgacccaaucugauguuguaauucuacaguucagcaagcuuaacucacgcaugcgcacacacacacgaaauauagguuuuaaauucuucuuuauauaugaagaagaaaacagaucaaaaggccauugcuuuuugaaaggcauuggaaagaaagcuucucacuuaaaauucagcaagggauugguauguucuacagcgcggaaugugccacagcacgguaguuacauaagagggcagacccaggaaauaagagaacugcauggaaaugagggacacagccuucacuaugguuuccuagggaagggaugcuucagagaacacacuccagccaugugacacucagguucaggaauggcuaguucggugcuuucuguaggcuacgguguuuauagguugugucuagucucaggguaccuggcuuuggguguuugggacacugggaagauggccauagcccuccuaguuugcauauaaaaauacuucugcuaucuuaucucuacaaacuguuuggggcuugugcuggagugcagguucugcaggguaaggaaguucucacaugccagaacuucagaaucauggcuaggguuaacuuugugcucugaaucuuuucuuuaauaauuuuaaaaaauguaauuuguccacaaugucucuagcaugucauccgagcacagcgggccaucaacaaugagauggcacaccaguuauauguucuccaagugcugaccuuuaaccuucuggaagacaggaugaugacuaagauggacccccaggaccagguagguggaugcuccacacaaauguaaucagagacagagacagugcaucaaaugucuguccuuuagcuacccucaaauccggagucuuauaugaucccauaauuguuuucuugacaucucagaacuuggacauauugcuuuaaaguuuaggugacccuaagaucagagaauaaaauggaagggcuaguccaugagguuccauaugcaugcauguuuuuccuuuacauuuaagagcuugagguuaaagcccugggcucuugaccauauuacauuaaguggggucaaguucccauacagcugagggcauucaaggccuugaguagcauugauucuacaagugggagugguuugcauucuccaguaucuaagaccaaaggcaguuuguccuuuucucccgugcacccucauuucuaggccuguguuuuuguuggcuggccaguuuuucuaacucccugcuaccucugucacuguguacaaaacauucuguuuccacccagaaggcuuuggggggagcuucccugcaggaggguagagggaggaagcagcugggagccccgccccugcuguacacauuuucaacucaaauaguggugcagcuguggaaaggaaaacauucgcuauuggcacgugagggccugaucugcugcagaugcugagcugcacauguggggcguguggcugcugcggcccuccauucaugcugagaggccaugugaguaagacugaaggagaggcuugcauaggccaaugauugugccccgugcuuuuucucugaaaaccaagauugguguaguacaagggagacaagacaauuguuuugccacuuggagcgagggagaucagugcucuuaauauggagcaacacgcuucauuuguaaacacuuccccucguugaauaaauggcgcauaacauaauuaaucacuuuauccauuaacuacauucacauuguuauaaccccacugcauguaucuucaggccuccuuguauguggccagacugaauuucugugcccucugaaaccauauuugcucuccuccuaucccuccaaucccuucuggguuucuauaaaucaccccucugcuuccuguuuuuauuaaguugacucuucuacaaagaguugaugagcagaaaaaagauauuaguugcuuucuaucuagccuguucuacucagcaaauuuaaguuuuuaauuauaauguuuuauguuuuagauuauaacauaaaaagaguauugcccuccuccuucccucuccccagccuucccauacacccaccucccuugcuuucaaauucauggccuccuuugcuuuaaguguuguugcauguaucuguauuugaacuccuaaauacauaaauacaaccugcucguccauauacuauuacuuguagagaugauuuccgggcugacuagucggucuuggauaguuagcugaugaacucucccuggugaagacuguuucuccuacuguuagcaggccuuaguuacuuccuauuccccccucccacauuagcgucucuauuggugccauccuuguuccaguguuuuuuaugaagccacguuggugauacgucauaggugcugcuucgcugacauuucucggagacauagucucauggggaauuuguaagguucuucccuaugguaagauguugguaguuugccaggcagugguggcgcacgccuuuaaucccaguacuugggaggcagaggcagguugauuucugaguucgaggccagccuggucuacagagugaguuccaggacagucagggcuacacagagaaacccugacucgaaaaagauguugguaguuugcuucuggcuagacuaacaacaucccacuguguuucuacaccacgcucgacuuuggaagaacauuugucauuguuuuugccuuugugcucucccuuuuauuuuuaucuugugcuaguuuccaugaagucaggccucagucgagugagagaucucuccuaguacaaacacugcuaagaaccacauguaccucuuaauuagcuucaaacagaacaucacucaaacacucuucaacuuaaucuucaucaauaauagcccuuccauuguauggugggcuuuuauguaggccucccuagauaauauuuaucauugcuccaagugccuuggcuggaagauagaugaaugccgagcuggagcagagagaggccugaguucuaacucaggacacgacuugucuuuuugcucuucugcuuugccugaaugcagugauucauuuaggcucuggggaaaggaggcggcgggggccuucugucaugcacagugaaagcagcuugcuuucuuuuugccuuuuuucuuccccucucuguauccuuuaggcccaaagggacaucauauuugaacuucgaagaauugcuuucgaugcagagucagaaccuaauaacagcaguggcagcauggagaaacgcaaguccauguacacucgggauuauaaaaaacuuggcuucauuguaaguacucugucuccaguacacucucuccucccacccuccccaucugaccucagucgcaucgaacgugugguccucuugugcuuugcagaaugguuuccacauuuccagauguuuagcugguuuaaauaggaucucauggaaaucuccucuggcugcggugaaauggaauaaguugcacaagugugacuaauacuucgcuuguuuauccaguucugauuaaguguaauguagaguaguuaggcuggaaugcaucgaaccguccugagccuccuucgaaagccacugugguucuccuggugggaugaauggugacaguuccaggaggcaucuuauuauuggcuggugauuggauuacucagaugcauugauuccaaucuaagggaagcuggaagucuccuggaguugaaucaugaugagauuuauauaguuuauggucuuaaaaaagucuuaccuugcuucaaauguuaauggauuguaucuuacacacacacacacacacacacacacacacacacacacacauacacacacacacacacacacacacacaaacuucauauaucagaacacaacgugucuugaaucuaaccugcuguugugguuguugcugcuuauggacaacaucaccaguucgagagugaacuuaaacucacuugaaauuuugcaguuguuauauuagguuuccauuuuagccuccauuguaaaugacccaauuaagauguuggcuugaguggugagaaaucacuaggaaauaauuuuuacuucagauacaucuuccuggaaaacaaagcaaaacgaaauaacccucaacuagguuuugaucgugccaaauugcuuucuuuaaguaucuaguaauuagcuuuuuauuuaaagcaugucaaagugaccauuuuuucaaccuuuuaauaaugucucuucaauuucaaaauguucaagcuagggauuuuauaguguuacuacugucuuuccgaguaagaguauuuauugauaacacauucaacguggcagcuacuuaacauuuccaggcaguguuugcuacaccaaacacugguuugguuuugacaguccaucugacacuauagaugaauugaguuggcgggugaggcuuucuugugucuuaguaucuuugaugccaccucuccaccuuugcgucauuccuuucugagacacgaggcccaguuaagguggacagcauccacuucccacuuccccgccuuugccuuccaauccugccccguggguaaagcauaacgacuucacauggaagcaaugcaggaucgucuucuggucugauccuuucuacccacaaaccaucaaaaucaccgaguagagcucagccuggcacuaccuggcaugggucucacuugaaucacauacaagcucucaaauaggcccucccuguguacuguucaucugcccaaggccucggugggccuacggugcagcccggaguucagaggaugcuggguuccucugaaggugaauggguggcaggcaugaaaaaucaacccugguguugcagccuguguaccuacaucacaagccagggaugaugcaccuuccucggugucucuguguucugucugagcaucauugguaaagccugacccaccuugguuuucaaguguaggccgcucuugaccaucucugucuuggaguguucuguuuccugaguaugggaugggcaaggguggaguguuuugucugaaagucaguucgaugugacucuaaagacucucaaauuuaugcagcacuuuccuugaggauucaaaacguuauuuuaaggaugggauuuaaaaaaaggcauucacuaaagaguagcccaaagggagcacugguuuccuggauuuuguucuacauuuuuuuuuuuuaauuuuaauuuuuaaaacuuccuuagaagccuaucccaggcuuaggccacggucuugcaucagaggguugagaaacuggaaagacuuuugaguaaugaucuaugcugagaaugagccaacagucuccacagcugauauuucacuggcgaauucguggccaaggcaaaaaaaaaaaaagccuaggcgcagacuccuucugccaccuagcggcugcucugcagaaaugcuacaggcuguccaccauggucucagcagauuuguguugaauucuuucugagccugcaaggcaaacaccauccugccugucuaaaucugaacuuggaagaacacugagaaguuuggauaaaauuugauuucuuugaauaaagguugaauuuauagaaagaauauaauuucuuauuucguuucucccaaguagacagagcccaggaagcaguaaguugauaguuucuuagaguccaugcaggccacauuucaccuucuauuucccugcuuccaagccaugggcuaagaaaccugucuuuuaauauaucugugauugguuuccuuggccgcaaacuggucacagcuuuuuguuucaaauuuaccaaagcagacagagaucuuagccacccuggagcccuccuucauuuuaggaaguacgugucuuggaaaccacaggcagaguuuugaguucagaguucuucagaggaacagaguaguccguggugugugugugugugugugugugugugugugcgcgugugugugaauuuauuaacugagguuaaaaaacagagcuaaaucacauccaagaagccgagagccuggcaguugacuuuguccuugaggcugaugccuuaacagcugcccgucauugucauucacuagagcggugauagacaguaguuguuccaucuacauggugaggugccgugauagucccaggcuagcaccagaagacuggcaugauccuggaaggcccacuggucccuuguccaugaaagcuaucggaaaugcugguucugcugucaaccaagacacuagcagagaaauacucaggaaaaucagcucagcugugagagggaggccaguccagcugaaggcuuacucguuuaaucuggaccacuaaagauggugcuauccacugugugugugugugugugugugugugugugugugugugugugugugugcgcgcgugcgcaagcgcgcguaugauuuggggcuugucuuccuacagcaaucaaggcaaccaggacaaguaugucagugagacuccuugaauggcugauucuaacuuugggcaauuugacauuaaaagcaucaaugacaccauuauagaaggggcugcugcuccaacaaggcagaagggacaauuuuuuuuauuagauauuuucuuuauuuacauuucaaaugcuauccugaaaguucccuguaccugccccccacccugcuuacccacucccacuucuuggcccuggcauuccccuguacuggggcauauaaaguuugcaagaccaaggggccucucuucccauugauggccgacuaggccaucuucugcuacauaugcagcuagagacacgagcucugaggguacugguuaguucauauuguuguuccucccauaggguugcagaccccuuuagcuccuuggguacuuucucuagcuccuccauugggggcccuguguuccauccaauagcucacugugagcauccauuucuguauuugccaggcacuggcauagccucacaagagacaacuauaucaggguccuuucagagaaaucuugcuggcauuugcaauagugucugcguuugguggcugauuaugggauggaucccugggugggauagucucuggaugguccauccuuucgucuuagcgccaaacuuugucucuguaacuccuuccauagguauuuuguucccuauuuuaaggaggaaugaaguauccacaguuggccuuccuucuucuugacuuucuuguguuuugcaaaugggacaauuauuuugaaggauggcuguuugauggaagaaguggauggacuucaugcuccuuagcucagcaucccaaaggaacgggcuuuccuaaugaaauaauuccagaacacacacacauuuuaauacagggucucauuacagaguucuaaacuucagaauugauguaaaguuacuacgugccuaugugcgguuguaacaauacggaaaagcacguucuuuaaaauaaagcugcaugguauuguaagaugauuaucacugucaguaucaaagugccaggccccuuugggguggcaggcaguggcguuggaugcugccacucuuacugaaauggaggagccacaaggccuucuguagaaugaccaggcaggcaagagcugcaccucucugacaguaaggacugugagaaacagagacagugacaugucuggccagggcuaugacagagucuaguuuugacuuugaauuuguggcuaugugaguugagaauuugcuguguucaguggcuggggcaaguccugguagcuuucauuagauuuucauucugcuuuucagucaggacauagaauaaaauugauuaaaacuuuuuuuucuagugccuccccauucuguuuaccuuuacuaagaaacuaaaaaaaauuuuuuuuaaauauaguuuucaucuauuguaaguugcauuaaugugagaaguuuuagacauugccuuuaacuuucucagagucaucuuauaagauaaaaagaauaaaauaagaaaguagcaaagauaauaugcagugggaaauguacuccuucaggaguaagcucuaugcgcagcuauucaggagaauuucugacuugagagauuggagguaaucacgcaguuacacacgugugauuauacauaacuccagcugcgggcuugcugucuuccaguccuccugagaggagauggcgggcagugaagugagcucucuuuucuuucuccuuccucccuucguugucccaguccccacacugcagaagcugugucgcugcuuuuccagugccuucagauguaaguguuaugagaaugccacgggagaggaaacccagugccugaguucugguagcucguacuguuucucucucucccacuuagagcacgugacuaaugcagaucaguucuucagauaaaguagagcccaacgguagaacauuuucagucagcauuucaaggcguuggguucaauuucccccacaaugcuaguuuguaaauacauaaauauaaaugagguagguauaauauccaacuagcaauaaguugugucuaccuaauuaucagacaauaaguugcucagugaugguuggugccuggaagcagugcaggaaucuagauguuuuuacugugaacuuacaaaagcuaccacugcucuuacugaaauggugcccggugacucaccccuguggcauaagguggaggaaaaguggaaaccaucggcuguccccggggcuagggagagacuguucugugcccucgguaaacugcggaucuuuggcacgcccaguguuugucacacaggaagaaaaaaguggaguuggcuuugagagcgagggaaagauuauaacaauuuuuuaauuaaaaaggggcgaggguugaaauacauagucaaaccucauuauuaauagauuccacgcuugaaaauucuccuauuuaucuaaauuucuuuguaacugcaacaugaauauuccaggcacuuuucaggguuacucuuggauguaaguaagugacacuaagccacuuaaucuguuuggacgcagcuccguugacagugagcggacuccugugucagcccucacauccaagccaacuuucugcagcugaccucagguugcauccucucuucucugucauuacuguugcugcuugaaauggcacaauguugacguuuuggugaaguuccuaaguagucgggggcuuuggugugccuuauggagaaacuucagaguauauguuuuaggugacuuuccuauaggaacgcauuauaaugccugguggcuacaugcuaaaugaaagaaaugaagcauaaacaucaaauaagaugccuuuuaaguagacgugcacuugaacuuggcuauguaggaguguauaguuaacaaaaauagcaaaacgaaucgaaugcugugcugcaccgaggcgccaugcaguugugaauuuagacucuuuaaucaugggugaagcauuaccaagacugcuuaguggguaggggugcuugcugccaagcuggcacaccugagcgggagucccuggacccacaaggaggggagcgacucaugaagguugucccuagaguuccucaaguauggugucucgcauaugugugcucauacacauucacacacaaauaacauuuaaugaauuguuuaaauggagaaaucauaugugcuccgaauaaggagagucuggugcguuuggucaugccugcggugccagagaacaguguccuguuuguggagaguggagaagacaugccccucucugcauuauaaaguuuuuguaugcacuucaugcucuuggaacagucaguggggugggaaggacaguacaccuuacaggggauuuucucuauuggaggucaagagcuagcagccugucuuguguuuucgcauggugcccaccaggguauugucagguaugcacccugccgaugugaccccaucuccaaugcuguacaaggacagcauuaguuagagcagauaacacauuucucgaagaaacuaagccauggcaguuacuuugaguugaggccucaccuuuguggugugugucuuucuuuuaugugaaggaguuuguggaaagcacaguacagaaugagcuuugcugagaauccagccacuuuccuaccaggauaacaugauaauuggguuguauuacuagcuaauuccuuggcuuguaucuuagcuacuaauauacccauaaccaauagaccagaaaagccaaaggacaguaaaauauauguauaguuucuaaacuucuguacauuuuagcucguuagaauucuggaugaaggaaaucugggcuaauauuagugaggauugaagguccaucuaguuccuccuauccugggaccgcacgggggaugcaggcaaagugauugcuagaaacuuaaagcaauguguguuuccuguggcucuuuuauuuccuuucauucuucuuucuuguuuuagacaucucagaauguagcccuggcugguuuggaacuuguuagguagaacaugguguagacugaucucauagagauugacuugugucugccuuuggaguacugggaccaaaagcaugcaguaguaccaugcccuguucuguguaugguuucaagcagguacuguguggccuugguccuuggggaacaguucucccucucucaaccuccuugaagcuucacgcacugucuuuucccaucugacaucugcacgcuccgguucuaauaauuucuagguacagucuuguuucaaauugagguaacauggacuuaaaccaagaacauaaauuuggguaguuagagaaggaaauucugggaggguuuaggagaugggaaaagcaugaucaaaaguauuauaucaaaacaaaacaaaccaacaacagcagcagcaacaaaccacucuagucacugauaaaaccagagcagaaauaaccaccagguggcgcaaaaccgcagccauuagcuuccagucacccugcuggcucuguugcacugguggugagcuuguggccuuggcagguauaggacuaagucaggacucucagggcucuuggagucaccaagcaugcacuggugccuuagaaaggacuagcagcuuucuaagaugucuaacugucguccuugugagauggaauuucccugcugcuccugggaggugaauuuaucagcacccccuccugccccgagacuuucuggagucucauuccaaguguuucucagucugcugcuaggaaagucuucuuaguggagcauagcacaucuaguuuuauguguuauccugccuuaucacggaagcacagggaaauguacuugaaaugcaaaaaucuaacaacaguaauaauauauuuuugagguucauuaaaccaugcggcagcaaugccuucgagagaucaggcgugguaaauggagucaaagugagaaagcaccagaagaugaacaguggucuggccagcuuggccauacucuaguggcauuucuugucuaaauugcaccucuugacaagcauauuucaacauuuucuguuaagcuguauaggcccagguucauucucuggucuuucaguggcuugaucaugugcagagaccacaguugucugaaagcugggguugacaaacgagcagaagaaagugagcgagcgcagaaagcucucauccagagaagaugguuggccucacugcccaccgcagaaccagaguggaacaguucaucauagcagggcucugcccagagcacugcacacugauucuugagggguuuagcaggguggucucagaccaccccaaagccacccacaucacuugcagaugugucucacugcuccgaaauagaauggaccagacugccacugucugggguggagagucagccccacaucuccuuuugugcagacuugugccgucauugccauuucuguccauuugaugauuuuauauaugugaucuguuacacccugcucucucucagcaagggagagaacaaagugguagagacaauguggaauaaucccauuuuagcacuuguaauggauacuguauggagagagaacauauggauaauugcauuauuaaaacuuuuuuuuuuuuuuaaagaaaguguuuuugaaagcaacuagugaaaacuacaaauguccgggcaugguggcacacgccuuuaaucccagcacuugggaggcagaggcaggcagauuucuaaguuuaaggccagccuggucuacagagugaguuccaggagagccaggacuacacagagaaacccugucucgaaaacaaaacaaaaaaacaaacaaaaaaaauuaaaaauuaaaaacuacaaaugaugauugauugccaugacaauaucugaguuuuauuuuucugguaguuuauuuuuuuuuuauuuuuuaucaauuuuagugggaaaaguuuuucaggggcauuauuggaagugggaaaaggaaacagguuuaucuuaucgcugguuucucagcuuccuucuguuuuggaugcugccacccuuggacaggauggguuuucuccuuguagaucugcuuucuguccacuggguggcacagcagaacaaagaugugaacagggaccuccaaggaugagaaggagcaacucuugguuagcaguguuuaacuugcaguauaugugguucuaagagguucgggaggauuccccaggucuuccuuucaguuuuaccuugaaauucauaagaaucucucucuccuaccucuacccugugcuuauaacagaucugcgacagaagggccaaugcauuaauaaggguuuauuacucaccucugugcuucacauaaacuuuccuggcacccaccuuccuuccuuccuuccuuccuuccuuccuuccuuccuuccuuccuuccuuccuucauuccuuccuuccuuccuuccuuccuucccuccuucccuccuucccuccuucccuccuucccucccucccucccucccucccuccuucccucccuucuucccucccucccucccucccucccucccucccucccucccucccuucuuuuauauaaauggauuucuggagcagaaaggcagcauccggcaagugaauggauggcaaaugaaagauggaagcaagcaaacaggagugguguucuugagagcaauccaguucuacugcagaccaguguuguguugugcaauuucucaugcacuucuaccccaaucucugcuaccaggcuucagauuucuguuccauugcuuguuaguaguugacuuugcucaguuuaucuuaucucuuuuaaugacucauuagcaaggaggguuugguagccaaucuacuuaggcuuguaguggagauuaaugaguuaauacauagcagaaaccugacucaccuuaagcagauuuucauacauuuuuuucuccaccuuguauauuggugcguguguacauacuuguaauaucggugugugcauauacauguaaaaggacaucugguuagucucucagggucauggccaggagccuucugucuuauuuuuugacuugggguaucuuucuaguaucuggggcucauuaauuaggggaggcugucuggccaaaaagcuccaaggaucuuccugucuccaccccuucagcacagagcauaaguugacuuggcuacaaccacacauaggccaccacagccaacuuuuauaugggaaccgguccucuugugagacccuuaucugaacucagguccuuaugcuugcucagcacuuugcugauggagguagccccgccccuccaccugaccauaacguagucucacuauugauauaaguagcugguggcugaaaugagcugggguguguccuaucccugcugaaugacuggaacaguucuuuaucugacagaagccaagugagauaaggagucacagcaucaagcuucaauaccagccucaguccugggaaaaacacaucccagauccaugaauuuuagggaguuuuccuacaaaugacuauaggguagggacccacccccuaacaaauaccuuuugugaugaaagaguugguuaugaugaucauuaugaucaucauguagaugcauuuuuacuaguaagcaugucuauuuagaucuauucuuccauucuaacagcgucucucuagacacucuaccaugagugugugcucucaugaaggaggaacuuauaauaaaauuaugaaaggcucaaaaccauggcaugcauuaaguuaauuucgcugcauaaaauaugaagccuuggacggaaggacaucauggaguuuucgucuuggagaagagcucuuaccgugugguccaguuaaccuaaauuucacagucauacuucaucuaccgagugcugugauuacaggggcaaggcuuacaccagcagacccagcuuacaugguacccuuuuggggacacccaggaccuaggaaggacagcacuaggaccagugugugauuagagucuaacuuaggaugagcagcuaugaauucugggucacaagcucagguuccuccuuuucuaacccuuagcucuaggcaccugggugguguauggacucuggaaaaccuuaacaaaguggccuagagaacaaagcuggccauccucggggucauugaagagcugaugaaauggccagauuagagacucauaauugagucaucagcuuucuuuccauugacuuugaguuugaccaucuugaggaaugccacaugagaugaacaugccucuugauguugccccugucuagacacuacacaguugcaauagguuuuauuuuuuuuuccuguuugccaaaugcucaucauaugauagugucauucauaacuuugaauuccaugugcugugaacucacuggccauauucacuugaacaaguccguggcgaagcuggagcugggagcagcuccauggcgugggauucuaauucuggagauggcauucuagauguguaggaagacugucaaagccuuuccaaugggaagggacugaaccaguuugagaaucacaugguuauauaagaccaguccccuugcagguaucucagcucacucuuuguuuuguucuuauucauucugaagaacgggacaaagggauugcccaacgcauuccuguaaacacgcgaacauuugaauggucacucuggcauggugcuugggacaacacacugacaaagacgagggugaauauuacuacacuugcucuuacucuuuaaaugauuacauuccacagguaguuaacauccuugauguggagcuuuaggugguccauggggaguggcugguuuuauauaacugaagaguugcagcugcuuccccgagagugggagccuuuuggauguuuuaaaaaaaccucagcccuuauaggucuucuguaguaauaucucauuucaucucagagaugcauagguaucugguauugauaggaacaaaacauuauuuuccucguucauaagauugcagucccccuuaaggaucuucuuuguucugcuggacaagagcacauaauacuugcauucucccucuguauagccaaaggugcacacuacaauguaggcaagacauuacaagaauagguaaaaauggcauaucucuauguaucuuuuuuguggcauccagggacuguaagggugguucgcaggacacucuccaugcucuuagagcucuuggaaaagcacuaaaacccagugggcuuauacuguugcacauaauauuacuaucagugaggaaccacacugauccucuugccuuucugggaaggaauuauauacuacgcgucucaaauggaacccacaguagcacagccauagaucuguuggguccaaagcugcggaguaccucacugaaucagccuugcauccugcuuuccaggguguuaggugaccuucauaaaugccauaaugaaaguggugacacuucugucugcccccagcuuuccugccacucagccucagggcuaugcugugccacccgaggaggagacacucuggaugaaaggccucggucugcagaagcugugcauguccgccaggcugcaucuuuccucugccgcugcuguucucagugcugcagucacugguucucuuucuggguuuucuuugccuucccccugguuccuggucuggagacccuucuccaccccuucuuccccuuccuacauagcuaaacaaaguagugaagacagauauuuugaagauccaguuugugaacgcccaucauccuuuauucaacagcgacauccuuuauucaauaacuggucuugucgucuccuccacccccaucucccguuguuuaggguccuaaaguuacuaauuuugguccuuggugcucuugaucagucugcagggcuaucugugcuugucugagaggugauacacuaagguccuuuucuucuaguuccauagaaaggcuuuccuauaucuguugggcagcuggcuuuuuuuuauuccugagcuggggaaaggaggagggcugcugugugggaaucaguguggcuguccagccagagguucagcagugagaguccguaugggagcaggucuguuaggagaacagccaggugagggcccagagaggaaagcucaggggucaccccucuuucucguccgaggaaacauuguauguccugaagcuccuuggagaaaagcaacuucuaccugguuggguguggauaagaaucuguaccagguaccgaaggcugaagaagugccuauggguuccagcuguauugaacaacccacuuccugggccaaagcuauagcuuaaggaaucccuuaaggauuccaacugagaaauugcaucucccuugcauaccuguaaggugccuuggaugauggaguagaguguggcuauguuaacuuucucuacagauaagaaccaaauuguuugguuaagucuaaccaguuauuagcaauuuugauaucuaagacugaaugagugagcgucaagucacaaugcugaguuaaggaaagacuaggccucccuggaccucagguaaugaacaugcugccacucugggccuccacacaugcuguuuccucugcuugaaguugcuuucuccucugcaguucuuaacccugcugcugugcuucagaguugaguagcaagggcugcccacacuuuggucccuucccauuuccggggcacauccccuuguauuguuccugcucuuucccccccacacccaauaccuuuccgcugauguaggaccuuguuuaccuggcacacccagacacagugaaguucauugaauagacguggugaguguaaaucuuuauauaaagacuuuauagacuauauauauauauauauauauauauauauauauauauauauauauacacacacacacauauauauauauauguauauauauauagacuauauauauauauauauaaagucuacaaaugcccuuggcaagacuauaaagugcccuugacguucaccaaaggaauaaaaauaucacauuagugguggaauuuucuaguaaaggggaugauggaugugaguaggcuguggugaggugggugagcagcggugaugagcuaggggaaaaauggaaaaauagaaaguuuccuucuguuucugcuccuuugaauccaggucauggaagaaugcuugcuggagcauuugacguuagguaauuuuuaaaguaggaaguaauuuuaaauuauuaugccuggaauugaggauuucacaguggugugaguauaauaggaacuuaggacagcuuggggagaauguuggugaacacugggaacagggacugugggaaugcagagggaaugaucaaugugcaagcaaagguaaaauauguugggguuggugacucgcugggugauauagaagagccuguauagauggagacugguguugcuuuucccauaugcaggacauauagcuuugguccaggagguggguuauucauuuauggaauaggcaucucuggucugaaugugugccuuccucccccacacacauucugcauggugauacagaggccuuaguguaggcaguagugcucccaugagagaaguucagugagaagccauuugccuuccuugcuaugaggacaguguucauagcgccauauuugagcccucuccaagaugaggaaccuccugucugugugagguuggacucuucaauggcuucacagguuugagagaaauuuucugucccuuggguuaccggguuugaagugguuuauaacagcaggccaaacacuguguuuggaggacauugaaauuauugaugggccuucccauuggcaguacccagaggaccauucaaaaggaaaguaaugcuugguucuucacauuuacuccagagacacuaaucugaccaguguuuuuguuuuuguuuuuuguuuuuuguuuuuuguuuuuuguuuuuuguuuuuguuuuuguuuuuuguuuuuuguuuuuauccaaacaagaaagcugaaguggaaagagaaaagagaauugcuugcauccauuuuuauaaaccccacacacuggguuugggguuccuuucuucacucauugauauacuugcuucugagaacuucccaggcugggcugagccucaaagcauacugggucaccagagaaugagcugaugagggaaccugagaaagacuugucauagccaagaguucagccaggaagggaggccagcaccaccugcacggggguggggaguugugcaugugugugggggggggaugugugugaaggaucugccuuuagcagaggagacuucugcccugggaacuggccuggauccugagcugugacuacaguagagaaaagggaguagagaggaacugagaagggccgugccauucggaguagagccagcaagaggagaaugcccuggugaccuuauagaaaguaguuucaugaguucauagcgcugagaucaugccccacugguccaucugguaugaaucaguuagaaauaugaagacuuucuggauggcucaacaacuuucucaggaaaagaaugguuuuugucuguaguuauguuaugaaaaauguagaaaauauuagaaaaaagaaaaucacgacaauuuuaucaacaaaagaaaaaugguaagcuguugucaggauuuuguccaacuuucuccugugcauauauuuguccuuucuaccuuucuccugugcacacauguguccuuuccaucuuucuccugugcacacauguguccuuuccaccucccucauguguauacauguaagacaauuagcuucaauacucaggauaaggucugagucagugaguacuagauucauguuuacuugugguuaugugucugugugugccugcauaaggaugugugcuugugguuaugugucugugugugccugcauuacgaugugugcuugugguuaugugucugugugugccugcauaaggaugugugcucauuuguuugucucuguaccagggagagggaaaguuauaagagagacuggaaaugggauggccugaaacuaauuuguuguugagaguuagaggacagaauugacagucccuauaaaaagccguuggugcugugcuauuuuuagguuuccuagugacucaacacuguguguggugcugccuuauuuucugcacugaggaugaguaaguuugcuuuccaaagcuucugguuacuaaggagucacacuggggcuccugggccugcagggagcuacccugccugggcggggacuccuggcacugcacuucugaugcuccuuuuaucccuucugguccauuccuccaucucuccucccugcauuucagauuacauaauagucaccaacccccccccaccccccccacccccccgaggcuugcauguaagaaggaagcucuagccuagccagaagcauacagccauacagcgaggacuggguggguaagcaucuuuguguggguuuggcauuguaggcucuacccaguacagaggcuuacccucugugagucucucuucucauacccuuuccugccaucucagagagaccaaggcagaggcagacagagcucuggggaaucccaugugguucccagugaacacugucaggcuuugaaguuugcaaaucccucacaacagcaugucugaaggcacaugugcaauuuccuuuuguuguguguuuagccaugcauguuuucuuuacgcuuugucacaacauuuauuuugggaaucaauaugaugaugucccuacagggaaggcuuugcagaggagacugugacaaagcaaaacaagcacucaggaaagcacugcccccuuguagcaggcacacugggcaacaggccugccucuucccuucacuguauuuuuuuuuuuaaauaacuuguaggguuugauguuaucguuguuuuuuuguuguuugcuuguuuauuucagacagggccucauuauguauuccuagcuggccugaaacuaagaguggucuguuugccucacacuuccugaguucugggaauaaagacaggugccaccaugccuggcacaugaacuauguguuugguugguugauuuucuagggcuuaauauggagcccagacuggcuuugugccucagcccaccgggugccaacucuguagucuuguccuaccacacacaccuagcuuccuuaacugugugacccaaauguccacguauuaucaauaaacuuugauagcauuucaugacaaggcuggcccaugauuuuaggaaggauucuccugugcauauuggggaauuuuuauauuuuacaaaauuuuguaagcauaucugggccaauuuuguguacaauuaguauucuauucuuuuuggcaagauuaaucauagacuuggaucaaaaaugugagaauguuggugacauucuuauuuuaaauuaaauuuaaaugauuucuacucuuuaauuuaaaaauuauuuuucaacuuugccagauaaaaaccaacaagaaauauuuuuaguuauaguuuuauguacuuugaauauguguuuuuaauuaacuauuuaaaauugugugugugugcacaugugcguguguguaugcacaaacaugugcaugugguuauaaguacauggguggugguugugguagaggccagaauagggcauuggauuuccggaagcugaaguuacaugcugggagcugccccaugugggugcugggaacucugcuccucugcaagagccacaagcacuuuuaacgacugagugaccucuccagucccuaauaauuguccuuuguauuugcuuuuaaaauuguucuaauucuauaaaaaaaaaagcucauuguaaaguacucuaaacucuagauaccaaaugacuuagagaaaagccagguguauuccucuacaccuuaaacacacacacacacacacacacacacacacacacacacacacacacacacacacgcacacacacgcacacacacacacacacacacgcgcgcacacacacgcacacacacacacacacacgcgcgcgcacacacacacacacacacacacacacacgcaugcacaccaaaauguguuuacaaauuugauauauaucuuucagauauuuuucaugauuauagaaauaaauauaguuccacuaaaaugugacuauauuagauauuuuagaccaaauggaaauaaaccauaaauuuuucaagagaagagcuaggauaggugacugccguugggcguggguuucucagauaggacaugucagaagccugcaguguuuaugccuucguuugaccgccugcagaaagcauauucaggcuuugcucucaugcugcucucggagucagugauggauaaucauugagaccaacguccaugcaaccgagcaagcaagugcaaguugucccucagcccaguucuccuuuauggacagcagccugucauuagcauaauguuuguuuugugcuccugcagacauuuuaucacaugaauugcagguuauaaauauuaaccuauugaucuuucccgcuucuuugucuccugugagaaugucugauaaaugccaucauuucuucguuauauagguaaaggaaaaaacaaaaccaagaagguaaguccccaggcaggugacacuccguauguuugugaaaugaucuacagcgugagaugcucugaccacauaaaaauccccaugcuuuucucgaggguuaaaguugacuugauucuuaaauccaagcugcuaugccccucugcucagcuuccuucucagcgcugugauuucugacauacaucacaaugaacacauuauaaauggucaaauaucaagcugaaacauacuugauuuauuccaccaaauccucuaccauucauuuuuacaucuuagcagcaauuuauugaagaagauucuagaauccuuugauggaaaucaggcuuuuccuucauuuagcagauuaucacuuaacuaagagacaaucuuauuccagguugucacugaagaccagcuuucugagugaucacaacuuguagcaaccccaagaacaacugucugcccuaucccugcugagcugcaguuccuauagauguguguucaucuguccuuauguuccuuugaacugcccauuuuguuucuugaaugauuacacaugcuauggggaccauuuaucuuucaauuuaggaugcagguagaugucugcuuugcaugugucccguggacccauucagggaugcugaagcaucucuuaguauugaugaaaauguauucauguuagaauuuccauccucucaagaagggaagucuggaguuuggggauuuaguuuuguggcacagugccugcuuagcaggagccuggcccuggguguagucccagcauggagaggugaugauguagaaaacagggaggaagggaaugagugucauuccuucuaaggcacagcuguguugcccacucauuguguaccuugacuuaggaauuacuuuccuauugccauuuguuuugaaucugcuucgaguaaugaguaguccaauaucauuaacucaagcagcuuggcuccauacaucauaugcauguucuuucaaacagcuccuuauguguaugugccaguuuuaaaacuauuaugugcagugccacagugcacaugcguauauuuuaucacugccuuucgaggguauauuuaaaucuuacccguaccccaucuguccauaucauugaugugggcagacucggagcaucuagcuguagauaaaagaucucagaugagacaaggcagcagccccagaaacagucuucacuuugagcuguagaccagaagucaucuaccaaaccgaagagagcaucucucaacagagagaacaaacaaaaucagggucgccacaacuggacauucacaacucuauaguguguuccaaaacucuguggcacaugaagagcaaauaucaaagaaaaccagagacaucccacuccaugaugagccagguguugaaauggacaaagaauguaaaucugccugcaaaguguccccagugggaaaacaaauuuguucucauaagugaagaucauagcagagaaagagagacagugggaagcagccaaguggaaaguccagaaaugagaaguauaguuucuaaaacucccccguaugugauaaaucuguaaauguaaacucuuauaccgcauaaguacuaaugagauagaaaggggcaggaccguuccauccauccgauagaccucacucucugcagccucgaggaacauaguugagaaauauaaguagauuuacaagaaaguguauuaaauugugccaccuuauuuacugacuaugacagaaaauauuuacuaguuucagcaaucaaguuauauuuguaucuauguacuuaaaaaaagaacacauuggccauuauaaauagaccugccuuuucuuaccugaucccuacuuuuguguuaacauuuuccucaacaaaaucaauuauuuaguucauucuucggaaagauuuuucuaugauacacaccccuaagcauucuuccuauaagauguauaauacauuaguguaucggucaacguuugauugaugugucagccuccauccacuguaccauaagcaccugagguuccgcauguuaaauggcucuuuuauauguucacccuucuugacauuuucgauggcuuaugugacaaaaggaagaacagcagagggaugguuccucugugaaccaccagggagaaagagggacuaacuucuuuguguguguuuaugauaaaauggcaggguugucuuggguauuuggcacacuucuuuuaugcguucuggcaaaggagguauuugguccuuugucuuaaguuugcaagugugagcagaaugaacaucaaaaaagggcuccgggauucacugccagcggcggcuuccucuuccucccccucuuccuccucuuccuccuccucuuccucuucuuccuccucuuccucuuccucuucuuccucuuccuuauuaaggauauuaaaucucuucaaaauagaaagcugagcgaauucagaggugcauaugaaaagcgcuucuagcaugagagcagccucuguaccuuccgauguugucacugcaaacuuuauucuuacuggaauggccaaggacgacauuucagugugcacucuauuucccaccagaggccuguuccauugcaaguuuuccuccagaucuccauaguacagucaggagagacugcaguagugguucgucugaaccuacuuuacuguguuuguaguacacauccauaacccaccaaccuuaguacccacacugcuugcuuagagaagccugugaaugggccuucuacuuggaacuuacugcuuucuguugccgccagagggcagcaucuucacauaguuuuugugcacacuccugagagcagacaggaagcuauuucacucauccucugagccugauccaguuuagguaaaccgaaugcaugccaacugaguugcauucucuuugcuuuuguuuauaaggaauggguuggauaagagggagaagauguauauuacauguuaacauacauauuuaaaacauuuaauacuuuaugaaaaugguuacauuacuuguauuuaguauucuuuugucugagaaaguaacacacucuucucucuauccuggcugcuguauucaauacccuucuaacucauaaaccuuucucauauauauggaaugcagagcugugccucucagcuuacuuucaaguaaguuggcaucuuguuuguuaucuagguuuguguuccugucagaguccuggguugauagaaucagauccaaucuguguguagggcaaagaugcuuccccaaauggcagauuacuuaaaugcugcaggguggguuggaauagcacaaagagggcagcuugguaaacugugcugauuugaggcaugaggcagaaccgcuccucacucccaucuuuccagcuuauccccucugcacagagguggggaacaaaagaccugagcugugucuguuucccggcaugcaguggccgcugggcaggcugaugucuguccgugggcuuuauuggugcuacuugugcccauuugggguuuggcagcugugcucuccuaacucuccuaaauuagggacuuugggucucuugucgcuuuuauucuuuuaagaacugauuguacuauuuuuuuauuauguguaccugugugcaucuguauguaugugcacacacgagugcugguggcugcggaggccagaggagucugaucggcaggagauggaguuauaggcagaugugagcuaugugacauggugcuugcgaucauuguuuuuauugagauaacuucacacaaugcagccauuuuaaaguaaauucauugugcucacaguauaguauacuaacacccugaugccaaauaauuuuagauuuuuaacuuuucauuuugauauaauuuuuuaacuggggaaaacgauaauagaaggggaaaucuuuccuagcugucaaccagauggacccuuguuguuccuguugguauuccauucacucauugguugguacugucuuugugugucucuauguagacacaugccguucaccucuaccuuggaacuuuugcagacauagugaggccccaggccaucugucacugaagacuguggcuuacacaguccccuacaagggcccauagcaugguacuaaaaccccgaaaaucugucaauacaguguuccuguccuauccagccacagccuuuauaggcugugcucucaggacccuccuaacccugagggcugcuuuccuuuaaguagguugaucuugcugcauccugaugagugcagcccucucaaguuugcccacugccugccuugcugauguuucggcuccuacugugucuuaggcuauccucuguugguggaaaugaguccugauuuucagcauuaccuuagaaacuuuuacacuauuuaccuuagaaguacuuacacuauuccuuuaagaacccauuggauggcauuucuaguuuuagaaacucuguagacuaauuuagaaacuguguaaagcugcuccgaucccaggggcuguagcgauggcagcuuucauuuccccaagagcacauagaggauaugaugcuuaacuuuguauucaagagucuguaaccagaguauuacggcacuucccuaagcagaagggaaaggcccgccaggccgugcccuggguaaagccacugugcuugauguguugccaagggguuugcuguguucacgucuuggaugcugaaugggauuuuguagugugaauuguugugauaacuaggucuguauucagugguacacgaauuccugaggccacugacugggcucucauuuuuccaaggcaggauggaucacuguguuccccacagucugacuuccuccuuuggggaagaacacugcuacucccugagaagaaguucauuauuucaguuuugauauaugguuaacgucucaugacugcucacuguguuccagguaacagcaggaacagguccuugaagaaguagcguggcccuuccacuccucucucagaccccucacuuggugucucuuaaacauuuacuucguuugaucuggccuguuuagucugauaacaaguuuucaugaaaauguuucaacauuuauuauaaagcugaaaugcaaaagcaaaaugcaccauaggcaaauuaaaccacauggacaaaauacaguuccauuuuuuccuaccaaggaaauucucucuggcuuugacuuuauaagguaaggauugaugugaaccuucaacuaaagguuuaagcucugugguguagcaaaccacagugagguagucagcugcccagggcuuuguacuaaugccgccuucccaucacuguguuagcugccaugucuuagucuccguucgccuaggaaaacaccuccuauuucuuuguuugugcugcuuuuuaaugaauucuggucagguaucauagaaacuguucuucuguugaguuugcuugauauuuucucaugauuagacucgaguuagguuuuuaaagagcaucgcagagguaaagugcccuucucaucacagcauggaaggaugcaagcuaucucuugacuuuuaaugcagaucuuauguucuuccccugcuccauacauaguuugugguuugacugauuuuauuuuuaaagugaaauacuguggacagguuacuuggucaucuaugcuuuuaauuaucuauauaaaaugggaaaauucugugucagaauaugaaaucagagcauucuucaucugcucugcguccuuuugcaaaguuuaaccucuacuugaaaagcauggauguauuacuuugagaaauauugaaaaacucuuggacaggauuuaccaagucucaagugcucaucuagaaucuagugugguggcucuuagugaauucugaacagaacuccugcaguuagcacgggggaaaggacaugauuuuucagaguuagucaagguucugugggaaguagggaugggugagagaggcugucugaugauaaggaguugccucacaaggguuauggggcuuaagaaacuccucauguggcuccuaccagauggagaccuggggcaaucaguuguguagcucgaaggccuaggcacugagagcugagagucugaaaccgaggaaacaggagccugaagacagaaggcccacauuggcagauguagauuuugauucccaccauguuuauuguucucuuugagucuuugcugcacuagauggugcccacccauguuggggagggucaucuacuucacagacccaccaaggaauuauacuuagccagaugugggaaaucauuuggucuauucaagcuuacaacugaaauuaacugcugcauuuugaaugugcgcccccccccccauuguaaugguauuaagaaguguguccuugacaaaagcuauucagccacacaggccccacugucgugaaugaauugagugugaucauuagaugaagagguuaguuuuucacuggagugggcuacugaugcaaagguuccaguagggucuuucucugaugguucccacaugcucuguugcccuccccccacaccacccuaugaggcaguccucacuagaugugaacccugucaguugugaacuuccaagucuauggaauagugggccaaauuagcuuuuaucauuuauaauuuauuuagucagugguauucuauuacaagagcagaaaaaaaaaagaugaagacauuagccgucccauuaaccauccuacuggggugagcccuccaguuucugacuucacacccaaauggcacucccugcauugauuuugagaggaggaaauuuauuuuuguccauggauuguucuggaaauugauuuuaacccaauauauaugcaccugaaauagauguaaacuagauauggauugauaucuuuucauucucuuaugaacacucagccucaauauauacauugaauauuacacagaaaugaaauuaaaagacuggagcaaccuacaaacucuguucagugcauauccacccagcagcugagacaauuacucauuagcaaugcaccuuggaaaacugucaucacagugauguucucagcacagugacuagaacgaaauaaaacacccagcaggggaaaacaaauauggguaggcucuuaaaaaugaaguuaauauuuagaaggucaccuuuguuuauuuccuaggauuuaauucugcuuaugauuccuggcacacucucaaaauuagugugccguagcuugaauaucacuaaucauguaugcuucaaauuggaaagaaaaauuaauuugcaccgaagcuggggaacuaugggaacaagcucugcuccgugccacuuccugcgcucucugugcuucugcuguuuuucguugcuggugugucgugcuccgugagggguuggcagccaaugccagggagucaggagcuuuggcaagcuacauaugugcugaagacuucgagagaaagcagaaauaaauaaaguacguuuguuugcuuuaguccacaaucuuccuuuguuuagagauggacuaucaacgcucacaguugggcaggcgaccugugauucauuaagacuugcacuucaauuccauugagaacacuuuuucucauuuucuaucugguuugaaacaugcuaagugugucuguugcuguguuggggucgcaucuccuuacauucucccuaagcugcgauggaagcucugugccuucucauggggcgugucucccuauugacuuaucacagucauuugaaguauacuauagauauuuuuugaaaagccaugaaauauguuuucuuucuuuagucuuccggcuauguuuuauauuuuguaccaaguucagugacaagauaauaaucaauucuggguuccaacuacuauuuuuauuaucugcuucuuucuagguuuuaugaucccuggggaagauuguucuguguuauuugacauauaccaccgugcucucugguuuuguaguaucauuguccuuuuagugauugcucccuucacuguguugauauguugcuuuaaacuuugacauuuaaaacauauuaaucuauugcuagucaugugccugguuguggaaacauacaccuagguacaggugucugccucauuuaggagaaggagucaaucccuggaaacuggaauuauaggcaggugagagcuguccauggugggaagugggaucugaccuugaguccugugcaagagcagcaaguacucuuagccacccggcaucucgucucaucucuccagcccaacguagauaguuuuacuuauucaauccauugcauguuuuuuuuucuauuuauaaaccuuacucaacccuuuuccauuugcauugccugaguguuucaagaugucugugcuucuaagucuggacguugacuucuuuuuuggguuaguuuuuuggcagugucauuucuaugaaaguccuuugucauugaccagauggucauuaaguagucucuucagaaguggcccucuuuugugauguuaucuuggcagucuuaagaaguuuuuaauaggaagccgaagugaagggauagugucugagagacucaggggaacuuguccaagagaagaguuguaaaacggccauuuugaaauuaauuuaugcagccuguuggacuuucccuggaaguuauugcugauacacacccacacacccacacauggacguccccauacacacauacacccccccacacauacacccacacaugaacacacacacacauacccagccaugaacacacacacauacacacacacacacacacacacacacacacacacacacauauacccagccaugagaacacacacacacacaaacacacacacacacacacacagccaugaacacacacacacauacacccacccccacccccacacacacauacacccacacaugaacacacacauacacacacauaaacauacccagccaugaacacauacacacacacacacacacacacacacacacacacacagccaucucuccuguacacggucccuagaagcuaccuuuccucucugcuucgccguuccaaguauuacucagauuguaugucuaaucugucaccuguugucaucaacagucauuuucaaauaucacagucuagcuuucagugaaaagugggcacaguucucccuugagaggagagaugcugucuauucgagugugaucaugggccauuuauuggguuuugaguuggucaacaggaaagaguaaaagcaaaguguugagaaauguuugaaggugacucuguuugggucuguggcaggcaagugggacaaagaggaggcaggacucacuccaaggcugacaacaccuucugugaucucucaccguccucaacccuggugaucuuuccugaaccaccuuaaagcagugugagcaggggccagucuguauugugaggaggugacuccaggugacaccuugcugugaagcccacauucacacuucaggaggaacacuugcugacucuguucucuaacucugcugguccacacucugcacagccccuuucucuuucauccuuguuuuuccugucccugaaauugaaugugcugauuuucuuuccccuuuuuuccuccccccaccuccuguucccuuuguaguauugccuuucuguaugcuccuccuacucugacuuuaggucucacugucccuugugguggcauucugaacccauggaaaaacauguuuaaacuuggacuguaccaagaaaugugauuuuuauaaugaaaaacuccaggauucagggaugguaaugggaggcuauugguagaggcaaggcugcuuguguguacugugugagugauuuagggugauaauccagugucucagguggauuugacuauauagugggacagcuggugccauuuuagccagaugcugaccucucccugccuguaauuaacaauuuuccagccauagaucauaaagugacugcuguucaaugacuacuaucaggugcuggugucuggaauuucuuacccuagggauccagugggcacagcaaccuugacucucuaggcaggagugacauuuaacacagucgcuugaugcuggauuaugagagcgcugacauugguccccagacaguugcucaauacagauggccgaugagcucugaagcuucaggcugacauguccagaugcccaggggugaaccuauccuuuucuuuuuagacacagugucuuuccccaguauuuagaaaauaaucagaaaccauuucaauuuguuuuucagcugcagcuuaggggcucgaguuuugaugauuaaacuggauggcuaaauauauuuccccagguuccaggcaucacacacagagaucuaugcauugaaguaagcuugccuccugucaugaguaucucagugaagucagaucuuuucaugacuucugucuauagcagucuuuuuuguauuuugagacaggguuucucuguguagccccgguuguccuggaacucacucuguagaccacgcuggccuugaacucagaaaucugccugccucugucucccaagugcuaggauuauaaauaggagugugccaccacugccuggcuaucuuugcuccuuuuaaauaacagaaaaaaaaauguauuggcugaaagcacaucuaguaggggaauggauuggagccugggauggauaacucauuugccugagaaguaucuaugaguugggggaagguggcaagauacaagacaacagagcugugagcccuuugcugggaucucaugcucuaaguuaaggaauuggcucaguccuuccaacaaauccaggacgagaaguggagcucuguguauaucaucuuccugcagcuauaaggguuuauguaugauacaaaccagcuaaccuauguuucacgaaaagauaugcaggugagacuauauaggcuuggaaugguugccacuacagcagccucucuuugcccuguuaaaagccacugacacaggccauuuuaaaugaucuuucaggcauaggguuguggggguuccaugugcagcuaauggaagguaggggcauuuuaggagaaauauguguuuucucaaaguuuuaaauguaacaagcugauaucagaggaagaccccccuccccccacacaccgucuuuaucguuccaagguagccgaggugagaugcugccaaaagccuugaagaggucagagaauaugggacaauggggcagucacaacuccuuacagaugcauggcuuuagagauauuaauucagaaauaccaucaugacucguugagauuuugaaauauugcuucucuauuccacuugaaauaaauuccacaauugucgcuauuuauaaccacaggcggauuucaaauaacacacuccaauggaaauaaaaggaguuuuagacagugagucuaaaacuugcuuccuuccaucaguagucacugugauguggccugugagguggucacucaguccagcaggugguguaacacucacaagaagagcuacaguccucauaugccuaccgaagaggucggggagcagggcaggacaccccugucccccaguccaacgucagagugugucucuagaauuaaaagaauauguuuuaaauucugagcuacugaagaugugauucuuggagacauuuuauuaggcagauuaaguuauaauacagaaauagcauuuuucauuucaucgaggaggaaaggcuggugagauuugauuacugcagcggaagcgucugcuuguccuuuucuugcuugcuuuucuccuccucuucugguccuggagucccugcugcucucuacccauccccuccccucuagcagaaagucagugugcucagagcuugcugagauggggagcaggguggguucuguggaaucccccuggaacuucaguuugcuggauugagcgugaggcuuuuguagacguaccgagagccucaaguaucccggugggcuugcugcuuuucuuccucagcauguaggcgcuugcaguccacugacugcuuggugacuggacaucugauugaguuccaguucuggucauauugaugaugcuucaacuaagggaagccccugggccaccagcacagagacugaugcaggguggcuugguuuacuuuguauucauuuagcagaugaaggcucugauagagggaaagaagcauaagggagagucuugauguuacggugccuggacggagcugcaggagacagaggaacgaggaccugcugaaaggccuuuuuauccuucuuauguuaagcaccaagggaguauuuuuuggacauuacaaguugguuuuguuucugaaauaucuuaaguggcucagaagagcacuucaguuugaaaugaccuuuuguggguaguuuuaaaaugaaaccacagacgaucucucuccaaccucagccuuuacaaaauucuaaagaucaagguuuuucaaaggagaagagacccagagaugaagguggcaagagaaaccaucuagaaucuacacugcaccaagagaaugcuguuuucuccugacauugcccucccuguggcccuagaaacucccugugugagaauuaucuacagaacgguuccuggaggcuccugucacuccgacuccaauuacuggcugaucauuuguguccucuauggguucuauguggucgcuauguucuugagauggcaagugauuacucuugaauguguggucacuagcuguacuuuuacugaauggagcauaguccacagcucuaaagguacagcucggucagcauccccuaccacuuuccuucuagaucugcuuuuucucugcuauagaggccaggaucauucccagcuuuguugcugaauuuuaguuuuuuauuuagaucugaucuuacucaggggaaggugagguauacauacacucguuaagcuacagacacucacuuugcaaguucucauaaauugaagagguaguagaagaaaagcaagaccugguuuuaggaauaaacaaauggauuauuuguaguuagugaauugaaucaucuuucggcaucuacaugcauauggaaauggguuccuuaugccauugaaggaaggguacauuuuguucaacccuaaucuuuugaacuauuauccacugccucucaucacuuagaucucucaaaucuuuuuaugcacucgaauaagcucuaauggacuccgugauacacagacaucuacaguaaacacacagaaagcacccgggaaauaacucagcugccauuuguuugugaaacuucuuuuuuuuuugcgcuuuaauuuuaucuauaauuuuuaugucccuguguguguguguguguguguguguguguguguguguauacaugaguucauaugcacuacacuccugcaggcgaucucaggagccaggggagagugucccauccucuggaacaugaagcugccaugugggugcugggaacuggacccugguccuguauaagagcaguaagugcucuuagccauugagccaucucuccagcucuguuccugauauuauuaccuuuggaguccaacguuuuugaagaauucagucuagcgacauugcuugucccuggugcugcugauuuguuguuguuguuuuuuguuuguuuguuuguuuguuuuucaugguauagcauuagaagaaucugaagcagagaagaaacugacuagugcuuaagcugcauccuagagugacucuuuggagcagcauacuucugacaacuucugggcuaggaauggagagaaacaggcuugcaaucauuuggaucuugucauuagaaacuauccugcaugcucuuguguuaucgucgagagcuugaucccaauuguguuaauuuuaugcuggcauuuuuaauauucacacauggucgcuagagaauaugaugguggaugucucucugaugacgaguaauuugggaaauucucuguuccccaaguuuagaaccaucaaaauucagagaccugagauaaggcuucuuaggaucaaugaaagaugaaaucugagucccacuauguaaaaccagaacuuagagaauuuuccccgugagcugugcaucaucucuaaguuguagaguuuuguaacuuucaucaaucaaaacuguaacucauagacuuuacgacuugaacugucuuuguuuccuaaagcaccuuucucuugggaugccucacaaauauuaacaauguauccaaaacaucuggauuaacucaguuuaaauauuucaguggaagaguaaaacuuuuuuccuucuuaaugagucagcugcuugucuuugccauaagaaaucguacuuaaagauuaauuaauuaauucuuuuaauuaagaacaggaggagccagggaaagccugcucucacagcccagcucuucucagggcaucgauguguuuccucuuaggcagguugaauuuaggagccauagccuaucaucauuuuauaaauguaaauagagaagaaaaaaagggugggggggggaaguguggcauuucuucucaaagucucauugaggcauuuuaaauaaggcaguucaaggauuauuuaauucuaauauaugacuuuacugucaguuguccacggagcagccagccagcauguuagcaccaggauguuugagccugauugcuagggaggcuacaugcaaagguuguagugcuucuuagaacauuguagcuuuccagguaaccuagcaaccuggcagucaagcuucuucuguaaccacaguaaacacuuuacagcgacccuccuuaccguucuuccaaacacuucaauauuacauuccacaaaucuuuauacauguuuacuguuuuuaugaguccugaauuuaacuuuuagaaacuuucccucugcauagcauuaaacucuucaagucaccuagaguuuccacuuauggugauuuacauuugcaggcugccgccuggggcugguucuugugcugugguucacaggcaaauggaagaaugauccuccuuuagcauguucagacgugugugucugagacucugcauaggguagacguuaucucggggaugguguggggagcgacauucugagcuggugcaccuacuuccagaguuagggaugugggcuugugggcagcauuggaaaagcguuuguguucucuugucuucuguggaacucuuuugggguggggggugagacagaguuccucuguauagcucuggcuauccuggaacucacuuuguagaccaggcuggccucgaacucagaaaucugccugccucugccuccugagugcuggaauuaaaggcgugugccaccacgccuggccuguggaacucuuuauccuuuccauguacugccuccccacaguucccacuuguuuuuccaaagagaugggcaccaugcuggcugcagaggccccugagacucauuaguugagucuucagaaggauuucuuaaggaagauguucugagacauucaauucaguuccaaccuccacaccccucacacacugauugcugucuucucacucuucugugacucccauuucuaucccucccaucucucuccccucugccccugccccugucucuuacaaaugccucacauggaaugcuguaaggauauuuagcugagguguguauuuacuucauuauuugaagguuuucuguaguaccuugguaagauccucuauaucaaaaugcauagcaacacauacgaaauuucuuguguauuuugauaguacacugguuuuaucugguuaccaagccauuuuccuaggauagcauaauuugaacaucuaucacugaugugcuuggaagugcuuuagaaaccagacguuuggggauuuuaggauacuugcauagauucuagucacugaccauacuuaaucuucagugugauagaauccaaaauucaaaacucuucaagugauguguugaugcuccaaaauuuucuaauuucagauuuuggauugccagcucugggauacuugacuuguaauuaaaguaucccaugaagcgacuuaggucccucauucugaucugaaugacuucucuaagcacuuacugcaguacuuuauguaacugagcaccuggacguuaggagaaauguggcugagucuauacaugugucaaaacggagaaaugcuacugagucuucuuugccagaaauucuuauaaauagaacaaguuaccuuccccaugggacaguggaaauuuccaugcuugaaugagggacucaaagaaaguagacuauauccaccauccuugaggaaguuuugauuuuuuuaucaguuauugccugguccuuuuggcagcaucuggggaugaugucauauaaucaggcaggaggacccuuuaggagaaugcuuacaaggaccagggauccaugugagcuuaaacagucccuggaauuggaacuugcaauuccaugaaaaagcgaaauugacauugacauuggaagucuaaaugguugcuugagauuaugaaggauuccaagcucagguugaaggccaagaucacccccucgggagcaaugcuaagagcagcaaaggacugugagguugaagaauuaguguuggccuacugcuaccauuucucuaaggcccuccuggugcucugugcaucuccuggugagaggauaaagccuucacagcagaccaguuuaagaagugaguagaaguuucuaaucaggugagcugccuuaucuaagauuaucagcuaauauaaaggauuccacuggacccaggguacugcuuugaugcugacacucugccgcuuccuuaccuguccuagguuagcugagaaagaccaccaggccuggaaggccaaugucuuaaaaucucuguaagugccgaggucauauaaaccuuggcaugcacaaggcccagaaaagggauucuccugaccugucugggauccaguuguguuuuuguugguugucccuugccuuauuuauucuagcaaucaucgcccccccacccccacacacccaaugcugccgcuagacccaccagagagguccugacaucuuugccaugaagaaugaguacuugugaaugagcaaggccaguggugugcucuggcuucugugcgaccgugugaggcauccacaggaguuucuuccaucaguccuugacuagaacauguggacuggaugaggaaaaugugcucguuuguagauggagaggugucuaauacguugagggcugccugacaagagugcacucacaugcgcccugaguucauuuagaaaggauucguugguggaggacugaaguauuucuauuaauauuccuuaucugagagaaacagaggcaucuacuggaugucacaaaauguaauaugaaaacugaucuccaaagucgucuuuguuuuccuuccuccuccuauguugaaacagaaaaauucaguuauccuuuauuugcugggucauagcagagggaacggcucgccguucaacauugaaguauuauugcaaauaaacacacauuugagcuucuagcaccaaccaaccaccuuuugaucuuaguuugauuguauuauucagugauauuuaaagugcaaagucguaaaguaauucagacuucccaaacuugcuauggucauaauguuuaauuaugcuuuaagcuucaaauauguaauuaagucuauauuuuuuaaauuaagauuuucauucuuuaguauuuugagcuguggacaaaacagaauaccugugauaguguuuguacucauuacucaaaacugaguauuuguauuuucuuuuuuuuaaauauuuuuuauuacguauuuuccucaauuacauuuccaaugcuaucccaaaagucccccauacccuccccccccacuccccuacccacccauucccauuuuuuggcccuggcauuccccuguacuagggcauauaaaguuugcauguccaaugggccucucuuuccagugauggccgacuaggccaucuuuugaguauuucaugguaacguaggaagaagagcaagauggcuccgguugauauuauucaauccucugguuuucuucucuuacuucuuccuaucaccaguguguauuauucuccugcauguuugcacacuuggaaaaaugauuguggcagcauugagagaauuucucuugcuaacugaauuacacaguaacauuaucaauuuagagccauuaaaauauuuucaaguaaaauuuccgugagauuuaauuauugaaaugcccacuugugagagguuguuuuagaaaagaaaagucagacucuaagaaagcagcucuucuucccacccacuccccucauccccucaucuugcucugggcuacauggcagauccucuacacacauugcauguggguguccaucuggcaggugcagcuugaguccacauacagagagccauugugagccauggaugcucacaguaguaugugaaugcaugcagaugcucucuaauguaucuguacauaaguucccaucacgaauucuguucauuucacacucuuccuucacauguagccucuccuccuucccgccaucagacucucgcacaaucccuucuuuccuuacugggauuagacagugaauggcuccgugcuuacuccguccaccuuuucuaaauucuuuccuccaauuaacugcagaugaaugcauggaaaugcauggccauguuuuagguccacacggucucuacuguaccaaagaaauaugaaaaacaguaucacuuguugcauucuguauuugaguuugcuauuacucuugaugauggaaaaacaauguucacaacauuuuacaaagagagagcuuuguuuaaggugcuuuaaugaacccagcugagucaauccugucucucaggucucuguaaagcuuucuuuccccgcaagucucagcuuccaguaaaguuccuuccugugcaucggagaacuaaguccgugggugcucagacaagcauuuguagauuuuuaagacuuucugugaccccuucuggcuuguacugccucauuucaggucaggaucuugaggcuacauucuauucugccugggaacaugaacacaagagggucaccagaacaacaaaagcuuuaaaguaaauaguaguucuuaauuccauuuaauccuuuugcuaagguuggggccacuugguaucuccgugguauuuacuuaacauuuccaacacuucucauucuuuugggggauuuauugcuucuguugguacuuguuuuagguccuuacucccugacugagggagacucaugccucuguguagcucggcagauuuuuaugggcuaaaacaaaacagcuggucuugauucucuguuagcuaguguuuauuugcuuucaauuuauucuuugacaauuccuuauauguguauaacucaaucuggugacacccaucuccccacccucggcucuccugaucucccucaacuaaucccuaauauucccaacaagccccucucccacuaucaugucaguuucuucuguaauugacaaguuaaaccagggcugcuggugugaaggugagucugaugcucuccccuggaccaugucuaacucaucacuguccauucucccuccuuaagcagccaucagcugccuguagcucuuggagaaugauuggacuugucccagauuagugucuguugccaugauaaaaugccaagcaaaaccaauuuggggaggaaaggauuuacuucaccguagagguuuacaguucaccuugggaaggagccagagugggagcucgagguaguaacugaaguugaaaccauggauuggugcucaaggucauagccaauuucuuuuuucuugcacagcucauucccacuggccuagggaugguuucgccuguaguggaaccaucaauuuguaaucaagaaaaugccccacagauaagcucauagguugaccuguuggaggcagucaguccuucaguggagacucugucuuuccagguaggucaagcugacuagacaccacagaccuuauaaacuccuucuccacccaugaccaacuguaggugagcccagucuuguuuaagccuuguguagguaaccacagcuauggugaguucaugaguauaacagcuaucucaugcucacaaggcagaauuuugaggccuuucuccuguaaugcuaguuuuauagugugguaucacaagugcaaucuaaaaaguuaauuuaaaaacuauucugaaguucaaacuaaaacuaugguaaugucucuggucauuuaaucacagcucugauugguuccuucuauaguugcuucaccauuugccuuuuaaaagucaaggccauaggggugguuccuuguauucagcugcucuuagguugaacuaaauuggguggauauuggugacucaguugcuuuucucuucaugcuuauggaaccugugcauguauagguuguacagcacuggaguugaaaaggcauaucaggaacaugugaguuucccagcacugccaggccaccccuggaggcuggacuaagauuguuuuguuguuguugaagugauaucccaggcuggagcccugauccuaugguucugauuaacuggacaaacugagaugugugguacaaacugcaaggggaggcuagcugaaagagucagaacacagaagguuggucccuucaugcucucuuguaccauacucuggcaggucagacauauugacaaauauccuggugcagccaaagucaagagaggaucugggauuauucuuauggcggugguggugauccuauaaaggcuuucucccucucccuucaucucucuccuucuaucucucugaaacaaagacauucuauccacauaugcugacuggaacacugcuuacaucugugccauuuucugaccagaacaugucuuucuggcauaguuggauucugacucacagagaaguucuugagaaagacucaagcaggaaggagaugaaugaagaucagguuauuggucauguucugcuagggaauggauuuguuuucuuguuagaaugccauguaacaccucuagucaaauauaaguaaaagucaaugcgccuucauuaggaaaauaugaaccccaagaaguauuaucuaucuucccaaaacuauaaaucguuauuaauauccugcugaauucccccuuaaugcauuuaaaacagaguucugaaauaucuaucuugaucuacauaauaagcauauaaagaauguuauggauacaaugcacauauggaaguaacauguacuacuauagaaguuguacagaaauaaagcuaacauagauuuacaccucugucuuugucacauguaauaauuacuccuugaacacaauacaaaagauaaaauguccagaaauagauacucaacuguguagcuaacuaaugguuccuauaagguguaagcuuaacacauaaacuguacgcugcugaguucaaauccagguuaauaugaaugugggcaagauggucaaccucucuaccccaguuaugacaguaacuggcaaggcaaaggauaaggggaccuucagugauagugaaggcugcuagcagaauuccuccucucacuguagcauuuccaggacagaguuuuuccaguuaaaugacugggagucugugcuaucauuauaauaaacacugaacacuuacagaagggccaugguguuguccaaggggugaaacacuaggauuuuaacuguuuuggcuugagagaacuauggguuuguuuuguuguuguuguugacccaguguuuauaacaauggcuggcaaaugcuuucuguggaggccaggugacaaaugugugggcuuugucagccaucugaugguuuuuauuacuaaccagcccuagacaagugagcaugauugaguuccaaaaaaucuucauuauagacauagaaauugaauuccauguaauuugaagaccacagauuauucucugccuaauuaaaaaaaaaaacuauuuaagcuuauacggaagaaagaaagaaagaaagaaagaaagaaagaaagaaacuagaugaacaucugcagaaaaaaaaaaaaaaggacccaguuaggcaccugggccuguuuccgcccccgcccccgccccaccccaccccaccccagcuuggaucagugcucaccauccauuaaugugguaagaauguuucagcaucugcucccacaaugacguuccugcuguuggcuccauccaagccuuucugccaugauaaacaaggccuggaaggaugucuugguauagagagcagcuggagcaggcugaguuccuggguucccccggcagguuuuguuucucaugccaauggcuucucugugccagaaccugcucacacagauggagaaaagugcgggcagaaaaggggucggugauuguuacacauugguguauccuuuguuggaugcuuggccucugcauuuccuguagaugagggagaggagcaugacugauggcaaugcuuacuccagcccuagguuugaagugauaaugggugauuauaaaggggaauaggacaaaaaggaguugggaaaugaagacagcugagagacagggaugguacccaagugcacggugcucuuuggauuguucauagucccguaugugcucagccgaguagagaaaaaugugaguaucuuuauaaaaccugacagccauugccuuauucauaaaggcuuuaacagaaaccuuuagccaaacuucauuuuaaaggaaauuuauucccaaggcauuuuaauugaguuuuuaugguaauucuguguauugucuauugaaucaacaucccaaauaaaaccauguuuuguuuauccuuuuauucugugagucucuacucuguaucuucaagauaaugaccugagucaacucagaguuucaugaauuguauguauaauagaacaaggccuuucuuggugucuuacaacuuauuuaaagcaauauuuucaccugaaguuuauuuuuagguuuuguuuuguuuuguuuuuuguuuuuguuuguuuuuuguuuguuuuuguuuuuugagacaggguuucucuguguagucauggcuguccuggaacucacuuuguagaccaggcuggacucaggaauccgccugccucugccuccugagugcugagauuaaaggcgugugccaccaugcccggcuugaaguuucuuuuuaaaugcagacuuuaaauguuuauuuauugauuugaguauaguaugugcacaugugugaauacacauguggaacauguggaaagucacaggaguucuuuuauucuaccauguggaucccugggauggaacuccagucaucaugcuuagagggaagcaucgucacccacugagccaagucauuggccccaaauauggaauuuuugaugaaggauucuauuuuuaaagauuuuuuaaaaauuuuuuaucauguauauauguauggagguggaucuaugcacaugaaggcgggcguugucugaggagucuaacagaggccaugcgauccccuagagcuagagguuuauguggcagugaacugccugaugugggugcagggaacugaacucgaguccuuugcaagagcacuauguguucuuaaccaggaaccauuuccccagcucccugguaaacuugucuuguacacguggucacaauauguaaauuguguauaagugcauauguguguacauguauauguaggccagauuuccuuuguucuauagagaugugcuuauaaguucuuucuugcuuccuacuuucugaacuuagcaccuucuugaacuucauucccagggaggaaguucccuaacugacaguggcgauuggagacaauccauaguucagcugaacuagauuccucauccaacaauuucauuugaaacuaucaaggagaugcggagcugggguucaggccaggacuuggcuugugggugaggagacuuagagcagucugcagaggaccagggauuccaggcgcacagggaaggaacugcagccgagagcagagguagauggggcugcuaugagggagaaaugcgggggccuggauucucagcuccauccucugggcuuuuguccugagcauuuuuugugaguuacucaaucaaauuuuaaugaugaggaacuggguucucaugaauuauuccuaggccagauuuccuuuguucuguagaagugugcuuagauuucaaaacaucauuguuagauuucucugauuaaguccuuucuugcuuccuacuuucugaagcucuuuugaacuuaaguuagaaacaaaacaagacaagaaauuucuccaguguucacauuuagcaacuguggcuuuggagaagauucuaguccugacccuuauccagaaguaagaguagcauccuucucuuuccucuugucucuuuggggacuuggaggcuuaucugaaauccugaauucagcgcguaauguggcgcuggccacuaccauuacucccuccaggucagucaugguuccguucucaucauguuugcugucuuccacugaaagauaaggcagacugccuucucuauuauccuaugguguuuuuguuuguuuagccaugcugacccgagaguccuucagguuggccucaaacuuucaggaaccucuagcugccauuacagucuugagcugugucuuagucaggguuucuauuccugcacaaacaucaugaccaagaagcaaguuggggaggaaaggguuuauucagcuuacacuuccaucaccaaaggaagucaggacuggaacucaagcaggucagaaagcaggagcugaugcagaggccauggagggauguucuuuacuggcuugcuucccccuggcuugcucagccugcucucuuauagaacccaagacuaccagcccagagauggucccacccacaaggggccuuucccccuugaucacuaauugaggaaaugccuuacaguuggaucucauggaggcauuuccucaacugaagcuccuuucucugugauaacuccagcugugucaaguugacacaaaccuauccaguacaagcuaccaccagcaaaacuauagguucuuauugcauuuaauggagggagacuaagacuagaauuagaaaucccccaaugcuacuuuuuggaaaugcugaccuaugugggacauugugaggucgaauguuuucaagagccucauuauacaaaugagugaaagcaacagagaaaguugugagcucugcuaacucugaguauguguucugccuugccuagagcagcagccuuugcuguaaaaguugcugccuauucaaguaccugguacagggcauggagcuuccaacugcaacagggcaucggcaagaacagaguuccauagcucccugcauuugguuauggcggcugauuguaaaugaauucaguucuucugcaauuuauguuucaguugugaauuaagaggcacuuuucaacgugcauguugcugaguuucauuucaguacaccugcacaauuggaaacuuuugagaauguguguguguguguguguguguguguguguguguguguguguguguguguguuuuagugcuauaaagagacaucgugacuauggcaacucucauaaaggaaaauauuucauuguggcuggcucacaguuucagagguuuagucuauuaccaucauggcauccaguguaucaggcaucaaauccaaccagaaagcgguugguuauucccacaacuguccuacaaacuguuacaccugugaacauaacucuccaggcaggucaggauuauaaaguguaaggugcaguagugauuaagaugacgucuuuucuccgagcacuuuguagcagaaguaguuuccuggucaacccaagauuguuuucucuaugucucucauccgaagugagugcugucuucagaaacagggcuauggagagucaccaagagcagugacaauagccuguguuguuuugggugccccuggagccucucugaccaauaacuuguauccuaugccuggcugugagauuuucaguuaauaaucccuguuuucuggaaucagcaugguucacccgugucggguaguuuuuuucauacuacuucaaaauaaaauauuuuaaauuagcauauacacuaauugccauaaaauuuccuuauauaucguuauccuugguucaccuacuccauacauuuucuuuuccccagucccuauaucuccacuuauagcuucaugagccugucuuccuuucaugucaccaguagccagucuaccaguuacuuuauguuuccucagguugggagaucauagguuuccacauagcuucauuuuuaaacaguucuugagcuccgccccaucccauggaaccauaaacagcaggccuuaccccagccucagggagguucugacuuccuuccaguuugggaaucacugguuuggaaaagugguucucagugucuuuggggcaucauaaucaugcaugggauucaagacucuaauugcuuggcuuccaguuaguuucucacuaaugugggguauagaggcacucugggauuuuaacagcucccuagugaauuucccacuguauuccaggcaauguucuagccauagagagcuugaugaaauaucauacacucaguucugcugggugaggaggugaagagaggggcauauugcucccagcucuacgugaaccuccuuuccccuggagaacaugcccuucuacugccugauuaaacaauguuuauaaauagggcauuuucuaugcuaaaugaauauucacucaaugugauuuguuuuaaagguugcuuauaaugcuauauuuguugaacaaauguagacacucauauaguucaaauauuaacuccuaaauccuccaagguuuuccccgugauauaccaucuggcaagcauuauuguaaucaucucuuuauuauccacacuaaugaaggacuagcauagcauugguaauugaaaaacagggaucguuuaaaaaucauucaggcuauuaccagcucugcuuccccaaccaggaagcacccaggaguagaaaauauugaccgaugaucacuucccaucaaggugacaaugcaugcucuuucugcaagaaauaggauaaauaagaggcuucuauguuguaaucccccuuucugaauaaaugcauuguuaaaugcacagccuaaacacacagcaggugaacaguagcguguguauugauguugaacgcauggauuaaauguggugcaguguauguuguauggaauuuaggauuuugggagaccuaguucuccaucuucugacacugucuguguaacuggagaugagcuaacguguguccccauaaccaacagcagguauaucacccgagaauuuauuagagauccaaguuuuugacucagacagugcuagcaaauugcggucuggcagugagucuagcagaugguucuucaguaagccccuugggagauccuaaggccuccuagccccaggccuagguccaugcuaauguuauuugcuccgacucuuacuggucagaguacacugcuccucaaauuuagacucugguguuuugagaaagaaagcacccauucuguuccccauccccugggagcugagugcugucugcugugaaucacagagcacuacuuccuugggagcuaacaaaugacaucucagaagaauguacagaggugcacaggcuucgcaguaaaacaaggggaaauuucaggcuauucaucaaaaccuugcaccuucucuucaagacagguggaagaaauaacaugcagcaagcaaagaaaauaaaucuguccagggagcaucucaucaaugaagaaggagugguccaguucuuagucuugcugagaucucagcauagguguuauucuugugacaauacagaaaacucucaaauauauaggccuguaguucuauuucuuuucuuaucaaaaaucuauggagguaaaaugauuucacccacuauuaaagaacagaagcuaaaauaucauuucaggagacugggaucaugauacuuggaaccagacagaagaguucacccaccuacaaaauaggauauucaucaucugaagugcagugauguuuccuaauuagaacaauucauugaacaaucaaaagcaauuuucuaauuggcuucuguguaucgagagccuauuuguuggagaccaguaggccacagagaauguggucuguuacaggaucugguagggaugaagaaguuaggacuucugcuaguaaauaggcugcaucacaagugaauuuugucuggggggaauaaugugcacagagaagagcugacagugaggaaccagcgcuggaaaugucugugaaauuugcagcaauguuagaucgaucagcaucagcaucacgucaacaaauucuaaaaacccuaaggcucuaguacacauuggcucugaaacugacaagcugcacaaacugucagugccucaguuuccuuuuuucacgaggugauaauuuccucauggaccuggugaugguuuccugagaauaaagaggacacugcauuuguaggacacuuugccacaucugcagcaugauaagagauuuuauuauauaccaacuggcuacaugguaccuuaaaggaauccaaacagccauuacagucagcuuucagcauccauggguucugugucuaucaaccacagauuuaaaauacuuacaagaaguuccuucuguacugaacauagauagagcuuuuugcuuucaucauucucuaauaauacaauauaacaucauuucauaucauugacauauuagauaauacaagaagucuagagguuauugaaguaugcagagaauugcuucucucucucucucucucucucucucucucucucucucucucucucucccucucucccuuauucucccucucugcaucccucucugucucccuucauuccuuucuccccucuuucucuuucuuucauuauaaggacccuuugaauaccaguacuauacuguacuuagugagcagauuauauggccaagaaaaaacuauugauagaagaaaacuuuaaggguccuaguguaaaauucaagcaaaagugaugacucuuggguuauagaggguuucuccucgccaacuuccuucacgauacuuuuugugaguuguuagaauuagauugagaauucauagaaguuuuguuucauuuuguuuugcuuuuucaguugagugccuuuucuuuaguacuggggauuguacccagggucucauggaugcuaggcaagaguucugccacuuggguauagucuuagcccucuauaaauuuuuauuuuucagacagguccucucuaaguuguucaagauggcuuugaauugcuucuauagcccagacaaaccuuaaacuugauaucaucuugccucugcuaccagaguagcugagaguacauaaacaggcacagcuugguuuccuuuucauuuauuguuggaauagaugaauaagcuaauacuagaaauugguuugaagugaguauuccauugugcucucuuuuguagcacucggucuuguuggcuaggcccugccacuugguggcccagacuuuugugaaguaaacuuuuaguccaaauggcagcagugugacaguaaauauguucagcuuucaaacugugaaagggaaaauguagaaacguaaggugguugagguauaguguccaaaaauguugccaagucuuggccaaauccaugcucuaagguccugugcuggcaugugaaggcaucuagccacaguuucuuaugagccacaggaggacagcagugacaguggcuuaauggggauguggugaauuuuaaugcucacaaaguacaagggagcaacagcuccuuaacuuaguaaggaacaauccuuguaccaucaucugggcucaggaaaaccagauucaucaaaauaacaagugugucugcauggggcaagcuuuagucuuuuuuuuuuuucuucuaaauaauuaaacuuagcgaaaucuccauuggguuauuucauguauuuuaauuuucuauuuucaguuggguaugauuggaaacucucacuuaaguaaauaccaaauuaagaguaaagugggguuggaaggauggcucagugguugaguccauguaaugcucauuccauagcaaguguucaguucccaacacuauagagaagcggcucauaaccagcugcagugccuccuuugggcauuccaaugcaucuaccuuccggcauuccaaugcauuugggcauuccagugcauuugguccuuggaagucaccugcacucacagguacacaaaccugcaaauggauguaaacacacuuaauuaaaaaaaaaaaaaaaaaaaagacugagcuguacugugcuugaaaugccaaaugauuuuuuauuauauuaauuccaugagcuagguacaucuuucucaucaguaauugauccucagcguuuuaaaagcucuccaguguuuuauggcaugaaucaggguggaaugucauaacaacauccaaaccauuggguuaacacagaucacuggauacacauagugaacuagguguuuugaaacgagaacucugggcuacagacagaacuacucugccuggauuuuugauaaucuaaauuaguucuuaaguaaaauuugagaucauccugggaaugacaagugacaugaacuuuuauucagaugaacacguuauucaaauguggguaauuguaggugguuugaaccgggaagcagugaguaaaaaggccuucugauucuaaaguuagaaagaaucacuauugaucaaauuucccuagaaaaagagacuaaagcuuuuuauuagaaaguauuuagagguacaauaaaaauaauuguuucaugcaaauuauguaaauuuuaaggucuuaaaaugccauuuaagggggcaaaaaaaugccaucauauuugauuauuugaagucugacuuuaauguuucuuuuauuuuugaaacuucuuuauugaaguagauucuuuucucauacaauauaucuugauuacauuuuccuucuccuuugacucuucccaguccuucccuacuuccucuuccacuccagaucgaguccccuucuuucauuagaaaagaaaggcuucuaagagguaacaaccggacaugacaaaaguaaaauauaguaagaugaagcaaacaguaucauauuaaaguugaacauaggggggaacgagucccaagaacaggcacaaguauacuauagcuuaauauuuuucuguaucucuucccaucuguugccagaggaagccucucugaugaugaauggauaaggcacugaucuaugaggguagcagaauaucauuaagaaucauuuuauugauuuuuauuuguguauuuaauuauuuuuaggcaaguaguauuugguuuuaccuuaggucucugugcuaccuagucucugguucuugguuguccaagcagugucaaguguugguucuucuuguggauuggaccuugggucaaaucagacauugccuggcuguggggaauuccaugcuggucuccaguugagcuaaggucugaaccccuguggugauaauucaccuucaugacaugguaggcguucccuuaugcuccuggaacucuggcuccugccuaaguaaccgcccccccacccccccagcccccagaagagaagcauggucaguagucacauaagcaauggcccaagcuucugaccuucaggcuaaacuccuccccaguuaccuagcaacaguaaagaccauaaaaaggacuguuuagcccaccucacucucuuacucgucucucucuuacuugucucccucucaacccucacucucacccucucuccccucucuuugucuucucuccucucuccucucucuuugucuucuccucuccucucuucucucucuuacucucuuucucucuagccuuuccuuucucucucugucucucugucucucugucucucuuuucuaccuucucucuuucccccugcauuucuauaauaaagcucuuaaaccauagaaagucucugcucaucaaggcugugcgcacuccagcagguguugggaaccucuucccucaucccucccuccuauaacccugguagcuuuagcaaaguagcuccgggguuguuagauagggcugcccauggccacccccugaagagugggauagaggagugcccacccagggaugaguggaagguaguuagcagcccucccacgccugacugaccagcgaauacguggaacucuggcggggugugggucucuuccccuccccucuuuccccaaggcccccguuuuuaguucccacaccuggcuacucuuacaaguucuaugcaaauuuucuacauuggcauugugugauuuuuuacaugcaacaugauguuuggaaguaguuguggaauguuacaucuagugacuucuaauauuguuauaauuuauaugguggaauaggguacccauugucauaauucuuauucaacauaguauuggagauaucaaccagaauaauuagggcaagagaaagaaauauuggaaaagaacaagucaaauuguuccuguuugaagaugacacuauccaccaucuauguuagaaaacucuaaugacaaaaacaaacaccaacccaaaccugcuaauacuaagugaauucagcaaguugaacguuauaaagucaguauacaagaaucagcauuucuguacagcaagaacaaauuguguuuaacaaucauuuuuucuuucuuuguucuuuucuuuaaguauaaaauaaugaagaucacaauuucuuugaaucccuucaucauuaagauuuauguggucucggcugguuuuggugacugguggaggaaagucaaucauuugggcuucauguucucuuaggcauaacuauauuaagccaucacuaugcugugugugauaacucaugcuaguugcucuucuugagggcaggcagauguuaggauccuguccauaucuacaugauucccacugccuguacuuagaaaccugucuaacccuggacaguucacaagccacccaagagggcugaucguaccucaccucacauuuaaggugaagaugcccauagguuguggcuucucaagguuagcuucugucauaaaugacagaauuguggcuucaccccacagcuucucucccaagugccaauugcuucacuucaguauagcccccacauacauuuaaaacgcguuauguucuuuuucuuaauguguuacuugucuaaucuuacauuugaucuccaacugggucacccaaucccaucuauaaaagcucuucugucugaaccugaauugcugggggaauucccacccaucuacacugguacagaggcaggcuaugccagcuucuuugaaauucccauccauauagauugguacauaggcaggcaaagucagcaucuuugauuacuugucauuuaccucauguugcuuccaucuugaggggagaucucaguuaguuugugguugaugacaucuucuggagcauuaauggugaccacauuuucuuuuacuccucacagaaucacgucaauccugccauggacuucacacagaccccuccugggaugcuggcucuggacaacaugcuguauuucgcuaagcaccaccaggaugcauacauccggguaagcaugcuggcuucucucagauacugccagugucguauggaauucuguuuuccaaccuacgcacaguaggagauugcuauuagaugagucaccccaguauuuuccuuuuaucagugguaaacuaaagacaugaaauugaucaaggggcuaaaauaagaaugccucauuuuacauuuuuuacacauacuuuaacaauauuacugaacaauguuuucuauaguuucauauuggcauaugaggaaaaacucuuaaguaguaaaauacagaaaugaacuauauacucaaauccuggaaaaucucaaaaccugcaagacuucuuccaugguuggaaagaggccaagguuccuuacugcuacauugcuucauuuuagucuaauguuuagagacacaauaaaauaaucacaaauacagagaaaaacaggagauuuguggagugaaaucuuucuauguuucauaacagaccacuacauaagguuguuaguggaaggaagaaggaaguggagaccucuguguuucuagcagaugccaccuggugccugggcagugcccuguagagaauacaaugagugccauaaaagcuuaucuggguugcccaucagagcccugugauugcaccauguccuugucuucaagauggagagcucagaugucauuacgauagaauggaugcaagauugaaaucaacgagggauuugaauugagugggaguuagacugaaguuacagugaugacuagcccaaagguuagaaagaguuugaaggacaaauugcucaaaguaagaaaaguugagcggaucugacaauggggcauguguacugggacaugugcugccagacccugauuaacauugguguccugaagaugaggcuuggcacuguuaguaguuagugauuuaaaugugggugauuccauugucccggcuaaagugucuuuuguuaaacaagggagacuugggggcucucagccaugauggugcuuucuuggcaagucuuuggaaauggacaaugcuaugcccacaagaggaccuuggguauauuuggguagucugcagugagaaauuguaccaucucauggugacuucuuuguacaaagcuauguuggacuuccuauuuucuguaggccucauguuuuacauguauguuauuuuauuuuauuuuuuuauuagguauuuauuucauuuacauuuccaaugcuaucccaaaagucccccacaugcucccccacccacuccuacuucuuggcccugguguuccccuguacugaggcagauaaaguuugcacgaccaaugggccucucuuuccagugauggccgacuaggccauuuucugauacauaugcagcuagagacacgaccucuggggaguacuggguaguucauauuguuguuccaccuauaggauugcagaucccuuuagcuccuugguuacuuucucuagcuccuccauugggggcccugugauccauccaauagcugacugugagcauccacuucuguguuugcuaggccccggcauagucucacaagagacagcuauaucuggguccuuucagcaaaaucuugcuaguguaugcaauggugucaguguuuggaagcugauuaugggauggauucucagauaucgcaguccguagaugguccauccuuucgucucagcuccaaacugugucucuguaacuccuuccauggauguuuugucccuauuucuaagaagggucaaaguguccccacuuuggucuucguucuucuugaguuucauguguuuagcaaauuauaucuuuuaucuuggguauucuaaguuucugggcuaauauccacuuaucagugaguacauauugugugaguuccuuugugauuggguuaccucacucaggaugaugcccuccagauccauccauuugccuaggaauuucauaaauucauucuuauuaauaacugaguaguacuccauuguguaaauguaccacauuuucuguauccauuccucuguugaggggcauuuggguucuuuccagcuucuggcuauuauaaauaaggcugcuaugaacauaguagagcauguguccuucuuaccgguuggaacaucuggauauaugcccaggagagguacugcaggauccuccaguaguacuauguucaauuuucugaggaacugccagacugauuuccagagugguuguacaagcuugcaaucccaccaacaauggaggaguguuccucuuucuccacauccucgccagcaucugcugucaccugaauuuuugaucuuagccauucugacuggugugggguuguuuugauuugcauuucccugaugauuaaggauguugaacauuuuuucaggugcuucucugccauucgauauuccucaggugagaauucuuuguucagcucugagccccauuuuuuaaugggguuauuugauuuuucuggaguccaccuucuugaguucuuuauauauauuggauauuaguccccaauuugauuuaggauagguaaacauucauucccaaucuguugguggccuuuuugucuuauugauggugucuuuugccuugcagaagcuuugcaacuuuaugaggucccauuugucaauucucgaucuuacagcauaagccauugcuguucuauucaggaaaauuuccccuguacccauaucuuugaggcuuuuuucuacuuuuuccuaugucagcacuuugagaaguuuucaacuauuaucuguaauuugaguauauaaaggauuuuauggucauuucccugaaaggugugcagucuaguacuuggugagaagugcagucugucuuaagauaauuguuuuccuauacaauuuugaucagaagcccaggcauagugacuauaauaugccuuuaaucccagaucuggggcggcaggagcagguugaucucugugaguuugagguuagcugcacugucucaaaaacaaaaaacaacaagaaaucaauaaacaaaacagucccuguaaaacccuuuaauuucauacaaacacacacacacacacacacacacacacacacacacacacgcaaacauacaugcacacacgcacacgcacauguucacugcacucgcauuuucugugcauguagucuguuuucaucacaggaaaacuaguauuuagggagaucauacaauaucuagccuuggagacuugacugugaaaaguggaagccguguggaaauuggauuucacaucagcugguugaugguugcagauaaaugcucuaagauuagagcuugcugaugccaaauguauuguuaauugcuuaagaagcauaugucuuaugaaaaguaauuuaaugucuuaagcuugauuucucagugcauuuucuaaacugcgauaagugaaauuaauaccauggcaaccuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggagaaaaaaaaauaccauggcaaccugaauuaaccuuauacuuaacagagaugaagaaaaccuagguacaaagccaggcuggucccuuuuguucuccuggauguuucuuuauggguugagauagaugcauguggcucauacacuguuauaucuucucauaagagucucucuaccauguuuucuaggucacaugugucuuuggggccuugacuacuagaugcaaggccaaagcuaccucuguaaaugccacuucccuguguaaaauuuaggguuuuguaccagugggauucuggugaccuugaagguagacacaaugguuguagagcucauguguucuacaguacugagcgauacccgucagcuggcuucguuuggucugugaccugggaggucucuuccaaaacacuaagaggaauuuauuuuuaaauaauauuuuuuuaauuccuuaagaagcccacacauuguaucuugaucguauucacucguuccuacaacucuuccucccugcaugucccuauccacucaaucuuuuguucuugucucuccauucaguccaguugcuguuggccaaguccucuugggaguaagcucugccugguaguuugagauauauccaguauauaugucacacacacacacacacacacacacacacacacacacacuauucccuuugcucuugacacugcuguaucuucaugcuuccuugaucacuuuguuuucaggucccucuaugucccugccuuugguuuagcaaacuugggcacguaugcuugugucuaucaguuuuccgaccuuccucaccuuugcccuucuguugacccuuggcauuaauuuuugcucugaagcuguuuggucugcuucuuaggauuguugcugagccucucugggcauuucuuuuccucucucugccuaugaaaugaacauaacaugcagugcucuuacuguuaaccuuugcagacuucaucuguuuucugaguaacuauugauacccacagugagccaaguguuggccacuccucggggaacaguggguucugacaucgaggaauuuccugucuaggaucgaugggggaggaacacaugguguggagauuaagagacagugccaggcaauuuuuaagucacuuggaauguauauuaguaugagaaguccccaacauagaugugggcucuggacgagaagaaccuccuggagaaaguggucagccuuagugaucuauugcugugaagagauaccaugacuaaggcauucaauuggggugcuuguuuauaguuucagaggguuaguccaugaucuucauagcgggaagcagacagacagugcagaaacaguagcugagaacuuuaucuccuaaucuguguguaggagggagagagagagagagagagagagagagagagagagagagagagagagagaaagagagagagagagagagagagagagagagagagagagagagagagagagaaacagagagaaacagagagaaacagagagaaacagagagaaacagagagaaacagagagaaacagagacagagacugggguugguguaugcuucugaaaccucaaagucuauucucaaggacaaaccuccuccaacaagaccacaucuccuaguccuuccuaaauaguuccauuaacugagaaccaaacauugaaauauacuagccuauaggggccauucuuauucagaccacucuaugguauuaacuagguauuuuaguuacuuuacauguuucugugauaaaauaccuugaaaaaggcaauucgaugcagaaagaguuuaauucaguucacaauuccauugaauacaguccauuaugacaaggaagucauggagauagaaaccugaggcaacagguuacauugcuguagccaauaaauaggcaauauauguugguaaucagcuagcaucuuccauuuuagccaguguaugacccaagccuagggaauagugcugcccacuucucggguauguauccuuccucaauuaucauagucaagauaaacccgcccaaacaugcuauuguaauugaacauucugucaaguugaaagcauuaacccucuuaacaggugaagggaagaccaaggugagcaugccaaguaaaggggaaaugagcuugaggugugaugguguguguuuugauugggaagccagcaaacucuaauaugggaguagcaaaguugggacaggucauuugagauauuuaaagcuaucuuaaggugcuuuuugaauucaaacaucauuuuucaguagcuauaacaauuucuaaacaauaaaccuaccauuuuccuaagugaguuaagcaaagauaauaauuuuagaaaaaaaaacaaaaaacaaaaaacaaaccaugcucuugcuagaaaagccacaugagaaauauagaugggaggcuuagccaagaaagcaauacuggacaggaggagauaaggcuauagcugugguguggaaagagagcauaggaauuugagaaauuguagagaauugauguuaacuugaccaagaguuggggucuggcaaugaggagaagcaguuugguuggacuaaaguaaauuuggcuagccaaggaagagagagacuucugacuugagagcccuagcaagucucuuuggccauuugaagccaugucccccuuccuuuucugcucugugucuuugugccaucugcuugagucucucuaugagacagucagugaacuugaggagcacagaugacgcuacagggcguggccucuucccaagccuguguaucuguauggccccucagguccccucugccaccucuguggcuuucucuaucacuacccaucccuuugucucugucaugugcacuccaaccaaacccuuugucccaacaaaauaauggcaggccacaugugagcaaaggcaguuccccacugaggacuugugacaccuuuauguuugaauguuucauaccauccaccugauggacagcuccuaaggcaaagaucaucuuuaaaaagaaacuccugucccuuucccuggaggauauuauugacauuggacacuuaaagcgaaugcugugaccuuuuauagcuuuaaauguauuuacccguguauugugucuccugugcuugacugaaauaaacugugugaguagacaccaaaguucacucagcuucucaacacuuagcccagugucuagugccuaauaacuucaaauaauuuccuuuuaaguaagcaaauaaaaaauaguguaugaaauggauuccauuuuguuuucuuuuguuuuuguccuguuguuugauuuuggguuuuugacagauacugagagaacaugaaguugagugauuagggcgauggggaguaucugggaggacuugcggaagggaaauaauaggaugaaaugauauuguaugaaauacauauauuuuuuuguuuugucuuuuguuuguuuuuguuuuugauuuugauuuuggagacagggucucuuuauguaaccugauuguccuagaauuugcucuguagaccaggguggccuccaacucacagagaucugccuggcuguaccuucagagugcugggauccaaggcauauaucaccacugccuggcucugaaaaaaauuuuuuuucaaagcaaaaaaagaacagaauuuucucagcuuuauuuuuuucuccucaauggaaauucauggccuucaugcuuacaacacuucuaaggauauuguuugccacaugaauuucuugauggguagcuauguuucuuauguaauacuuaaaguguagcaacuguguucuagugaaaaccguugauguaauugaauuaccccacaguuggauagggacaaaacccaaggaggaauuacagaucuaagcauugcacaguguacagagagaaaucacuaugugauuucagauaugaaucuuucaucauauuauccaauauuuggccaacaccaaaugauuuuauuucuaggacuaagagagccugguaaaggugucagagcagaucauucuuaauugaccuuuuguuuucagaguaguaacaugaaugaaaaguaacagcaauccagauagucagaaccuauugugaguuauuagaccaacccuuaugaaagccagauaagcuuaaaugugcaacaauaaaagccaaaugcaugcaaaggagauucuucugugauuguauauugacuuagaauacaaaagauaagagggagaaagcuuauguaugcccuuagaugcuuaaaggaaaaaguugaagaaauucccuuaagaguuauaaucauucauucauugacucauucaaaaauguuaucagacacccagcaggcgugauaccaugcacaguggauguggcaguaagggaagaagcuaagauuuggcucuuguauagaaggaauaaucucucucucucucucucucucucucucucucucucucucucucucacacacacacacacacacacacacacacacacaccacaaguaaggagcaguaguaauuacuuucuauuugugaaguuccuuguuucccaugggacuuuuagauguucacuauaaggggaaacuaauaaaagcucugcuugauaacuugugaaguuuucuacaauuuuaugaaguauauauuguuuagcuauaugagaaucacucaggacuuccuuccuccugugaccugacuuuaaacaacauccuggcuucauggagaaaccuggugguaguuggucaauguggaguagagcagacccggccuuugcucaguugcuguucauguggggcuguaucauaaauauagguguuccuaaugaagcuguuaccucauugauauacagacucuaaccaacaaagcuguaacucaacagaauuuauaagaucuggaguuccaggaacaaaauauaaagguagaccuggcaaugguuaguucuuuauauaaccugcaauccauuuuuuuauggagguauaauugguauacaaaaacaauuugcaagaucguguaauucuugcaauuacaauuucguguaauucuugcuucaucaucccuccuaauuuaugacuagcauuuuauccacuguauaucaugggcuacugucugacuauaguagaagauaaugaauuuccugaugagauaaaaaagagaugcuuuuuagaaauacaauuaauuauaauaguguuacacaacuguaggccaggaaauauguuucuaauuguauaccaaaucagaacaaaauauauugauaguuugucaauaagaaauuaugagagaagauggauauuccaccuaagaauggauuucuccauucuuuagagucauuuuuuucuagagaugaaaacuguaaagucuaucuuuacuguuuaaacaucucuaaguggguguuccuauacaccuacugaacagugugcuuuaaaccucuugacagagcuagagucagugacaaaucccugcucccuuugcacuugugacuuugaugcagucgguccuucaaggguggucucagucaugugacaaugucucaaaaaucaucaaugaaauaaguaagggagagaagaagaaacaaaacagagcaaugggagagaccgguuagguccugaccuggggcugcugagacagaaucccgagggagcucuccuggaugcccgaguaugagaagugccacgucugaggcucuaagacacauugugaacuucuccucagugcaggaagauggggugacucuguacugaagauggggauguagauuacucaccauggccgggauccccaugacccauucaccucuguaucuaguggagguugucuuccuucugugcgucccucugcuaugucauuagagguucgucucauuuagcaggggaggcucgugucagcugggagguaaggacagguuaauugcucacagcacuguugugcaguuggcgcuuucagugcugugcuugagggaacugacacucagagaggguagguugccugaccgaggccacagagcuagagcuguaccagcaauaaacuuuaaacacuuacgcuuuuaauacauuuuuauuaaaauauaacuuuacugccccuuuccccuucuggucccuuccauaguccccuacucuaaaauuaauaaccucuuuucuuuuaguguguguguguguguguguguguguguguguguguguguaacauagaauguaacucaagagauagcuucucagaaauggcugcauagcaaaaccagaaaaaugacaaugucaauagauaugcucacauagaaaggggaagaucucucagggccuccuccuuagagaaggagaguguuucacagcaggcaucugauaaucuggcucuuaaaaucuuucugcuuucucuuucggacuguucccugggcugcagaugcugaggcugggauguagauuacucaccauggcugggauccccacgagccauucaccucuguaucuaguggagguuuccugugcuauaaagugaggcuucugugaugaggggugcuagcuacauuuuccucugaguauaaagagaagauuuaaaaaguagcuagggauuauguuggucuagggagauuucaggaguagguuguuuucugacauucaugaccucagcagcccagagaaucuggcuagguucccauuaccaaccaugacuucccuccuuuugagugagccccaaguacaaugaaauagcuguugguugccacuaacuuguggguacacuucuugcaccuccauccugccaugcuuucaucguugugguucauagguauugcaucuggguagggcuauuuaaucccccgccaccccugccucuuggcaagcuagacugcaagaaagaggcuuucaggucagauccaagggaagucaucuaaaaguguagucuccaguuuuccuuaaagcugggugguagucuguuuuguguaugcaucucacuuucauuauccauucaccugguaaaggacauuuggguugucuuccuuuccuagcuauugcgaguaaugaacacagccacacagccaugugagcaucuguggagugggcugcugaguccuuugggcauaugccuugggguggucuagcugggugagucauauggugcauuuaucuuuaguuuucugagaauucucauauugauuucuagaguggauaacuuggauuauccagaguagcugcacugauaaccuugguauuugggggcgggggguagagauuuauguggagguuucauccauacuucagaugaacccuacaguugguuuuuguuguuguuguuuugguuuugcuuuuuguuuuugccccacuaacccaauauuuucugaggaaaggcaauugauuugcccaggagcaguuuauccugcuguuaagcagucuccuggacucguuacucucuuccguuuagcuuugcuuucuaugucugcuugguacuugaucacauuggcggccauugauaagaaucaucuccagcugacugaacugcucacgcucagcccauugcugguagccgggaagucuucauaugacuguaccuggcuguguccuuugccacuacucggguggggcccaguagauucuccaucucccuuaugcuugcucuuucccauccuugucaaaucccagagaccagcacuuuaucuuguccugguuguuugcuuuuuuuuuuuuuuuuuuuuuuuuuucugaaaaauaaaggacuuacuuaugagaggagggaaggggagagcugcgcuucgggguuucuccuguuguaaauuuaagaggaaagaaagaacaccauccguuccuguaaaauuccugccauaaguuccaggagcugugugcacccgcagcccccugguggcucuaagaaaccuaaaacucuaguuaccguccaccagccugcccuggaaggaagcaggcucgaccaaugcauguguaccgaggcaggcgggugcugguggaggcgaugcugacucuucaaaguaaauuaaggaacuuuucacauuuuagagggggaaauuggcaguuuuccaagcggcauaauuacaggacaguguguaauguguaauuaaacuuaacuaugaagcaaacgauuggaauacagcuugcuggaacaucauuuuuuuguucccauggcacugacagaucuuccccuccccuuguccccgaagcagcuucugcagcaauugcuucuaauuuuuuuuuaaaauaaaauuauauguugccaguuaaacacacaguuucauguaaaggagccuuuuucacuugagugacauuuuccuucuaggugauguggagcaaagauucagcuuagaauagcaaggaccucacagcacagccuugcaggggcuuaaaaaaugauucuuugucuaauaauucauguaaauacuuuuuauuccugccucuuauucucuuauucucuuauuuucauucuuucucugaccaagggccaugguucagagguuuguuuuuauguauagcuuuuuuuuuucaugcuuuaaaaauagcagcauuaauuucguugauugugaauaugcaagcuguuccugccaagcaaucgggaccccuugagagugugaaugcaugugauuagauuuacuaauugggcuggaaagcacaaagucugacucccaaagccaaauauuugaauggaaugcuucaguccuuaggaugagaucauuguuaaacaugggccuggauuauuucagaggacugguccccuggggagggagggcagacacacagggaugugcugcuggauucgaugguuauagacugccuguaaaccaccugccaccugcugucccaccugccuuccugggcccuucacuuagugucugaaaucucaguagcucugacuuaauauggguacugccugcuucggucuuucuugguugccgaccaagaugagagguucaaaguaguccacuagguuuuaugcaguccucuuccuaacuuuaaaacaccaggaaggguuggcaugaugcuuacauaggauuacccgcgugggaggcccugaguuaaaccuauugcaacaaacagaagcgguggacauuaaauuguugauuuguuaauugaaauaaauaucucacccuauggugaacucuaugguuggcacauuccaaacacagguccacugugaauucuaagcuauagaaggcauauguguggcugccacccucauggcccuguuggcauuagcuacugauuuucaggguacuucccugguuuuucugccucaaacccagucuaguuuuucuccuauauuuuuuuacuuggugauuugacugcauguuugcugucucucugcuuuaugaccagcccugcuucucucugcuaaagucaugaggcuucuuccuucaaguacugucuguauaccuggcuuggaaacuuccaguuucuucccccugcauggaacccauugccacccuguauuguaguugcaguggggggaguucagaagguaacaacgcaccccugccuaugcccaggggaggggaaggguuuauagagagauugaaguuuucaggccuucaugacuuuuuuuuuguuacuucucaccgauggccuuugcauuugagggcaguuucaggacuagagaagaauuacucucccguugccuugcuggaauugcuuaaccuugcagggagguuugcauugagaaaucaugucaucugugaacaaauacagcagaaucauuucuuccuuucuaguuuguagcauuuuuccuuuuacuaccuuaucucauuaccuaugacuaccaguaaacacuaaagaggaguggugggggaauaucauugcaucuaauuuuaaggagaaagugaugggugucccacauuuaaguauguuaucugcuguuaguuucuuauagauguucuuuaccagauugauaaaauuuccuuccauuuuuaauuuuaagaguguuuugacaugaacagguacugucugauguucaauguuuuuauuuuuaauuuauugguauuaacauaucuugaacuugauaaugccauguguuguaucaauugauuuucaauucauugcgauguguaauucuuuuuauucacagauucuacuuaauauuuuguagacccuuuauuuguagacugucauuguacuauacauugcauaauaugcacuuuacauauaauugacauggccacaaaagucaggagugguguguaaccacccacuucuuccccaccgccaucccguccuuuacuguggcaaucaccagcauguuccccaugucuaggauuuugucauuguuaaagaauaguucacgacugcagauagagucccacacugggcccaauucucuacagaguucagguuaucuguaacagggaugcucccuuugucccuuugaagugaugcucacuguacgacacaguuugguuuacucauuuuacucacugacaaucaugauucauuuguaggccuuggugauaaauguucauggaaaaaaaaucaucuguguuaaaagaauuguccugaugcccugauguuacaccuuugguuagguguucggguguuagggacucaugagagaguuuaggaaaggguccuuugcucuguccucuggaguaaauuguagggagucaguucauaccauucccuaccuauuugagaaaacucaccagugacauugccugaugaugccugguccuuucugguuagggaggauauuaauuauugauccaauuccuuuagcaggucuggaaguacucaaaugaucuguuuugcuacauugugccauugagggaauuaguccuguccuguaaaucuucagcuguaugaccauagagcugucugugagauucugcuaccaguucagggauuccccaguacagcuugguucaguuuucauauucuaagugaaacagugauuuguuuuuucuccaucuccuuaggcuaguuaguaugugauaauugugguuguaacagagucaacuuuccauuuccuugguguuucucuacuuugucuuuucaaugucacagauuucuacuccagcuuuuauuccuuucuuuugcuuguugguguuuuuaauuuuuucuuccuuuucucccuuaagguguaaguuuagaagugguuguuccuccugcaggauuuuggcuuagcuaaaccucuuugggacuuguuucgugggagugaauaugguuuacuuuacaguaucuucccagugacuuaauuauguaugucucaagguugcucuucaucacaguacggacuguuaucugaauauccagcagcaaggccuguugccucuacccucagaaaauguccacagccuacuuuugcacacucuaaccucccacccauugcugaaauaaugcaucucaucagcucucuuuccuacagucuuagagcaacucacuaguuagaucucccugcauccagcuuuccucccuugucugcucacaauauguuaaucacacuguuaagauacugccuugcaaggcuggccaaagccuguuccuaccacacugacaacccuuguaguucccaucuaacgcaaaauauaagccagagcauccacuauagcucaucuacgucugcugugugcuuuuccuaggaacgacacauaguccacucacccaagguguguaacaaacaacaacacagauucugcuaaggucggauguggugaacgagugagcuugguguuauuuacaggaguaggggugaugggcaauccacaagacccuggacgacgccaaagcaaccacaucaccuaaaagcucuucccagcaugggucaugacucgcagaagcuacugccuuggaccuagcaaugggcagcgagauaguuucaaaguccucagacuagucagauuuaguuacucccgagucuucuucccuccucccuccaagagugaacuguuuggauucugagaaauuugcuacacaaaaacuuccugugacuuugccgucucuacuucugucccacucaacuccagacacggauacauugugcuagucauuuugggcucacacaacuaaauaaucacaggcugguugacuuacacaacaggcuuguuuccucacagcuaggaagguuggagguguaggaucaaggugucagcaggguguuucccuugagguccuucucuugugacuacuguauagauaguugcuggaugcuucaacagccccaagcuggugcugaggaacaggagaacccuuggagagcugaugaucuguaguccaaguuugaagcccagagaagcugagcucugacugguggaggaaugaaacugcagaagcagcagcaaaugaaguagaugaacuugccagugagacauacaaguaaaaaaaaagggcaaaaaugaaguguaucccuuggaccguuaauguaggauaucacuggaaaaugcugccuacauuuaggacagguguuuccacuucaucgaacuuaagaaaagcccacacagcuuugaccaguggauuagcugauucugguuaagccgagaagcaugauuaacccucagaacaucugacugcaaauuugcuauuaccaacuacaggaaaauagccuggcugaucugcuaguuuuugaaucgugauguucuuguaccacaggacuugcacaugcaggagaaauggaauaugccuugaugagcaggucaggccaucacaggccugagguuugaguggcaaggcguuaagcaauauguaucuuccguggaagaaagccauuacuaggcgcuggugaggaauguuggcaggagcaggucuugaccacaagccuguugggaacaccaaauaucauauccagcacugcaucaauagguacacaaugggcgggcgcuguggccuugaguuuccuccuucuccuccucagugugggauaagucuuuaaagaaaggcucugaaaugagaaaaauuuuaaaaagugaagaaauuuugauaaauuaaucugagauaccugcuuucccuaauaucucaguaucuguacuuccggggaaccaaaaccagaccaccucucuuugauacaaggaugugcagauugaagauacaggguucuuuccugagggcauaugaagugguucaagagacuuccugggaaagggacagauaucaguugcuuuagccugcagcauuuucuucccuuccacauuggucggcagagauucugauccuuuauauacgaauugggagaauucucccugcucaccgagaucauucugaauuucuugagugccuccauucuucacccagaagggcagucuucaggcaaggaaagcagggugggcgcagggcgaguucuagcuagacuaggagccaugguaucuaagugcucuccugugggugggaaggggcaggaaagcccauggggcauccuuuuuuuuuuuuuuuuggaagcaaauggguuuuacuuuguucacugacugcaggggaaucaauguccaagauugugauucccccaaccuuacugugauucccaugguaaccuuugugggugguugggugcugcugcggaggaugcaggugggaggugcugggcacaccuccuuuguuguggagguguccccaacucccaucaugguuuguucugcuucccacacagcauuuacaggaagcauguauagcaaacacuggccaaguguuuuccagaaucgcacaacuaggacauuuccacacauuccagccuuauauaaauauuuauuucuucaccauacauaaaggaggucgagcagaauaucaugaacaggccuuggaaguguagacuuuggccgagugcggguuggguugugcauuucuuccucuacccaggcacaucacccgugagggcacagcaggcagaggcagucaccaccaaugguguucaagaguguuuuccuccagaaccuggcuccuaucuguggacacgugcauugaugagugcucccagggcccagagggagucucgugacgaagagcaggguuggaggucagguacgcuccacagaaagggaaagggagacuauagaaggcagagggcaggaagguggcuuugucuuucuguacuaaagaugcagggaucuaauuuuuaaaaaugcagagaacauacagaaauggcagauuaugggagaauauguggaaguuguguggcugacuuccuugcaaaugacugggcugcugauucuaugcacaacuagcuccgcugagacgagaaccauuuucuucauugcuuacucacuuguguaguaacuguauuaguaaauuccuacugcacccagcacucagcugggguaaaaacuucacagguaagauggcccugucaaggcugaucccaccaggaaaaccaggacacacaacacacacacacacacacacacacacaugccuucauccaaacuggagacaaaauaggaaaauacauaugacuaauacucuaggaaaagagugaauaaagaaauaucuacaaaaagaaauaugaagguccauagagcuuuagaggaaggaguuugcuacauccacuccaauaucguuuuguuaaugaucugcauaagaguauuucuguagaauugucagagcuacauauugaaagaaccuaguggggaaacccccacuuguaucccaagucggcgugcacccaaagaaucacgagagaccgucuugaugcaaacacaugaggcaguuuaaugacagagcuccagcggacacauaucucacacaggagauagcgauuguuggccuugaggcucaaacgcuagggguuuuuauagaaaagggucuggggcugggggaggaauuggugugguucacaugauugguucauuuaaacaucagcaaacuguccgugcagaucaagguaacagcagagcaucugguuaacauuuaacuuaggccagaagggcgggagauagggaggcaccaggccaguucggacauucuuguaugucuucccuaucuuuauggcuaguugguucugggauggcuuuacagccuuuguucuuugcucuaggcccaaaaagcccucauaacuagcaagcugcacgaguauggaccuugaauuuuaauuuucuuuuaauauuauagauaagaaacuggaggcaaaggucaaugcuuuaaaaaagguaguuuuagccacagauugagacaggauauagcaaauauuaaggcuagguuaacagaaauuucagauaugagcagaagccauuuggauacuuggaacauugaugaauuggccagagauuuaaagaauaagcuaagugcauugaaucccuuggauuggguucaauauauaaucuugcuugcuauuauuauuggcauuauuuuauuaguaaucauugcguuuccacucaucuuuagaguucuucugagaucuguaacuaccacgaggcgggacauucuggaacuucaucuaaaaaauaaaaagcagggggaacugcuacauccacucgaguagugacaaacacaacgggccccaaaaaccugggcgcugucccgaggcgaaaaguucauggaaccuuagucuccuggaauuguggcauccuguauaaagaaugcuccaauguccuugcuuuaguugguaaacggaucugugugcuuucccuuaauauugcuuuauuacaagugcuccuaaggauugauauuuugacauauagcuaaguuagauuccaggcaguccuugauccgacccuggacauggauagcuaaauuacugcccuacacaggaauuuaccaucaucuaggaagaaggaaguuugugguuuaaggaggaaccaaaguagauacuuagaacuauagauagcugauuuacacccauacacaaguauuuacaauggccuaggggcaagguggacuauacaauagacuagaauaggaacuguggcaagggcacgaagccccugccccuggcuucuaagauuaaguggaccuuagguagagcugcuuuugaaucccagguguuaccauugaauuuuaucccaguugguucccaccaguccuuccguguuugcauuccucuguuuuguguaagaauucgguaaccucauuguaccuugcaggugugucaccuaacuucccuauuuucuucuguauaaaaacuuugaugcucgauuugacacauuacauucagauccacacucccuugugucgagucuguuuguuaccccaauucccgucaacucuaugcccaucugcuggaaccccugauucccacggauugaggggggccgaucaggcccgguccauggcaggaauuguggaaaguuuuauugaguaauuaccauaugaguuauaucuaauaggaagugucagggaagggugauuucuauacaaaagguccauaucuagccuggcuccuauagcaguggaccacuguaacaggauccuuuuaucagcaaaauugccuaagcuuagaaauucuuguacaggguaagaugaaaagccauauggaaaccuacuacuauagaagcuucuuaaaauauauacauguauguauauuaaaauauauccuuauaugggaggaaccuaaaaggaaucugcaaugagagagacaguuccccuuguagguauuuuaugcuaccacuucaaaaccaacagggcugggaaugaguuacagcuuccugacuuuuuggccaaaggaaccucagugaaacucuccaaacaucacaggcuguugccaaggcuacuguuugcuguccacaaccugaugauaaugucauguugcugaagauaacacucguguuguugaacaguaagaggacaagcuugugccuaaacaggcuucauuccuacugacuaggauaagauguaaugggaugagaaccguuuaaaaagcuagaucucauaggacaaugauuucuuuuuccuauucuuuaaguucaggucuuucugcuugaauaguuauuagcugaaaaaauuggguuuaagucaggaacuuuuucauuguagauagcauuguaugugauaaucaguaaacauguucugcucaaaaauguguuucugaaauauccaucuugucuguccagaagaaaauaaauaauaguuucuucccccauuccuaugcccucagauccacucuccugagccagaguggauuucugaacauagucuugaugcugggauuugagaggggagcuuacuuuagaagcacaucucacuggcugagucucucacaagagccucauuuaguaaagcaagcucugucagaacaugccucugacaguacacuagaggguagcuuagcuuuaagagaucuguaauguuaacacacuggugacaguaugaaauuggacuucagaaaugccaggcuuacuuuuucauuuaacagcgacuacagacagaaccaaccucacucugccaacuugugccaucuuugcuuucaggugucggccauaagaagaauuuguaaucagucacaucauaugaacaagucauaguucugcacugugacccugaaaucaccccuauuuugccaguauggcagaggaccucagccauugcccuuccuccaguccucacucuuccaguuguaaugugccuuucuuaacauauacuguggcuaaccuugguucaaaguggcaaagagauaccuuagaagagauacuggcaaccuuucuucuccuuugaugcugaacuugggguuccccucugcaugcaucuuugccugcuugcccuccacaccucacacgcaccucuacuauaaaagugguacugccuugccuuguaggcaacauaaacaacuaaggaaguaugucaaagcaaaggccacgaaauaaaucuguccacccugucuuacucuucaagucucaaaaucagccaaccccucaacuugcuauuuucuucaugcaugucuucuucuucuucuucuucuucuucuucuucuucuucuucuucuucuucuucuucuucuucuucuucuucuucuccuucuccuccuucuccuucuccuucuccuucuccuccuccuuccuccuccuccuccucuuccuccuccuccuccuccuccuucuucuccucuuccuccuccuccuuauucuuuuuugucuagcaaguuguucugcaauaucaaugcuuuuugugugugggagaggugccucagauguugagauguugagacuguucucugaaaacccugaguucaauucccagcaaucacaugguugcugaccaccaucuacugugaggucuggcacccuuuucugucuugcagauauauaugcaggcagaacgcugcacauaauaaacaaauagauccuuucaaaaauggugugugugugugugugugugugugugugugugugugugugugugugugugugugugugaauggaucaaagaguuguaaauggugggaaggugggggcgggguguggaucugggacucagcugcuagacugagggaacacugcuuuauauuucagaacguuguccuuaacuuugagcaucaguaucaccuggguguuugguaggaaugccuaccacagggccuagugcugaaucaaggccacauuuuaacaaggucucugagugaucugagaauacuuuuaaaauauggugggucugggagagugaauaccuaugaaagaauucaacacucgaggugucaaaaaagagaggcaggcaaguacacauguccuucaguaccccacgcacacaucucgcaagcacccuuuggccuucuguagaacucaucuguacugcuaccuaugcucgcccaucuggucacuccugaaauucagguagcuuguuccaaggaauguuuuucucaucugugaaaggagaaucucauuccaaagacuugugaggaccaaauaaaguaaacaugugagaguuugugcaugucaaucauuugauuuguaguaauuuuuuaaaauuuugagguaaaauucacaugccauaaaauuaggcauuuuaaaaugaacuauucaggagcgugucacacauuuguaaacucaccaucauuguuuaauuccaagacaugaucacugccuucaaauggccuuaaagaguugcugcgguuucccaugcucccuagucccagccaccagaucacaugaucucucuagugcuuuucucuccuuaaugauguuccauauuaguuauagaaaaagcagauguauuguguuuucauugguucucugcuuuggaugucuuuuuuuuuucuuuuauucugagacacgguuucucuguguagcccuggcuguccuggaacucacucuguagaccaggcuggccucgaacucagaaauuuaccugccucugccuccggagugcuggaauuaaaggcaugcgccaccacugcccagcuggaugucuuuuaacguaggaauauugcuagugagaauaaaucuuaagaggguagguauagaccgcuuugucuguuucuuacuccuuuuuguggugcaagguuccaauugaggaccucauucacacuagcccagugaugcaucacuacugauuccaagccccagcccaggaaaaggagcuuuaagccaaggauucccaaagucuaagcccaaaacagcagcagucauaucacaugggaacaugucaagauuacaggaucccagguucccaucagaaucagcgaaacacaguucuggagauagggcuuugagauugguguuuucaugugcuuccagaggauucuaguguacaaucaaguaagcaaaucacugcuugaaagcaguaacccuguacugaugccucaggugcucaacaccccuguacccauucuugggugcagcaacacacacaguggucuaggagagaugucaaagaccagcucugcaguggagugguagcaguggcucugccaaugcuggcuugcaggugcuuaagagggccaaguccuugacuucccucauugacguugggguuagaggccacacaaacacacguaacccauuaucccugcuguugcuugagccccucccuccaccuuguucacagaggagggccagcaucgagugcugugauugcuucauguguuccacaugucuggcuuuugcauuauaccaaugugcaaggagcguuucuuuuuaguugauuaauguucauuuugaggucuauuaugagccuccaggcuuuaauuacuacacuauuacccagucgauuccuugccauuuuauauuuauggccuuuauuaugccuugguauguguaacugccauauuuauucuaaaugcauuuuaccucauuaaguggguuuuauuccauuuuucucauuuguccagguuguuauuuaucucaguaucccauguguauuuucugcuuuugcuuuuucaccaaucugaccucucaugaauucucuuccucuuuucccucuuugcaugugucccuaucugcagcgugacaaugguguuguacuucaguuauacauccugugagugaaagaaggcaauucgagcaaagcucuuagagcaaggccugagagauaagcucugugguugcaaauuagcauuugcugccauguguaggacuacauuccuaaggcuuuuuucuuuuagguauauuuucucugcagccauacucccucaccugcagaucugguaggcaugugagucuagugugcuggcagcccuugauucugacuuggugugguaugcuggcuugcauggaauaccuucuacaauuacagagcucuuguuuagcccacuuaaaaauuacccuuuuaggacuuuggugguuuguuugauccuagggacuugccuaagauuuaugaucacaauuagccucuuauaccaccuuauugaaguggccuggugcucuucugaguaauugucucuggcuuucugaggaccagucauccucucauuggagacaggaggaaaagugauucuugccuggcugccagcucuuuucaagaggagacaaagcugcuuuccccuuugcccuuguaggcaccugggucuggagauauaacauuauucagugugucugcugucauuaaugcaagugacacuuguguugguguguaugaaagcugauugguacacaucaggauuuccauuuaccucucaguuugucauuguguaagacaggcauuucucuaucuagguagaagguggguuuuaccuuuauuuucaugucaucaaggguucuaagagcgaaugcucuaugguggcucugcaugauuaguguuaagacuucaaugcaauaaacagggugucaugagggggguugcucagggguuccuuacucaucuuugugcuaguuccuuguaucucuaggguggguuucugccuaaauuuggccugcccuuccaguguaaguugguaagagcacaagcagaucuccagaccucuugcacuaaaaacacaagaaggcuuccggcuugcuuucauguguccccagaggccugucaccagaaagguaaucuuuuacaaucacuguuuuaguuuaguuucuacuaaaaguguugcacgaaauguuggccaggggccacagaggaaucagaaggagggguggaauagagaaaaugaacccagacucugugaagccuguuucgggcacguugcuuccacaucguggcuuuucuggcauaggagucccauaaauugaguguugugaaauaucuguagaccuugaagacagugaggaccucauugagccuccucacaccucaaagugaaagcaaggagauugagacuggaagaaaagccccccaugaugacagagacauuaacgcacaggagguuugauccagggcuggccccaagaaccccugaguggacuguacuuggccuaguagauagaaccuaaucaggaaguggaaguguguaucagagccagcauccuaaguguuuuuguucaccagcaaauggauucuggggucagagggcaugcacgggcaguccugucagucggauauuugcagcacaggcacugagcauguaguaccauuagucaagcccaaaucaacugggucccucaucugcaacaguuugagaaacccggugggaguggggaggauguguggaaaugcgugaggaugcuucaacaacuuugauuguguacccugaagaacagaucugcauccuuagugaauaauggagauuagugagaagugucuauuuuagggggacugggguuucugaaccuacuuuaaugagacacagaaaaccaacccauaaaacuucccuuggucuaacugggccaaguccacugauguucaugccagguguauaaagucagauuauacucucaagggguuaggagaguuugggaauggaagaugaaaagagaaaaaaaauaauuuguuugagauaguggcuaucuguguagcccagguagacuuugaacucaaaauacuccugccuaaggccccaagugcugggauuacagguagcuuguacuaccauacccagauaacacuuuaagaauugaauuccaagccggacugagacuagcuaugaucuagaauucuuccuuuuaucccaacagucuugagaggauaauaucagcuaauguaucccuccuuaguacuguggauaaguuggagaucaguugauagaccacagguguaaagacagccauaaacuagaaacuauauacaguucagguuuacacagguauacaguguucuuauuuuguaaaacaaauuucuuuugguauacuacacauuguaagaugggugauagcaguaauuuuaagauuucaugcaucauuugcuaguaccacuuuugcagaggaccucagucuguucccagcacccacacuggguccaucaguugcuaguacagcucuugcagaggaccugagcucaguucccagcacccacacuggguuuaucaguugcuaguacugcuccugcaggggaccugagcucaguucccagcacccacacuggguuuaucaguugcuaguacugcuccugcaggggaccugagcucaguucccagcauccacacuggguucaucaguugcuaguacagcuccugcaggggaccugagcucaguucccagcauccacacugggugccucacggcuuccuacaacuccagcucuagggaauucaguacuccugucuggccuacacaagcaugccacggaugugcacauauguuauccucacccccaucuaauuaaaacuaaaauaaauacaaauguuuagacuuuaauuuugguuucugucugugcuggcuacuuuuaagucaacuugccagaagcuagaguugucugagagaaaggaacuucagcugagauagugccucccuaagacuccagcagaaguuuagguuuuguucuguuuguuguuuuuggagacaggguuucuguguguagcccaggcuggaacuuccccuguagauuagguuaaccuugaacucagacauuugcccuccuuugccugccaagcguugggaucaaaggugugugccaccaauccuggcugacacauuguuagugauugauauaaacucagucuauuguaaguagugccugaccugggcugauggguuugagcucuaagaagcaaacggcgaggcacaaaccaccaggcagcaucccuucacggccucuucaucagccccugcuuacagguuccuaucuuaacugccugugaagaugaacugcaauaaggaaaauaaacccuuuccuccccauggugcuccaucagcagcaggaacccuaacuaagacacugucucagaguauaauuuaacaguauaggagaaaauaaagauuaaaaagugugcacugguacuuucaaauggagcuuuucuaaauggcucagguaggcaugacuuauuucaaaauacugaaguugaauauaguuauagaaguguguuuaaaaaaaaaaaacccaaaagcuacuaccaguuuaagcaucucucacuguaguaaaaccucauuaguaauaguuguaauaauaauuucuaaauuauuccuguaaagucuuucaccucaauacuuaaacagggaacuuuaaauauggugucugccaugacaucaggaaggaagguuuguuuuucuuugggcaaguaaauaugagaagauagaugaaguauuaaaaauaaagagaagggcuucuccaagugauuuacauauugauuacuuaaauuacuacuuaauuuagugccugcuaauaaacugcgccuuggaaauguuuccugagcauuuauuggcugcaguaauucuaccuaguguaugcggaucacauccucauuaaauauugaugcccucaugaaauguuaauagaauguuaaugugaaauacaggggaaugugcucucugggagccugcagcuagaugugagcuaccugucucuggcuuugcuuuaugcccugucuucuugcuguuuucuucaguuuguuuccucauuaccaggagauucacacuucuuccugaucugaugucucagauacaauuuuuuuuuuuaaaggaggaauaagauuuuuuuuuucugaucgaugggaaugcaguuguucuaccugccugcuuuuccaagcuggaauucucgcuuucaaccagaaugaaaucuguuaaaggaagugggguaggagagcuagguaugaggucuccggagacaacucacaggauacccuggccagggagccaggccucaaggacugggaagaugucccugucuggaaggacuacuacccugagggucugggucacugcacucagcaguggccuugugugcagauaauucagccuuugucuuccccuaaaugcucugccuugucaccuccauucucuugccuguucaucucuugacuucuggguuuccauggccacucaguacccacagccuucuuggguucugggcuccagaugcugcccuccagguccaggccccuccacucuguagacuagacagugugucggcauucugaccuucucacccaaggguuaugaccuggcucucucuaccuggcauguuuuccugcucucagacucagacccagcagguucuugaugaagaucugacucucaccgaccaaggaaacauccuugaccuuuugacaccuagacuugcaagcuuucuuuccuuguagcgugcuugauggauuggaacuucuuauuagauuuucauccuccucuucaucagaaucaaugcacugugaagucagggcccuaauguaccuuguuccuuauuugaagaagucuauccuguuaguuaguaggugcucaauuaauaugguugguugaaugaauaaaauacauuccugccacugacaagaucauagucuagagagguacauuaguuuguuuugugcugugauaaccaaauuucugaggaugagucacacuauacagaaacaagguuuauuugucucacaguucugggaugacaaacccacauacggugauggacuuuauaugcauguguguguacacgcacacauaccccaccggugucuguuuggucugucuaccuguuccucuuuuuccugucuauugcccccacccucuuuauagaaccaucaguauucggucauggguaccacccagaaaaucugaucugguccacaucccccauuacuguucccuucuccuaaacaccggucuuaaucccuuacaguggggauuaaauuuuagcacagccuugagguacagucagucugucaccaaacuauaacaaaggagaaacugaaacacacaccaaacagcagugcucccaggagaccagccacugaguggcugggcagcuuaggggauaguaguucagccuugcaggggaagaguuuccgccguagcuucagauaugacgaaugugguuuugugaaugaguaaaguaagcagccuccucaaguaugauugcuuuuguuggcauacgacuuuggacuuuauuuacuuuggagaguuguauucuguuuccguucuaucuauaugaaaaaugguucccuuagguuuaaauagcaagaucauuuugagcuagcuaaaggaggcaagagaauuccuuaugaaaagcggaauuuucagaagauggacugugaggccaaaccuugacuacagggaagaauccucuaauaaagaauaggggaccugggacucguagaugcuccucaguguuuauuuucugucaccagcauccauguaaugccauacccuguggaugcuaucagcacagguaggucuguuuccuuuauuccauuagugacaguucuuuucacuguggcauacugucugacugaaagaacugagggcaagauggcuuuuuauucuggcuagugacugcacaggugucagacuagcauggggucagagggcauggcaaaacaaauugggucacaucauagcagacaaggagaggagaaaaaaauaaaaccagaaagcauucaggggaagauaucacccacuucuccacccccagaaaccuacuucaucuagcuagauagggccugccuccucuguuucaacgccucuaaagcugcuguacuuuuguggcuucaucaagcuucaucaaaucuacacacugaauuugucaggaccuugugauguacucauuucuggaaaugccuuuaccgacacacccagaguuguguaccgcugagcugagaugguuuauauucuacugagcuuggcaagauaagcaaaccacucauuugcugaggaagucucagugaagcacugcagcuggucuaauugaugugguccccaggcaugguucagugagaucaugcaaaaacaaacaaacacaaacacagggaaccuuuagcaagaaguaagccacggaaguguuggaguuguacacaguugcuguuccugaacaggagagauugucugggagacaaggaagaaguccugucacuuaaguaguaaaucuguaucauuuugucuuuaaaaaaaaaaaaaaugcuucccaggcuccuaugugcugaggaaaaccaacaagccaagcaaaacaucuuccugaaggccagggagcuguaggaggcuugaaaaguaucaaagucuguguucucuguguucuauuuagccauagguggaggaugacccagaggcugucgugauccacuuuacgucuuucuuuggagcgagccuggagccuucugugucugggcacacucccuuuccugaccgaucccucuucucuccacagaucgugcuagagaacagcagccgagaagauaaacaugagugccccuucggccgcagcaguauagagcugaccaagaugcugugugagauccucaaagugggcgagcugcgugaguacucguguagaugccccgugggugcagaguuuagcagacccucagcuuccaagguugaacccccaccucuguguccaauucagagcacuuagaccuucacaucccuucauuauggucccuucucuggcucggguuuccuacauguguguuucugcauguuugcuacgcauagauagaugaaagacuauaggaauagagaaguuggcagguauuguggcaguuuccaauauuauaaaaaugaguacauauuacaacugaugcacuguuggugagguaagagaccuguggguuucuccuuuauucuaguuucuagucuucuuguagaccauuuccuuuacuuucucuauaaagaaaaguugagggcuggugagauggcucaguggguaagagcacccaacuguucuucuaaagguccugaguucaaaucccagcaaccacaugguggcucacaaucauccauaaggagaucugacucccucuucuggagugucugaagacagcuccagucuacuuacauauaauaaauaaauacaucuuuaaaaaaaaaaaaaaagaaaaguugaaugcuuuagugaaauucucuuucuaccaguguuucagaugugggaauauuuacucuauauagaaagaauuauugaaggaaaugaguagcugaaaaugaaaaauuggcuagagauaugcuuugggcucuuuuuccuacucacauuacaaaauuuaugagaggacacacagaaaaagagauaauaauguccuugccuguuuguucauugguacaaccuggcuuuaacauguaggcggauaugacuuaauccucuuccguuguccuugccaaugucaagucuccuuaaagcagcugauucucacuucuaccaucuaugguacuggaacaaacauauaaauccuuccucuuaagcuuaguagcaugagugccagagaagacugguuauaucaggaaaucgcuggggguggcaugugguucuguccugaaaagcacagauaauauggccaccuguuuagagaacuuaaaauaaugauguagagugauuaaugggaauggacuugaugauuaaauugaaaaaugaauuauguuuuauuuacacuguggagaaaacuacuguugagaacaaugggaaaauuuagggauuaggaaaaaccuaagaaguugagcuguuggaccaugcaggagccaagcaucguccaaccacugccaguuggguaaagaagccggccuuggcauggaccugcugaggaaggccauugccugugaggccucaacacugcagaguugcauuaggaguggggcagcccacucagcagagucugcuaauugacgcucuucacuguguguugagauuucauagggaucccugaugugaguugucuuuugcuuuccuaauggagccuguugucuuccguauggguuacuguuuguucggcuuaaguaugcaaguccuaaucaaacaacccccacguacucuuucaaucugauaacaauuuuguauuuaucuugguuuccuggagggaacuguuuaaagucauguacuuacaagacuaucugaaccucucuauuucuagaaaaugcagagacaaggauuuccauguucaaguuacuaagcuccauugcuucuuuuucaccugcucuuuccaucuccccaauaccauacauuggcauuuugaucucaucuugagggaaccagagaguacacuugugcugcgauguucugugcauggcuuucuguucuucuccuucgcucugaugucauacucuucccaaaaaugggcccagugucggggaaagagauguuggcaauacagaaaugcugcauucucucugcuaccauggugucuauggguaauuacucaccagaguaaauggcucuucuagccauuccugguaccuauaaugggagcauuuggggugaaggacugaguggugucuuuacuuuauaacugaaagugcagaaacaucaguguaucaggagccuguuaaagcaaaaugccggaaggggcugucaagggaggcaugguuggauuuuagaguggguuguggguaggguuacuguggagcugaucugaggugguccuggggucacugcggcagucuagguaaaggaaaggaacuguggugacaggagucugaagucacagcucucuaggaagucucugcacuguguagcugaaggugauuuggaagaggcugcagggaccagccuuuggcaauguagauuugcucugauagcucuuagagggauaauggugguaucccucuccugggacggagaugauaggguagagaugaaggcgucuggcccaaggaccuggcacuguggugcagcugcuauucuuauaucucccaacuucuaaugaagaaccgcccuuggcauuccauguagcucacacagcgaguacuggaguugccucugcaccaaggcuggguuugaguggcaaaguggcagaacuguucuuucaccuccgauaaggauuuacaugcauucacucaguuaaaaucuacugagcuuuuguaauguguugcauacuacagcuguaggugaagcagauagcgugucucaccacaggaacuucuggaauuuucuuaaaccucagaaagugaaaggaugggcugggacugucagcuuaccugugauuuuuaaauuuaucauguuuuaaaaauaacgucuauuugugauacaggccgauguuucuaauauuuggauaguuucguguuuaacuuccaaucugaccugcucacugucaucuguaagggccauucuggguaucuuucaaagcuugcaaaguguuuucacuucucugaagugcaacaugcccaaaugacuuguuuucugcucauaaaauauaaaaggacggcuacacucugauugaaugcuggacaucaaaugauaaaauaccccaugguaagaggaaaauugcuuuuuuaaaaauggauugccuuuugcucagugccauauuaaauacguuacuaauaugaaaaacccauuugaauguacccuuauacugaaggagacgccuauuuuucuucuucuaaggcaaauuaguuuccaugugcaaauucaucuuuucuuggcuuauuugcuuauuuucccuucucacucuuaaguucacaguucugaagaguucucagauuugugugaauaauugaccuugaaaucuuggucaauuucacuguuagcaaaugcugagaccaaagaaaugcccaguuaaaaaaaucuaaccagagagagcaaaaggauguuuauaaguagaaagauuuaauuuucuagaaauuauuucuacuuugauuuuaauuuuaggucucucuaggaaauuuaguuuggaagugccaauuauaauuugguaucuaaagcaaacauuaaauuacagauaccaaauauaugugaacauuuuuuuuuuuagguugcuuaaguauauacacauacucuucugcuuccuaaguuauugggaugucaggaggcaaauauuuucucuaaugguauggcuuaaaauaacaucuauuucuauucucagaccacuuuaucaagguuauuuaacugaagucugugacacucaaaaucaauaauaucuauguuuauuaaugaagggagguccucugaugacauuuuauggaguuacucacuaaacuggcacucaggacguccaggggacugcagagagugguaggcaaagagaaugguggcauuuggacgucugaaggucccaaccuggugcccaguccagccacuuguugggugucucuacaugcucuccucuaucuauauacauaauaaugauagguccccucucuauaaacauacuacauguucugcaguuguuggagcuuaaaugaaaucaugaacauugcuuuaguggaaacaccaguaggguucuuuuuuuuuuucuuuuucuuuuuuuuuuucuuugcaaguggccuuaaccugaagauuaaaucggugguugggggugggggggguguuguuucuacuuuacugggagcuagugcaaugccuuuguuucuuuauucuacauacuguucaaacuuacuagagucagcccuccaucuauguggaauugggacccacagaaccauccaucucuggauuuaaacuauuuggaaaauaaauuuuguccauacugaacaugcacaaacuuuucaccuucugauuguugucuaauacaacaauggcuauuugugcaccauuuacaguguguucauuucuauaggcuauguagaaaucauucuaagcacaugggcauuuaugcacaggcuacauccaaacgcugcaucauuuacauagggcuggggcuuggauuucguuucuaauggguuuaggaugugcuaccucuaugacagaaaagcagaacugcauucuuuucauccugccuucuccgugaggcuuuuuugagaggaagacauauguuucccuuaguuucagcuuuagaagccacaaagaauccuuacaaagcuggauaugaucacgugcagccagagucaguguuguauauuugucaauccaaagaaaagaauaaaacugaguggagaaaaagaguaaagcguucaagauauaaaagguauuuauuugcuuggaguuuuuguagaugacuggaaggggugguaccccuucuuacaggaggaaggaaggaagcaaacccauaugauagcugcagaccugaguccuugggaagcuauuagcucccaauagggagauauaaagagaugguugcguuguuuuuguuuucauaacauuuuucuucaaauaaauaaugaauuuucugauauaaauugaguaacugcuuuccuguugaaccuguaauacauugccuauaccucaccacuagcuguggggcaucuucucuauaugcaagaaucuuagucaccgugccaugaacuuagaacauuuucugaaaccucaagcugccugcaggauaacuggagcacccgucacaugaacuaaugguuaaaauucauugccaucuauaguauuucauugauggcagaauaauguuucuaggaggcaguguuauugugaauggguagagguagagaagguaugcuagagagacauaagagcuuacacauguggggaccaaagaaacuaagaauaacuccaagaauauagacauguaggucuggcuagagagauggagggaauggaugcugaaaaaucccaugaagaaacuagguggaaauucugaguguucagagaacucuaguucuauguaguugaagaggaggucuggggagcaagcuaaaagaggagaugccaguugcugaugcaagugaaguuguugugggaaauaucuagagcuagccccuguaccaggugaucacacucacuaggucucuuugccugccaacuugccagcccugcuaggcuauuuggcucccaccaguccaucucuaggaugcccccccuccccaguuccucuugcuuucacacaaugccccacgcaccacugguuagccacucuuacugcuuaauuagccaaucagauuuauguaucaauaauaacacaauuuauaagaugucaguacaauaauuucagagccaaaugacaaugauaaagcuuuaacacaauuauucuauccuuuugauaacacuacauuagccuguauucugguucucuuucuuccacauaccucucucucugucuccucaacuccucacucugccucccuuuuccuguccaaucacaagccucccacugccuuaaugugauuggacagggaaaauccugcaacaugaaaucauaaguauuugucccucagagggguuuggacccgaccauaaaggccauggcaaccaauagaaggauuugauucacagagggcuauccucgucaggaacaucaccuucuagaguuugacuguuuauugggugugaggcggacguuuaagaaugaugauguguagagccaggaacagugccaagccgacauccgacaagcuuccccaauaaugcagcagugcagaugauuccagcuacagccaauugaaaucccacuugauugcaugagggcagagucagcagguccgaggcuugauuaaccugugugcggaccuucaagaaccccagucccuccauuagugcucugcugcuagcagauucguggcuccugacacaugucccgagggucacuuuucugugugugaacauguuucuagaagucauccacacacuccucuccauuaucaaugucugauaccuuggccucugcccaccucgaccagacaucagaacacggaauggggcuggcccaggccagaccagucauugcugcuaguuagacuggaaguacagcaggccuauccuuugugugugacuaccagaugcccaucauagcuaagagcaccagaguucuguucugauggagaaaugauugaugucuuggaauauuuucugcccuuauaugugaaaagacuuucuguauuuuucuuacugauguacuaaacuacaacaaauuauggccagauuacugccugucuugugucuccuggaaacugggcaaaugcacuagaguuuuuuaauaugacgauauuaaagauugcugaaaaagggaaguagagguuugacuauaaugcauuucucuuucaucagcaagaugcaagggcuggggcuccacuccauuacacucacgcuagcaaauggguguucccagugccucacauaaucuuccguguaucgguccaaguugaguucugaaggacagauggacaccuuuguggugaaaggguccauaaugccuucaguuuugcccuguuuaccuccauaaccacuugcaauuagaucaaauaacauguucuauuuagagaaauuaaugaggaggaaacuuagaucacacuaugaaaauaauaaucacuuccagaccgugucuuuuggggcaacauuuauucaaacaaaacaguggugcugaguggagcaucuugcuccauuuaucaccuagacacuugugcuuuuuaacaaguaaaaaagaacacacggagcacauggaaguacccuucggccugcagcagcaauuagaacagacucuuaacucugggacauuggugugugugaacguugagugcaacaauccaucacuuucauucuuagucacaacauucuaguugaagaaaggacaagaaaauuagauuuuagcaauuacaucuauuaaggucagcuuccucuccacacacuagcuugugcgauuaacccuuagaaagcuaagcuucucagaccuugguucugccuagaguuuuuauauuguacucaacuuucuuauuaacuuucaacuuuugaaguaaagaggaaagacaaaguaaacacuuaaauucaaauauggcuugagaaaaccuauuuuagcauuuucucuggcauucagagucuaaauuccugagugggcauguagguuucugucaggguggcuaaccuggcucccucuuuacccucgacaucugggacaugggaucaucacccccuucucuucccccuucgucuuccuccucugccccgauuugaugauugagcaaggagcgaagagagaguucucgguugacugugaagugcucgugugcaggcgaugaucuucaucaggucgugcacacacagaccaggagacacggcauaucuggccggaaagccagcucugcugcgccgcauucugcaguucauaaacguucagcuuugugguuuguuuguucauguuugcaaggguaaugcuacauaggguuucuggaauuacaagaaaauguuuguccucaugagauuggacugugaacagaaacuugacaguuuaaaaggacauuauaccuagcauaucuccauuacaaauagaggaaaauaacuuauguuauucugggcuuuuucuuagcacuuacuucacuuuauacuauccgugaaauaacaugugaacuggaaacaagcagagucuauuccuguugccuguuugaguagauuucagauugugaagugagccugcagguuugcccagcccugaagggaagggagaugcaggccuauugagaaagccugcugugccauagaagcccuucucgaaauccuucucuccaagugccccuccagcaucaccugggcauggcucuccugaucucagcuugcucugccaugugaggcaucauucuccuugaaacaccauagcauuuuaccuuugucuccuuuguucuacuccugauuucuugauaacucuugguuuuguuuuguuuuguuuuuuauuuguuuuugaauuuuuuuguugguuuguuccuuuuuuuguuuuguuuuggugguccuguuuuucuugaaaugguuuguuuauacuuaaaaaauauaagauuuuuuuaaaaagaaaaacaauuaacacacauaacuaaauaaaaauaacugaaaaugauggugaguuguguuugcaaaaugcauguuauaaaaagccuuuguguuuaccuaaaauggucacuggaucugacuaaaaauugauuuguaaggguauguguauauguguuuguguauguguguguuuguauauguguguguuuguguguguguguguguuguuuuauaaaauaggacagggugcuaucucacuggaauaagcuccauagaaauccaaacacuaauuuuaauuaaugcuaaauuaauauuuguugacauuuaaucccaggaauaaaggauauuagaguaggauaaguccccccccccccgugugugugugugugugugugugugucugugugugugugugucugugugugugucugugucugugucugugugucucuguguuuccaaggauauaagccugaggauagccuuaggaaucuuccuuuuuuuacuuuuuaagguuuauuuauuuuguuauaugcauaugcauauuugauugcauauugcaccaugugugugccuaugacggccaaaagauugggucagauccccaggaguuacaggaacugugaauaguuuugaccuacuguguggguguugggaacuuaccuuuuguccucuacaagugcagcuggugcuuuuccacgcugagccaucagucagggccuauuuugccuuuuaaaccuugucucucaccagccuggcagauaucaaguagccugggcugccugaccccugagucccaggguucugcugucuccaccuccucagcucugggaucccagaccuguuccaucccuccuugcuuuuugguuauguggauucugagggaggaaaucagucucuccguuuugcaaggcaagcacuuuaccaacugaccugucugucuagccccaggaugaucuucuuaucauuaaaaauaaagcuacuguaaaccaacaaacuaacauauuuaaaccugaaaaaagguugaagaaccaaaguaggaugcugugagaugcugacauucacauuuguuauuuuaccguggucaggagaacacagcagagguacaguucaucaacaaaaacagugcuuuaaauuauggauaacaaggcuuucuaucuaaaacucccugaagaacccaaggaaaagcuguuaguacugaccuaaauuagaggguagaugcuggaggaaugaaauuuaguagauuuucucuaugucauugaugcuuaggucauuauaaaguagaaaaaaaaauuguggacgggguagcaaugaaaauaauccuaguggaaagccccuuagagggguaaugaaaauuguaagacuuuacuagaaaacaagcagauuccucauaaggaaauauuaauaugugaaaaguauauacucuguugcacagcagugagcuggccccuaucuuacccuggaguagcaaugggaauuaagacagaaaugugacagagaugauugaagaguucauuggauagaaaaaggccaaaauugcuaaugaagucuugauaaagaauaccaauaaaaaaagaccaauaaaaaacacugcauuaagcacuacagccccaaucccauggagcuuggcuuucagcuacuacagaagaaaaccugacaccagguaauuuauaaagagcagaugcauuccuucuuacuguucgagcacuugugaaguuaaacucauggggccacaucugguacuggcuuccuggagacugccuagauuugaaagugggagagcugggagaguugcuguaggacaguggggcauguuagggacugagcucagcacuucccaggaacuuacuaagacaauaccugacucccuaguaacaguaugauggccaugccuggacaggaggaagguggaagcggggugcuguaggugguaccugaaguccugugcuuaguaugcugaagggggaagugggagaggggcaagagcaguuuccaaaaaccuggacauaggaaaaucagacccauuugaauaaaucuuguuuuagauccagugguacucauucuccaagacuuugcagccagaaaucaccuguaaaaggucucaccucggggaaugagugcauugugcauuuaguuuccuuuggagacacagccaaaaucaaccuuucacccaaacucaaaauguaauucuuaguuuuuugccacaauuagaauuuuuauuuuucugucuguuuuucucugugucucuguaucugucugucuaucugucuaucucucucucucucucucucucucucucucacacacacacacacacacacacgcgcgcagugauuagauuaugaaaaauguuucuuauggccagcaggaaaaaaaaacccuuuuaaaauuugugaagaaacaguaagcuaaaaauaaauauaaaaacaagccuuucaaaggcugggaaugcagcccaggguuggugaaggcacaggacucugaguucaguacuuuaaguuuccacaaaaggaaauagacugacaaacaccuucagauuggacuugguucuggccucuuaucuguaagggaggaaccugcauggcaagugccccaccaagagaccuugaggaggaagaaggcagcaaagacugcugcugcuaagaaagugccucucugucaggcugcagcuuaugcugaccagcagagguuagagagaggcucucugccuccucuacaucagaggugugucucagggcccuucuuuugacaaauguauaccacuuucacuuccggacuaucauaacuuagugaauauagcuugccuaaaguccaugguuauauacaagagcagcugagaucuuggacauguggcuucuuaugaaaggaaaaucauuaaauagaucaaaaacauaaaauuaauagauuccaguccccaaaaaggcuguuuacaugaauauugucaucaugcuccaucuauaaaguaauccaaguuuuauaguuacuccaaaaaaaaaaaaaaauagguacuguugaauccucccuccccugcuacagugaugccagcugcuucgaauccccaggcuuugagcuguggggcuuuaucuggucugcuuguuuguuucuuccagagcaucaaguaccauuucacaauuuauuguagggucauuuagaccagaccacuguaagucucugaugagccuuagcagacgccgaccugacacccuacuucccccaggugaacaacgaggagcaaaagcaagaggaauuuauuguucguacgcuuuggugcuauccugccccagaaggagagguggcaaccucgggcagcccauuuggccaguuuuuauacaguuuucagcgguugaauagagcaacagccacuaggcacaaugugaauggcagaacaaugugacuuuuaaacugauucauccuuagggaaugagguagcgagggguucccuuaucuguggguaccuaaaggucuacccugaggaaugugucuaugugcucuguucuuuccucaucugcagguuggucccccuguggucugaggaauguaauuagccucucccuuccagaggggagaggugccuguguguucuaugaccuuccucuuccaggaggggaggggucugguggaauucuccaaaguuccugaguugaacuuuuucuucaccaugaccuccaaugucugaguuguaagaauuacauuaacaugaaagagaauauaggaaaaaaaaauaauaaagcaaaguuuaagccgaaggcaucaagguucaaacagauuaaaaacaaacaaaacaaaaccacuaaaacuacagaaauagcgcugaaaugaugacagauacuaaaauguaaaaauuuuaaacuaaaaaagcccaccaugaaaguuuuugacauucuggaaguucuguccccagggcuuagggggcaguggaagagagagcucugggacgccuguuuuccucauccuuagccucagcaggcagagaucugccuuguaggcgggguagauuagaaguaacuuuuaaaaagauuucuauugaguggauguuuucuaaaagguagagaguuccaaggucaacauuaagcacaaacuaucucugaggagccuuuuacauuuacaaaugagaaaccagagacaacagagaaaggugaggcagaugaaggucaagaggacagggacagacagacagcccccccccaccccccaugacucuugcuuuguuaacucugugcuccugauuuuccuacacuguccuguguuccuuauagacugcaaacuccuuggggacugauuuucagugaauucauuucucaccucaucccuagugguucauacacacagucugcuuucaagucagugguuacugcaggguuagagucacuguuugcuucaugaucaacuauaaaugaaugaguaaaacaaauaaaaaggaauaaaaagauacaugacuggucccgaguuucagccauucauuccggaugaaugaaaaaggaaacaaauaggguaagaaaggaaaaaguaugacuguucauagguaugguggaggagaaaguuuauuguagauaaaugggagaccauagucagaggcagggacaucugggagaauccagaguugccaugucuagacagagcugggccauguggggagaggaaggaagaggggaaagaggggagccaguugcggcaguuggagacccaaaaguacaaagagggugaguaaccaaacugguuggauuauauagggaagagcggcccagcucccuggacuggagaguucaagcuaagaggcuggcaaugccaaucaaaaggacucuguaacagucagggacucagggaugcugagagagccuggcugccagaucugcuucuauauguuaaauaggcaccuuggccuguccugaguuugaaaccuaacaaaaaccacaucacuguuuguuuguuuguuuuuuauuuuuuccugaacuuuacaucuuccauaggaucucucaaacacuuucuuguuucaaccuggcuggcagugagguacauaagggucucucuaaacuccucuccuccucagaguaauuuuggagggcucaauaaacaaaaugucuccguagauacccuugccuccagcaaggugcaugagcagcagucuggaggcagggggccuuaugcauggauggcugcaagccaaggaaguccggcauacccgaucuaguagucacuuggaggucagucagcacagcaacaggucugucucugaguggacauguuccuugcuucacugagaggauuucugaccuguuuggaggacuagaacaguaaagaacaaaguucagcauuuacucaagccuacuguggcuucccuuaauuuggauuuccaaggguuugggccacaagaacagauugcagcuguggccugagcaucuuuggaagugugaaucauauuuuuccuucugaagaagcuauuuugagcuuuauaauugcauauucccauguuguuguuuuucauagagugaguaagaggaaugacuugcgucuuuugaaaauggaagucugcuuucuuugcucuugugucuuauguaacccagucuguucugaccuugugauucaugaccuuggcuguguaucagaggcacuugagaaacuucuggggaacuugaaguucagcagagaaaucuagaggcuggcauauuaaacacacuuuagaugguuccuagguacaggacuggauuuguaccuacuauccuguggugauucggacugcaugcaagugugcauuuccacaguguacagagcucuugagaggcacuuggaaaacauggauucuauguuagcucacuacuaaccagcucugaacaugucucagggugguccucgugagacuccgauuucaaggauuaccaaugcccagguagcuuccacuuuuaaagcaaccgggaaacagacugauuuuuaauuuaacuaauacgauuaucuuaacuacugaguuaguaauacuaggaauuucccaccaaagguugcuucauggccuguguauuagccauguuuuuaucugagagaacagcuuaaaggaguuccagagagugaguggcuccgagcacagcugcugugguggucuggcacaggaugguuuuucuguuuguuuguuugcuuguuuguuuguuugcuuguuuguuuuccuggacaggaaacagaaugaaaggguccaggacaaaauguucccuucuaagaugaagacuugcugccuccaaccaggaaucuuuugcuaucuagacccucuugaaauagaaaaaugaucuggagaugaaguggucaacacacuaacuuauagggugcuuuauauuuaaaucauaaaggaguuuugauuuauucgaugguugguugguugguuggucaguugcaguguuggagauuggacccaggacagcaugcaaguugggcaaguugggcagcccaugagcugcauccccaucauuaccaccaucaccucuaaagaauauuucuugccuaaguuagcuaccgggcuguuuccaagagcauaaaggaaguacuuugauagaaguagagacagggcaguauggacccaggcagguuucaaucccucacuauuugcacacaguguuaaauaaguugugguuuucucagucugaaaaauuuccuucuuuaaaauagaaacucacuaucaguuuuaugaaguauuugggcgagaaggcuuucagauuuagguuauuuuuagaucuugaaauacuuauauaaguagauaaugaaauaacagcgauggaacccaaggguaaauaugaaauucauucauguuauacauauauacauacauacauacauacauacauacauacauacuacucacauagccugaauguaauuuuauauaauuucuuaaugauuuuauucauaagacguguacaguguagaauuuucuaccaugauguaauacaguugaccaacaaaauuugaggacugggcauggagugacacauuucaauuucaacuguuacugccagcaagagucauuugagaguaguuaauuuuucgauucgcaauuccauucuuccccccacccccacccuuuuuuguguguggagacugaacccagcacuuugcucaugcuaaguguuugccaucaacugaagaacauccuagccugcuccugucauucccuccugccaagcucauuucccccagguauucucaaaccuagacguguuguagguugucuacagaagcuuuuggcagggagugggguggggaaucagccuggguagccuaugagcaucuuuuuuaaaacuuaaaggaauaagaaagaauaauagaaagaggugauggggcagaguacagaugggggcugcccagugccucugagcaccuuugggcagaggauguagagcaagcacuuagcagcugcuggaccaaucugacacugcuggugcuuuccaacacaugaucuguuuucuagugauuaauuguugcuauaaguuuuaaaauaacauugguuucuaaacuacagguuaggaaagugaaacaaaugagacuuuaccacagauacaagggauaacuauuuuaaaaggaguauuuacaugauggaaaaaaauaaacaaacaagucagguugaaggguaagaguauuaccaccaacugggguuggaaaacucuguauguauuucuaugcucauaaacagaguaaguggagaacaggcaaggguguccugacagugaaggaggccugcaccuccacagcaacuuuacuuuucuuaaauaaugaaaagcgggagggagggagggaaggagggagagggggagggagggagggagggagagggugagggagaauucuucaauguggccucauugggaagaggcacaaaacaagauccagucuucccccaugucugucuucaugauuccugacagcagagugagguuuaaauggcaacaagguguguucugccucccauggcugccugggcggagacuguccuuaggggcuagucuccaggacgcaagcuccuccuccuguugccuuccccuucuucucucccagcagcagauuccugggggagagucugauuucuuggggucuacuguuucaauaguauauagccaaagagguagcauauugucccuuuagcaugacauacucauuucugccugaaagcucagaauucccguuucuuuaacaccucaaucuggugaaauaugaagcaaauauaaagaaaaccuaaguaggaacaaaggucagaacacauucggauauugucaagucauucuguguaagaacuguuuuuccauaaccuccuguguuuugguuacuugugaaagaaugggaugccaaaagcuacuacaucuuguugacucgagacagcgucuccacagaaaggagacggaagugggccucaaauguugcuucauguucucauuugcuggguauagaggugagcacagccaugcccauguaacuagucacucacaucuuuaucuuuguacuuauuuucacuggucuucacagagaaauguccgugcuguauccugagccagacaguauauauucucagcaucuuuucuacguuucagacuaaccuaugcucauuucugaaaaaucuuaaaaugcaaagaagcaaauccauuauucugccaccaaaauauaaucauguuucuuuccaaacuuuuuuuugguauuaaaacagaauuaaacuguacuauuuuuauauuacacucuauauuuaauauauugugccuauguuuguuuccacaacaacggagauauaaugauaucauuauuucaugucuggaaccacuguaauuaauuugauagacugcuuuuggcagcauauuuagagauguuuccauuuucugugagaaauaccacuguggugaacauccccauauuuucaccugguuauuuacugaggacuaauucacagaagacacaggcauguuaaauggccugaugguuuaaggcucuguuauuguuuggcacaauuuauuucuagaaacucagcaggguugcuccucugcuggccaggccucugcaucuagacacagcuuugacccaggguuuaaagcacugaugaaugguggguggagaaagcagucucguugguggugaaccugagaugcaggucugauacugagaugacaggugagucgcucauagacacugcgugauuggcaucuguguacaugguggagaccuguaugcacagcuggcuguagccaugccaugacuguggugggcgcuagaugauuuguauuuaugagaccuuuucucuguacgauguuaagcuuuguguuuuacaacugagcuguuauaaauaauagaucccaggcugaguucauuauuauauauguguuguuauuauuguuuuccuuuugacuuaaaaauaaucaguguuaaacuauuuugaggaauuucuucaaugguuauauauguuaauuaaacagggccuuauaucauaagaauaacuauuacucacgguauaaaaagugaaagaggcaaauuagcugaauuugggaguguucacgauugagcagaggagucaugugccucacgucuccuaagagcaguuggcuauaaugaaagacuuggcucuugacauuuaaaaagaauguuuuuuuuuuuaaaguaaaagcucacugauuucugcuagucuacacuuugcugcuguugcugaucucugugugccauugaugggugacacgcccugaaaccagucacugucauccauggcuucacaugcgcaugcccugaagcaucucccugcucauaagucuccugccugcucugcauguucacugcaguuacccuagcucccauggucacugucacaccuccucgugugcccccucugcacugucccugcuuuguccuacacacuagucuucuucuacgaucuagucagagccccacgugggcaccugcuucuuuuugggauaaauuccaugacugcuuuucuccuuccacacuucacagaucucaguaugaucugcuugcucuuccccgagggcucuuccacacucugccucuuuaguuuagaacacacuucuuacuuucuuuaguuuucccaauucagacccacaccugagcuucgcucuccaacagcacucuucuacugggcuugacuccuguccuucagccuauagacaggucucaccccauguugaaauugagucuguggguaccuuugaaauguauggaagacaguuaugguagaaaggugaauccuugucuguguagaccaugcuugaaguaguugauaguuaauagaccaccacaaucacauagaaaguagaagacagcgucagaugcagauagugcucagcagacucugauucuugcugcauuccauggaagcagcauuaggaaucuggcuaagaguuugcccuaacacacgguggaugauguuuguuggagacaggccaaacucaggaugguaugugccacuagcaaucagguaaagucaggcaccagcaguuggggacagcugugcuguugcugcuucuagugguggugcugguagcgauagugaugaugguggugguggcugucuugguggugaugguucuaaccaguaggauuugggucuuugcucuuucugcaugagucuggggcucaaguuucuuugcuguuccaacgucugaggaaaaaguagauucaaagcuagauaagugagauuuucaaguggugaagcauaugcgugcauacacacgcgugugcgcacacagacacacacgcacacacacacacacacacacacacacacacacacacacgcacgcauacgcacaugggcacgcacacaccgaugucacaggaaaucuaacucccuaguaaguaaguacauuugccccuccauuagcaugcugcugguuuucuugcagcugugaggggaaaaggagcccuuuguuggacuuuuucauuuuaccauauccuguuccgcagauugucugaaucuaaacuuagauaauagcauauuuucuaucauuuuuugaaucuuccucuugagucacgaccuugaaucauucaauuucugacuuugaauuguucaugagaugugcuucugggcauuuuaucucaaggaagaagaaacaacaggagcuggaaagaggcagucagguagauggcucuuuggaagacucaugggguggggugugcaauaaagaaaaucacuuuagugauuugugaauaguguuuuuaaaaggugaaguaaaacaauuguuuguguguacaagcagccaagguaagugucucauuauaucagguuuaaauucaugugccuguguacuaagguguguacagaauguuuuguuccguaggccacagcuggaaaguuuuagaaguccccucaaccccugcccaucauaagcaauucuccuugaaauuacuuauucaggagggcauugcugcucccacuauaauagauggcuucuccuuuucugguucagacauguuguuucccucagaguugaguuuugggaauggguuaccuucugcacuguaauccagugaggcuaguucucaucacagccaccugcuuaugagucucugagugacaacagccuugguucccaagguaguuccccauggaaauaacauuuagauuagaaaauguaaucuguucaugugacguauuccaugugugcauuggagggaggcacaagauguauguuuaaauaauggggcaaugcccauccuuaaccuacagagucauccuacaggaacgugauuuuaaaacagcugguguguuucucaauuaguucacuauuuuauaugaaagagaguauucugauucauauacuccaaaaugaaaagccaugacuuaaaagucccuuuguaaacccaggcagaaauggcucauuaacugauaaauaccuugccucuacucaacuguuucacacacagucaaggggauggaguaaguggggcaugggaaagcaauuucaaggucuccggcaauaaggaaaucauugcacaggcuuuccuuccuacucaagacagguuuguggaggugccuguauggccuaaaggcuuggguggcuuuguaaccuggcuucuauuugguuuucuugaguuaacuuucuuugaaaaaaaauaaaauaaaaagacaucuuucuaaaaagcuaacccuagaacaaaaagaguucaugcuuuguuuagcuugcucccguuugcaaguauaagcaagucagaucacugcaugucuacccugacccuuuuucuccccagcuguguaaaaucuaauauuguccagucucugugguccagacucauguucucuccugcuacaaaccuucagcaaccuccacugaugccauugcacuugaguugaacaucugacguaccaucuugagacauagaauaggcauggugauggguucccuucuggcccaugcuuuguauauuugugucugcauagaucuuucuguacacauacacuuacaucugcaugcauauaugaaaacaggggaccacacucccucuguaguucggaauuaccucuuccuuacucagaauuauuauaucaguaacuuccuucaauaaaaccgucuuaauaagcagacaacauuucaguguauaauuuacccuuaacaaaguaugcuuuucuguuaaaaaaaagauuuuaagguuaaauccuauuacaaaaacuucuuagauuuaccacuagaaugaauucagagaauuucuuuuucauccuuuacuuggaauagauuuccagaauugaacuugcuacucaauagauauguccauccuuaagagaucuacuaugccacuauauucucaaaagcacccugcguguaucaggagaugggaggcagugccuauuucacuguaucaaguguagucauaaaaagcacagcaaaauauagaaccucuucuaucacuccagaguucauaccgcaaagaauacaccauugcacuuuaugagaaagaacacuuuuauguaugcauuggcuagcuuuuguauuaaaaugguugguucuauucuaacugcaucacacugguauauaucuuauauuugguaaauaagaaaagucagcaguccuuacucauccuaggcuccaguuaauaaguaacauguuauugacaucggaaccaggaagguugcuucuuuaaaauaaucugaugugugauuccuguuuggaagacuugcagaagaucaaucuuacuuaaauauuuuagaguguucugaaacauuaaaacggaggugcuauguugauuggaacucucugaagaauccaagcuguaagagaucauucccgguuucuguggguaacagugcugggagacaggagguccagacuacagcaucuggagccuucuugcugccuguaacugauacgugaaaaaucugggucccuucauggguaccuauucucauuaguaauacaaguuagggauagacucaaaugggaagcucuuggauacuuauaauugaggugugggggacacuucccagagcaggaaagcuauuauccucugcccagagggagagagugacggcgaggaggaaaagaaucccauacuuugaaucaagcuggcaugggcaucagcuacauggcagggagggggcuuuggaaaaagcaagcaggcugcagcacuaggaagaucaggcccugcaccuggccugaacaacauagccgugcagcgccugauggagguggggggggggaugcaggugagcugcccugagggcaugugugcaggagagcuggcauggccacuucucuggccugagguggcauaggugcaaggauuauugguaggggugaggaggugauucucuuuccacuccccacccuuugccaccuccauguggaucuucuggagagcuggcucaaagggcaagagaacaagaaagcuagcccugccucaaagucaguaguacugaaugguuccuauacuuugccugggcaacacaguggagcuggccaucauagggaaggaauggacaagccagccccaagagugugagagcaagagaguugacccugccuccugcugaugguggcaugugguaguuuaccugaauggagcagugcuugcgagcucaccauagaaaugcagcuaccacguaggcccaaauccagggcucugaguuggcccaccucaaaaucuuuaucagcuguaaacaguuaggcuggggcuugugaaagggacaguucugccuauccaaagcugcaggauguccuugacacaaggcaccaacaggauaaucaaggggaggucuggugaggauccuguauugauggagucacagaagccagagagcucaaaccagaccaaugacucaucgcaaugagcauuugcaagagaagauguguggccaggggaauagacugugucacacacacuucgacauacugcagcuuuccugaugagauguuuuccuacggugugugugugucugugugucuguguguguguguguguguguguguguguguguguguguguguuauuuuggagaaggaauuuucauaagugaaggguggauaugaggggaagaggagaugaguggaacuggagugcaugauaugaaacucaaagaaucaguaaaaacuuaaaaaugagcaagcaacuccagaguuccagagaaagcauccuuagguucucauccacauccacuggagacugaaaaagaaaagucagcagagucagaacucaguaaggaggaugggccauccgaaccuuagggcuacuuggccuuuguccuuuauacaaugucucugcugugccucuucagacacuuaguacuuccgcucuuugugauguguguguuauuauuauaaagauuuuacuuuuaaaggcugaauaauauucuagaugaguauagaaccugaacacaacguuuuaccuucagagaauuuuguuuacaauauguggaagaaagaaaaggccuagaagauggucauuucaguuaaugcaaguagagauauuaugauggaauaacucuguuucaguguuuauuugcuugcuuuuuaagauacaccaaagacaaaacaauguaacugacuuuaauuguccucuuugcuugauuaauuuauucaaaauuuggagccaaauaaauggugguggucuguagaccaccugugcgcaugggggaggaggggcuuacucacaaagcauggggaacugauuuuauucuugacucuucucauccaagucucuauaacacauugaagaauuuuuuucuugcuagcaguuuuuucuuggacauagaagcaaacuuuggagaagugugcauuuuuuuucuaauauuuggaguaugguaaagaguaacccaagguguguguguguguguguguguguguguguguguguguguuguguauguugagagugaagggcuuuuuuuauugucucucaaucuucauguuguuggaguggguagccuuguuugacugcuucuuucaucuuugauaaugaagcauucaagacacugagguuguaaagggcuggcuuacugagguuguaaagagcgggcuuuagguuugauuuauucuccuccccuuuaauggcacuuuuuugaaguaugcuucagcacaguaagauuugccacuuuucagggugcauuuuuguuucuuuugggaaauguguaccagauuacucccguccucacuacuggguuuccaagauugcucucccugacagcucuuccuggacaaugugauuugcuaacuacuaguucuuggcccagagaucacaugacacaaugacauugagucuaacuucaucaauucugcuuucuaagacuguguaugcaucuugucuuuacuaugagugugcccuguccuaugaacuauguagaaaggagugcccaguagagaaaccauuucaccauguagauguuucccauaccuugauuucccuacuuuaguuacuuccacacagugagccccaaccuacugcugaccacagagcacaaugcuacccaucaauaaucauuccuuagaaccagccauggcuacauagagguaagaaaagaugggacaagaacacaggagucagagagaaguacguggacucaggagaggagggaagacugguaagccccuuauuugguguuugcaucuaauauauagguauugucucaaauuaacccacaaaaacauugaguauaacauauacucagagucuauagauuuaaguagaaauuuagaaguguaauuuuaaaaaaauaaaccgaccaugccaacaaauucuauuuuaggugauauuccuuuacugcaaaugaagaagauauuaugaagugugugucuucauguggcauuuucucagcccagcauggucuucuugccacagccaugcaacaugggaaggguugugaaagcuacagauguuaugaccuuagcacugcaggcuguguacccucaaaugugccagggcaggauggccagaggauguaaugugacaaaauuccagucuccuuguuugcaccucccccgggugcugucuccucguccccuacaagaauaucuuccacaucuaguaggaugagguaaaaaaaaaaagaaaauugcauuuauuuuaagcuugacguuuagccagaugggaacuagcuuaaguuucccuggaauauauuucauuuucucccccugucaccauccugugguaaauucccucugacagcugauaaaauucauauuuuuuuuagugaaucaaggauuuagauauaaauaugcagagugagcacacaaacugacucguauucucaaaguuaaggggguaggguuggaguaacaucauguaagaaaaauuccaaguuaugcaaaaagaggggaaaaauagauaauaacgcaaaauuagaucccagaauucuuccaguucaugaguuucagcagucuggggaacauucucccagaguugauuacuaagucugagaccuauuuucucauuaacuuuuaguauaaaauuggagauggacuccauuucaaaugauucccccaaacacugaacuaaaaaugaaauaaguuuaaaaucgggaguguuaugaaacgugaagcuucagaguuuagcuccugguagugacucauucuuggcgcagaucgugaacuccucuucugagggaguucuucauuucauaauugcagcugugguguggccccugcccuugguucugcuaaguccagauuuuuaugcugacuggaggugaaggagcugggaaguaaugacaugcaaucugguuuugcucucuaucugaaagugggauuuccaguucuacucauuugauguagaagcagguucuuuuucuucacaauugacuuguugaauguuggugaggcaggguguuggacauguuucuguuguccuuugguagagccaugguuggaagaaggaagaguccaugguccacaguagucaagggugaggcacucuucuagcaccaugcggugcaggugguaggggauccuguugaagcuccaugggaggcaggagcuccaaugguagagaacuggaagagucuugcuauauuaggcuaccugggaaaucacugcauaauggcuggaguagacaucaugacccauaggacagaauaggcacuuaguggcaaaugauccaucaaacauuauaaaugaaguuguuaauauguuuauauuuuagacauauaauuauuacuaaauucaaacuguauucuuaccucaacuuguaacuaucaucgugaagucauaacccaagugaugauuugauaucucaggggcaagaaggaugucuugaagggucaagcuuucuacaggaaauuucuguaggaaccccucaaaauaccuagugcuuaauaggaaucagcacccuuuuuuuuuuuuuguaaaccugccuaaguacgcuuaguuuuguuagguccaacagugaacagcuuaccaccccucucuaucaggucccuuaguuugaaaugcauuguauaaauuccagccuuacaugcauuaugaaacuacagaccuuccaaaaaggcgauuuucucacuuauuguuuuacucaggcaggaguuaaagugcaucuuccuuuuugguguggaccuccuaauuauguauuagaagaaggugugaauauguucuaggaacuagcuuuggcaauaaguaucauauacauaagccauguucauguauggcauugucacaugcuagugauaaaugaguuucuacuaauacuauuccaaagucuaagcuugcaucaucuuccuagagaggguuuaagaacuauucuucaagccaccccucuuacugacuaacauuauuuuucaagaacagaauggaaaggaguguuccuugaacugguggagccauguuuaacugcccaacuuagcuuuugcaugcagguuugauuuagagccuacuggugcuagacuauggucuaugguuuuaccccggguacacaguaggaugggaccccaucaauuccacacuagugcagcugauaggugccaaggcauugugggacuuguuaucuuuggcacauuucauucucuuaguucaguauuuucuuucuuauauucauguguauuuucugggaaucucuauaacugaauuuuggauucuucuaacaucaagcagaacuugaaccgguuuacuuaugaaugaaaaaagcauguauggcauucauauuccagcuuaugcuccugagacuugugaugaaucgugugcaaggugagugcacagggcugcauucaucagccauguauccucuguuuccaggaaacucuuuaaccuucacagugcagguaacaggaaaauucagucuuauaaaaaaaaaccaauaggugcuuucaagcucuuccagacauacagauucgauuucugcuuuguucguuuugugauuauguaguuaauagagauggcuccgagagaagcaaaggugguuuagucuuuucacagucuacaaccauuauagaaauuaucucuuuugacauucacacacccccuccauaagugagaguguauuuuuugucuagugaugaaagggauacuuuaagcaauuaaauaauuagaagauuggacguguaaaggggaauaagcaucaucagauagccaugguuugguuucucucaaccucugcugugcaucugcuuuagacaccuuauucaccauugugcccuagagccuuaggccuuuugaagaaggaagccacucaccugcaguacaggcuggcugaucuccaugcugauuauugcugccuucucagcugaugucacaccuaacacugucuaguagaugcuuccuuccaaagcaugcuaccuccacauccaugcugagcugcugccuuggagauccaguuuuauguggccuucuuuaaauauggccaggcuugcuucauaagugcagcucauaugcacuuugucucgaaaauuacccauauaauuugcuuccaacuccuuugcacuaauaucuuuguaaccagacagaaaccucaugguuuauugcagcaugcuugcuuuucucauuucacaguugcacacucucccugcacacaaauucaagugaauuuccaauuaucaaaaccugucaaaagcuugaugcucuccuauguaucucuuuuauaaguuaaacauucuaugcucuaaaauugagaugggcauuugagcucagcuuucucuguuaucaauagcucuuugagacacugaagcccagugacuguagucaccauggcuucucuaggugauaaguccagaaggcccugauucuaaccaguggucugcauuuguuccuauauaguuacucucuguacuggagaaaauacaguucugcaguguagauauuguccuuaaauugccaaauacuagguuuggaggaguagguaugcaccuuugugccacauugucaugugacagagccuacagucugucuuuagcucucuguauacuuuugaucuucaugguuggccaucuuugaaggucauagacuaucaucuuccaagauagccugaauacuguucaagacuggcaauguuccuuugcacaucuccacccuccccucaccuaggaggaguacugucauuuccccaauagauauauauucagaugggagagcacugauaaugauuaugaaguuucugacagaagaaacaaauuaacaucccuugcuugcaauacacugaggucaugaaaucagcuuacauugucucaaaagaguauagagcaggaagugcagagauccaggaugcuguccuaggggaaccugucacaaagggccuuggacaggaaaaagggaagacuacaugaacaccuauuugaggcagacgcuccaaaggcauggacaguuacuacagagcgaggcuagacauauacccugauggaugcuagaaaccuagcaaaaacagucuccaaggagagguggagacagcagacagaauggagugagacuccaucaucauaauccggacugauggaggcuccucauuucaagauagcauuucaaccccaaauggcaaccauaagaggcuaaaagaagaaccaucacuagaagauuagauaagaugaaggaugaaggguuugaauccuaggagagguuuucuuuuauuuuuauuuaugguaguacuugaguuuuaaaaccacuaaauuuuuggcaaauuugguaaccaguugcaaaauauuugacagcuuaaaauugccaauaguaggaggauuuaugccacugaaacuggucaacacacuucaccucuaauauagccaucaaaagcuggucaauaaacacuagucagaauacggugagcacaucugaaggcaggcagacagaauccaugagaaagccacaugacucaaagcauaugagagagagguggggcccaugacccaacccugaggauauggaaggagacuguacugaugugauggaggaagacuucugagaggagaaaggacuuuuaaaaaagggaaaagaaacugucagaggagagguccaggaucuagaaugauaaugauuaucaagcuaacaacccugaguaccuguuauaugugaaauaguguucuucaugcuuccccugguuuaccuccuguagcagccacugcacagagacaaguaacaucaucauguacucaugaaugaaugaauagucaggggcaaagacuuguuugcccaaagccccacagcugucagaauacagagacaagguuugaauuccauguaggaucugaugauguagccgucauaccuaccaucugugcuacaucccagagaauuagcggauucugugccaaggaguugcuuuggguuuccugaugaagauuucuguguccuuuaagaauguagcaacauccccuuagacagagggaagacaauaagauagauaauguugaggcacuuacgcauggcagggacaugggagggaguggaguguccaagcagugcuaaggaccuuggugccagauaggauuuuaaaggaaugaggagauuccagggagagagagguuuuucucugacacaccucagcugcucuuuuuggguauagcaaaagucgcccagaaguccucuacuuaggcugugacugaucaaagggaaguugaugacauuuaacaaucgaaggaaucaggagaaaacaaauuguaauuggccucagaaucugcacuguugugaaagcaagaggaguuuguugaacuuaaaccuuaaaagaaucuggaaaauauaguuuuuggaagacuugaauaaggagcuaagagaggaggccagcuuugaaaacaugggcacuguaaucuaucaauuuuggggacagugcaguuuuucauacucuccauucagugugugucuuaaaaagcaguggauggaaacaaucaucauagaagaugagaucaaaggccauacaaauggauuuuacaauaguccagggugaaaacagcaguuucaaugaagagaaagccuaugacuauagauauuuucuaggauaucuacuauuaaauaacaagucauuuaaguucuuuaugugaugcuggcuuuucaaacagcauuugcaauuaaauuguauauaaauuuguuauauuuuuaauauauauauacacauaugugugugugugugugugugugugugugugugugugugugugugguguuuaguacuaaaguucaagauuuuuagacagauauuauuuugaagaguuagacuacaugugaaaccugaaaaugcguccaggcauagugaauaaaugcuaaguggauaauauucauuaaguucgaucaucuuccaaaggcuguuugcugauuaaauacagucucuaacccugcuugaguaguacacuaggacuugcuccaaggugaacaucaucaauaugaauggcaauuacucaacuuugaccuucacauugcuuccagaucuccauuuguuuuccuguucuuuccuugaaaccuaaaagggggaaauggcauuuauaagucauaguaaauuacaccauguguauuguaaccccuuuccuucuugucugggugaaauaaauucaugucccuuaccuugaugugcagaggaaaugcaucuguuauuccuuuucugaucccucugagaggucugggcucucacucacuaccccauucccuggaggcagugccagucagagaagacauuuuucuuccugaaaaauagccagcaguggauugugaaugcagacgccauuacccuuggaucuucucuccaagagaauuugcugcucaguuuuuacaaagcucaaucugacuguauguuccuauguuuaggaguucuguuuccuuauauucuaagugggauuaauuuuuguagcucauuugaccagguccaggaggcaagcuccgauuacuauggaaacaguuaccaaguuuccuggcuuuuguacauuuaauggaucaacaaugaugccauagugacauaaauauuucuuccucuucccacuuucauuuuauuuuccccuuuuuggauacauuauuguugaggaauguagauuuaauuucacagucuggcuuaucugaucuuuggguauucauccagggagagauuuucaugauaauuacaugaccaaggaaugcaugugucuaaacauuacuucccaccguuggugcaagcuuugauggacuuuucagaugugaugagacuccugcagaacggcagggagaaaauuuucaaauucacacuauacuuugauccuuaacuuagccuccuauaccaugguaagugaauuacaaauuuaaauuuugugcuuccucauuccuucccuaaaacugaaaggccuguaaucuugaacgucuauauagccauagauuauaauuggcaaaggaguacuugcguugcauuuccaggccauguaaucuuuacccuggcauuugcauauuaauagauaauuguaaaacauuauguaaauuaaacaugguggugaauauauuaccaaaucaaauggccuuuagggguaauuacaggaucguacuauguaaacuaggaugcugcagguugaaugcugaacauuuuucauaagaugaaauauaacccaggcaagauauuuauuuccauccagucauggguuuuccuuuugagugugacuauuuuuguuugauuaagcacauuuagggucaauucauagaauuguaggaacucauaguacucugaauaaaagguagaaaauauauuuuuugguagugauuauuccagauauuugacucacagaggcauuccuacaaacacuaaugguuuucacuauccuuuugaauguaauuuuuauuuuucuuugcuugaaaauuacucacucuuauuguuuuaucauuguaugagcaaaccauucggucuccuuuuuacacugucaguccauuuuugcuacuguagcauaauuccucagacuggguaauuucuaaagaaccgagaacagagauuuguuuggcuuauuguccugaagguuugaaaauagaaugugucauugguaccuggccaacaccuuugugcuucuuauccccagauaaaaugggagggagggagggagggaggagagggagggagggagggagggagggagggagggagggagggggagagggggaggggaagagggagagagaaagggggggguggagagaacucaugcuuuuauaugagccaugcuggcaguagcucagaaaugaugucaucucuaccugcucaccuuucacaguucccacaugccagcauagacuaaaguaggaauuaagguaggaauuaaguuuucaacauaggauuuuugggggacuguguuaaagcuagagcacacugucuugcuaaauaacuucuuccuuuucugacugcucauuagucuuucuagucuaugagccccaugcgcugcuucaucaucuuguucuccaugagucuaccuccuuauccaugcuauauauggggucagggacaugcaggaagaguggggaagaagggaggaaacuggucauuuucuucaaaccuucagucaaaaagaucucuuuaguacauuucucccaguaaaauaguuauaugaguuuuguuacucagugcuuggggaggaagcuucuguaugcagauauuuccuguuauuaaauggaaguucccaagccaguugaucuuggucauuauuuuagucuguguuuucuccucccuuauaccucagcagccugcuucuuccucuccugcauuauuccaguacagugcccgcccucuucccuccuuccccucucuguucaucuaagugcuucugguuuaccauguaccugguguuacucaaugacagcugaauguagcagauuuuaugcuaaaacaaaccugguguuauggcaaauagcucccauugcaaaaccacaguauaaauauugaucaaguuuaggagagaaaaagauuacucauugacaaaaacaauuauguccuuugaaaucugaaucucagacugcagaguguuggagucagaauuuuuuuaauuuuuaauuuuuaauuuuuuuuuuuuuuuuugucugucuucauacaggguuccagucagguggacuggagaccugguucacgugcuugaaaaaaaaauacugcuugguuuaauuacauaauaaauaaaauaaagacaauaacacccuuucauaggcagcaaacuugacuaaaaaaauuaugaucugguucacuuguucuagacugcucuagaccuuauaaccaaaauggaaagcaaaaugcucguuaaaaaugaauccucuugcuuucucaacagcagccccgcucugaugcaguagugucugacgaguuacuaaauuuaagcuuuucacuggccuuauuaacaugugugauaauuaccgaaucagggaugugucacaaagaucaaaaguaaucagggagcaaagucccuaacaacagagggcgagguccauacuagguguuccguguaugcccgucucuaaggccucuuuucuuguuuucacgcccuuccuccaauggagucauagacaugucaaacacugaugauugucauaaccaaaauacccaaaggucuguaccugcccuuaggcaagucauuuauuuauuaucccuucccccuucucucuuuccagcuuagauguguaauuugaagccagugggaacuaaugagaaaaugaaagucguuguuaccauuauugcucuggugccaugagaucucugguggggacauuugagggaggaaaaggauaauaaaggaaaaaagacaccugccuagauuuaagcugugccuucuagggccucccgcacauaaccucaaagcugcauuucuuuaaguaggaguuaaaggcuuaaucuccuugccauuagaaauaauuccuaaugauuagcauaauagcaaaucauuucugcgcccugugagauacuauugaugguguuuucacugaaaaugcagugaaacacagaaacggcuucugccguacaaugaaagaggaaauacaacagcuaauuaauaguccgugaaaugguuucuauuacuacacucugcaagucugacacacauauuauuaguuuuccacacgaaguugucauuuuuuuuuacgguauuguauauuaaaaaagagauucauagucuaucccuuguacucuuguguugaagucauuuuagcccacagccuugaugagagcuacagcagacaaucaugacuuggugucacucaccaucugggcuuuccccaagagacuccguggcaccagagcaauauagcagugaaggugcuuuucauauuaucguuugcucccucugguuccaaauuacacaucugagcugguaauagauaaagaggaaggggcagcgaauacauaacuugcccaaggacagaugucaguguuagauguguuugugguaccaccucaaggggauggaaacaagaaaacacacauuccgauauggacaggcuuugaacaucuacugugguaggauuggauuagaauuacccacucuggguuuguugagagaauucgucaauguggaagaagaaaaggaacugucauaucaagaccagugagucuggaaaaguuccaacauccaagucuaacuucaagcuauugccacacagagacuuggaaucaccucuaaagaccuuaauggagccuuggagcuagugaagagcaucuugacaguaauacuaggacaggcaggacuuuacccucuccccaugguucuugauucucucauagaucauauauguacucccugaaaguaaggaaacacacaaguuuagaacagccacgggagaaauccuugggagguauguaugagguuaaacuguuaaugcuggacuuucuccagugaaucucacuccuaguuaccacucaugcugugcugccacccuagaucucucuuaaugcagaguccggaacggaggacuguauuuuccuaacuggaggugagcccuucucaaacuuuuggugguguuuaccaucauggugucuacaaaauuauguucuaccaguuguuagcggaucugaggauagauugguaggacuccuucuaucccgccucuucuuuccuacucccuucuggcugaguauaacaccucauacuacagagagcagagcugugugcaguggacuggagaagagguaguaauguucuuaaaugaaccaucaaaucuacaaugaaaauguaauaagccagcuaaaauucuccugcauuuuuuuuucuuagauugcaugucuguugcuuugacuuaagugguaccuacuccaguagacaauuuauauggaagcauccugguggacugagagaaagugagaugaggacuugacugcaacacuaaggcaguuugcaaagcuccagacugaagcccugguggccugggaaagaauuuguagucaguggcauaggacacauagauaauguuccuacauacacuuaugcauaugcacaggcauaugcgugugcaugucuguagaacacuucauuuuccauuccuuuugcagcacuuaaacacugauuggaacugugcucugacaucuuccuagccauauucuuccauuaauuugaucaugauagacaaauuuuuacuugauguuguucgacaaauuaaaaaguuaauugccuugucgguagccaaauuuaaaagaauuuucuaaucugaaaucuccucagauagagaccauuucuuaacagaauccuccacuaccaauguucuuccagcagccucuaucuaugugaagguuggaaaugugaagagaaacauuccuacugaugggccuaagaggcaaauucauagugggugcauacucauccauccaugcagauguguggguuucagaagcugaaacaagaggugugcucauaguggguguguauauagcugugaacauucaugaguuucagaggcugagacaagaggugagcucauggugggugggugugcacguacauaagcaucagaggccgagacaagcuuuuccucuucuacaguguuuaguuugcauggcugauguacuguugcugagcuggauacaucuaaaagaugaaaugaugaauauuuuacuguggaaaaaggucaggaaauaauuuuuuggugagaaucagacaaaagccucauggcuugagaccugacuuagaccuccaaauccuuuugccaucauguaguaguagugaaagcagaggcacaucucccccgcacagacagagugguaccugucagaugcaggacauaauggcuccuaacacuuucuuuucuuuaauccugugaagcuagguuguggcauaagagacuguuaaaauuuauuuauuuuaacagucucgaaaaaacaaaaaaaaauuuuuuuuaaauaaugacaauaugcagcaugauauaagugauuuuaacuucuuagggguccaaaugcaaaucccaucaaagaauguauaaaaauaauauaauacuguguaaaaacucuauugguaaucuaauuuucuucaaaaugguuauaauuaaugucugucuuauuacacgcuuguuuaaauccauuuaccagucauuuauuaaguacgaucauuucccuuuucccugucuuaugaacauaauacuaaaagcaagaauuaaauauguuuuaguauuuaccauguguuggaaagucugcuaagaaauguugcauuuauuauuucauuuaauucuuaauucaucuuaugaaacagauggcuaccaaugccaucugaaaugucucccagaggcucacaugcccaugaauugcugccagucuguagugcucuggaauaugguagaaccuuuaagagcuggggucuagugagaggacguuaggccguuggaggugugcacuugggagugagauauuagaauccagcacccuuucucucuauuuaaugcuaucauuugcuuauaaacaaacaaacuagauuaaagaaguucauuuuaugcuccuuuguuuuugcuugcuuguuuugcuuugcagcucuggauauuaagcuuagggcauuacacaugccugaccagcacucuccuacugagauauauccaaccgucccugucugguuucccaacaggcacggacucucaauucugaaggccugucauuugguuuacaaugcucagaggagcuggauuuguuaugagcaaaguggcuucaguaagaauucugaaagaugaugugcucagaauuauuuaucucauuguggacugaugcaugaaaagaugcccuggcucugugccccugucaaagaauucacuuagaagaaauagugacuguacuagcuuuuuaaucgcugcauagcuucccuccuggguacacaggccuuguaaagaauugguuagaaaucuauagucaauaaaaaagcuugugcuuuuaaaucauuuuuacuuuacgagcagaaaucuuuccacaaauuuugcuagaaguaaaaucuucaugaaaaaaaucaaagaaaacaaggcuacaguaaauugcuuuaguuuuuuuccuggguaggauuauguuuuacauuuuuauuguuucucccaagcaugaauguuuaccaaauauuuuaugguuaauugguuccuaucuaagguuaaguucaguguuaaaucgcgaugauuacaggaacugaaacuagaacaugagggauauucuuucaguugaggcuugaguaccucaacuuuacaauaccaacuuuagaaagaguaaaguagcccacuucccguguccauucauagguagguugcaucauucauuaaaaaaaauaaaauaauaugagggccugcgcugccacucaccgggguccaagccuucuucugguaccaugcuugugaagguaagauaauacagauuuagugauaugagaauccucaggcagucccuuaucucauuuuaucucaauuuauucauguuaucuuagcuuagcuuagaacagagaacuaaugagagauuucaccugauggagggcuggggcuaauaucuguuaacaucaucccauaaacugguugugcagauggguaguuugagacugucguucauugguuucugggaggaugucuggguagugagaugcugggggauagggaaucuuaauuguuaauguuuuagcuauaguuucauauacauaucugcaaucccagaaucugccaugacggucauuccagaaacuuuuuuugggugugggagggggcuucuacuguguuagcaauugcuaaaagagaaagcaagugaggcuacaagaaggaaccuguucaaaaucauauagcuuaguugaggauauugaauucaugcagaccuuucaagccuucaagcuguauucuugauaguauucuaugcuacuuauaguauugaugguauuuuuugauauauauuugagcuuucuuauaauaauuucugucgcauugucuauaggaaggaccacgugcucauguucauuucaguguccauuguuuauguuuugggauggguugaaaguacacguugauguggcugacagggagaggaggguggucugggaugcggaaugauuaacuccuuagaaauccaucucugguugcugaaauacacuauuguuugcacgcaguagcauuccagauaggacaagaaguguuauccauaugcucaagugugcaugaauggcugggaagauguuugaaucaaagaagguugccuuuuuacauuaacagccaguggaaacaaaaucuuuuuuuuuaauugguuauuuucuuuacuuacauuucaaauguuauccccuucccagaaacccucucccguccccuuccuccugcuucuaugagaguguucccccaccaaaccuacccauuucuaccuccccacccuugauuucccuacaccgaggcaucuaucgagccuucauaggaccaagaaccucuccucccauugaugucugacaaggccauccucuuuuacauaugcagcuggagcuauguguacuccuugguugguugcuuagucccugggaauucuggggggucugguugguugauauuuuuguucuuccuaugggguugcaaaccccuucagcuccuucagugcuuucucuaacgccuccauugggggccccauugaggacccuguccucaguccaaugguuggguuuccuugaaguugggagagguacaggagcuggaguugcuuacccagugaagaccucuuuugagcuauuuauauaaacagauauauaagugggugacaaucucaaaauccugcugcaaaaauaccacagacuauagaugaaguaaauuacuccaauuuguuggacacacuaugaguaaacacaagugcuuaaauugccuugaguuaggauuauguaaaaggaagacacucucagcgcuuuacuaaaguagcaauaaaacacgagcacaguuggcuugcucucacucaucucuaaacaaaaugaguccuugagcauucguuuacuacuuuauuauggcaaaugucauuuccguucuugaagugaaggauuuggaucuauaaccuccuccacaccacuccucccagauauuugaaaacaaagccuauguauuaagcaucucugugguagacugucaaucugugugggugugucagcaacugauaguagagguuaucuucacgcucucuaaagguggauuuuuuuuuaaaaaaaguccaugacaaaauuuuaaauggauuauuggaaaaucuaauacuggaugcuuaugaaaugaacagacaaacauguauggaggagaaacaucuuauguuguuaaaguguaauuucuucucaaacuacucuauucugugaaaaauauuaacaugaugaaauagacaagugaaaugguacaucuagauuuuuagcaugagcuugugcuugaagaauuuguaagaauggcucucauuggcugcauuuccuuuaugaaggauugaaccacaaucuguaugaaagcaugcagauuguacucaacagcuuucuuuuuagaagacugacaaaugaagaggggaguauuucauaauuaaagaacuuuaaugucuucauagacagaagcugugagacaacguaaucuuaauugugaugaaguuagguacugagaauguaugucaguugcaaagggagaguacuuaggagucucugaucaauauucuuggauaaaaauacugagaauuaggugauaauucauucaggccauuauauggaaacugacuauugaguaaaaucacugaaauaccaggcuucacucauagaauaaguucuagauccaagaaggcaguuaguagucccauuagaacuauacgcuccucacaccauaguucagauauuaggaagcacucuggggugugcaguguaaggaaggaaaaaaacguuuggaaaagaggaaagugacauaucaaagugaaggcacuuucaaggugaagacuggucaagcaggagcagaggcgguguguguguguguguguguguguguguguguguguguguguguguguguguguguguuuugcguuggcgcucuccuugguacugaacggaggugaaaucuuucaagaagucucccagguugaaguucccuuuucuuuauucucacucugcagcaguugagaucacaccucuugcucugucaucugccuccacguuacgguaucuaaacacauagauggcauccucaugcccagccucugauaaugcugcaugccuugccuuaaauccagcugauccuuccaauuuguauuucaagaaagaugaauugugaaagagcuuugaggggaagacucagcacaaagacagcauauuuguaggucuauauugacuuaccaagcaauuguauuuauuauaaauuuaaaagauguugcaugauauauguuaguggaccuacucauuacagaaaugaaagcagguaugauagauuuugcauagggaagauaauucuaagggcuugaugagucacugauagguuagguauaagaauuauauuucucccuuaugcuuuuagcuuaaucucacauaugcaaagcauaguuauuggugaccugaaugucaauucugaagcaugcuuugcaugaaaugaaauaucuuugaauaaaggucaccguaugacaacuuagaagaaguacauugacagaacuucuuuguaacaacacuaaugauacccucaccuugaaguggcagaauagauagcucagaagaagacaggaggacugcuagaugggcagagagaggugcuucugcuccccccaccucccacugcagcucacaacagccagagggaaauucaccgauguaagcauuacuucugugaggacagauaacuggccugaaaugagguagaccuugagagaagaaaucuuggaaaucucaaaaccaagagguagggaaaggaguugcuacaugaaaaaggagcauggauuucuuuacaugaauuguaugaaaaagagaggacaaagagagccauauuuagugauacuuaacuucauuaaaaaucugcgcagaagacaggccauaucagacacaucaauuauauagccaguuuuuaaugacaaacuccaugaguaaaauguuccccccaaaauaccguaguacuuauaacugauggaacauugcuacacucaauuauacaauuaguaaacauuucccacaauucaugugugccuaaggaaaguaaucucuuugaaauaaaggaggaaaauauaaacaagguucagaaaauaaaacaagauauucauuucuccaaguucaucaaauaugauucuaugauuagauaagaccuuuaaguaaagaacuuuaaaagugaaauaauuaaugcuaguucauaauuuaaauaaucucuuaauaacuggcuaagcucaaggucagauuuguauuccuauaaaaugauccgaauugggaguagucacugaagaagcagcucagugauucacugauugucuugguucauucugaaauauucuccagggcuaagguauccacuggcucuuugggucauauuucacccagcgugcucaggaggccaaguagacagagucuauuucucuuuguuuucuuguccuuuuagaauugcaguucuuuccaaagcuguucugcuacucagauucucacagacagaaaacaauauucaguccuugguuucacagaauggcuaggaucaagcccuguguucauucucaaggagaaaggaagacacacaugucaaagaaagaauucccuugggaaauuccaccguugcaacagggcauccucaaagcaaacgaggccuucuaucugggcuguauucugugcugaaauugccucccuggacagcaguuaagcaguaaagguagacuacauaucaacagcaaauguuugauuuccuuccacugaacuucagacaaguuugugauaaaacauuagucagccucugaacuugguuucuguaucugucaaaauaggguauuuauuuuacuauuuuuaccauauaaguaacacaaugcaguguuuaagcuacucaacauagugagcuguuacauuuuuauaccuuaaggucuuugcaucuaucagugaugaaaauguuauaaugucauaucagagggcacagcuggcacaaucuagagacaauugcaauuuuaauaacugauguagcauguaaauggcuaagggucaggaagaccuuggacauucucaggcaccuggacaguuuccccuaaacaagcaucaguauuauugagguugagugacucuggugucccucacugaaacaauauugucaggaaccuuacagugugauaauuuacuuuuauauggcaagcccagugcaauaaacuagaaggauguuugcaaccaauuguuauagcauuauuucagugaaaguuaaaaccauugugugugugcuugugcauuuguguguguguguguguguguguguguguguguguguguguguagauuucaguuccucagccuugguggccacuuugauauccucuccuuuaagaauuuuuuuaaaaaaaaaucauuauuuuccuuccaaaaacaucuauaauaccuuuccuugugauuuuuaaccaauagccucaacuaaucacacaaagaucucuugcugaugaauaggaaacuucggguuuauagacuaaaauccuuccacuuuauuuaggaaaacacacuugaacuaugagguggagauagagucaggaagauuuauaguugugguucauccagaauuuccuuacuuggaagaucugauauucuuguguauuaaucccauagggagcaaauggcacuuggauaccuuagcaacaucugcuuccuugaauaaauguucucuuugguauguuaaaauucuugccagucccauggaauccaaccucuuguucuugucuguuuagaaccuuuuguggucacuccaucucucuugacaguuuuaaagcucacgggguuacauaaacaugagucaauauggagaagaggcugcaacaaugguaacaacaauuaaugaacuauuucugucuuuaacaagcuucuuuuuucuccuaaauuagucuauaaaaugaaaugcuaggucaucuguauucagcaggcauauacuguagccaguguuaaaagcaggggacagaaggugagugagccccuguagacauguacuuauguggcuccacucuggcucuuucuccucugcaaacuagauaagcagcaguagcagcugccuaagaugaaguacuuuuaaaagccugcuguuugauuuauccuugauauaguuuccuuugaugagaacccauggcuuguaaacauaaaacgaaguuccuguuucaucaucgagcacgccaugacuucccaucaucucccagacucuuccaaacgcuugaaagaaucuugcaaacccauuugugcuuuguacugggauuguuuagccuucccagguucccugaggaucagaaagugaauuuauggcagauguuacaauuccagaaaccuccuugaucuuccagaggucugcuuguuggucugagacaaucugacacagcuauguguuguugccuugcccgaucccucagugaguugcaaagcaucagggguaacugcagaugcuggcaauguccuuugauugcaucacucuuugaucccuuuugucuugaguuguucucaucauuccuguucacuccuuugauugauucaucaguaguuauuaaauaucaaaacacagaguuccaaccccuggucuaaugagggcagucacagugggauucuuuccuaauauaacccaagacccuggaaacaacucugagggggacaucuccaggcugucacucuucaaaaagaaggucacucagaggggccugggcccuuccacuuucucucacauuacuaaggauuccuugugggaaaaauagaauuguugaucuuucugguugaguuaucuauguuggugugacuucuaacaaaccugauuuuguaucuaucaaaucagguuuucuuuuucaaaagcugaccucauguagccuuaaaauuguauauaauuacagggcaguaaugcaaagucuauaguuuuuaugcugaucagaaaaugcagguggcaggaaaagagcaguugacucuagacuuguuuauauuugguaagcaaggaagcuugggucgauauaaaggcgagcauaacaguaaaaagcucagggcugcuucagaugggaggagggugugugcauggacauuuugcacuaagggcugcugucagugagacugccaugagcuggagagucacagggucagagccagaucauggcaguugcaggaaguccacaguucuacacggcuaggcuacucagagcccccgagaggggaaugauucugcaucucauagccaucaucaagaaaacuaugaaguaugugggagaugcacucuacacuucaguacagcacagcaugugagauguuuauggcuguuucacaauccucagcuacuguagggaaucugggaaggaggauuagugacugguggccuuuucuccuguccuuuuucugagcugagacacugcacugauauauaaaaagauacacucucuccucuuaagugauucuuaaaaauaucuucuacauaaaguuucacagggaagaaaggaaaaagaaauugcuguugagcaaaagcagugagcaagaagcagaaaaacaguuugaaccaauagaaucuggggcaaagggagguggagaauuuggguuuguuuguuuuaauaaagccacaucauaagauaaacgcaaaggugguacagagaacaugcguuuuugcuuugauucacuacuacaaguuaauuuguuacauuuucuaucaucaauacauuuguuaucauuacuaauagccacauuaaguaaagucauacucaguuuguauguaauucauuuuuccuggucuuggaucagucacugauuuacauucagucccagguuguccugugagucuguggaucaauugguuauucuuuccacagaucuuuauugauccugcuaguaaagcauucacagccucacccugauuaauaauagcaccuuuaucccagaguucagcugcaaauccuagcaacacauagcacagaggcggcagagcucauaacaguauuaacuguauuugugcacaauaaucauagcuuuauuuuuaaaauguauacgugcugcauuuauaccuauuuuacauguauuuuaaccauucuguuaccauuaaauauuuugaugcuuaaauucaaaauuaguuuguauccauagcagcugauauuuaacugaaauucaagaauuaaccuuggaaauaaaggaccaaaaagaugugugcguucucuuuuuccuaacuugaaggacccuguauccagcauaacauuaagaaugcagaugcugauuauagaauaaugacacauguauguuaacagaaagaguaaagagcuauacccaauugccagcucugcauaacccagaaagauuaacauugauaauguuuuuuuaaagauuuauuuuauuuauuauauguaaguaacagcugagccaccucuccagccccaaagauuuauuuauuguuauauguaaguacacuguagcugucuucauacacaccagaagagggagucagaucucauuacagaugguugugagccaccauguaguugcugggauuugaacuaggaucuuuggaacagcagucagugcucuuaacugcugagccaucucaccacugauaaugaguuucaaugaacuauaaaaucacgaggagucaucagaugaauuaauaauuguaacuuuuuccacccaagaagugguauuaucucugcaguaagcuucagguaucauccaacaggccccaggcagacguguggugcugcuaucacaaauugcucguucuucuaucgggagugaacgucugcgaacucauccauguacgguggguaacauuaggauuacacaguaaauggcugagagaugggacaaaaccaucuaugcagucugcauccugcucuguugugcuguacauaguuggcaaccagagccagcaagaucaaagguacagugcaagggauauauuugggcauagcauggucagacaggucuuggugauacugugacaucuauuagggggacagaagagacagaggaccaagcaggaagauuucuuagaagccauugauucugagguccccagccaugaauuagcauguacagaguaagaccagaaguuaggguggguagaggcaagguggggagaugaugggucaagaccaacuuaaagauuggucuuuuuuuucugaguaagauuagaacauucaugaggcaggaugucagugacaucauuuuguccauauuuuaaaaggaucuuuuuggcuucauuguggaaggaaagguaaacaauacaguuaggaacccccaugggacgagagguaagacaguuugguuuuaggugguacuggcaggauuuaaauuuuaccuauuaauuguaaaugacauuugaggagcuagagaugcuucaaggucuuugaucaucuugcuuaggaacagggaauagaugaaugcugaagaaugagaaucaaaaguccuguuccugauguugaauuuagacccucuuaauggagauguuggcaggcaaguagaggucuguacuuggcuggauggagaggacucuugauccaugggcucagaugagaguucauuacccaaagaggggaugcaaauacaauacugcccuucagguuaagggugggaggaagagucagugacacagccaagcccaguaagagcacagagagagggagagauuacccaccugcaaagagaaaggugauuguugcuucaaaccauggcauaggcagagggaagcaggacucaccauaugguuugcaauauagagaccaugggaagcccaggacuuccauuuucaaccaaagauagcauuaucaugggccuauaauguugcaaggauuaauauacauggaggcugucuguugacauguguaauguugcagggauuaauauacacugcaaggauucauuuauaauagagcuaacuguuggcauaguuaguguuccguucaugucaucugcccuaacuggguacaguugggugaugugcacucuaaguagccuccucggugaucuggaggcaggguaggccauugcugucauaguccuuguucauaagugauggugcucagagaccccagagccucccugaccauuucaaaucagccugaagaggcuuauuauaauccuucaauuuaagaauggguggauuucagaguuucuccucuugaacuuguuuaaaauuauuuuuuaagaaugugaguaguuccuaguccauguuugaacggaauaagaaagaggaacucuaacauucaaagcagagcccugagcucuguaccuagagcagacuccugagccagccuuggggcccucugugcaccuucuccaacagcugugguuggaaggaguuuuauauuuacauguuccucaauccugauuauguguggagucacuggagaccauuaagacaacccuacucuuugagccucacuuuaguuuucugacuuaacuuauucagcauuaggagcagauauagauagcaggaugacuuuuuaaauuaaauuuuuugacauguaauuucuauacaaugcuauuuuucccuauuaucugugguugaguucuagcaaauacuuauguaugcagacaacaacaucacagccaaaauugaggcccuuagugucacuacaaacagccuuguucagguuacccuggguccugaggaccacuccucuaucucucuucuuggggcauuagcauuuuaaaagggcaugaaugugaugcaccaccacgaagacagccuuuauagaauauuaguguguaguggaugaaagcugcuggguuuucuauaaucuaagcauuaugacugcuuuaugaucaugaguuaagagaagacaguucuacucuugucugguggggcuuuguuuuagcaucaggguuccagggaaggaagaaaugguaugaaugggaaacuccaaggucuugucuggacaaguucaaccucccacaucagccacaguggacacagugaaggcaccauguguacaugaaguggacacaguggagaaugaugagcgcaccgugccugcccaaaugagacuaauuuaauguaaaucaagaugggcaguuacaaucaauacauucagaagaaagauuaggaaauaucacauagaccuuccccugaauaaaaugacugggaagauguggggcuacuugacauuugguggcucaggagagguuucuuuguccucuuuaagcuaagacuugaaugucucaaggauagcagccauacagaauuaaagaaagaugucagaacucagagugggaaggcuuaauacugaaaaugggauuugugagaguucagaaagaaagaaagaaagaaagaaagaaagaaagaaagaaagaaagaaagaaagaaagaaagaaagcuucugugcauguugaagaacaaaaaagggggggggguaagugggagaggcaggcagaggucaccucuccuggagcucugagaaccuucagggugaagagacaugucauccaauaccugaaaauaaugugucugcuguguuaggaaauaugacuuuggguacuauguggaaaauaugcugugggagauuggcugaaaaugaaagguguccuuaacuacagcucagucuguuguaauuagaugcaagaauaaauauagauguaauuacucauaaagguaaguuugcuggggaaagaacagucaauggugccuugagaguggcccuugggaggcucuuacuaggucccacaccuaguuuucaaggacuggauuuauuauuuuuauccagaacccucuccuacguuguccuacauacccagugcuccucuuacauaccuucucuagugccccugacuccuuuguuuucuucauuacagauaaaagagugggccugaguagucacuggaggaguaguuauggugcugguaggguaaugcauccaggccaagggagauggcaguggccuaauggaggugcuuuagacaugaguuagucuuacuuggccuggcugaagaugggguggggugugaggcauggguaagagugaccaagguaucucagauugaccaucuuccauuuacuggugauagguuuccacuguccucacugcauacauagaaccuacaucuuuuccccauagaguuccacugacuagcugagauuccagcuuucuggaaccaugcacaagagccuacaucugagacagcacauggcaguugaccagcuugucuuuggauuauagucuccugcaaauaaacacagggagggagacaucaggcucugggacuucuuaaugucuaguacauuaauuguguuaaauguggaaaucucuaauuaauuacuaccauaaauguauuuguuugguuuuguuuuguccuuguuuuuuuuuuuuucuucaaaagacacagcccuucauaugacuucaggaaacucacauuaccagcuaaugugcaacucucuuaaauaaaacugagcugucaaaaauaugugaaaacaauuauauguguuauaaaacaaaaaucacaaaucucuuuauuuucaaaaguguaauuagcuuuguguauuccauccaaauugagacuaaaauccaggaauuaugugaucauaccuaaacacucagugagcagccauucauuccuuuguaguccgcuccuaggcgaggcuggcuuuccuccuguuaacauguguguugacuguaagcucacuugucagcuugaugcucguguuuucuuuguccuaguuuuaaccaauauuuuagaggauacaacuuuauuuaaagauauucauagauuuuuaaaaauuaauuuuauauauuuuuaucuuauguauauggcugcuuugccaacauguauguuucugaacugugugcauacaaugccuacagugggcaacaaauccuccggaacuggcauuacaaaugguugugaguuguuauauggaugugaggaacagaacccgaguccuguggacgagcagccggggcucaugaucacugagccaucuccccugccccaauaugcacauauuuuaaacauauguaauaaaucaucauguugucucuguggcccuacuuuccaagcagcaucucuaacuuuuaucaugcuugcuguggguaucuggagaugaacccagggaccacauuugacugaaguaguggagaaaggcaaugagcaauacacacaauacaaggaagaaaauauucacuagaaaaugacuugcacagaacuaaguguaagcacaauggaagacucuagccuuacagguaaggccugccacggaagccucacacagucaacugaggagcccuuacuaggucaucuugguaggcacagaccuuccuguuuauauuucaggguccugaaaucuguccaugauaaauauggccuucagaagucucaggcuuauggcuauaaaaugacaaauggcagcauuaaucuucauguuguuucuuuccccuauggucauuauagggccagccaaggucagugcagcaauaugucccaagcacagguuuucuucuccuuuccugcagagugucaacacuaccuauuauauguacuuuuguucacauguucccaaauucccauuccaguauagauuuuagaguuucggagucucaaauacacaaacauaagggaaaugugucucuucuguguggcaugcagaucugcuaugcaggcuacugagcgucacuugugucccuucacugguacaaacaccuguaauaggcaagaaguagcaagguauggaaaacauucacuacuucaaaucugcaagugcucugccucuggaaaaacuggagacagugucaucaucugugugaauaggaaagauucaucacccauaaaccgaguaaucaacuugggacccgugccacuaacagucacacugcuauucacauugugcuuucugucuccaguccuguugacauaauuaagauguccuuuacuuacggaauuauucucugucccgccugcauucuucaagaacucuuuguacagaaccacagcuguuuaugucccuaauaaauucaacugcacaaccauuuaacccagagaucgaugauggagaaaaugauccuacacaauuucuuugaggaugauuucaugauuuuguauaugugaaagcuuaagagcaugcugcccaccacaucaucuccuacucucaagggcugauuuaaauaggaaauauguugaaauaggaaaaaauuugaaauucagcuguucacacuagaacuauuacaaauguuuuacacagauacacacacacagacaaacacacccaucaucauagaaauuuuaacugggcagcaguauaguauaaugccuucccuaaaugaggugaaaaaaaaucuuugaacuuuuuaauuauuuuggaucagugcaagugcauacauuacuuguuaaaucuccaugguguugaucgauuugugccauaaguaaaauucacaauuggauuugucaagcuauguggacugugaauguuaucaauacuuaggaggaauaaugagguauaguugguuacugucagcuggacucaaacuaauuggaaaaauuuuuccaaaaggaagucaugcagggcaggcauagcacuguugcuugccuaugucucucaugaugguguagaauauuccucuaagcucauacaguggcucuuaacacuuaaguagcuacgaaaucaaauggccuuccuugcugucugcuucucuucuucuguguacuuaugcguauguuacgaguagcuagauauuagugaauuuguucuucguucuauggagaaagggccagacauggugcuaagcaucugucuauguaagucagccggccccagagcgugcugcucaguguaaggagccuacuugaguagaagcagcguaucucuuuuguccuguccugugaccccgagucagagugauaacagacuuuugcaggagagaaccaaugugggucucuguaggaaaaauaccaguauuuugaagcaaauuaaaccauuuaccauagaccacugcaugcuauaaucuauguguccugcucccuugauagguauaugauguggagugccaucuauuugucagcuuguguagauccacaugacugcucaugugaacuaaacuguauuuguuuaucuuagagaaauucuuccuuuuaaaugguauuuggaaccuuuacauuucucugaagauaauauguaaguuccaggugugaccaagugcuacagguccuccugucccaucauccuucacucgguguaugaguugaaggacagauccacaggacaauggccucuguguauggagacuuugggagguaauugucacagguuuagaugaaaucaggaagagucugacccucacagugggauugauagagagacaguguguguucucugccccucuccaucaccaugugaacgcacagcaagaaggaugcuaugcaugggaugaagaauguauaucagugguagaaugcuugcugagcugaaauaaggcugcccacaaaagcagcuaucuccaagugaagaaaaaaccucacagccccaagcaugcuaucacgugaggcuaauacaggacaucuaacggcauguuagaaggaaguuuccaagcgaggaagaagcuuguuauuuguucuucuauuucaaguugagaaugaaaauggaaagagagaguucucugagcauucaaagugcaaauggcguuuaauuuucaggaagaagcagcaacguccaugcuaauaaacaaaggacaggaaaauccccaacccacacuaaugggagcauccuuuuugacaccaguguggacucaauucuucccauucaaaaccaucuaauaucaagacaguaguucugggggcgcauggaaagggcacagccuggaugcagugccaggguuacagacaccugaaaagaugggucugaaaggagcagcauccaaguguagaaugaacauggaacuguuuggaaucuguagcacauaagauaagagccaaguaaguaugagaaaagucaagaauguuaagcagagagacuuaggauccaacagaagggauggauauggugaaggugacaugaaggcuucagauuagagauucuccaggcacuugugauggaugcuugucuuuuagcuguggcgcucuaguggaaaaacacagggccaugcccaacaguuaagggaugugccuuaguauaugggggccagagguggccagaacagugacucuagucuaaucuugcuuaggauauagaaggaaggacugugugguuagagcaaaugggccacuauagccugguuuaacauuuguguauguuagggcgugguaacgaggaccaccauucuaaucuggcuuuguguguaucgaaugguggucagagcuuuaugucugcccaaaccucuuguuuuggcaguggcagccagaagauguggaucuagucuaaucuuauauaugauauggaauguacuagucagagaaagugggaccacccuaaccugggguaggaugugaggaauagcugucauagacaggggguuccuauguauguacuuaagcugagcuguggucacuggagacauaugcucucaauuguaauuuccagaugugucauucaaagugucugagagauauuugucugaauuucugaggaucuuuuuuuuucccaacacuaaccuuucuggaagcuuuaccugcuuacaauagccaugucuuaaagucagccauuagugccucugcaugugcaucugcauaucaucuauuuagacaaacuaaucccucagaaugcagcuuugaucggugaaaggccuggccaguggauauccugaguauucugucccagaaccauugccccgccagccaguuuuccaaacgaccuucuguuuucacugcuuacugaaugugauaaaccuguauuguuccauaguccaguugggugugggacagucgaccaugcuaggaggcuugguaagguagagcagaucugaguccucagcacccagacauccaccaagcagcucccugcucccucccugccagauuccgguacuggaaugcaugccacacucccuuuguuggucugguaguccgaaacacaguucuccauguuaaugagguaucaauaggcccugcagguuuagccaauaagcuucucuucccagacauaucucccugcaaaagguauuuaauuucugguccacccugagaaguugguaugcauccauuuuccacgaucaacagucaaucaacaguguggauaaacauggacugccccuuccaucagagccucuguggggagcauggaggaagccuuugccuacagagcugcagcuucagucuccuguagaagaccucucugugcuuccagacaccugcugcuaccuuugcugaagcccaguacccaaaggcagggcuacaggcagacgcagucaagcacucaguuucaccuccccagcagagugucccacaccuccaugguggggcagacauggaccugcagguuggggcacugccucauacccuuggcugcggagggcaacagucuucuugguggcucagucuuauaggugagugaacagaaucgggcgaggacacaggaagggaaugguuaaucagguuuuagaugacucaagggaggaaaaugcaaauauaaauguggacugagcuuuuuaaggucacugaaaauaacaggaaguccugugugacccuccuguuuuaggaaccacuggcaucagauacauucccuugagaaaccacuucacugcagguuuccuuugguuaggacacgaaagggcacguucuacccucugcaauagagagcugccacggcaggugcuguacuuuuaacucauggauggagaaaccuuccguaagucaaucaucacuccucacuuuauuacuuuaucagaaacacaugggugauucugcccuacuccacuggccauuacuggcaguggcacccugucuccuguccauuucaccauggcucuuccucugccuaguuuccugugaugucaacagacuuaggcuguaaggaaaucuuagugccuuucauuucucucuuccacaucugauggaaaucuguuuugaaugccuucugcuauggugucugaaccauggugacaucacugaugggucaccagacucacggcauaagguucaacuaacuuaaauaucuuacuucuccuucuaaaauaauacucaacaacgaaaaugcauucaugguucuuguucucuugacuuucugauauuucuagauuuaagcucaaaguauaauugcccuggccuuuuuuuuuuuuuuuugcuaucagacuauugauauguaaguuuuuuuuuuuuaagauagauucuucucuuguacaauccaucaggcccaguuuccccucccucuccucccauaccccuuccaacuuacccucauccccuuuccgacuuacccucaccccagauccacuucuucuccauguccuccucacaaaagagccagacucugagagacaacgaccaaacaugacaacaacaacaacaauaauaauacaguaagacagggagaaagcuggaaaaggcaacccaacaggaaaaaaaagaguuucaagacaaauaagucaaagacacccucacucccauaguuaaucacacacacaccaagggaacagccacgcuauuuaugcagaugaccuggugcagacccaugcaggcuccaugcucgcugcuucagucuuugugagucaaugcgcagccugcaugguugauucagugggcuguguccuccuggugcccuucauccccucuggcuccuacgaucuugaaauccccucuucugugggauuuccagagcaaugaggugagcaaucugauggagaucuccgauuuugccuuucuacauaaugucucaucguggguucauaugcucacucugaugauggaggaagccucucugaugacaacuggacaagguaccagucucugaguauagcagaauauccuuagaauucauuacacugauuuuuuuucuuuuuuuggcuaguuguguuugguucuauccuaggucucugggcuauccagucucccauuccuggccauccaagcaguaucuggcacggacuccuucuaguggaauaagccucaaguuaaaucagacauuaguuggccacucccaacguucaugccacuccuacauguucaugccagcauugcuccagcacauauuguaggcaggacagauugaagguuggugguuuaauggcuaaguugauguccaggcuccauguagcaucagaucaaccucuccauguucagugagcuguguggaagucuguaggaagggaaccuggcugucaguuagcagagggaaacgcucuguccucccaucagccugguuguuugaagaucucugcaagaccuucucagccaacaucucagauagguaauuuucuuaagccuggcauaaugaaauuuaauagauucaguagcuuauguuuaucuuuucagaaugccaagugccaggaggcugggaucaggauuugagaagggcuguacuucuucugucucacuucccuccuggguuucuaugcauugucuucuucccgagucuugaugaggcuuuuccauuaaacaaaggucccagcuuccuuuuccuauuaggacaucagugacauuagauuagaacaugauuuuuuucuuaaucaucucuuuacagguucuaucuccuaaaacaguccauucuggauuacuggggggaggugaggaucaggaaucuaaccuaugauguucaggagccacgacuacauucauguuagugugcaucuugucuguucacuuucuuaacugugugagguguugggaaauuaagcaucccauccaccuauuuugugucagagcagagauauggcuugggcccucugaugcuucaggcaauuauucuacacaucgcugcucucaugugaaaucugaguuaugccugggcugcugguaucuucccucuacugccuaauguguuugcucagcaccacugaauccucugugcaccagucccuuccuguccuggauucugagcagucauucacauaguaucccucacauauccucuuuucaaccucuccaauauucuggucccugguacagcaucaugggaagaauuugccuucuaauuccucuccugaccccacccuuuucuucauguauucauagggugcuuccccggaauggacauuucacccuucaaugagaaugcugccuugcucagcaguugugccugcaagguuuucucucacuaagcgaguauucuagacacuggccuuguccauuucgucccugaaaugaaagcauugcuuucauaaagcucuuuccuccugaaaaauucauagcgcucugagcacguacauagagcaugccuguaggugaguagguggcaaguauuuuuacccgguuuuauuaaagcaguggcagaauucucugcaaaacagugcccccuggaaggcuaagcagcuuggacugagccagucucugcucugcauguuuuauccaccaccaccaacucucuggggacaaacagaacagaucgaggacagaagaacaucuuuugcagagaacacacacacacacacacacacacacacacacacacacacacacagagagagagagagagagagagagagagagaguuaaauagcuuccaggugacagugacucuagaauuguggagugggaaugucaaugguaucugggaugagccugacagggaaauugcucugaaagaacaacacacucagaacuaugaauuagaaggauuagagcccaccuguccuucgacucaauuccaauaccaguucuguagaaacaaccuccucugcccggcucugaaucuuuuaucugcucuucucuuguaguauaauuguuuucuuuagccucggguuuguuuguuuguuuuuuuuuucuauauuguuuacccaugaucaacagugcuccagaaauacuaaauaaaaaauuagagaugcuggggagaucgcaugucaugcaaccauaaacaccugaauucagaucccuagcauccacaugaaagccaaaugguguagcauacaucuguaacucacagaaacagaaacucccuggcgcuugcuuccuugccagccuagccaaucagugagcuccagguucaguuagcuaccauggcuccaaagaacaagguggagaacaaugaagaaaagcaaucugucuuuacuucugccauccacacacacacaugugcauacacaugacugagcaucucucccacaccgacauacacacacacacacacacacacacacacacagauacacacacacacgugcauacacaugucugagcaucucucccacacucacauacacacacacacagacacacacacacacaugugcauacacaugucugagcaucucucccacacccacauacacacacacacacacaaaucuuuacauaugcuauauacuaaaaugcaaaaauacacccuacagaauacauuauagaaauagacagugaaagacuuuugagucacacagugucaauaguaccugauaacuugcagcaucccagugcuuccuccccaggaucuugccacugcucaguguauccauacuguauaugcuauccucacauuagucacaugguggcuauuccaguugucagguuggcugacauaguaucacaguacguauguucagaguaaccuuuauuuuccuuaauaaugacccaaguuacuaaaguugacaauggaaaugcuucuuuuagguaaugaaaaaaaagcaaaaucccuggauuuaugauauaugugccaaaagaaaacauauaauauuuauaugguuuaauaguauccauauucaaguucuuaccuggaucaugggaugugccccucacuaauaagggggaguucuuuauaacucauugggcuuaguucuauuaaucaucugcauggaguccaugaaguuuucaacucuguggcuacguaucccaaaauguuuucuguaguggaaugaaagggcuuguuuuaacugucaccuuguugggagguuaggagucccuugaaaggcacacagaacacugcuuaguuugccuuauccaucagcucacugcuugacuauauuaaagaagucucuucucuugagccaagacuuugauguaauagacaggagagcaugauucaauaagccacuuuaucuccagcaucucugagagccgcagguguccaccugcaugaggaccauugaguuugccuuuaccuccugcaaacuuuccccuuggauggacacagccuagugccaaccagcuagguauugaccucccaggaggaucaggagcagcauuggauggcucaggccuccaagugucugcugcuucuaucaaaggugcuuuaaauagagcugccuguuaaaaauaaguacugccaauucucaagccgccccguguuucccucuuucuugcucccuuggauguuuuucacgaugccacaaaagucugaaaaacauggauaauggagaggaagagagagcaagcucuuuugucauaaggaugaagcaugagucaucuguucugacucaccuugaacauacaaagggagccaaucagcagggaacagucuaaugggauguuuuuccagugacucaugcaggccugcaacaaggguccagaagcaaaccaaacaaguguauuuuuaaauaugggcaggagcauuuucuaggacaaucugauggugaguccucacacuugcaggcuuauuuuaagccagacccugaaaugugugggcguggucuccacagaaccuucucccgugguuguguuuuguuuuucuauguuuaaagggagcguuuaaugauuaaacagcacuuaacaggacuauaauacuccaggguaauaugucugcaugaggagguaagaacuuucuaaucuagagaguccauugacuuugcuccugugcacagaaggcugcuucauguauaauucuauacugaaacaugaaaguaaaguaauaauucaagccccaagaugcuuagaguuuuuacagagggucacaggaaggaaaaaacaagcagagggguuauaacuuggaaaacguguguaauggaaacaccuaggaagaucacccuauggaaaugaguaaagagacccauagagguggacaugaaacccccagcuccuggaagaacuguauuugcugcugcugcuguuggaggaggaggaggaggaggaggaggaggaggaggaggaggaggaggaggaggaggaggaggaggaagaggaagaggaagaggaggagaauagaauaauaaguuaagaauuuacuuaaggauuuugagcagagagaacguauagcucuaguuagguuauaauuccuccucacuaggggucaguguggccuacugaaggccacacuggacaaacaauuugccaagaauuuccuaggcuguuacgcuuugcucucuaaggcccucagagcugucuacuaauuaugauggguucacaaggacuccacauuagugaaguacacucgauauacuguauggaaguuggugucuuaaugggugacuugguggaacccagcccacauuaaaaugucacaggcagauuguuagaaugcuaaugacaaugauguaaucucuuuggagcuuguguagucuucgugauugcagucucaauggugagguggcuaagaaaggcagcucaaauguucgaauucaguugaggaugcagaguaagacccuauuuuuucuuuguuuuauuuuauggagaaauuucuauaaaacaaaaguucauaacaguaaaaggugcuugcugccauccccaguauccacaguguggaaggagggaacugacuucuuugaguuguccucugaccucaagucguacuccauaaaaaucccauacgcauguacgcacacccacacucacacauaaacacacauaaacacacacacacacaaacauacacacacacacagauagagagacagacagacauggacagacacacacacacaaacagacagagauaaaauagugaagguuacaaaauccauuugucagagaauaguuuuaaaaacauguuauaaaaauugagcaacuaagacaagaaguaaaaaugucugcagguuacaggauggaaagugccuuugagcauaaacuuuugcucauguagaagaacauucccauaagugucuuccaacugaguuuaagccaucugacuuuuagucccauccuucgucaaguuucuucauuaagguguguucuuaucuaaaacagaaccucuuccugguaaagguuuaagcacagagagaaaugacaccaagacucuggaagccaacauagcccuuacuccuagagucuucuccaaaaauccccuauacccucccccucccccugcuccccaacccacccacucccaacuggaauuccccuauacuggggcauauaaucuuugcaagaccaagggccucuccucccauugauggccgaauaggccauccucugcuccauaugcagcuaaagacacgagcucuggggguacugguuaguucauauuguuguuccuccuauaggguugcaccgcuuucugugccuccacgauuuaaaaacugagucggccaccaagcaugguggcaccugccuuuaauccuaguacuuagcaaagcuugaggccagccaggucuacacaaugaggaugaaaacagccagagcuacuuagugagaccaugucucaauggaaaaaacacaacagcaacaacaaaaagaauuaaaccugucucauggguauccuaugaaaauuaaauaacuguaaagcaccaagaagagagacugguacauauuagaguaagauuggaaaaugucaggcuggguugccaugcccaaguauucaaucccaccucauaugaagaggugaaucuucaggaaaacacucaaucagagaauuuguauuuagcuuugguuuuugagacagagucacacuguuuagcugaggcuggcuuggaacucacuacuacauaguccagacuagucacacuguguuuccaaggcuggcuugaaauucuacauagccuaggcuagcaugaaacucaagguaggacuucuaccuuaucuacugcauccacuuggcuuccuuuuuauuuauuuaguuauuauuaaaccacuucagaaaaacauccuaaggaauuuuaaccuucuucucgugguagaugcuaucuuuuugguuagugaaaagacauuuuuuaaaaaaaaauuuagaauuauuuauuauauauaaguacacuguacugucuucagacacaccagaagagggagucagaucucauuacagaugguugugagcuaccaugucguugcugagauuugaacucaggaccucuggaagagcagucagugcucuuaaccgcugagccaucucuccaacccuaguguaaagacuuuuaucccaaaugaacaguaagcccuggauccuguuauacuguuggucagugagcugaaugauuauauaacuuuuguuuuacuucuaaacuguccaaaaacaaaauuagagaggaaagaguuugucuuaaaaucccaguuuacaguccaucauuaagggaagucaagccagaaauuugaaggcaggugggcuuuguauuccuaccacauuuauuacuucagaccagugaacuuauuuuauagcuaugaaguacagcaggaacucuagaggaggguagcuuauaaucacuagcuuucuuacacaguuuaguaccaccugccuagggguggugccacccacaguaggccuuuagacaccagauacaaucuccuauagacauguccacaggcaugcucuaggcaauuucccaauugauaauuucuucucagacgacucuagauuauaucagcugacaucuaaagcuaaccaagacaauggacuacugcuuguugccuuagacaagaggacugauacaagaagcaucccagggaauuggucugaagaugaacaaauaucugcguaugaaaauaauccugguuacuuguguuuccaggcagcuucccuacuuggucauaucuaaugccccaaguaucauggaauaaagauuauguccguuucaaauuguuuagccaguugucacucuguccacauguugagaaacuucuguuugguccccucaaagcucucacaugauccuugaccacagagugugauccuugaguuuuucuauuuaagguacugaacagaacuauuugagguaaaaaugauagggacuuaacucauugcuucuuuccugauagcaaucuguauccucccaaaucucacauuggcaagggcaugcuugucaguagauuacuccccuacagucacccaugcuucccuuaauuccacccccaggguuaaguccuguuaacagugcugagcgagccuugaggcuguaggacaggauaagaagcagcgagcgauaaacucugugccugugcagagcugggggugguugaugcagaaccccaugcuggggcugacuugaagaagagggaugcuucuuuguauuuuaaaaauauaaucagauuuuuuucuguugaaauuguauaauaagguugcuuccauuauaauagucuucauuuuuggagaagauuucuauagucuuucuaauauucuuuauaauagucuucauuauucuuuuuuuuuuuuugaggauuucuuuacucuguuuuuaaauuuuacugucuuuuuaaaugaggccucuacacuguuuauaauagucuccauuguccuuucuguagaguccaauuuucaggacagcuacagaauauauaccuccuccuccuucuucuucuucuucuucuucuucuucuucuucuucuucuucuuucuuucuuucuuuucuuuuuuuacaauuuucuuuguuuuguuuuaugcugggucccuacuguguucagaagaccuaauuaaaacaaacuuagacugagacuaaaguaugaaguaaaguaugucagccagacuccgacaacuuuaagcuacacuauuguaacaaaaauaauucagugcuccaagggauggauaucaaauauaccacgaguugucaaagcacuggccaaucgaacucaugaccugauuuuuuucauugucuucuuuuaagagaacaucuaagauugguuucaaaaagucaagguugaguagacaugcacugggucauuuugaaggauggacuauuuuaagacaucagauaaagauguaugugauggggcaccuucuugggcaagucuccuucugucugaugccccacgacaggagugcuaugaugcagcugauugcacaaaagcuuggggauaugcuucauguccuguaaaugaaaggauggaguaauaaaaaccacagagaagggaaaagugcagcugguggugcaagauggauggggaccaagaaaaagagugugagcgaccguguuccugaaagauugagaaagugaaagccaugaagagaccagccaugacuaaaucacaguccuguuucucgugagcucgcuacucugagggacagaagauacaguuuacagaagccugaguggugaaguaucuggagcagccaagagccaaucuagagaaaacucacuccaugggcuuugcacaaagaauaaccaaagagcucgacauguugaggcacaaucuggggggaucugugugauaaaugcugacugcaauugacuaucggaguuuacucaguggucagaaauaguuccacauggcaguaucagguagaacggaguuggcugccuugcugaggccuucauaccucaauuagcggcaccuacaggagaucacuguuagcugacuucagcagagacauugacugaacaaugacaagcaggcacauguguuaugagcaagccuugaccaguuagcccuuaaaaucacauguauuuaaugcagaauuacugauauauauauauauauuuuuuuuucauugcacaguacauacagucuaugggauacuuacuagcugcaguuuaguaaaccuucaguccacuguaacccucaagugccuaacaugcacacacacacacacacagaguuauuuuauguauuuuguguguaugaauucaccccacaugaaugcuuggaaguuaaagcuaguugugagucacuacaguggcgcagguccuaagagcaacaagaacucuuaaccacugagcgaucccgccaaccuuucugacagccucuuaguaugccauuucucaggaugaauuuucuuaaauaguguuuaaaagggauggaaugaagcuacuuucugaaugugcuccccugcuggagcugcuuuggacuguaccacucaacuagaacauuccucaauuucucacuauccuucagguuccugaagagaagcaaguccagaaagauacauaauacauacauguguaucucuauaucugcauaugcauauauaacauauauuauauauauacauauauauauauuauuuucuucauaagaaaucucuuauguauucauuaauauacauuauuuuuagauuuauuaugaggaauuaguguuacuggagacgaagcagccccaacaagcaccgugugggaagaggaaagccaauaaagcuagugauauuauuuggccuacaucggagggacagagaaguggggaguaaauuuaagaucuucucuugcacaggggaaguugagcugacaugucccagaucaagcaguuagggaggcaagaggaccagauuccuccugcugcuaaauuuugugcuguuggauuugagauggugccaaccaacacugguuagggcaaucuguggcauacucauucaaauggcaacauccaaaaccacuucaacagaccaguacaagucaaucuugaccuacaaaauuaaacuucaccuugacccccaaagccagguauccuguauuuauccagcuaagugggcuccaccuuaacgagcaucacaaagccacaccacugagucugcuuuccaguaaaugcuuucccucugccugcuuugcauccuuggcccaggaaugugcagucucaucucuggaagcagcucuggaaauaaugugggcuuuuuuucucccaucaaauaaggucccagagguguggauucuguucuguacuuugcuugaucucaguuagaggacacaggagaggugcgggcgcauaucggcaugaucauuuuauaauuauaagcaaacucucaggggucuccacuccuguuaucagaaaucuucagugacugggauuucuuuauauuugcuuuuggcuaaauaguucacaagaugaccuugacgaugcuacuuugggacuuaucagaagaacuggguuaagucaugggaagcuaacucaguaagacucaccacaacuuaaaccaaacauauguugauuaaaauauaaauaauauauaauaguguaugugugugucuguaugugugugugcauuuuauggcuagcgugcacagagcacuugauacauggcaccugcauguuucuuacuggagacccaguuauuuucuuuuacuuucccauccaugugcaaauaauauuuuuacauaauuauucugguacuacagucuuauaaaucuuugcauuugaugauauuggguuuucugaauuugccauuugagcuauauauucuaauugcuaauacaguugucuuuguaauguuuauaucugauaaccuuugaauaacuuuacauucaugucuaauacccacagaucaaugaaauagaagguacuaucucuuuauuuuaaugagaaaaauuaagauucaguacaaccauagggcacucaagauccuguugcuacucaggggugauagcagaauugguacacagaccaaccuccuguggucccucuggccuucuguauccacagucuucaugacuggggcacagccucaggaaauuuugggggaagugucuugcugugcugugugucuugauuuucagcaugaacacuguuuuaguauuucuuuccuuuuucuccagacucuggaaaaaggccuacaaggaaagugaacagugaagcauuggguuaacuacuguugcugucucuguauuguagauuucaugcuauuuuuagguuugguagauggaaaaaggagcagcuagaguucuaguaaagcugauuugaggaacugugaaguucugagaaaguuuaaagucuccgauucugucugagguaguggggguggggguggggugggggugggaguuguucuguauugccugaauuuaugggaaugagggaagugcaaguuuauugcccuggcucuccucaccucuccuaccuacaaaagguucugaacuuuaagcgucuucccacacagugcugcucugcaccaucaacagcaaagguuuccaggucuaaaaauagaaaacccaaggucuucugggaaacagcaagaagacuuccugcaaugauacauauacauauacauauacauauacauauacauauacauguacauauacauguacauauacauauacauaugcaucuuagaauucauaaauguauaaucggggcuuacuguaaaaccacacauagucuuaaugugaguuucugugccacagauagcugcugacauuuugugacugcucuggcaauugucaugaguuaaauucuuuugaguauauaugacuuaucaccucuuccuuguaauucguaauuuuacaucaaaaugucguuaugugcuagcccuauuuauuaaucuuucaaaaugcucauuuccaaagaugauuguuugucaaaugauucacacugucaugguauaaacaguauaauuuucccagugcuuccaaagcccacagcuccaaguuccugcaaauggguuuaaagacucucuuugcauaacucgggucaugaagagauuuuuggcaucuuaaaaaguacauguguccgagaaaauuaccaugauagagcaaaaauugucuauacuugccugugucuucuuguuaucucaucuuuagucagguacuuuucuuuuguaaaugucuacauuaggugguaugaauugguugaaaggguauaaaaacaaguagcaauuuucuuaugaagaauaaauacuagcacagaaaacauuaagcuaaaccagaaaaugccauguugaugcuuuaauacccuaagaugcacagauggaauauguagccaucucgucucuagacagagagauagaaacuaugaaauuuggugcagccacaaucuccuaguucuauaacuauugacaagcauuagagaguaagaaauaaaaauaaaucacaaucucaugugcacacauguguugugugugugugagagagaggagggggagagggagggggggaaagagagagaaagagagaguugggauuugggaguuagcaauauauuaccuuaucucauguauaaguauauuuucaauggggucucagaaguggguuuuaaggucacaggacauuuuuaccaccaguucuuccuuccugcucauaguauauucacuacaguauacaggccauuauuuucugagaacgucaugacaacaugggcuucaucucauauuauccaauagaaaauaagaauacauguacuuuggcagauguugcuaguuugggugacuuuuguauucuauguguuguacuggaggcuaaguccccaguguaacuguacuaaguagaacuuugaagaaauggaggcaagucagucauugagagcauugcugugguuaggauuauuuauugcugguuucuuagaguaaguuaguucucuuuuaugaauagguuguuagaaaaacaaauuugcuuuuuuuuguccuaggauacaaucucuccuucugacaaacauucccacaauuguuuuuucaucuucauguagacaaaaguccuuaggggcagcagauguuagcacaauguucuuggaccuuuaauuaugagucguauaagcauccucuuaauaaaaaaagccuccagccuccagccuuuucuuacagcaauagcaaaugggauaauaauucugcuaaauacgugugucacauucuuacuuuauuuuuagaacuuacauguguauauuauaguuacuuagaaaugaauuagaugauggcaaauuaacauucuaaccuaacccugaaaauaucuuuauauuccaaacuaaaaagaccagugagucaauucucuuguacaaaauggaaucucacugagauaaaaauagugugcuuaagaacaauuuggcuuuaaaaaugucguacuauuuuugucucauugaauguuucucuaaauuucauuuauaaaaucauugccugcugcuucaauuucuuucuucaauaggccuugcuguuuucuuuuaaagacaauaauaaacucacccuccuuauaauuuuuuuaaucucugaauuaaagccuguucuugagacccaguccuuccaugugauuauucacgaacucuccuauguguguggccuuggacaucuauaccaugacugauagguuuuguaaucuccuugauccgaacuacauugagcuuccucuuguguuuuccacuccuagaauucuuuuuguauugcaugggagaagaguguggaguagaucacaaaaagacuuuuccuguguaaccagcugaaacagcuaggaaugaauugaaccucaguuguuuaacuuaaagcaucugugauuacagagucguggaugaacugcuuuaccuuucucauaguucuugccuucaaguguguaagacuauucuaauggauucagugauagcuaaucucauuggccaugugacacuccauggaaaaagggaaccuuagcuggaaaauugucuccaucaagauuggccuagagacauguuugugggaacauuuuacuguuugcuguuugauguagaagaucccagcccacugugggcagcaccauacuuaagcagguggaccuugguuguauaagaaagguaucugagcaagaauaagccagagaacaagccaguaaccuuuguucuuuggucucaagcuccugccuugagcuucugaugguacauugaaacauguaaaaugaaauaaacccuuuccuccccuaagauaguuuugguuaugguauuuaccuacagcaauacaaaacaaccuaggacagacucuugacugucuguauuuugaauguuuuagagaaaaaacucuacuacuaaauauuauguuuguuuguuuguuuguuuguuuguuuguuuuuuauuauggaaagauccuuaaagagugacauguccauagaaguccuauaguuguuuauguaucaugugguaaacuaacuugccccagauuuguucucugccuacucuucagugaaaggggcaagucuuaaagagucauacgaugaaguaugcaugauggugcacauuugugugcccaggaggcucaguuaagaagaccacgaauggaagggcacccugaggaacauugcaggaccccgccucaaacaaagcagacgagaacaaaacaagaguguaaaggcgggccuuucauggagagucugagcacacugacugcagacauggaaggaacacuggauucuguuccuggccccucacugcagggcacuuaacuccguuacuccuuagguuucugugugcagaucauaggaguauuuucaggugggaaaaaucugaacuaagaguucacagcccagugaaauuucgccuuugagaucucaauacucccacagguuuuaacacaaucaauaagaaauaguaaagaauaugcaccaaauucuucaugauaugcuucacagaaaucaaugcucuugaccuucacaguugacguaauaggcuccaggaucuuaacuaucuaaggauauaaaucauuugaggaaacaucaaauuugacguuuucaugcaaauguguuugaccagaacacuuguacucaugcauccugcgcauguuuucuuaaauuacuauucaaguacuuccugaaccuuaacuuuccauaugaauaauuaugucuaagcauaguuucaaaaauguaaaaacagggaucuaagcacagaauuccagaggaaaaguuuggcuauggugucuucacaguggcaccaagagcucuuucuaaucaucuaggauacagcccucauuuuuaggcuaauaaacgaguuguagaagcucagucguagucuuacauuccagacauaaaagaauuaaauaggaaaggaagaacaaaggagaauaagcuaguagagccucccucuucucuuccuuuccuggaaaguugacuaagaaauggcuccuuuuuuguuauuggucaggacuuguucaugugacuucucuuaguuaaaagagagccuagauauugcauuuugcagcugcuuucauugucaacaagaucaaaauuggguuucuguugacauggaccugaaguuuugaauuucuugaauuacaucaaucaugugaauucauccagagggaccuucacuagugaccaacuaccuggggguaacuugguauuugguagccagugaguggagcuuuauacaacaaaagcuuggagcaagguugugaauuuuuuuuuuuuuuuuuuuuuuuuuuuacucaggagagcugucaaggugcaaugugucccagacccagagaaaagagaggaaaggcucaaaaaacagugucccugauaaccuggaaccuucuuaagccaugaguagcagggcacaagcagagggauggauaauagccuugaaaugugacuuacauauucaauguagacuaccuugcauaacuuuauaaauaugugaugacgaaagaaguugucacuuuagaauuguguuugggagguucagcagaggcaguuaaccaaugaauacauauacggaggaaaagcacuacauacagagcaucaaugaugagcuuuggaguuauuucuuccuagguuuucauccuggaaguacaaugugugauccauguagaguggucuaaaugagaauggcccacauaaacucauauaugugacugcuuaguccucaguugauagaauuauucuggaagaauuaggagguguggccuuuuuguaggagguguguuacuggauuugagauuucacaagccugcuauccguaauuccuuuugcagaucaggguguaaacucucaaugacuucuccaacacccugccugccugccugcccgccugccugccugccugcucccaugcuccccaccaguggucauagacuuacucacugaaacuauaagcccccauucaacucuuucaucuauaaguuaucuugauuaugguguguuuucauagcaauagaaacguaaugaagaugccaugcaccuugaaaaguugucucguuuuucugaaucucguuucuuaucuuucaaacaagaaaaaaauggaaaagaaaaaaaaaaccaaaaaccuaauacaccucucaucugcuuguacauuacugauaauaacagacaaaaccucuguccagugcauggcccacagugguggaauugcuaguuuuaguucuaugaugacagggcauguguucucaacuggcaggcacuaacugugcacuugcugggggagccccacugcauugcaggcuaugcucuguguucuuguugaaggagguguacaggagauccagggaaguacaaggagaaauuaacuuucuaggcagcagccaccaggaaguucccugugcucuugaugucagcgaaggcuguaaaccuccugcuagguccacuaaauuguagguuuccaaugcuuacuugggaccaccuacaaaaagcucgugaugaaaggcuucguuucuacaacuuuugccuuccucauauauaaaaugaauauacucauaauguccaccucccuggcauguuuucaagauagugccuguggaaccuggcccguaaugugcauccagcaaacacugucaauuauaagcuacuucccucuuuccauccaaccaaaaacagggcucauggguuuuggagcugucucagcuccaguaaugcuauaaaaauuuaacuagggcauaaaguacacauauaaucacacuagguccaaaaaugauucuaugauaaugugauuaauaacgaguucuucgaucguaauagcaucuuaaguugcuucuguagacuuguaaauuucauaggcuccagugcuuaugaaagugagacuggcggcucauugccagggcagcaagcugcacauuaggccuguauugguguugcacacucccuaaauagcuuugugucucaggucaaaacuucacauuugcugcaaucucucuggggggacugacuuuacuugugugcucuugcuuuuccuugcugagaugugaacaagcuugacaaggaaaucgaggagaguccuuggaacggugugcugguaucugagauuugucaugaccagcaccucccuccaugcuccugguaacuuuuaucauuuccagggcagguuuucuaugaauugugccaggugcuccucucgaacgccuggaaagaaaggagaaugauuuucauuacuguuuuuuagguaagaaaauacaagcuaagcaauugaaaguaacaucucccuccuuggcaugggcuagacaugacuccagaucuuugcuucucguuccuuuuugcaugacugcauugcagguuaccucuguccuuaugccgucuggagacacugggcauuucuauaucuucauaucaaauuguauuugagaaggagugagcuguauaaacacacacccagauucuuuagaugggcagacgacuagaagcucuaugcucauaaagccuguggaugggugggcuuagcacauagcaacugugcuggagcagaaccuguucauucuaggaaugccgggguucauaaccagcaugguguuguaccagaaaugauuuggcuauucauacucauggcaagaagcagacguucucugguuuaaacuccaucccuaacccucccgcccucuccccuccugaauucccaaagccuaaaauccuaccaccucagaucuugaacacuagccaaacuucgaagagauuucaauaaaauagaagcguuuuccuucagagcguauaacagcacucauuauaauuagugugcauacaugcgugugugcauguuuaaaccuugaauuagggguggggggacaggucacaaagcugaguucccagaacucuaucacauccuccucuaugacacaagaaauaagagaugcuccagugaucaagcaaguuguaauauuuaucaaaggacugacaguauuggggggcuggagagauugcucgauggucaggagcgcuuauugaucuugaugaggacccagguucuguuuccagcauccaaauuccaguucaugacugucuguaaggccaguuccacaucuggcucccucuucuggccuuuauaggcaccaggcgcuccuuccuuccuuccuuccuuccuuccuuccuuccuuccuuccucccucccucccucccucccucccucccucccucccucccucacucccccccucucucuuucuuuuuuuaugaaucuuuuucuauuuggagaacuggcugaaccaaagagcccuuccuuccaccacuugucacugguugggcuuauaugguuuuuguuuuucucuacugguuuuauuuauauuaaaacccugauugguaugcaugugucuugcuguaguggucguagaguuuguuuugcaaugauagaaggaacaaauacuuucccacuuaggggccccgaguucaugucauuucuuacaugauauaguagaaucuagaaaauuccuguuuggggagucagguuuaacucagugguagagcuaagcuaaucauguucaagguaguagguucagucuacagcaucaacagauuucuuugcagaaucugucccagaaaacagcuccuuguccuccagucacucucaucaucucucuuccucaccaccuccucugaagccauaggguacuuacauacaugcaagaugaaacacucagacacaugaagaaaugaaucuuuuucuuuuuuaaaggacuauaaaaguacaagccuaggacauugcuggaugugaggaggggcuuagggcaaaggggguggggaagcaggucugaggaaagggagggaggugucuaaccugucucuuucucaaacacgauaaccauaacuaggcuuggaagcagucugaacuaauuuucugguugcuugugagagcuggacauugcagcacucagagcauucagguugcuuugaccuccagccaucugugcccggccuguaaaguuaaauggccaguggcaucagauggugagugcucacaaacgaucccuguucacugccccuguaagagagaaaaaaaugcccccuggagaaauaaucauagaugcuauuuucaaagguggaauuaauuguauacucaggaaagcccaucuucugccaauuauucuauuagggugacagagguauugugccucugaaaacagcaggaauaguuucucaaaggucaccuaccucagcacuccuggaacaaagcccuuggggucacauucucugguggauuagcaagugacauuuuacagucaaaauauguaccuaagaauaggccugauccucugaccuuaagcuuuuaaggaugggagcugucuuuuggugacuuuuuaaaauuacuuuucccccguggucacauaaucuuaaauaugucccuuugucucuauggauaccaaacaugagcuugaucacacauuccacuauauuaauauguccgccucuguucgaucucgucccuccagcuagugagaccugcaacgacuuucacccgauguucuucacccaugacagaucuuuugaggaauucuucugcauuugcauucaacuccugaacaaaacauggaaggaaaugagggcaacaucugaagacuucaacaagguaacggguguggucacccgccaucugacaggucuggggcucacgccucagaugugguauacuauguucccucagcugugcauagaagcaguguucgagggaagagaaggaaaggagugugauuuuaaaucgcacccaaaauggaagcaaccacuagguaucugcuuggggucgcuuuggccccuuugucucagccaaggccaccaacugagaaccuuucuggagaaacucuccuggugauuuuuuccuuugugguuuugguaugggaugcuuugucacugguuugaggcuauuaaguaaggcgucaucccucuaucuguguagaagacaaauggagagccagccaauacagaagacaacuggcugguccauugguauguuuguguaguauggacaccuuaaguucauaugacugcuucuauguccaaauaacaauuauuucuaugauggagguucucucucucucucucucucucucucucucucucaucucuaucucuuucucuaucucuaucucuaucucuaucucuaucucuaucucuaucucuaucucuaucuaucucuauaggguuauauggaccauuucagaggacagcuugccugaguagucaguucuuugcuuuaauuguguugguuccaggucuugaacucagguugcuaggcuuaguggcagaugcuuuuacccucucggccaccucaccagcauuuguuuguucuuccauugucauuacuugugggaauaugacuuuccugcugcgauagaugugagaauuuccgggucaacuuagaggaguuugaaacagagucccuacuuuuagagauuaagaacauauuucucuuugcaacagacauguauaacaguaauggcuaauuaugucuaguuuuagggucuggacagguauaguuuagccuguaaccguuguaacaugacucuaaacaaggcuccagcccuuugcucaaacccacucuccugguucuaaggaucauaacuaucuaagaauuuggugugcuacuucuguggccuugggacauagauaacaucuaaacuucuaacuucauuuuucucccuguuaccuucugucugaauguuugucaccucuauuuuguuuuguuuccaaauucuguuuuguguuaucuuuaaccacucaugguugaaaagaaaggaaagcaggaaaugggcugaagccugagccaggcacugcccuggcauaguuaccucauccacaggucauuucccucuguggugccuuccaucuuuccuuuaccauccaauguguccccguugaaccccgaucagcaaggugcauuugucugaacaucauugucugaguaggcaugauucaaagaagccugagagcgaagaagccauuaauucacuugcaaucacagccacagccuccucuguguacuucacuugauuaugagagacuuugcuauucaggugcaaaucaccccagagaaaggaggccuuccccacucaagucacaagaggagacuuaaaucaauagccuuucaaaguggcuguggccacucugcccuggaucagcgugacucuucaugugcugugggggcaggccagccaagcaagucucuguguucuguguuaggacacucacuccucguggaaggcuaccucaccauccgugauauagauuaacauugguucaagaauuagugucagagaggggucaagcauagaaaagacacgggauuuuaauuucccauaauacucugcuuuuccccugcuuauuaaagaaaagcauauuucaagaugaaugcauaaacacauacaugaauuuauugaaauauaaguacacagauacauagauauagauaaauaguaaauagcauauguauucauuuucuuuuccuacuaccacaaaugacugcagaauuaguagcuugaacaaugcaaauuuuuuaucugacuguucuauaauucagaagcuaacagugucuccuuggaucacaguuaaggcuucaacaagcaauguuucuaucugaauguucuaggggaaaauuuguuuccucacagucuuuagcuucuagagguugcuauauuccuugguuugcauccuguuucucucucuucaaugccaaccgcugugggucuaguccuuucugaugccaccucugaugucuuuuuuuuaagugucccaagauuguuuggaauuuggauaauucacgauaauaagcucccaguguuaagguuggcaaaaaaaaacaaccuuaauucuauugguaaccuaaauaacgcuuugccguguagcacacuuacacaucuuagggauuaaaacaugggccuccuuggaggguauucugcugaccaucauagucuauauuuuaucuguguuuguuuuaucuauaaguguuaauaacaacuuuuaauacaguauugauagaaaaacucuuugcuuguaauuugacugguagacauaauuccagaauucagcugagagcuucucaggcucaauacagauauguuuguguccccuuuccuuugugucccuguucucccugccuuuuuacuuugggggcaaaaagaaagacgacaaugagugugcagugugagagccacuaccaccauuccaugcagccuuuccauuuuuuauuucuuuuuucuugcuuccugccuaucaaccacugugccgcuuuacucaauaauaaauggaagcagagagaagugcugaaauugaaaucaguucacuuuucuucuuguuauuaacuugguagcagaggagauugaauuuaggaacaaauguggguuuggaguuucugguagauuuaaaugauaucauguuccugagauugucuaaauucgaauucaggaauauuuuaaaagaacccaacaugaaacaccauugcuuuugaaauacuuucgauaucucaggcucuggucguuuuauauacagcaugaaauggagauugaauugccuaccucagggccacuaauucaaaauuuuaauuucaccaacauagcacuugcagcacguucuagcaaaggcaggaauagcuucugguggguacccugacuucggcuucagcuugaagguaucuggaaugugcuaguuaaugucacuaguuaaugccacugcuggaagacggcguuuggaaaagcagcuggcuacugcucuuccagucuugaggagcagcagacgggaaguuuucuuauuuauguaagagaaguagaauugggaugauuaaaauacuuaugcuucggaaagaacuuucacuuucuagauauagcagucuacagaauaaucccuugauucaggccauugaguuuguauucuguguuuuggcuuuuauuaccaauauuuuagaacaugcauuauucauuuguaggggugucagggaagagcuaaacugcugccagcuauuuucccacacaaguggcccaaccaucauuugagggcuucacuuauaauguuuuguuuacaggaaucuuauuuuaugcuuguguggguuguaguugucucacuuuaauuauucuaacaagaguuugcaaguggaauauggaucuaugcagcaguaugucucaaaccguggauacauuuggagcacauaggaccucuuagcucagugggcaguagaaccaccgaccagggaaaccauucagugggaaaaagcuauccacgaauuguuuucaugaaguuagaguugcucacucaaggugaguuguaacaaugggauuuccaccuauugauauagauauaugccacacauauuuccaacuaauucagacugccugcauugagaagaguacugugaccauuugucauacucaaaaauuccaugccugaaaauuaacaaaaaagaaaaauggaaaugcugucucaucuucucuuauuggugaugcuauaguaauuggagucauacauguaaacauauguugaggaaguaaauuuauaugcagaugugauacagcuuuuuaaaaaagaaaucauaagauaaaucucaucugcaaacauggccaagcagcuuuuugaaguucauuuuaagcauaucagguuaaaaugguggugaauggugaagauguccgugaaccuuacgccaaguucugaacgguacgacuaaccuaacaguggcaaaaauuaaacuuaugcugacuucagcaauuuguugccaaacagcuuuaagaacugacuugguuucccacauuggcacaucaugauagcagccuaauaggauaucagcaggccucaagaauugugugucccuaacaguugaugagaacuagggccucuccaaaagcugacuacuuggucagacucauuuagugguacucaagucauucuaaggaccaucagcaaucugucuuuuugguauugauggcacuaucaaaaaucaacauuauaaacggagaugacacaacuuugcauguuuccauguaaugaaauggaagugacaauuuuaaaaguggccuuacugcgaaguaaguaauagagcuaucuuggaauuuuauccaacagcaaaaauaggcuaggcacacuuugcuaaggcuuggaaucuuacacucacagaugaaaagucguggaugcuuaaaauaucagagaccgagguggaacaacccggggcuagcaaagcagcugccccuuggccaagcugugggcaucaucugugucaaugggagaaaaucccaauuaggaagaauuggagaauggaccagaaggaaacauucuaagaaauccccugaagaggagucacagaaaauaauggaucuugguguggcauaaaaugggauggugguuaaaauguuaacacuggcaaaugccugggcucacaggggacggcuuacuucucacauugcuuuuggcuuacugacuuccagugugugcuuugcagaagacaguuguauauucagaaguccuccucccagcccugcucagcucacucuuuagguucacugagccagccuauggaaugaaagguagucuguaacucuccucaugaauaaacaugaggcuccucauuugcaugaggcaggugacuguaaaauaggcuugcagcaaguaaugaaaggaagcuuuguguguggugcccagggggagcugagaggacucagaguuguuuaucuucauuagaauuccaucuagugcugcuguuauugaucugaacuggaccugguguggcuaauaaaguagguguacauuuuaauugaaacaugaauauuuaaguagaggagcugucuuuuaaagaaacccugugucgugcaaugagauuauauauuauuuuaucuguccaggcuauuaacaaguauuuauucaaaagccuucucaucugccacaauagguuuguagguuugcaguauagacagacauccucuagaaccaaaugcauuguaaugaaaagauguaguuuuuccuuuaauguuucccaaugacuaguagcgaguggauucuugugcuugugguugucagcugcuaauucgagguagcguugggcuuuguucaugguccuugccacuuuuuauuagauuguccucguucaucauaauuacacucucuuaggacagcaggaagaccaagagugacuuugcuaacuuuaguuugaugcacagcauuuguugaaauagacuguaagguacuugcuucauaaaaaaagaaaguguugguagcugcugacaugaggcugccugagucaggcaggcgacagcaguguggagcuguguuuugcaaccucuucuggucaggcccuuguaagccuuuuuacauuauuucccuucccucaucagcuuuucuccugaaauuguuguugugaucauaaaaaugagaaagaccuaugagaauauguucuggcugggugugugggaagggggugccucagugggcccaugccaaggcaucccuuaccccugagagaccagccacaugacaguguaguauaaaauagaguuuauuuagcucaaaggguggguagguaagagaguaguagaggcagagaaaggcagagagaaggagagaguagagaaguagaggccgguaacggccacgugaagagagagggagaagggaauggggaggagggagcaaggaggcaagagagagaaaggcaggaguaagagagagaagggggcaagcagccccuuuuauagguggccagaccuaccuggcuguuguagcuaacuguggggaggagcauuccuggcuguugucagguaacugugcgggcagaguccagacagaauaccaaaacuuguuguuacagaaauaccaagucuuguguauugguacccaagguagauuuucaaauaucaauaauauauauauuuuuuccuuccuuguauagagaacaacuggaauuuggcuuggucacaaagggaauguguccacaguggaaauacauuccugagugcaggagcuuuccuuuaagguuccugauauuggaaguuuccuuuuccagcucaucucucaauguacuacacauggcucagugccagacacaguggagacuaaaaagccuagcucauccuuccuuguacccagauagccauguggaaagggacucagcagcuugagccucaggggucucaucuguggaauaagagcaagcacuuugccuaccacucaggauggcucuguacucuccuggugucaguagaugaacuguguaucguguuucuggauggagccgguaucaggcaaugguaauauggucguaggagaccauaugcuggaggauuuuagcuacaagcauuuccaggaaaaguagacaagcuugcacagggacauuucuaaaaaagaacaccuguuggccaugguuccaccaucacagggagcgugccucauucaggaagaagcuaagaugaccuuucccagauguucugcacacaacugcuuccgcacuuacaaaugagagugcagggagagagauccaggguucuccaaaaaaucaauuuguugcuucuguucauguaaucacaguaaaaaaaaaugguuaaguuguuuaacauuuguuugaaaggcuaggauaacccuagucugcugaagucauaccuauuguguuuugccuucuggacauugucuaccacuggacauguguaguauaaaacuucaugaguuucacaaacagucccagauaagccugacaaugcuaauagauucagacaguaucccuuuguaauucaagacuaguauagaguucucacuucugaaguuuugaccaagcccauauaacuuucuuugcuguguccagauuuggcaaaugugagaaggaaacaauuagcagguucuuccgcuccacagcagcacaauccaucagucccuugguucaguuacagaccaucccuuaggagacucgucacuacucaccaagcugauugcucuauucauccacaucugaagccucuuucccuucuauuaacuguguuuuggggacugugugugaaugguuaacaaguuucugugaccugaauuccagacuccaguguggaguauaagagagauuucauaauggcagagacaccauuuuauuaguauauguucaauuaacaggaaaucacccgcauuuuaagugaggccuaaugagaugaaagcauuuuaaaugaaagggcagacaggagucagaguugcuuagcuaggaagggguaccauucugugcuguucucuuauaaaguguaaguacuuguuggucaaaaaaaguauuuaucuuguaauugcaaaguaaauuauguucagugggagauuuaaaaaugcaguuguagagagugcagcagaggccauggcuauaucauguggucacucccuauugucaccugaaagggccgggugugaugggcagaggacugaggucaaagaggggacauaaauugagauaacgagucuauauuuaguuacuauuuugcugcucuguuaaaaugccauaaucaaacaauuuuccuuagugcuccagagggcuagaugucuguaacagaggguggggaaggcaugccagcaggaacaaggaacugagagcuuccaucuuuauccauacacaggacacagagggaauaauaaaaaaaaaguguucgucaggguucuuaaaggugaaguggaacaguaugugcgcacgcgcgugcgcacguguguguguguguguguguguguguguguguguguuuguguguguguauguauguauguguguauguauguauguauguuugccugagauuuauuagacugauucacauacagggugugguccaucucguccaacaauagcugucuccuaacggaaaagcuauggaucuggcugcugauccaucuguuauacuagaugucucagcaauaccagacccaggguagagucccagggagguucuagagagcugcuguucuucagucuacauuggacuccugaaggaguauguccucacagcagugaagaagugauucaggaacaggguagaugaacccaauaucgaaaucgaggucaaacaggcagaaaggaaaaacuucugucuuccauguccuuuuauguggguugcugucagaaaguguggaccagccuuagguuggcucuucucaccuuaaaugauauaaucaagaaaaauaccucucaggugugcuaccucuuuagguuuuaguugaguccauauguaguccaguuggaaaccaaauuaaucaucucaaaucggaacugagaugacacuauaagcccuuaaaaaacgcaccccccccccagugauagucuuccaccagaaagucuguacuuccaaaggucccauacccucuccaaacagcacuaccaagugaggaucccaaguguuccaauacaggagccuaugggaaccaauugucauuuaagucaccacagagaaucaaagguaaugauaauuuguaaaggauccaaaacaagagcugugagaaguuagaaaacucuaagugaggucugugggugccaucagcauugaugccagauccggggcuggagugguggcucgguagggaagugcacuggcuccaacucuagguuggagucccagaacccauguguuggcucacaacccucuauuacucuaguucaguccugggggagccaaugcucucuucuggcuuucauggacaccacauguacacaggauguaccaaguguacauuuaagcaaaaugucuauacuuauaaaaauaaacaauuuuuggccagacucccucagcccacacaccagccuacccccucugaccagucauagaccaaaaccucugaguccaaagaccaaaaacaggaacagagagugagaggcaggaauaggccaaaggggagggcuaaauuuauccauaauuucuuuagccccuuuguggcaaguguuaaagggagaaaaaugaauagugaaguuugacuuugagagcucugggcuccuaauuguuuguuaguuuguuuauucucucucugccuucucgcucucuuguugccuguaacugcuuugcuggcucuaaaguuaggaggaagugguccuauaugagucuagguggaagaaaacgauuaaggaggcagucaguccacuuauuucccagguugagccaacaucuucuucagggagguuccuaagccugugacuugcuuacuaacaacuaacucagaugucccugggguaccuaccacccugcucugucgcuguggauaccuauucucuacaacauauggcagugaacuauuaauccuccaguuaucucagaguagaaccuugaauugucuauauucauaagagucuugcacugugccuggguuuggaaagacauuuaaaaugaucucacaaccgcuguacaaauagcacggccauaucuaugucuacgucuuggccaauaaggugauugacuaagcaacauuuucaguguaagucauucuuucuaaaaucuuugggucuacaucagguugugcagcagaauaugaaaauaacagaacacuuucagcucucuuaggacacacaagcuaguaauguucucuuugaagacuauagacuggcuucuguuugaaaccaaucgcuagccggagucauguaagcacuggauaguccuuuauccuuucaucauugcauugauucguagguuccucuucucaucccagauguggucagcuugaugccucgucacacugugcuugcuuggagacaguuguaccuacaagucuuugccauauuccccuuggcuuggucagaaggcuuucuugcaccaaugugauguaaauagaugugauaugagaagaguacauaagagcugugcacuaugggcagcuguugcuaacucagggcaaaccccagacuaacacaucugggugcaguuuucuagagucaacccgacauuuugaaaugucaagauauaaccaaauagccaucucagcucaccuauagaccugggaguauaaaaaucuuuugugauugcuuguuacacagcaucuauauaggaauaacuaagauaccaacuguuacauuacuuaauuucugucuuugaaaucuuguuuucaaaaucaaaucugaccauaucauuccugcuucuagacuuccugaggcuggcuguuaccuggcucugaaaguuucacgguaacauacuuuuccugccucuaccucgcuuucacuccccaccuuuccuaggcugccagcacauccugaaugcccacuguuuuuuuguacgugcuguaacacuuuucaucucucagccuuagcucauccucauucucucugccagaaacgucuucucccaucugccugucgagagccuacuuauccuuuaggauuuugcacaagugccaccucaguaugagagguaccaucuaucucccguucaauucaguacaaagcuuugcaccucugccuccacaauguggaauucaaauauucuauuggaaaauaccuucuagcucuauaguggcuuuuaauuauaaaucuaacuucccacauuaagucuauguuuuacuggaugcagaaauuucauaucucaguauucucucgaugcuuuguaaguauuggcucaauuaauuuggaucaaacccuaaaugaauggccagaaauaucugauucaucacuuaaaaugguccuucuggccaaaaguugaauugauuuauaucauuucaauacagaguggauacuguagcucagcucccagaggccauagguacuaaguauuuugcaguuaugcugucuaaagaauugucuuaucuagacauaguagcacaugccauaaucccagcauuguggaugugcauagauaugaaaugagcagagaacuugggaacuguguacuauagauagcugcuaacucauugcaauccccagacuaaggcaggaggauccagaguccaaagccagcaguagcccaccauuccugagaugucaauaagcuuuacugguaaauccugcuaaaucgacccuucagaaugucuucugcagauaucagugcuuugagagacuuauaaaauaacauugacauuuguuaauuaaagucacaguaauaaccacucuccucccagcauaguuuauauaaagugaugagacccuucagagaaucugacccacugcaaaucaaacucgguuucucuuuuccgaguagcacaguuggaaccgugcucguuucccagccccacccauucauuauaucacuguuagucacgcuuaacccacacaccccggcaggucagggaacccucuagucucccauuugucauguuuucggaccacugagggaaaguaaugucaauaauagcauuuauccuuucccaagauggcugucaagagaucuucuagggcagaggacaaaugcaccguccaacuguccaucccuucgagguuacaggugcuauccaagcagaccugagaacgugagugugagggucgggcuucuuagaugaaaaacaggaauguguuaaacucaucuuagacacacacgcacagagacacaaauagacacacacagagacacacacacacgccacuaugcauuacuuuugccuccaaaguuaucuuaaauuagggggacauugcauuauuccauaaguggcauaauacaggaagacccccucaggauaaauuuauaucuaggcagaauuggagguaauaggcuccuuggaugggcucugguccccauauucuuuuuuucuaguucacauacacauugguguggcaugguuagauuugaaguagguggcauauggcuuuuugcugcuugaacugccacagaaggcaaugucauuggcauagaaugccagauuuccauuuugugaaucacagagcauggaauucuaucugaaggcuuccuggcugcaauguguccuuaaagcagaaggacacaaaagguaugcaucucccaggugugcugcuccuauguguguaauuuaucaugauggaaagucugccggcaauggacauggacgugccaaugacccgagguguggcagaaaggcugugaggcuuguuuaauuguggucacuggguaaacaggcuguuugcccccuagccguaguagauaccagugaguuaugguuguuuucuaaguuuuucagaugaauagaugucuacuugugcauguaccagaaaaaaaaaaaauacaaaagacugugaguaaaagauacuugugcuuagaggauggaguucgccacaauguugcagucacuagaauuucagauuauaagucacuuuccaacugaugcaagagaccuagugcugucacuccuacucuuagccuucgucuccucucccaccuagccucuuacugaggauccaagagaaauuugaagauuucccaaacagaggauuagaaagaacccuaugaaauugucuauacuugacaguuuaaaagguauuucuuuuauuuuugagauugugauuacaacaucuuuccccuuucccguccuccauccaaacucccauauaucucuccuugcucucuuucaaauucauggcccccuuuuucauuagcuguuguuuuaaauacacacacaccuaaauacauuaaaaaagagacagaaaacaccagcuuacccaggcuguguaauauuacauauacguauguuuccaaaauacaggaauguggggcuggagagauggcucagugguuaaaagcacugacugcucuucuuaagguccugaguucaaaucccagcaugguggcucacaaccaucuguaaugaaauaugaagcccuuucuggggugucugaagacagguacaguguacuuacauauaaugaaugaaugaaugaaugaaugaaugaaucuaucuuuaaaaacaaaacaaacaaaccaaaaaaaaaaaucaaaaaacaaaauacaggaaugugaagugguucagcuuuguaauugugugucacauaagagcaaagguggcuacgcuccagaacugaccauugacucccauccugaguuucccacaguacccuuucccccuucauguacccuguucuaugaccacuuaacugaugagagagauugccauagagucuagccagacugccucugagcccauggaaugggguucgguucuagcuccagcauuuccuguuugggugauuaacugucuuguuauuugucuccuuaucucugaauuauaaaacuuaauagaauaguugugaguauuaaaugagucgauuuagauggaacugaaaugcagaauuagucauucucugaggcucauccaguaugucaagcucugccuucuggaaaaguaagggucucagaggaggcacggggaagccugagaucuagcccagaucuuuucauauuuguccaucaucugcucucaccacccaucuucucccaggcagagcuuguguuccuagacucugcauggccaggucuucuguguuuugaauucuaccccucuuggacagcucugggaugcuacucugccaguuaucaguuuuaaucauuacaucaucaauaucuuccucucagggccaccugaaugcacugaagcccccuuacacguucauuacucuaagccagguauccucaaagggcuauaccuccaucugccuucuuuccuuuucauuuacuaauuuacugaaaacgccauccuacacuagguaaaaauguauuccagcaaagagggaaagucugguuauaaaauacauuguuggcucuugagaaucucuuuaaucacaaaauauaccaguuuugucaaaugcagagagacuucugagggacaguucuaaauuucaagcauuuuacuugcuucugugcagcacuuuuaccccuuuggacacuugucuuucuucaugaagagugucucgugguagcuuacaaagcacacaugcaaaaaagauccacacuacauauacacaugccaagaccaaccuacauugagaaaaguuacaugcaggacaugaaaucauuuuugucgccucaguuccuagcauaauuuuuagaaaaaugaaagauaagcaacacuacaacuacauuuaaaaaaugggagcaggacuuucaauaucaguuguguguauuuaacacugagaaaacucuuucaucagaaaagaugcuacgcuguugcuuaguuuuucauaagugcacgucauaaacagauguccacucaccaaagguugggcacccacaacaaaacaaagaaauuauucuaugcacaucaagcuugguaaaguaauaaguuuaauugggccuuauuaagaaaaugggugagaagugccuacagaaauaugaacaguuuacauguaaaccaccaaagaaagggcuauuacucccagaaacuacauagauaucuacaaaaggaggcagggcuuucaggcuccucccccaaguccauuauagaaaguuaauauguccaauggccugugauguaauccaacuaaugaauaauccugagagcucuggagggccauccugcacagaggacaguguuccucaacacaugccauuucucagacaaaaaugggauggaaacuggccaguuacucuaaauguaagguuggaauaaaguucuaaugaaaaggguguacaugacaaaucauaaaacuuacaucauugugcuuauuugcaucucuccuacucugaucccuucucuucauccaaaauauggagacaagucaccucaauccuuacacacuauuuucuagugcuuuccucugcugaggucauauucaguccccgccugucacuguggugacaacuccuccaggagaaaaugcugacucugcugccucucccucuugcugugguccgugucgcuugucccccugcugcuugucuagaguagcaaucagcuccugauugucaagucuggagaucucuccccagagcuagucccaucccauugcucuaaagcgugaccauccugccucugugauccugggaucuuugccuuguuacacucaggcaauuguuccucugaccucuuuagcauaaacauucccuaagcccacccuuuuuuuuauuguauuuguguaugguguccuccuggccacucaaaaucccuugacuuuaacagaaggugaauuggagucuccugaaguucauguguaugaccaguccacagacccuucaaauuggaugggucuaaaaugagucuugcuguuuuacucuccucucagcuggcuuuuagugcuuucuaacucuaggagcucuuuggugaucuacccacauuuuuuacuucaaacaguggguugaucugacuuucuaacuugguuuuaguagguccuuuaauucugccauccugcacguguuggacaaagggacaucugccaccuggugcugggacucuguagcagcuuccaugucuucugcagacuguaugugccuuuuauuguucacugaaucuggacuuggaccauccauaaacugucuagucccuggguuccagaaggaucuuuuaaaaacacagguuuauggcaugaucuuuccauagucaaaacucuuggggugggggggaauggcuagagcgauagcucagagguuaagagcacuugguuuucuuauauaagaucuaggugucugcugugggggauggucaggagugcaucccagaaucccuuucaccugcucaggcuggagugcagcagugagagggggaagucaucaaaaugcuuuuagagguccucaucuccuaagaguccgugaugcucgggagaagaacagaguacccccaaaccucuguacugugccuggagcauccucugccaggcacuuagaggugauccugggguuuagauaaugaauuuaguucuaaaggguuccugggguggaacuggguggguguaacuucacaguaaaaugcauggacaaagcaauagcauagacaguguacagaaaucacucaaaguuacaaaaagagcuacuuuuaggagagcuuuuggccuaugacucagaacacaguagggaaaagcaaaaucggcaaggaguuggagaaggaugaaauauaauggaauacaagaggaaaaaggcucccaggggaacuugauuaacauccagaccccaacugggaagccuugaaagaagcauggcacaugauuggcgcuuucuaaguauucuguuuaguaaagacaccuuacuucaaacugaaauuuuugucgaaauguaauuuuuuuaguguauuuuuccaaagagccaagaugucuaguauaagauagauuccacaacagcacaagcaagaacuuaucugugauucaacacuggagauuccuugagcucuuugcuccguaauucuccugccugucagugugcugguagaacuguaguuauuuggaaacuaugcugcuauuuggaaaccaugcugcauauucucccugccaugacuugauaaaaguaggggguacuuuugcauugcauauuagaggauuacuuaucacccauggggccaauuuuuuuuaucaucaacuuaauaacuacuuucugaaguuagaaacuuaaauaugcaaguaaguagcaaaguaauuaauaaaaucagauuaugucguaucugaauuuaauuccuguacaguugagguuguagagccuguuccccgugagagucagaaguaacgaguccagaacauuuguccaggaguugagacacacagaugucuguagcugaaaguggaaugagggacaguuugaagccauauggcccuuuucaagcagagaaagauugggcuuagagaacaagcagcucaccccagugagggcaacagggcuucacuaugugcaagcacacuguugacauugugguucugaguguacaguugccacuacucaaugcauuuucacacagaguugugauauucccagcaucugaugacaaccacuuuuauuacagagggugaacauaaaaauaacucauucuuauaagucacuuuagaauuuguagguggccacuuugcuguguggaaagccccauccacuguguuccugugccugcuggagcuguacaaacccaucugcccaucuuucucuauccucuucuacaucugcugcaugaccucccugauugugacugccuaacucucucucucucucuccugcgugcugcacuagucgucuuuaccugcuggcuggacaggaagucacuuaccugcuccagcuucuuguuccucuuguucccagcacuguucaccuuuuccucaugccuugcuugcuaugcucugaugcagcgacaggagaccaggaugcaaaggcaucuggccaguugaugugcugauguaucugucaaucugaagcagaaaagcagaggaagcgauagucucuggugcuuaagcauuucauaagagagucagccaagauuuaaucucuaacauuuuggaugagaguagucuucagaaugagaauaucauaaacuaguguuuucuuccucaaaaggugcaauugcuuccuuggggaauggauauguuucagcguaaggagagguggacuccaacaaaggccuggaaacugguguguagugagauccaaagcccccuuuucacaauggcacaaaagcuguuugcauuuuguacuauugauagaguaucuuccuguugacccaguaggcuucugacaccauauugccagggacacacuuggcaacauugaacugagaaugugggcauguucauugccuccuuuuggcaugauucucuccagcauucaauucugggacacauuuuccuagcauauuuggaaaacuuaaauuggcaagaugcugagaucugaguuuucccagcucuucuuucuaagacacucaggauuguuagaaaucuucccuuccucuuucccauuggccucaaguaaguccuuucaauuuugucaagucugccacacuccaaacauccccuaacuggauccuaacccuccugccauuuuggaaaagaaaugaaggacugugcagguuguaaaaugggcuuguauuuuguggauguguguuuuucacaguauuuguagaauuucccuacacuuuagacauuuuugagggaaauaucauuauagcaaagucugagguauuaccaccagguuaaagauucauuuugucuaacuugcuuggacuuagaugcugugagagugauccugcucuagcggcuugcucuggaggacagaggcuauaggaagcuaucuccuuagacagauuucugagucuaugucauggcaguccccuaucauuagguauuggcugaaaacaagguacuuauguauacuuaaggaacaucacuaucuccauuuguaaauggacauuaugauauuagcuugcgaaaaacgugcacaucuauuugcugauaguucugugugugaucuuuaucccugucacaaagagcuuucuggcuugggaccuaaaaacacagugacagaguaucagauuuuguauguuuuguuuaugaaugucuuuacauauaagugagaagccaagcaacuauccauguauagaauaacucuauggacaguuacugaucuuguucuccugagauaaaguuauucuuacauauuuacuuaaaauuuugcauauguuuuuuauuuaaaauaaauaaaguaaucagagaugauuguauuacucaacccaaaugacuggccaacuguauugcucgugucucuggaaugagauaaccaagugaagcaagccaguaauaacuauuugagcagaguuuccauucucaccacauagcuuuauaaacaugguuuagccuaggguuagucagcuuguuccauuuuagaagugaauaaguuugcauguguguguguguuauguauguguguguauguuugugugauguauaugcauguauaguggggugucuuaagaagacaaagaugugguugaaaaugaacuuauugaaauacagacuauuuguuuggaauuucauuaaagcuccacuuuucucucaagacuguguagagggaacuagccacccaaagaaagagccacacagcagagcuguauuuagaacagugaggucaucacuaucacauucauuguagugaugcacaugucuccagaugaagucaaugcugaagggggagaagcaacauguuugggacagagaguuugaaaauagauggguugacuuuuauuacuguuacuucuuugugaugacuagaauuguuguuuuccaucuuuuaaugcuuaauauaacaauaucagguuucuuuguaaauuugaauguuucuuuagaaagcauucuguagcaguugcuguaguuauggggggaauucugucaccuaacagaacuuuuauaguuuguaaaguuuaaaagcauuauaaaaaauauuuucucagauuugaugcaguauauaaggcaugguuugggaaagaaaucaaacuuagaaucugccuaagaaaauguaggacuaggguacugacaaugcuuacccaggguggagcaaagaacacaggcucagugcgcucaaguggaaagagacaucuuccaacuggugaagaccacccagggacucuaauucugauguguagcugcaguucuaaaagcugguguuugcccuucucaucccacaacuuaaagaggacuaugaagaccaugggacuuuaaaagagcagccaccccgugaucuaaggaauacucccucaggacaggacuccacagggagccauggaaguguccauggggacuaugucuuaggaagguccccuugggaaauauuagugaaacuuguuauuucuauaaacuggauccaugaguggguacguuaguagacaugcuuacccugaguaaauaaauaagaaggauuugacaggacugaagcuuuaaaaauaguaguuaacuuugcauuuugacuuaaaaauuaguuuuggggugaagauguuaacuagcuggucuaaaaaccguucuaccuuuacgguuaauauguuucugcauuaaaaguggauauuuacauguuuucaacaaggugagagggucagaguaggucaguguccuuaaaauagaggagucagaaaagcuaucgcuagaagagcuacacuguccauggcccccaaagaggccucuagaaacccccauacuucuucauaagucuguuccuuagagcagcugcugagcaccaugggaagcuggguagucaccucagcuaacuucaggucaugugaugcaauaggaauuugcacucccaacgauaaaguggaccuugauuuuuuuuuuuuuuuuuuguaagaauggcuuuuuggagauggccugaaauagugagacacacauaccaauuuucaaaaauaaugcccuuuugcaugguauaccaugaaaacuaaugugggauucaucuuuuuuucugugcaagcaugucuguagugaucaucaagcugaguugugucuaagaauccucuaguguucucaggaacauguuccauaaaguccucguuuagaagaggcagcgaaaccccaaaucugcauuuuuaauaaggacuuucauacacaugguugacauggggcacagcuagacaaacugaagccagaauccuuuaguccacaucacagcucuaccccuuaauguuuuuggaacuuuggucaaauuuaaccuuccuagaccucaguccguccauccgcauaacaaggacaaugcuauuucucagguucucaguaaggacgacuccugguuaaucaaggccaaaugcuuaagguguuucccagagugaucauuaagcuuaguucugcuuauccggccaagccaacaaguuaggaauauccuggaauagauuauuugaaucacauugauuuacuguugguauaccacugaacacaaccgagagauguacaaagucgguauguucgugagcaagaagucauuuaauggaguaccauaacuaacuaucauugcuuucagaauaaaaccugaccuuucaccuggugucuagaacgcuacuugcuuugccucauaccuuccucuucguccucacugcaucuagugcaucuagucugucucauggacauuccuccaucuuuuccaagaugccaggcuccuagcacaagcccugugugggugugcuccuuauaucaguucauuaacuuugauucuuugguacuuugaauacuggcugauugcacugcuucuuagauaugcuuccuggccucacuaggucagacccacuuucugugcucauugcacauauagcucagaucucuccugcacacccacagguacacuuuauuauguuaguuggcugaacucaaggcugagagcugagggcagaagccgugucacuugguuguaucacuagccuaaauuccugacacagucaacaacugcugaaaaauauugaguuuuguuugaugaaggaucuggggugaaaugacauguuucugugucaaacaaguuggauauuuggaucuuuucaacaagguaagaggguaagaguggaucaguggcauuagaauacaggaaucgguaaagauuccuuucuaaguccacagugacauaaagggaccgaguggaacaucaggguccauagucuucaaggagcaaaucuaaugugaucaaaggcagaucuaaacaccauggaauggaagcugugggauuugggcagguggucacucacuuuaagaauaaagggagcucagagcuacuguucuuuaggaacaaaggaugcugugcuaagcauguaacuuacuuugcuagcagacccagagacauccaaugagccuucucagccucagcccugucaaaaacacgcuucauguaaucaccacaacagcaucauacuugcaaagaccuuuguggaacagacaguuugccuugaggauauagugaugcugauagugacaacagaucugcuuagaccuuggcuuuuuuuuuuuucauaaugucauuuuuuauauaucuauacaugcaugucagagcacagcuuuuuucauguuugucauuuuaugcauauguaggcauguacgugagagauugaugucuugguuuccccucuaaggaaccugacaguuccauucaugcagccauucauugcucaguggcggccccugcugcuaaggagacagacagcagcgcauacggcaucugacauuaauucugaucaugccacgcgugcaaccaggagaauuuaaagcaagcaggaggggaagagaugggagagaugaaaaugugcugagaaaauuaaggaaggucucucauaccuuaggugcuuuggugaaaugcugaugcaagagagagcuuaaccuaaagacuuuauguuuacaaaauccuccggauucgggcaucucaauauuuaaaggcuugcuagaaaccaagacaacacuuucugagaagcaccaguguaaacuuuucuuugggguuuuccaaggcuauuacguaaugauuuaaagauaccccccccccacccgucugcuagauuccaaguuucuguggauuugaauuagguguggaggcucuuuagguucaucugcaucucgaguuggaaucagaguguggauccucccucgggaccccugcuaggaugaaagcuucucucucucccucucucucucuguguuucugggcgugugagcauccccacagcacaugauguauuuuacaaagcaaggcagcuacguagccuuucugucuaaaaacuguaguggagagaagguggaaguaugcauuacaaucaaauaaaaguagaggggggcagagaugagauuguaguugauuaugggucuggcagcagauguucuacacgaauccaacucgcugcagccagucuguuuccauggcaacagaaucaguaauuauugagcccuggcacucccccccacccuccuuccuaccaagguggaggcugaugaaugugaacuaucucccgcuccuucucgguccucuucuuucccucgcuuucuucagucccucauaggaaaaaguagagguaucgaggagaacuaagagagggagcucuuugugucuugacaaagauugugagaaauuaaauugcaaaggauccuuuaccuugugauacuaccagaucagagaaaagcucuucccagaaaagccgaugaucucugaagaugcuaaauaaaugagcaggaguuucccugaaauggaagcucccuuugauuggcugaucuucccacaacuccugccaaucggagcaccccugggcuucagcuccauaaacauaagcaaagcuccaugcuuauucuucuggacuuggagcguauuccauucgaaggugugcagcgggucucuguucacauggcucaacuggaaaccuguuuccugagcaagcuuacugggcagcccucuggucuuccggcacacuguccuacuggggcacgacucuaagucauauuuguggcagcagcuuagacgcaguauaugucguuggggaugauggacuuacggaagcuuggugaguaaaucuuugucuuacacaucugugcacugguauuagcaggcugagauagaauguagcuuuguucuauugucugccaagaaagccgaguuggaaggagcacauggaagaacacccaugcaaagguucccaugauacgggagacugcuucaaaaggcuuccugcuuuguuugauuccggucggauuuguaguugauugugaauuauauucggauguugacaaucuaguuaggauuagugugaggaguggagccgugucuugucucccuggguauugaugcauuacaaagaaaauguguuuaaaaccacauuaguaagaauuaacccuguggaguggucaaaaggaggaaacggcaugagcacagagcuugaagcugccagguuguauagcugacauuugcauggagaagagagauguuguuagaaugaucugucacucuucaggauccuggccacaggaggaagcaucucuuccccauguacugcuguucucaguuucagaaaugugccaccgggcuaggucguguccuugccccuuuucaggaaccaguguccaaacugaaaugugcuuuuucaaaucaaugucagagaugaguugagaugugggcagaaagauuuuagcagccagaaagcaugugugaaagggcucuguguuacaucucuccaaccucggaaacccagggggguugcaaaguuacguuuaagcacuggcuccguaccagagcuggagugcucugugcuagugcgcuguuccuugggguuuaauuuucugauaccagugaugaaauuugccguguuuagugaucacagacaggcaagagagcaguccugcgaaugagcagugaagaucagcacagggagaggaaaggucacugcccuugcagaccuccugccacaaacuuaaaaauauacacgucaagaggaagcccgggcacaaugcagaauuccacaggagcuaugaucuuggcaagcaugagagggaagguguugccuucagcuugggugcagagcgcagggcugaacuugaguuuccaccucugcugaagaucuguucucuugucucugauguuugaggcuucgugauuguugcuuuuugcaagaaugugauuucugaucuuaugucgggaaagugcuguagcaucauuggaaucuuuuauggggcugggggaugaagcaucaucgcugaguuuauaaaggaaaugaugcgaaauaguggcacaugggaauguguugaugagaaccuuuaauagacuguccuuuuacuugaagaguguccuggcucuucacguggaggugaaauggaaaucgcuguguccaaagugggaaucugugauagacugauaaaggcacaaaggaacugggaaggcucugcuugucugagacuugggagagggcgcuggauggaacagacccucugcucuguguauuggagagagaggcugaugcugggggacagugaggauuuccugacuguggcugacagugcauugaggaccuggccaucaagcagugcaaugaccuguuccuuagcggauguccucucuaggcgugcagccuggccucuaguccugaggcugcguauggucagaugcauugagucucccaccugauuagaggugcauuucucugucugaauaaacucuuccugaagcuucuugcucuggcccccacuugaggacaggcacagguuugaggaagacugguugcucguggauccauguucaggaacagucauuuuagagugaugcuccauccaccguuggucccuucucugaaccaguaguaucacuuuacagagggaggggguuugcuggcaccuguuggcaagaaugggagaagaaagcagccuuuuauggaagaaguaaaacuguuucgagaucacaaccuauuuuuggauccuggaacucuuuuagaaagcuaccugcccccaagaaaauauauuuugcauaauucucucacacuuugauaacaagcugcuucuggggagaaggagauaccuguccuggagaauagcaaacaauuuuaggcacugaguccuaucaacuuuuuucuuuuucaaaugugaguacuaacuacuacuacaucucccucuccaucaaccauacuggucuuagcagcgaggcugacuucugaaugagguuuucaauaccaucagucacugcuggaauuaaaugucuugaggauaggacugcagcucaaugguagagggcuugucuagugugcgugaggcccuggauccaauggcugcaauggcauucugucuccugagcucagugagguguugacaaagcagaguugugggauuccugcugcaguuguuccuucaguguuagggcggagacugugucuggugacuauucugcucauuccugaaagagaaagcuacuuuccacugcucuuccugcuguccauagacuauggggaauugggaaaaucaagguacagaugaaguacaauacacuuaguuaaacuucugaggagcgcaaaguuauacagcaggagugugaaaggacaugaauauguuaacucucauucuugaaauuaaguauugagaauuugaacaacaauucuucacuuuucccauuaauuguaauaaaauugaucacaugaugauugcuaaccuucgauugucacucugugcccaguacaauuaugugcuuuagaaauggaagaauaaugggauccucacaguauugcuaauuuaauauauuuuauuaauuauuugagaguuucauacaaugcauuuuacucauauccccccccccacuucucccucuaacuccccccagaucaccccugaucuuuuuaaucccucccaacuuuguauccucucuguacucuuuaaugugcugcacacauacucaugugugcugaauauggucaaccuacuaggggcugcauuguuaaagaaaacugacucucugaccccaaaugccaucaucugucuauagcucaucaguuaaggauuggagcucaugagccucucuccauccauaguagaauaccaaauggcuugcucuuugcucuuuugaagguccugugugggcagccacaguugccgugaggcuggcaguguagugggguccuggcaugucuacacaagacuguuucacucugccccucucugaucucuggcuuuuacagucuuucugccuccucuucuucaauguccuugagcauuguuugggggaguguuucagauguagaaaugugcuguuuguggaugaguguuccagguaugcauguuacuuuaaucagcgauagauuucugcauuaauugcuguccauugcauaaagaaacuucucugaugagaacugagaguugcaguaacacagggaauaaacacacaaaguaacagggaauuugauacacguccauuuagcaaaaucucacuuugguuuuuguuguuguuguuguuguuguuuguuuuuuguuuuuguuucucaagacaagguuuuucuguguagcccuggcuguucuugaacucacucuguagaccaggcuggccucaaacucagaaauccuccugcuucugccucccaagugcugggauuaaaggcgugugccaccacugcuccccuuaaucucauucuuaguaaucucacuccaggggccuaacuggacuuugagggcucggggggaacagagucagugucucgcuuucucuauaaaccagggcuggccuagaauucacagagauccagcccccuuugacuucugaguacugggauuacugauguaugccaccgugccuagccugggcuaauuuuaaugccuguuucauagauugaaauauugagccaaccaaauauuauagaacuugcccaguuuauccuucuaaaaucugguaagcuccugguuucauacauugguuuauuaagugcugcagucaccgauggaaagacggugaguagaugaggaagaaguguuugucaguuugucugucugucugauuggagucagccugcugaaggcugaauuaaacagccaucacaauuuaaaucaaauaaaaauggcacucugaaauggcugguuguaggacuaauaauaccauuaaggaagaauauuucgaccuaagcaagcuaagcaagaacucucaccaagugccccucuggguagccccucuauauuaucauauaaugaauagcugcugccgugugcacaucacuggauucagugauguaggaaaugaguguuaccaggaugcuggggagaagcuucagcgucccaguguugccuguauccccuuagcuuguguuucccaauaaugacuugcagugaccagagcaguuguaagaguggagcaggaagccuggggcugggcuuuuccucugcuugggaaucaccugagcucugaagcuuucugaagacccaugaauagaagcaacacacacacacacacacacacacacacacacacauacauacacacacacacauacacacacacauacauacauacauacacacacacauacauacauacauacacacacacauacacacacacagacagacagacagacacacacacacauacguacauacacacacacacacuuacacacacagacacacacacgcacacacacacagacacacacauacguacauacacacauacacacacacagacacacacacacagacagacagacagacacacacacauacguacauacauacauacauacacacacacacacacacacacacacacacacacacacacacauugaugaaucaaccauggccccauagaagaguagucuuggaaaucauuugauaacauuguuuucaaagcacauucuaccgaguuuuggggagagcugauggcuguuugcuuguuguagaacucauguggcagauggaucguccccucccacacccacagagcaucgccacuucuguuuuauaagcuaccauccacaauggaaaugcauucauaaaaaaugaaagagaaaagguuagcuuaccaagaagaaaaauaaaaacucuugaccuugucaaaauuucccauucaauauaaaaagcaagggaucaguaccuggaggaaggccgcagugccagcugguauggaaauuuauaguggguggcuuaacaaaccugagcuagcugcugucugugccuaauauucugaacauucuagcaugccauacuagguaugugugaauguuuuaauaauuccagaaaaacuuauguuggcagauauuuuuacagaccaguguucuccaauacaaaguaaaugcaaguuauauaugaguuaaaagcuguucauagucaccuuaagaaacaggucagguaguuucaguaagauauuacuaaaaccauuaugucugacuugucauuuuaguauaaguauaaaauuauuagcaaauauuuauauugaauuuuucacaugagaucuuugguauuuucuuugaauucuuguagcccaacccauuuugaguauggguuuucacuuuuauuuuugguuuuccuuucuuaaaauguuuuuuuuugggggggggggaagcagauuuguguguaaguuguuccacacacauuuccuaguaacugaacugaguaguugguggguuuucuuuugggggggggguuaauuuuaaacuagcucaaaucaugugacguagaaauuuauuuacacagucgugcuagccuccacaccacuauggucaaaggcauaguucagucuggagugucguagcacucugagcagacacugagccauucacuccugugagccgagcaucaugcuacagugucugaccucucuuccuuccaugagguaucuggaggacuacucuggggacagagccuggggucugccuuucauaagcaugugucagcauugcccuuaucagggucuuaucagccacauggcaaacuugccauaaaucuaguuaugucuugaucuugauugcacuguuggacauggggaauuaaaagcaugccgguuccuuuugcuaaaaaucaaaacuucuccuucuauagcauuuuuucagucccuaaauaucuuguccuucaaucagaccuuccuuguccuagugcuuuuccuacuauuauaaccgaacccccaagacuagguaauuuguggugaaaagaaauaaaucucacagcuguagugacuacaaaguacagugaggugccagcauuuggugaggccaucacaugagagagcaugcguagucuauucuaccuucuuccaucuugccguuccuacuaccuauguccuuacauagccuaaauugccuccccaagacccaaguaaugucaacaucugaauuaaaggaucaaaaucuuaauacagggacuuugguaaacacauucaaacacuacuaguauuucucaauucaggauaaaauguggauuuaauuucaauuaaaugcaaaccauucucaagaagguaacuccauggcaaacagauaauucuuuacaaaggugaguacaaaugaagaccaagagcaguuuaauugcuauuauccuuuucaauuccucaguugguuuugcuaaaaaguauugacuuuauagacuuggucuuaaaauucuuaccuucguucaacaccacauguuuccuaggucucuaucgccuuacaaaagauauuuuaaguggaaaacuaaccuuggguggucaaacucucuaauaauaaaguaaaaaauauacucauaagguuccuuagccuacgauggaugauuucagcuaaaucuggugacuggaagaauagaguucucucuaagcucuguccucucccaccucccugaaauaaggagcaucauuuacaguuacacacacacaaaagacaaaauuccacauagugcaauaauaucugaaguucagggaaaccuucggguccaaaagucuccaucucuugcauguagcacagaaucucuacggagaaugucuaguguguuucaacauuaaacaggcauuuguugaaaugaauuguauguuuuccguaugacuucuuugucauuauggcuugacuggaccuucuucccuaaggcagcacuggcaggcuuggcaaaggaaauuuuggguagaguugauucuaacuacacaaugagucgcuuugcauaucugcugguauuugaccaagccaagggcuaaaaugauggaaggaaguauuuugggauuuaagugagugcagaggcacagggacacaggcugucuaucacacacauaagauuaguguuauaacacuaaucucagaauuacuucaacguuugaagucugcuuauuugcugcauuaucgaaagcaaccugagagauuccugaauccaggacuagacuaguucuuacagcacaaauguauaaucuaaggccuuaggcuaugccucuagauuauuagcuaacucuugcaaguuacuugacuuaucuucuucagcaucuuuauauggauaagggcagguuuagaccucaugauguguaugcaaaguaacuaucgaauuuucugaauauucuggaccuauguuuuggugauucuauccaucauuuuuaggauaccuagccagagccucagaauccuucuuaaugcagaaguauaccacugcagccaaaaucaacauuggcuaauagcuaagguagacuuuuaauucccgucucuuuuuucuacuccgaugccauggucaagacucugucauggggcacacagggaaaugucaucagugcugggcuucagagauauuguggugucagcucuacccucauccucuugcucagcugcccugcggagguacugcaaucugacagggagggcuguaggcuggcacuuugggagcucacuuuucuuugccuuugagcuguaagugaugagagaccugucaaggaaaacgguucgcuggcaucauucccagaccuggaagcauaaugaaauaaaguuucauucugacucaguugggauucuugccgcugaacauuggagauagcaucuggaguauuucuaccauccacucuccugguggaaaagaagcauucauuaguuaacggaacuuggaccuuuuuacuggcagcccaagucaaaagcccuuggagcaacucauuucaaaccagagucaacccagaccacaccccaguacauacaguagagccuccccuguccuguggaccaaccacuugaaaugcauauuucagagguuuuuaccaagaacagagagagugguaucaaacuggcucugaaauccagccacacugcucauguucucuagagucaagauaacuucucagugccagagguucugcacuugagaguuggaaucaaggcauaagaacaucauuuuuuuauucccuugggccuuguuccgacaucucugcaaaggccagaccaaaaaaacgcaucuucgggaacauccucugccuucucugaaauguccagagaacugugucgauagacuuuguaaauucucuggaaccuuggguuccuugcuuguaaaaauggaagcaaagacaucguucuuauagaaaggaagaacaauaaaauuaaagaaaagcaauguguguuugaguaucgcuaugcaguugugugugugcuguauugggucaagcagggauaauuacacucaguucugguugaagcugccuauuugcccacauccuguuacagaauggcugcucuagcugucaaagacucuccauucucagaucauuuuuguacaccccuauagaaacccucugcucagaauagcaauggaggucacgcagacagagcuggagugagacuuauagacaggaugcugcagucagaccagaguuuagccaugagacaggauguaggcuccucugucauugccucucuaaucuguaauuuuuucccuuauguuacuacuauacugauacuccuaucacugacauacacaaauguuuacagaaugcuacaugucuuguggacuauaauguaagauauuauauaaauuuucuuuccucccaaaucuccugucuucuaauaucugggccuuguuuauuacagcagaauuauuagaagccuguuugugaagccaaaacagcagcagcucaggucuggugcuguuuccuucccugacuuuggaagccagucaagaucaggcuuguguucuggagagaugcuaugugacauuccaagacgcugugaccugcagucacuaaucaguggcuuuaacauuuauaagucaggauguucuugguguacagagagaccggaaauguaucugauagccuggccuuggucauccuacucucucugcaccuuucuucuugaagacagagccaagcuuuggaaaugcaugcuuucaguuguucugugagcagguuccuggccucuucccucuugcuuuucucccuaccucagcagccacauacagccaacccugauuuguguauaugacagaagaggagaagaggugauaucaaacucuuuaucucuuuaauguaagcccacgaaaugcuagaccuuaaggaagccugagcugagagaacacaugcagacaacuggagucuaccuguuuugacagccuaaggcccacuuagcugggcccagugggccugggcaggaagaggaauuuccaaagcuugacucugucuucccuuauuacagagaaggaagagugccccauugaaacuaaugacaugcccugucaguaggagcaagguuuacauuuucuuccucucuuaguuuauucaccaacuuugcuuaaugccaaccacuuaccagauaucaccaccucaggaucaaagguuauggauaccuguggauuauaccaccuugauauuuaauuuuuucagacaaucaacguuucugauuucucagaauauggagguuaggaugagggaaaaaaaaagguuguacaaaucacuuuugcuuauauauucacuaaggcauuugcuuauguguucauuuccauuuuacuuaaguaacaggaaaaaaaaaaccuacuuaaauaaaauagggcccugauaggaguucauuagaaaccaaccuaaaagugauauaugaacaagcuggccaauaccugucccugucucugccuuuccuuccaaauaacuaaggaauuaaacugugaaagugaacuuaaggcauccgcuggccuaguguuacauagcaaccuacacgauaaagccuggauggacccaaagcgcuccacuauaccaaaguaacugucagaugguuaauuaaaaacuauccugagagaaaauguauagccaugguggucuagaacuguugugauuccauauaaccugggggugggggguggggagugugaacaacaauugucaugaaagccuccugucccaaaguuugaguacugcagcuaaaggcacagcaaaugcacguuuguggccuuugucucucucauaccugguaguaccauccuuuauaagguuaaucccugucaugugcuucuaggcuagaccaaugucagaaacauggcccgagaguaggagguuuuuguuuucucugugcuggauaucuuacauaucuuaagcaucaaaucaagggucccaugagucccaugacuuucuguauagcuguuuuucugcaucucugagaaguagcugauguagacauggggcccucuuuguagauuaucaaggaguagucucuuaacuucugggcuuagucauauugaauaggaaaauucuucaauaguuggcuugccuacaagccagcguggggucugaggucuggggauccaaggagcagcuuuccaggaaggagaaucugacaucuuguauguucagaacuggcagaaaccuguacugaggcuuuuagcaucagaggggauguuuaaaaccuauuuuguaaucuggauggaugcuacaggaugauacgcuggaguccuaaccuuacaaugaucauauuuagagauuacguuaaauugaaaucaaaagauggccucuaguucaguauuauugauguuuagauacaaaagacaagcguggcuguccagaccugaauucauagaaggaagacaaucugaaggcaugcaggaagaacacagccaucuacuacucugaggagcaaggcuggggucuccccagagcccucaggaggaagaaagcuuccugagucuuugaucucagggucccagccuccagagcuaugagaaugguuccaguuguucccaucacacagucugugaucuuuauccugcugucuuggcacacagcuacagugauccugaaagcagagcuucuuccagugaacuuuccuaagccccaugauuuauaauauuuucacuuacugcccaugagaauacguuugucuugcuccccagagucucuccaacuccuaagggcagggcucaggggaacagucaaaaucaagucugagcuccuggguuuaaaugugacuggcugugccaucuuuaccugguggcuuuauuugcaaaaucaaaguuggaagguauauauggucaguuggcguugcugcuucaggguugucuugaggcagaaccucacagcaggcagcucaccuuuuccaugcaguccaggagccaaacccaggaaacuauggcauucaccuuugggcugggucuuccacaucacuaacacaauagagcaaaucugcucaucuguuaggaugcaguuuuaauugucaacuugacacaauccagaaucaccuaagaggaucuucucaguaaggaguugucucgaucaggcuggcuugugagcaugucugugcaggaugccccuccccccccccccgcccgccuuucaauaugcacuaacauuuuaguauuuuaaucauuaaacugaauucuuggaauauauuuuuucuaaaauaauuauacaaaacagcaccacuucaaaugucgacacaaaaggagaguaaagaaguuuuagaagugggccuuucacucgugaaaugugaaaugaauuagagaaaugucuguauuuaaagcagugauuaucacccuuugcugcauacaguaaucaccuugagaagagcuaacaaauggaaaaacaaaaauuggaagaguaauauggacauuauaaagcccaaaugcuuaaagagcaaaacagucaucuuauagauuuuaaaguacaagcuauuaaauaaaaaugaaucuuugcuuauaagacagcuucaucaacuuugaaaaugaaacuauaaggagacaaaacacaauacggcugugacgacuaauuaaugauugcaguagcaugcuaugaauauauagauuuuugugguuaauaaguaucaauaaauauguguuaagaguaugacucacuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauagggggcuaauauccaacauauauaaagaacucaagaagguggacuucagaaaaucgaacaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaaugcuccuccauuguuggugggauugcaggcuuguacaaccacucuggaaaucagucugacgguuccucagaaaauuggacauaguacuaccggaggauccagcaauaccucuccugggcauuuauccagaagaugccccaacugguaagaaggacacaugcuccacuauguucauagcagccuuauuuauaauagccagaagcuggaaagaacccagauaccccucaacagaggaauggauacagaaaaugugguacaucuacacaauggaguacuacucagcuauuaaaaagaauaaauuuaugaaauuccuaggcaaauggauggaccuggagggcaucauccugagugagguaacacauucacaaaggaacucacacaauauguacucacugauaaguggauauuagccccaaaccuaggauuuccaagauauaagguacaauuugcuaaacacaugaaacucaagaagaaugaagacugagguguggacacuaugccccuucuuagaauugggaacaaaacacccauggaaggaguuacagagacaaaguuuggagcugagaugaaaggauggaccauguagagacugccauauccagggauccaccccauaaucagcauccaaacgcugacaccauugcauacccuagcaagauuuuauugaaaggacccagauguagcuaucucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauaugcaucaaaagauggccuagucggccaucacuggaaagagaggcccauuggacacguaaacuuuguaugccccaguacaggggaacgccagggccaaaaagggggaguggguggguaggggaguggggguggguggguaugggggacuuuugguuuagcauuggaaauguaaaugagcuaaauaccuaauaaaaaauggaaaaaaaaaagaguaugacucacuagucacacagcuuuuuaaaaaaauuuguagcuuacuuuacuaagguuaauuuuuuuuguugagucaaagaagaaaaccaaacauuuacuagaaagcaguugaaaaauguugacagugaaaaaucuccuaugcugaaacuuaccauaugcagccaaagcugccuccagcucacacauugauaaccauaaagccacuaguuuugagaaacaauaaaaagguaaacuaagguugaacucauguugggaacuaacaguagaaguaccuaaaggauauaagaggaagaguguaacuauaaacucauaauagaaaauuaaaaaaaaauagauucaguaaacaaagccaagaucuacaucuauaaaauaagucaauuuagauaaagcauuggcaagguuuucaaaucaaaagaacaaguaauuuauaauggaaauugugaaaauaaagaggugauuaaaagaucguagaugauucuaguggaugccauuacgccgcugugccugaacauccgcugugccugaccaugcucacugagcguaggccugcauaugugcagacacaagcggaauaacugcaggcuacuugagaauauauguuaugugggacaaaacacauuaaaagaagugugugaagucaauaacuugaacucaaagaaucuauucuuuuucucuacuggcauuaucauuaacuuaauaauaucuuuguagugcugaauuuucuagaauuuugguaaagauucacuauaauaaagaauaaggucuuccaaaaaaaaaaaaagaaagaaagaagugugugugugugugugugugugugugugugugugugugugugguguauauuguacaugugugugugguguguauauugagugugugugugugugugugugugugugugugugagagagagagagagagagagagagagagagagagagagguguauaugugugcacgagugcacggaugcacucacagccacucauauucgauggcacucauggcuaugggacagcucccagguauugggcgucuccugcagucucuggaaucugggaauuaagcccaggccaucaagccugcacgcaggacugcacgcaggaugcccuccccacacaaccaucucaccagcccugaaagauacaaauucuaaaagagucgucucccacuuugcucuuccacauacacauggauauagacuuauagaaaauggugguagcuuucaaacuuuuucaauguucucuaaucuuugaccuuucuguuuuucuuuuuuuuuucuuuuuuaauuagauauuuucuucauuuacauuucaaaugcuaucccaaaaguccccuauaccucucccccccccuccccuacccacucacucccacuucuuggcccugguguuccccuguacuggggcauauaaaguuugcuagaccaaggggccucucuucccaaugauggccgacuaggccaucuucugcuacauaugcagcuagagacacgagcucuggggauacugauuaguucauauuguuguuccaccuauaggguugcagaccccuucagcuccuuggguacuuucucuagcuccucuauugggggcccuguguuccauccuauagaugacugugagcauccacuucuguauuugccagggacuggcaaagccucacaggagacagcuauaucagaguccuuucagcaaaaucuugcugguguaugcaauagugucugcguuugguggcugauuauaggauggacccucggguggggcagucucuggaugguugaucuuugaccuuuaauuuuaaaugagggaauuuaugcuaagaaacccacaaaguugaauacauguucuauuacuuaagacaugugaauuucagaaaacuaacacugcgggaucauccagauacauaacuguguaauuauaaacauaaaacuaauucuggaagacaccaaaccacaaagcuaacuuguuuguuuguuuguuuguuuguuuguuugagacaggguuucucuguguagcccuggcuguccuggaacucacucuguagaccaggcugcccucaaacucagaaauccgucugccucuacuucccaagugcugggauuaaaggcaugugccaccacugcccggcugcuaacacaauuuuuaagugaaggagucauacuagagcuuuacugucuuucuuguaguuuuuacauucuccaaauagucaauaguaauauuauuuuguaaagauuuucuuuuaaacuuuuauacauagagcccugcaugugugccuaugcaccacaugcauguuauaccuauagaggccaaagagggcgccaggucccccagaacugaagacagacaguagugagcugccuuuugggagcugggaauugaaucuuccguuuccuuuugaagagcagccagugcucuagaacugcuuagccaccucuccagccccuaaauuauaauauuuuuaaauugauacuaaagcaaaugaagaaauguaguauaaaauaaagggaaagagcauacagaaagcaugucaaacugaggugucacuacaucucuuuguucucuaggugguuugucuguuuuucauucccuggaaacgucugccaaaggcaagaguuugggaaagauaugagcugagacacugucuccggcccaaaccucagaucuuugauaaccaccuuguuugcaguuuuggucuuuuauuguuaacccaagaagacaaucagcugcuuauccucagacucaugggccugcaccuagaacacugucuguccucaccuacccaagaacaguggcuucuuuuccucuuuggucugccuguccuuucugugagacugagggacucuuucaauagaacagccuccuuuuuuccagauggacaaauuuggccaauacucccccuaguggccauuuaggaaaucuccuggacuagccuagaguacugaagccagaggaguacagugacuuguuaauguuugacugggcuccaacuccauauuacggcccacaaauguguucuuuuauuuuuuuucaacaaauagugcaaguuaugaaauauuccaguucucaucuaaugaccuggauuguauauuguuuuagaagagagaugacgaggaacuccaguaaacuaaggaaguguuuguuuccuacaguacaguuguguaaggacucgauucugcuguguaccaucaaggcguguccaucacagaaaagccagucaccgggcauuguuucauuaaucucccugcacauuuuuaagccuaucaccuuggauuuuccaguugccagccagccaacccacucgagacagccugcggauuuaaucagcacgcugcuuaucauguuuuccagaugguuaaugggucccuuaaauaaagcuggcccuaauucuaucugguguuucuauucugguccccuuuguagaauaauuuguuuuaugguccaaguuguucuuucuuuauuacucuguagucuuuggugaucucuuacuaccacuucuuuauucaaaacuauggcauauuaacucaacucauugaucuugauuuuuacauucagagaagagaccacucagaugaauaucaacacaguacccuaauuguuuaauaucauuauuauuauuuauuuguuauuauuguuaucauuuaucauuguugucauuauuaacauuaccauuacucgugagauuuagagacuagguuugcuagcauuauugauugagggagggaggaaggaaacaccuuuauguuguggaaucauagauuagcaguuucuuuccauugcagauucugccucaggaggaacaguccuugucaugugaagcagugcuaucugggaaucaguacauggauuccagguuuuagcaaucuuccuuaaagauuuguagucuuagugauccauauuacaacaaagaaucccaagucuaaauagcugagccaacuguagauucagucugauucccauuccacaaaugguuucccagguauacagccaguuugcacugaagugacauuaaagugcauauuggcagaaugccacggugugugacuuccacaguaauaaauggcuggaaggaggcaagguaaugcaagauuucaaugguggugcacucugaaaggaaggaagccagagggucugggaauuagugguggagcuacaggggggaaaauacagcucuauuacagcacacacuugccucuucuuccuucccauugccugccugagaugauugggccgaguuuaaaaauaaaugaaguguauucacguuuuccuucagaauuuugcuuugaagggauucuguaaaggaaaaagauggaguacuuacaugagcagaaugcagcaaucaagacaugaaagcauaggccuuguagauagcagguguacccuuacauggggagagacacaugcuuccaauuaaagccagucgcacaggugagcauguugcuucuguacaauguuaaugauuggauaggugaugcugacaugaugacauuuuugaauggguucugcucucauuuguaccuuucuacugccaucuuuauggacugaacuauacagugacggggacugaauuuucaauagaaacuuaaugucaacuuuuagugcugacuagagaugcgauuccacacacacccaggcuaucauuuauguugauaugcuuuucacauuuuauuuuagcugcaaaaccuuuauuucaaaguggaacacuauccagaugcacauggaguuugucucuacaggaaaccgggauggaugucucuaugauuucccugcugagcuauuuucccagugcccgucucuuucugcccuuaggugagcuaaggaaauaguuuacuaugugaccugagaagaagugcuucaguguucacgccuucccaaauauuuacuuagugccugugauaagccagacccucuucugggcagcaggaacaaagcaauagaaaggaaagccaaugccugucuugauuaagggagcagcagucaaugggggugggggugggcacuccucugaagaaaaugaagggcuuagaaagugauccuguaggacaucccacuuagagagaucagcagggaaggccuaacacagaaauucaguguugagaagagggccuguguagaaagcuuuggaaagaauguucuagauagaaaauuucugaaagucagcaccagguccaacacuguuacacgauguaggguuagaaccuaugccccaacaaagcgugccaggccaccugucuuugauaaaccaacugaaagagcaaaauugauaaugaaaaacaugaagcagguauuuuuuuuccaguauagcuacauuggaaagguggacagagagauccauaaaagugcaaguuuaucuuugggauccugaugugacaguuuagaagguaagcgauauguauaagcuguccuacccaagucucgcccuaccuaucauugucuuagcaccaacucucccuaccaggucagcuucucuuucaaggucaacugacaagguguagaccuuccuccagaagacagauucuuccugcuguggcuuuuucuucucccagcuugagauuccugggcaggucuaauuucuugaacccacuguuucaguagccugauagcuagagagaagaguccaagugucucuuuagaagacauccauggcugugagguagaccagguagcuagaucucaucuuuggguuguaggguuggcccaguccauguaacaggguaucugauaaugcaugauauacauucacugauucucuuuuguuguccaacugcuuuuacuguccauuuauuucauuauauccuguuaaugucaauaucuaaaaggguuugagguuacagcuauacaugguguauacugcagucuuuuucguuuuuguguguguguguuuucuuuuuauuauuaaaaauuccaaccauauaaaagaguaggaaggauuuguaucuuuaaauuuuuggcaugauuuagauagugcaauugagaauuuuaaaaaguaguuccucacaguccagguagaaagaaggaaagagguggggagaagaaagcaaaaugauggcuuacauaauuaugauucaucaaaaaggcacaguguucucuggggaagaaaugccuggugcuaaauucuaaauauaauguauuacauugggccuuauguaagagauaucaauaauucucuuuaugaauauuguaugcuuaauauaugcaaacuggggaauacaaaccguaaucagacauaaauucuaccuucugagagcuugcaguuuagcgaggcacacaaugaacaugcgggaaaacuaggcaagguaggagguauaaauacaagauggcuuguuaguggauuuagagauaggcuuucaugaaacucucagucaaagguguagcuuacaugcaugagacugggacaccacaggugagaggacagaaagcagccagccagguuuguagguauuuuauagucagaauuaagcacucaguacccaggagcauguccguuaggucucccugagauaucaguuggugaaggugauacuuauuaaauuuacacuugacauugucaagagcccaggacaaaccaaccuuaugacauuugauuagugccuuuccccuauucaaauauguauuuauauggaauaaauucuggguggaaaugucaaacuauauagauauaguaaaaggaaaaugcauaaugucuaccccaugguucacacacucaugagcacuguacacguggcaugucacccuguuucagucgcucucugcugugcuggcaugggagcaggaugcccagugaacacacagugcugcagcaagcaucauccaaggucgguuccuaccacuuuccccaugucuauagcacauucauauuucuacagaggacaaugauuuucacuucagucucuuaugagucacacuucuucccagagcucuuacuuaagaccuuuacugauggacucuagcuguagaaaugcuaagcuauccuuuuuuccagaagugguaccucagagcacuuagcgagucaaugaauuuugcauucucauuugcuuucccugucuugccauccaagcauccaucaauuucauuacaugagcaucccaugccagagcuugggcuccuuucacucugccucucuccucaacgcuuaccuuguccagcagucauggaggacauugggucguaucuccaaaaaagcccuuucuccugcaaugcuugcuggucuggucaccuucccugggugacgucaggaucuccuaaauccuccccucuuuuggguuucaguuccucuucuaagccauagucaauaucuaacuugguaaaaauaugcucugccacaaagcuuuucaugacuccaaacuccagacaccuuucuggauaaauuucaaaucacucaaagugaaacacagcccuuuauuucugggucaagucaguggguugagguuuuagaaucuggguuuucucugugguuuucgggcgagcauauggaccccugguuagucucaaagugggcaccaaggacaugcuaaucugcuuggauuccccuguaggauucacgagccagcuacagcuggaaacuucucccagccaaggcuuaaaauuacccagcacacuguaguuauuuuaggaaaaauuucaaaagcauucuaccaaaaagcagccuguuugcaaguauagauuagaggaucauuuccauuuaggaagccuaauuuaauuaagugacacaauuuuugagguaguaaagcuuuuccugccaagucaggauccuuuuauuuuuauguaucugugugugcacuucugcuaauguaaaacagguaguagaaaaaugauacugacuccuagagauuccugcauguccagcuggcugccacuauggucagagcagcaaauguucuccacacuaggaaacaagaggccaacuuguauaaguuuuguuaaagcauuaaguucugaguuuucaguugagacauuuuaaugucagguucuuuuuuaaaaugccugagaaucauucauuagagaucaguuaagaaagaaaguaagaaguugugauugauaauuccuuucaggaaugaggcuaauuagcuugaaaaggccuccaggccaugacugggcccugaggugaaaagacaucaaagacaauacaauauggagacacaaauaucuaaagguuucccuuuaaaaccaggugagaaguuucauuacuagcuugcuggcucaguuuacccaauggauaauuuuauuucaauaauucauaguuaauauuauccuacagauguccaguccuggaaaucauucaucacaugaacuuccacgaccccuccccccacgcaaaaccgcuaagauacugauaaguuauccccaucaaaaauggucacacaaauauucacauaaugugaggaaaucucucagaaucauuuuuaccuuuucagaaaaaaauagucucggcaugauugcaaggaagugggaaauuuauacccaaacagugccauguaucacucugaaaaaaaaauuauuuugauucucauauuuucuacuccuacaaguaugcauacguacacacacacacacacacacacacacacacacacacagugaaaaugagaaagauagguuugagugagaguuaacccugagagggcuaggucuggcagcaggaaaccaagcaaccucuucaguugccuuuagagcaaucucacaagcacucauaaucuguagucaccaacagaccagucccagugaugaaggagaggucugacuucuuauuucuuuuuaggggucacaacaucauuuacaccacaugauaguucaauauagcaaguauagaaaggagcauggaggagcuggguacuauaaguugucaagucacagcagggacugcuuaucugaaagaacuugcacaaggcuuaugaaucaggcgguggaggugagccuaaagguacaggcaggcaucuucuaacacuucauaugucuuauaagaaaggagcuacauacauaucaccaaacuguugcacaaaagaaagacaaauguaaacuaucgugauuccuuaaaguuaauggugaaguguuuggaaaagguguguguguguguguguguguguguguguguguguguguguuuguguguguguguguuaagacaauaaaauaacauuuuauuuuacuuuggacaauuaccuugaaguagaucaauggguuaaaguucucuagauuuuuuuuauaugucauguaauauaaacaccuggagugguaauaucacucuaaacaauauagaugagauuuuuuaaaaaaauuauuucugugguuuugcuuccuacucaauauaugccauuuccacaaugggucccugugucuguuucccaccauguccccagagucuauuuugugauagcugcagguauaaaucugacuggugcauguugcgcuccuccagcgagguaugaaggcaugagaauugacccuugacuuaaaagaaucuugugauagaaacaaagaccucuuucuaacccacuuaccugauucaucaaauuauuauuaugccaugaauaguggcaaugagauuuuuaaauaaaagaccuauuuugucuuccuauauauauaugcuuuuuguuuucaugcuucaugcauauucuccauuccugcauuccaaaauuuucacaaauauguaaguucuguauauguguguaguagggucaaguaggcuauuuucucaaucaucucuaaguauguaaaacaauaaaaguuaguuuucagcacuguagguagagaugagcuuccccuguguguccugagcucugugcagcuguuuugcagcagguaaagggacguccacggaaugugagucagguauguuccagagcacagugcugaguucagacugcuuuuuccaggguggacauucuauaugaaaaggcagucuucuccucugaggcgagcuguugaaguagcacucaucuguaaccaguuauuagauuuuaaaaaaaucaucuaguaguaaaaauaucuccaaacugcuucucaaagggaucaauugaauaguuauuucuuaauauuuagaauguaaguaaguuuuggauagacaaguggauagucugguagugaugaagccaugggcuuauagugggauaggagguacuuuaggcaccagagggcucaggggugguauccuaguuucauuucuauugcuauaauaaaaugccucaacaaagaaucaaguuaagggagaaaugauuucucuuagcucacaagucuaggugcuucucugucauuucaggagagucacaauggcaggagcuugaagcagcucgucauaucacauccauagucgagagcaaagagagcucaaugcaggcaugcucaccucacagcucauuuacucuacccauacaguccaggaucuccuaggaaguagugccacucacaauggacugugucuucucacaucaauuacuauaaucaagacaauuccaugcuuacagaccaaucucuuccagagaaucccucauugagacuucugagugauuccagguuguguccauuugaugguuauacauaauaucacagauggauucucugagggggacaccugaucugugaaacuuaaagcugcugaaauuucgcuucaaugggaguauucuugaaagaaagaggaaacagcaucuaacaacccaaaaccaggcaugagaaacccucauuugggcuguuggucagaguugucuaagagacucccaaaacauuacagauuauugccaaugcccucaguugccugacagggguagaaauuaagucucuuucgguggagacaccauguacuucagacguaaggcccagaggccccuaaguuggaacugaccuauaugucaccucccugaguacugucuuucaugguaucagaaggagccaugcaagcuuccaaagggcagcaacccgcaguccuauccaacuaugaacuguaacaacuaccagcaugccauaaugacccaagaccaauauuaacacacacacacacacacacacacacacacacacacacauacaaacgcacacacaccccuucccaauaaccaauagcucucuucuuggaguucaguccugcucaacaagagggaagccauucuugguacuagaaaccaagccaauuaccugggguuacugaaguccuagaacuuggagaagaaccagcauaaugccuaacuacauuauaaauauuuguccucuuacccacggaugagguguuucucauuccucaguggggacacuucucuuuacaacagacagagacuaaguacagaaaacuacaaccaaucaaaaugaagaauuguggagcccaguuccaacagacauaucuacaaaacacucuuagcagcuaaggcccuggaagcauugcagaagaaggggucccagagaaccagggaauuugcugugagcuugagucuccuaguaaugccagaauuuauagucaugaucucucaccaacccuacuggcuaaacaugugcugaacaaggauaauaacaguaggcauuccaaagaggauggggaaaggccacaaugccucaacucugcacaaaacacuacaggcaacugaggaaaacugagcagaagacaaauagucuuccacagagaagaacacaccaguuauuuauccaguuccaaauggucagcccugaaaauguauauauaaauaacauuauacagauugagcagguucuauuuaguuguguguauaacaaaaguucaugggaagaaaaagagaccaugaaauugaaagagagcaaagaaggguguauaggauucuggagggaagaaagggaaggaagaaaugauguaauuauauuauaaucucaaaaauaaaauaaucucaaaaguaaaaggaaugaggcagaggccuucagagauggauggugggcacaugacuugccaugugagcaugaagaccugauuuuaauucccagaacacauguaacagacacacauguguuugucuggaaucuucaaaauguugugggaaaauuggaggcagagacaagagacuccccagaaacucguggacucagcuagucuaguguauucagcagaaaaacaucagagacccaucucaaacaaggaaggaaaggaccaaguuucucuaacuuccauauauacacuguagcaugaguaugcucaccuuuggacagagggauggggaacacauauuauaugcagagagagguugagggagauagguagacaugcuggagggcauaucaaaaaagcgagacaaaacuuucauuuaauuuaacauuuaacuaauauauaaaaaauuuucaaaucuagcuuucauuuugccugagggauaauggacaagaaagagcuguaaaaaauuagaugagagagguaaccaugggccagacuuuucagggccucguaagcuaugguagagauaugugcuuucauuuugggugagauagugugccaauggaggauuuguaggacagaagaugcuugaucugcagguuugaaauauuaacugugaguacagggaauaugggugaaauaaggcgagugagguuguuauuguuagccaugaauggaaaaaaugcuaucuuagaccgaggugggcaggaugauaaugauggaaacuugucauuuugagcuuuuaauuuuuaaauacuuuuuuauuuuugagauaauaugauuguaucaagucccuguuuccucuccucuugcccaacuuucccaugucucccacuuauucucuuuaaaauucaugcccucuuuuucuuugauuguuguuacaaguguguguguguguguguguguguaugaguguuccuaaacacuguuacuuguauguacauguuuucagggcugacaauuugguaucagauaaccaacuuggugugcucuucccuggggaaaauuauuucuuccauucucaucccuccuaguugccuuugguucuuucuuuaguguugaggcuuuugugagcuuccaaccuccauaaucacaugucuguuccuguuguccuuguucaggucauguuuaguguaacuuaauggguauagcucuuuugcagcuuuuuaaaggcagauaugauaagacauaugagcugaguaugauagauggggagugggaugagggagaauaaaugaauacagcaccacacuaaguuuaaugacgacagucauugagaugaggacuacugaaggaaagaagaagaggaggaggaaaaggagaagaaagaucgaguuuggaacuauugguaugaaaugccuaauaaauauccuagagcagauauggagaugguaggggaauacaugcaccagaguccuuggaagaagauuuacauuggaucauaucaccuaaagaugacagaguaggacaccaagaacaaaaugcaggacacuaucauagguccaggauucugauuuaaagcaaaacaaacaaacaaaaaaaagacauagcaacgggagauggaggagaggacacugggcaugagauacaugcaaacaacaacaaaaaaaugggaaauuaguuuucucaacagcaagagaagaaagguugugggaaccagaccaugaagcacuacugugaaaugaagauuauagaggaucagauuuggccuuauggggguccuugauguccaagaucagagcagcuucagauccaauacauggcuuaauuagaggagcuaucuuauaauugcucuagauucuuggugaaaggagaauuaguuaucuugugaaaacuaaggaggaaggaggaggcuugagagcucugugaauaaaaaaagcuguaacauaguaaucugaugaacaaauccacguggaaagacaagaggacuucuggauaaacaaauaauucucuuggcacuuaagguuauaaauuuaaaauagaagcacugugcuuuguauagucuucccaaacaugucaaccuucccaggugaauggaagcaaagaacaagauuuaagcuaugguaggaagggugcuggggcuuuggaaaucaauaugaaaggaugauuguauuagaauggaaguaaaucagacauguggauagguagacaagggagaaauggugguaucaaagaucaauaggaucaaagacauuuuuaaaauggagaugcacgaaagaguaacauagaaagaugugguaugacuguaaguugaaauuuugguaaugacuugguguuuugaugguucaguuaaaagcauuugaugaugauguauuggcaaugacgaggcuuaggauacacuggauaguaacagugaauggccacaaaaaauauuauaaagggaaaaauaauuugauuaagaaccacagaaugugaaacuugaaggacucauaucuugaguuuuuauaauuaccacgaacaaaaaugaggggaaggaagggcaggaaaaucuccaaagaacuguggcaaggccaggaggagcugaagaacaacagaggaaggagguaguauuaucucauggaaaguggucucagagaugucaaggggguuagcaaauagaagacuucacucuaaaaguagcacugaagaccaagaaagccaaacaguaagaugagaaguaccuagucuguuggaagaaaaccagaaaagacagugaaagaauagccaugcccccacagaaucauccaggcugauaugaggagcagaaggagcaguuugugcccagagaagauacagaauuuacuaaugacagacccugguucccaaagaacacucuggauacucucaggguaauugggggggggggggggacuaaggucaggggauaagcagagccucugggaguguagaucuguaacauucugguugcuguagcuuggaccaaguagaauccuuggcauccugcuccagcguuggguacaaggaggaaugagaguuauaugcucuugggaauuaugucuacugauucuggugaugggauggaauggauugaagaagggcuaugggaagguuuuggcagaagcugcaaauaucuagaucuuuacuuccacacuguccuuuuguggaagguaaccauaagguuuucagaaacuucuccaauuguuacaguauuuucuagacaggaagaaaggaaaaaaaaaaacaaacaccauuauggaauggggucuuugcccaaauguaucuaggaauuccugaguugguugaaagugucaacaaacacuguuuucauggagaacaaugccacauuuacauuauaaaagagcugguauauccuuuccucagauacaaggcuggcauucccuaaauagcuuuggcugucucuuagggagaucacaguuggaccaaacucuacaacauuaccaugaaaugucacuuggaaaugauauuuuucuuugcucaccacugaacauuuugaacuugggaagcucacgcugacaacagaguuucucucuccuguaggucaacccugguuuauuuguuaagcaguauuugugaagggcacaugcuucuaacaaugacucgccagcaucuuucuuacauuauaaccaaacccauaaaucacucauuauuuacuaauuuauuaauucagcuuccuuguuuucccugcuugaaaguagucguuuuaaaaaguaaccaacugauaauuuuuauguggaaagaacuugaugucuuagugacuugcccugucucuguguuaaaguagccugacaagaacaagcuaagggaagaagcauguguuuaggcucccagcucaagagaugaauucaucaucacagagacaucccagcagcaagagccugagcagcuggucacagugcaugugugguuaaggaaagggugguacacaugugugguuaaggagagggugguacacgugugugguuaaggagagggugguacacaugugugguuaaggagacggugguacacgugugugguuaaggagagggugguacacaugugugguuaaggagagggugguacgcgugugugguuaaggagagggugguacaagcugcuccucagcuggcucgcuccuucucugcaguccaggacacagaugcaggggaugaugucaccuaccuucaggguggcucagaagcuaaccuaaucuagauaaucccuuagcuugucugcuaguggccacuagauccaaucaaguuuugauagccaauguaaaugaccacacaucauuuugauaauugucauagaacuacuaaaaacuuuguuauuauaaagugucgugaaauagauucauuuggucaucuuaaagucuaauuaguuucucugaacgccugggugccuuuugaggcuguuaaauaaaacuuguugaccuuuuuuccccuaaaugcaaucucauauuucaaauacguccuuuauaagcguaugaaacauugauugauuugauggcauuugggucuaaaauuacuucuuagauguggaagagaacaaggccuuguuuucgaaaguuucugaccuaauggcuuucuucucaaaaagaaggcaaauucagaauuagaaaggagcuauagauuucauucugaccugcuccagacugaauguuuagagccuucaggaugccccagauaaggguuucagaauaaaaccagccacugagaugaauaaaucuggccuggcccugcugugcaccuggcagugcacacacaguccagcugagaaaggaugaaugcgugcaaugaacccagccgaguuagcgauggacuuccaucauagaggauguggggauggcuuacugucuuggagaagacagaaagcugggcuuggggacagcaggaagcacuuggaauuuacagagaauguguuugaauugaauuuugguauauaauuaggaauucaucaccuauuugggauggaaauuaaauauucaucacguaauuuugcaucgaauaauacagaagauaucaggaagaggauucagagguggguggagaaucugaacaguagauagaggcaaaaaaaaauaaggcagccuuuggaacccuugagauuaguaggggcccagaaagaagugcccuggagaacugggucacuacauauggaaaagauuuuuauauucauuauucauaaugaaggcucacacggaggcccuuguguguguuuaugagacuguuaccacugugcuacaguccaaggccuggaaagaugcuaacugagggcccuagaacaccaucuuuggcaaauuuggagagaaucaaaagauauuuuuguuuuccaaauguuacagagaacauucacuuuuguuccuucugugcuaagagacauucguggaucagguuguucuaaugaugggauuggagcccuucucacaaugaggcugaguuaucugguggguguuucuccaaaggaagacuuuacaccugcuuauguguguucuuccaacuauaauccacugacuaugagucuuuucuuaaaaaaaaaauggauucucuauucuuuggugaguggggaccaugaaacacaguagugcaaaagaaaucagcaaggucauccuguaauacaaggagaaggcugaaggaaaaaccuaaggaggguuuauuuucaggugagaucaguuagagccggggggggggggggugggcauuguuugguuacagguuugguuuggcccaucaucaggagaagccaaggcaagaacacagagugagauccuggagacaggaacagaagcagcggcugugacauaggguugggggaaaugcugcuuacugguuuguucuucauagcuuacucccaguugggaaauuugacuagagucguauuccuacccauaggguagccuuaaguuuuccugagccucauaaggugucaugccugagacacagguacuccguggggucccgucaggcaucucaggguugagccaguagugauucuaaucucugggugcagucucuauacucuccucuauggccacuucacugcaacaguaaugagaugaauuuaagaaagacccugagagcaccuguuaugugugauucuuauaaaaauaucaagucucuggaaccaccucugggcuuucugacccaguagaucuacaguugaauuuaggaaugugccuguuuaguuaacauccugugaugcuucauaauagaugggacauuucaaagaaacugaccuaaaaauucuggggggaaaugucuauuuacucaguagugugaagccaggaguugcccugcugcuaugggccuuucuauacccuucccaguucucaaauaaugacagggagacuguauuuauuuguaaguuuuuggccuuauacuuaggcauuauuuccagcuagcuuguaauucgauuaucccauuuauacuaaucuacaucuuucacguggcugcucccucuccucgguuugauacaagcaacuucuuccaaguccccauagugaaucucccaccucugacucucucccagacuuccucucugugucuggaauuacuaccuuacuauucugccuuuugcuauaggucauaggcuuuuuauuuuaaccauccagaacaugccuuagucaggaaaggcaggauagagacacgguguacagaaauaucacuccaaaauuguccaacccauuaauagagccuuggauucucaucggaguaaaguuuagcuucuuagggucuucuuugauaugcaccacaguuugagcuugguuaugucgucuugcuccagauagaaauggaauagaagcguugagcuccuguugggugugguaugaaaaaucaaagcugaggcugcuucuggccugagugccuuuguagugguagcagucaggcucagaagucaggcucaggcuucucucuugcggcucucacuucacugugacccagcagugucagcagugggccccccagaagaaccauuccuccuucccaagccucccauucucccucugcucccucccuccacagucucaagugagagcugugacgcggagaaagugcuugaacccuaaucauaguacuuagugggacugugaccucaggccauugccuugcuuuuccagucuccauccccucaacucuaaauaaggauggcauucguaacucgcagcauuucugugaugaagaagcaauguggcaggaugcagggugcuccauaugagcugcuguguuguaucugcuguucggaccaugauaaaauccgaucuucuggaaguugccuauuaaugaugcacuuuuggugucagagugaggggccaaauuuuagauugacaacaaacaaacaaaaacaagacagacaaaacaaacaaacaaacagaaacagcuuuuagauuuuugcuaaauuacaguaagcucuuuuugugcuaugggauauguaccaagacccugguagggcccugaaaccacaaauagcaccaaacccuacagguuccacguucuuccuuauagucuacuaccuacauagauagaagaaaguucuguuugcacauuaaguaaaauaagaagugaauucugaaagaauacuguaagagacucaguaaacucauuauuugaggaauuauucacuuacugugcuucaaauauggcuguaugugcugcugaaauugcaaaauguucaagaagagaaaacuaugguguuagcuucuaaauaacagugguaauauuuaauugugcaauugagcucucuucuuuuggaauuuccuuuugaaauaaccaauacagauauggacacauagacagacaaacagaaauacacacacacacauacacacacagagggaggggaggggaggaggagggggguggagagggagacauauguuaaaacuauguuuaagaaugcucuuagauacaugccaaaagcuuucuguccgugguagaauuagagaucauuuaaaacuauugcuuacucauaauauauucuaucaaacuucauguacuucuguaauaaacagaauuuuauuuggggguucuuauuaauuuuuuaaaaauauuuuuguaagucuuucggaugccauaguaugugugugaaggucugacaacagccaguagaauucuguggucauuucuccuguagcucccagguacugaacucauguaaucaguccuggcagcaagcagccacauauucugagccauuuuccagcccaggcaucuuauucuaccugauggacuaaaaauauuuucucagaaaacugcgagcuuugaaugauguccuacucuaugucaauagagcuguacccuggcuuuguguccuucggauguccucaggcuugauuacuagucucuagauaccccaagaaauacuugaggggcaguaaggagaccuggcaccugcaaaaacagacaccgucccuuccuuccagugccuucuguguguuucccaccucccccaauguucacaagacaguagaauuuuuccuaaggaaguagaccuucuugagacauuccgugaagggaaagaauguuuugcguuugcuuuuugaagaguuaauacacuuuccucuuucccuccauuuauucuucaagugagucuagagugaucucuuuccuugcgagucuugcucagucucucaggcgcuuccaccugggagcuucggaagguuaggcugacaacuuagggcugcugcuuauuaaucagguguuugcucugugcgccauuaaucacacaacccacacagcugggucggauucauuagugucaucuuccauagcauuccucuccccacccugcuugcucucuguggcauucauuaaaaugccaccaucacuuuggucucuggcuacucgucucccugucucucaccucccuagccaugugcugugcuugcccucuuggguguauggaaagauuacuaagagguuauuaagcagaacauuuaauuacagggccuccgauggccuuuuugacagauuuccuuucagauccuuggaucguccugaaguuucaucucaggauuuguguuccaugcugagccaaauggcagcccccaggggugcagacgaccucagcguguuacugagcaucugugugcagggcugucucaguaggacagcucuguucaucagucacuccccccacccaaaccccagcuuggguuauccuguugaugacagaccuugcccucugguccccagccagcuccuucucacuauacucacuauacaguucccacaaagacagcuuuaggcucagugcacuucaguguucugaucuuuaaacuuucuauuagccacuguucagcacauauuuauaaagcaccuauuaugugaacaguucugagucaggacauaauguaguucuggccuguguaucucacacuguagcagggagggcauauaaaagcagaaccaaagagcagaugcgucuucaagugcugugagggcacaaaacugaugcaaaauuuaccagaugugguugaccauaguucaaauaguguggucagagaaugcuguggucccagccccagcuucaucagcauugucugggacucuccaaccuguccccaccuacuuuagucuugacuuacuagacacucuaggagauucuggggaccaggaagucuggacaacauggacuugcacuguaucccugugaugggaaggaggaagucauguacagagugaagaaagacaaauaucacaaaagguccaaauaccaugcugguccaagaaauagaaccgaagaccauagaaggcugaguaauuuaaggacaagaugcaggacugugcugcaagaagagcagcugucuuccuauuaaaaagggauugaguguugucagccuugcuugagggguuucuucaccuuaggaaagaggaaaguaaagaagagagacaaauugccuaaggcaaugaagccaagacugcccagacaucuaguggggguucaagcaaaaaccagaagcaggugaaagggugacagccaggagcacagaaggaagcuagaggaaucugggcucuguggcaagugaccuugugaacaguuacuacugugcagagggaacugcaggaagaaauagcuaggaggacagauuuuaaacuccucagcuccuguagaggaauuaggauuguagcacuaaacacugugugggggcuuugcaguaccccagucucaacugaaugcuguugaaaacaucucaucucccguaccugucagucauguguaugucaauuuggccggucaggaguugguccucuccaguuguccagacugccucgcugacggugcaucuucgugcauuauuugcugugucaguucucagauaaagaggcuaugucuucuacauuaaacccuccaaaaauaccuuuaaccaagaugaaggguugccggggagcaagucaaagaaggggaaauucuguucaagugauucggagcuaaaucugaggaguugauccagcacgaccagugagccuugagguuuuagaugauauuuauaaugucuguguaagugucaugaggcaggagaggguaggaacuuuaacaauaucuugcuaugguuuuguucccugcaguuggguggacagagggagccacugaugugcaguggguggaggccugggcugcugcuaaccaucugccuaggcacaguaggccuaaugagagaauugccugcacaagaucagcagugccaauacugagaugggcuacuguuugccacaaagaauggauccagucauacugagaacauaguugagccuugucaugacagggaacagaugaggaagcaaggucaaauccaacuguaauucuacggcuuguauaagucucauacacaucaaacauaguuugcuacucuccucuccagcuugcaaggcaccaggcaagguaaggcagggauacaggugugaauaaaagauggugugcacccucauggaacuuauagcccaaggauggcuuuucauugaugcaaaguagugaccagcccucuggagagaaugugucuuagaggcucuguaguauggugggaacaugguuaaacccuacguaugcacauuuuaacuuugaugugaugugaagaagaguguggauuuggaaaguguaagaacugucuuugcauguccauuuucuucuaagaggcaaucauaggauuacauacagaauaaauaaaacuauguaaaauaguuguucaaacagcacguagcacauaguucucaauaguauuuuauagugaacgcuacucuucucagggagucuauucuucagaacuuauauuucuuuaucuuuuuuuuccauuuuuuauuagguauuuagcucauuuacauuuccaaugcuauaccaaaagucccccauacccacccacccccacuccccuacccacccacucccccuuuuuggcccuggcguuacccuguacuggggcauauaaaguuugcguguccaaugggccucucuuuccagugauggccgacuaggccaucuuuugauacaaaugcagcuagagucaagagcucugggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacuagagacagcuacaucuggguccuuucgauaaaaucuugcuaguguaugcaauggugucagcguuuggaugcugauuaugggguggaucccuucuuuaucuuuaagaagagaucaaacgauagagccuuugaaaggcaaaaacgguauuugcagaguaccuaggaaauggcaauauauugguguauacuaaaucuucuuguuucagaguuuagucuacagacucuuaaguuuguacacagucaccccaagucuggaccugaaguugcuaggaucccucauacuccccaucaguacagggaagcugagucuccucccaugguuaucucaucagagggcuuuuaagaagaaaauauaugugcuuauaaacagauuugagauuucauauaaaaucuaguuccucuugacucuacuuagagcucuuguccauuugucuauucaaguugcacuuauccagccucuacuguaugcuaggaauuguuguaaaaauuuggcacaacaagcaaaaugccuuauuuggcuaauuuuugaaaacuagaugaguguuuguaaucuauaaucuguaaccugacaucuaccuuggagaagucuaccauauuauuucaguaaauauacuugguauguccccugaagaaagaggugaccaugaggagacucaacagagaagacgaaguauggcgccugugugcaaacauagcauagugaacuuuugugugaaagucacuggagaggaccacaccuucaggucacugggcagaguacaaguggguugcaccacagccuggaaagggcccaggaaagggcuguggaggugaagcuucagcccaggguuauagaaaugcaucucuaacggacaaaaggaaaauguuaagcccaggagagauggccucauauuugcacuucagaaagagagcacucuagacaaaagaucuugauugcugaaaagagacgaaguuaggagucucgaucugagcaggagauagaagugucuaaucaaaacuuagaauggagucagugcauugcuuagacuggggagucaauaguugauugcauguuauugagauugagucagauaaugagaaauugaagaugaucucuuaguaaauucuggaauagaaugagcauccauagucugagaacuaaaacucaaaacguuccaaauuccaaaacauuuccaugucacaaguauaauuucuacccugaccucaagugaugagucuuaacuaaaaugcugguuuacuaaacacacuguauaaaauuaccuucagcccguguguguaagguacauaugaaaccuagguuuuacacugagacuggggucucgucuuugaaauaucucacuacguacaugaaaaugcuccagauugcuaauggguuggcacaggauacauuucuagucccaggaauuccagaugagaagcgcucaaacuuguggagauaggaggaccaauagcagacaagggaauaaaggaaaugcuuuagaugcaugcaagggguggguuucuccuucuccaccguggagaguuuagaaaguaaaaauggccuagaaaugcagacauuagcgcaaaguaagucauuugaauggauuacaucauugagacggaagguaaagagaaaagaaggggucacuggacucugcaccuucucuuacgagucuugcagaauuaaaugaacucugaaagacccauaggagugucucuuuguagggaaaauuauuagauccugauggcuucagaagguggcuuucuaugaagaccaccugguuacuugucuuuaucauagauacagccuuccuuuagaagacauggaaaacacugucuccgaauuaucauucuaagcuuagccaaggguagcuuugaagauucagccauaaggaagugauagggagaauuccacuuuuguguccuugauaccuuuugucuucacuguauagugggaggcuccaguggccccauggaugacugguacacuuagccucuaaccauuaauaccacucauucucucacuuacugggagggcccuguaguccuccuggcugccccuggucucccuuccuggugauagaaauuuccauuauugacagggaaacugcuggcuaauggcacagacgaauuguaaauuuugacaaccccgacagguaaauauuggcuuugcacaaacaaguuucuauaaauaaccugucugcugaagaaacuccacagauggcagcagggcugcccaagcauucauuuuucccaggaugcucggugcaagaaagcacagcugccagcuuugcugcacuugcuggagccaaggcuucacugcugugcugcagcagacugccccugcucaagggacauggcagacagacccaggacaggcagagaucgaucauucuguaaccucccgccagugcucuccauuccucggcuccaaggggcuuucuuaaaaaugucacuucuuugguuuuauagucaaagggaggaguugucugaccuggggauuuauuagccucuuuuaauuaaagucgacccuauugaaaagaaaacgaggagggaugagacauagucauuguggacugugugccauauggcugcauugcuaaaaauagggguuucaagacucugaaaagaaugucaggcuauuguauguggcacaugguggacuccaacccaguggaugcguugggguaugaaacccuucaugucagagucauuccagggggaauauuugcccgguggccaugucaccccaucuggaaagcugaggggagaguggcaagccauuuuaggcaaguuacagaagcauucuucacuucuguguuaagagccgcaaaagggaauaaaguugagugagaugucagugcucugagugagcgugcuaggagacuccuaaucugauggggaguaaauaugcccuccauuauugaggccagucucugacugagauuguauaccuucccuccuccccucccucccucccagucauuuucagcuucugauuauaucuuuggcucuuuggucuaguuuacuuuaucauaagccccuucuggcccuuagaaaguggauagugucugagaaaagugaguuuagagauguccaagauaacaaucauaaccagagaacauccucuaccaaggccauggaaaaucacacaguaucaauagacaccaaacauucagacaacauggguagaaaauugagaacaaaacagugcuugaggacugugugggaaagugcucguggacaguggaguaagaguggugccacgcugagaagagaggaagacaaugcuggacauuggagaguggagcaagggagcauuuccucacgcucugagcucacucagcucccacuccugggcaaugggucucagagggagagagagagggagagggagggagagggagagggagagggagagagagagagagagagagagagagagagagagagaucaaugagaucaauagucaaggagugcauaggcuuaagagcacagcacaacuggagaggaucaugauccugagcaagaaaguacacaaguagauaaagauuaaucugagagagagggagaggaggagggagaaggagagggagagggagggaaagagagggggagaggagagagagagagagagagagagagagagagagagagagagagagagagagagauagauacugggggaauacuugcauauagcuccauguucagaaggacaagcauuagucuauggauaccaugcacacaaggcugugcccuuguguguccugacuauuuuacacagcacuuggcauccagcacauaacagaucaaugugugcagaaaggagguguuuucagugaguucucagggaauauaacguccauauugaagaagcaaccagagaacaucuuuauggauaaaaguagagauuccuauccaacccuagguucaagcaauaugcucagcacacaaaaucaugaaucaacaucaacuaaacaugugguacuagcaggggggcugguaguauggugaaaggaucuagggauuuaaaaucaagccacuuuccugauaaaguuugcacaaugugaacugguggacuuugguuaaguuugacucuuugaauccuucauuuuuuacaauauagacaguaauaauuguauuccccacuuucccagauccaaaccaugcucuaaauggcagagaugcaaacaaggacucagaaccugcagcaccagguucagaucuccacucugauguucacuacagagugauuuguaucuaaugguguuaucuuucugagcgcaacuuuaaaaugaggugagggugguuuguggcuuaguggaagggcauagcccuggauuaaaucccaaacacaaauaaguaaaugcaugaaguggcuguaaguaguaguugguguugugccauucuuugaacagugcgacacauaaguaguucacauaugcuaugucagguggcacugagagcacacugcccacagucauuuccccaccacaugugucuaacucucaagcuuucuuagaagcuucugggucacuuuaaaauguggaacaacauaugcuaucauaucccgaaaggauuauacauggcauuaucuaaugcugcuucccucaaagggaaccuuguacuggcuccucacagagccaagaagaaagcccuugaggccccaggagagagcaaaauggaugauauuagguagaaugguaguucaaguuuguuuuuucuugugguugugaaaauaaauucuuaaauuggagaagaaaaugacugcaugguauucugaaaacaaaaguaccauccaugguuauugaauaggaugugauuugugauugaucuguuugauugaagcuagggcaugucuuaucauucaagaugagaggcaacuauuccaauccuuuguucauucacuuaaaguguuauauauauauauauauauauauauauauauauauauauauauauauauauauauaauuuguguauguguguguagucauuguacauuuaguccuaccuuggguagaaauaagauccuaaauucaaucaaauugguaaaaucaaugaaugacuauugcugauacacgcuguuggcaacaaucuguuuaugaaugaagagcaagauacagacaggaagaaagcaaucugccuugugcuaggacugguaccauagcuaaggcagugacuggaugaagugggaaaggaagacucuaauuuauacaaacaccaauguuacuuugaguuucuuuuguauuuauaaauagaagagaagguauuguugacaaucucagaaccuaacagucgaagugguuacaugauaaugcauacaauggaauaacugucuuagucaccuccugccacuaacauaaaauagccacagucuggauuguuuauacguacuagaaaugaauuucucacaguuccagagguuacagagucugagagcaaggcaacagcaagucuggugucaccuugagaauuacuuuccauuuccaauaugaugccucuugcuacagccucacacaguagagggaugggagggccaguggacuugggcauaccccuuacauucucuuguaaggguaaaaguucccauaguuacagugcgacuaauggcucccuucuuaauucuaucacucuggauauuaaauucucauauugaaauuuggaggaacacaaguaugcaaaguauaguuauaaauuugauaauuuucuuucaucuccuuuguaugcuuagcuucuucuagccacugcagaugugaucgucuuauacagguguccuuggggagugcugucccucacuaucuuuccgaugagucagagcuccuugccuucaauccacauccuguguuguaaguucacccaguggccagcagcuuugccauccugucuccagagacaaagaacacaccguuuugagccuuuccacauuucaauggcugucacuuauaauuacuucauaauucuauuuuaggcuuuguugacaugcuccaauaaaaguguuuguuuccuccaaauagagcugcggggucuuagaaguuacaagcugcuacgcuuugcaauugaggaggagagauuuaccuucuagcuguggcagagagggcagggcugcagacugagucagacucaagggucuuugcagguuuuuuguucagaguccaccagguugugaaccacuguguggacucugacuuaacaaguggauacuuugagagacuuugccuuuaaaaugugaagaaaagaaaagaacagcguuaugcaucuacugaugagaugacuaacuaguccauugguuugugaaguaaauugcacaucaaggcuuacuucuuuucaugcccaacuuguagcuuucaagaaccaaucacgaugauaaccuccucaggcuguugugucccaaggcagcugggcuggagugaacaaggaagcuuugcaagaagaauucaauuccuaccccugcucagcucuguggucuuagacgcauuggcucaccauguugagcucccauugggcuaugugugaaaagggaggcaugaaaccagcuucacagaguuuucuggcggaacaaagaacauuuggggagaguggguaguuucuucugaauggaaaguucaaguaguccaguggaaauuccugcuugaugaaauacccgggaguggucaccaagcggaugccgugggcgaaucugucugauugcugggaauggguuggacuugucuuuacggauugaucagugcuaugccaguuacugaguuagcacuuuccuaggugagcucggaagcgaaucauuuaacagcucuuaaccugccuugcaaggcuacgugcucuuguggugcucccaguuuaagaaguugaauggccuugacugauauaugcugauaugcauagaaagccuccaggacacuguuucucaaaaguuucacuguuuaucauaaagcucuuuccucccccuguucaccucucagaauuucuagauugcuaugcuccagaauggccucugaaaaaugcagguuagaguccagcauaacugcucucaggucuugacaaacuagcauugauccacccaguucaccuuccagucacaaaguuacuccccucaagauagaggaacauaaauauucacaguccuuauguguggccucagagaaacuuggaacuucuccauuccuuaaaagucucacuauagucaauacuauaagcuauaucaaucacuuuucccagauggacugaauguggaacucuuuccuaggccuguuugucuaagguugucucacuagaucuaacgaccaugacucugaacccuuguuaagcuuggguuaauugcuaauuuaggcaguguucuuguuuagaaagucccuccagggagcacagcaucagaacugggagaugguuuucaguuugcucucacuugcccagcugcugaugggguuacgaggaugccaacaacauaugccacuccagauucuucucauuuacagaagcuuaaugguuuccacacuugugauuuggucuauggccaucuuuagaaucaggaagucaagccagccaguauuauugggcacacaucaacucuaacgacagcauaggcagugaagucauucauggccucucuuguuccuggugugcuccuacuuggagaaacagcacggcaaagagugagacaggauuuugaacuguugcuguaaggcauaugccacuguuugcaugccacgggcuagccauuuguuuccccaggcuucaggucccagcagcaguaacagaagaauggaauauagcuacucugucuuucuuggcuguguucuaagaguggagagaccuccccaggcaaagguuuuccugcauucugaauacacaagguguuaccaguuugcacaugauggagcaagguugcugagauguuucaccuaccaucucaucucaacauguccagaaaauggagcccuuauuuugcuugugugagugaaaucaaaccagaaauauaaguuggaauagaggccacuauguggacauuaucagcauaagaaaccaagccugcaggaaaauacuuugugcggcuacuuggccuccagggcuaguuccuggacuuuugucucuggugaguagcugagucuuuggcccagucauaauauggccacggaguucaccaccugcccagggaugacaccauccacacuggggggggggggucuggcucccacaucaccguuaaucauucaucaagaaaauaucccauccacauuugcccacagaugaaucugauggaguuuuuguuugcuugcucauuuuggugguuuuguuguuguuuuauugagguucccucuuuccacaugguuccaguuuggaacuugacaacaaagggauaaaacauagucuuugucuauuuaggaacaucaucuaagcugaaaccaacuacaggagagucucacugucuuagcccaugaaucucauuaguuaaaauauguugacaaaaauucuuauucugcuuuuuguugcuauaacagaaugccuaagacugagcaggaaaggauuugaggucaucccauuucuggaggcugagaagcccaaagcaggugaccauuucuugcauuacuguaaacaugguagaagccagaaggcaaaaauagcaccugagaguacacaaaaccaaaaaguauacucacaaaguaacaaccuauucucuaaguaacuaaccgaugacaaaucaccaacagccaauaacuaauccaggccuuggagugagaacucacgaggaaagaauuaacuccucuaaagcagcuacuccuuaaaguaaccucaccaacuaccaaagucaacuggauuucagcauacgcuguagaggggaauaacaguauacgacacguaaccaugguuguggucucuuuaaauaauuuaguugacugcaaagcauauaagcauauauucaaccauuaaaccauuaaagguuguuuuuuuuaaugugaagccaaaauauguuuugggcuucuuaauuauuguuuauuagucccauaacucugcuuaaaacaccacauguuauuuccaguuucaguaauuuuccuuucuuuuagaaaaugaacucaaaucuuuuagaccaucuccaacaugaucuagauaucacaucucuaauuuucugugguggacccaccaaccacagguuuguuuuguuuucugaagcauguuucucucuugccuuugaaaguaugcuuuuccuuuucacauucauaugccaucguggucuuuaacaugcaaucaaguuacauaauuacaauaacaaguguaacugucagaacggcagcguuugaaaacagagacuccuaagugucacaucacagcuggcagaagcagaagugugacacucccugaagcuuggagugucagccugggcaucaggcagcacaguuuuacagaacgaacugagccuguuucauauuaaagcaagucagcuaaauuaagaaguuuccuacauucaagaaugcagugauaagcaccuguuauuuguguccccccaaauaaacauauuucccagaguuccucagagagcaacaggugugaaucuuaucaacucccuucaucagcaagagcgcacuaugauccggcaggaccuguguuuaucuccuaaaaggauaugggagggugaauguuuuaggcauugugcauagugugcaucggacaggacaucuugggcuuuuagcagccuggcacgaauugcuuuuggcugaggacaccugguagcaguuuuaaaucuuuucuauaaagacacgcaauuucaauugucugcuuggcacuuaguuucauuccacuguuucuggguuggucugggguaguuuucuaagacugcugugacagaguacuggagggagguggcuuaaaaugugucauuucacagacuagaagccaaaagucuaacaucagggagccuugcaaggccuugggccuuugaauccugcaggggaaucuuuccuggccuccuggguauuucuuaugauuuguuaguaaccuuuggcaguccuuaaaugugcuggauccagggaucagaacugcaccucaaaugugacacuauuuguuaaauagucagacacccacagugacuaguacugcucccuggccuuaagacuucgauggaaugaugcuaaaguuuguaaugcccgggcacggguacauucccugaaggauuucgaagcuuaggucagguaaaaaaaaagcccagauaaaggaacuucagugagaaaaagaaaucuccuauuguuugcuucuuucucaguccuaugcuaaauaagugcugccugcaauuuauuguugauuuuuucauuugucaauuauaaacauaugauuuuuuucauuugccaaagcguagcagguguaaucgucuugucauauguuuucauuuauaaguaacagaaaacacacaucuuucacuagaaaccugcauuuuugcuaaguaagcagaagcuaaaaguaggauagacuucagugcuaauguaaucauggguugacuucaguacuagccuaacuuagggccagcagcuagcagugugcuuccccgaguucuucccacaugcagcagauuuauuuccaaacuguuauuaacgguaguaguguaggacauuugcauaccaccucaccucauggauuauagaaggagcaagaacuuccacagaaacacucaguugaccugacccucuugucuccuugggacccucagacaucaaaguuacauaccaucaaaggaaaaggacucaguagaccacuuaggucuacaccuauguggcagauggggguuggggguuggcgucagucuggccccaggacugccuggcagaagaauagaauaaaaauguucuccaaggaaggaagaggaccaguuaccaccagcacuagcccugcauaaacaugaaaucacugagguucggugaaccaggccuaucuuugcaaaagcacagagcucccaaguguuagaucaacucccagacaugggcuuugauuuguucucuucugugcaucacuacuccauccuguacuagguagaauggccaaccaccuccgggggauggggguagggugggaaguaguuucaagguugcagcuuauuagaaaccugaucuucagagcccuugguuguguauuuucuaacaagaucacagugugaaaugcagugucacugagggcugaggaagaauuaugggggugcuccuggcuggaggaucucucacuggaacaggcaugucccauuaaaccauggcgucacuugaucagggcagcagauggauguccaggaaugguggcauggagaaguagagccuccugaccuuguguugggccaugugugucugagaggagacagugcuucaaggcuaggcuucucugaacaagagaccuugcugggugucaagcacuccgacacucccacccaacguggagggaggggcaggcuucaucagcucacaccuaaaacacaguuaggcuuuggcucugagcugaguugaacuccuuuccauuauucaguuaguacugcucuggcccuuggcucucuaaggcuguucuagagucacuagagaaggauuuccuuuuguggguauucuaguccuugucaagaagggaaaggaagaagggaagaaggagaaggagugaggggaaggaaggaaggaaggaaggacggaaggaaggaagggagggaggaaggaagggagggagggagggagggagggagggagggagggagggaggaaagaaagaaggaaggaaagaaggaaggaaggaaggaaggaaggaaggaaggaaggaaggaaagaaagaaagaaagaaagaaagaaagaaagaaagaaagaaguaucuugccuauuauuaacauucaagcuaauuggcucuuuuuuucuuauuuccuaaucaucaaaagcucauauuuucauuuauuucaaucauuucaguuaugugcauccuaaucagaaauaaucccaauuuuaauaccuuuccuaauggccagaaguaaacaucucugagccuccccugacaagacucaaggucccacuugccuugggggccagguauggugccauaugagagcagaagagugaagucaaggguggacaguaucaacuccuguguccguccugaccugcagggccucugaauccaagaugaaguuugugauccucccaaagccgccccucagccacucucauugcugagccucauuagcgugugcucccaaccucaccccagcauagccacguggcucgccuggaaggaagccugccuuuuaggcccuccucggccuugaacucucucgugcuccuugucuuauuugcccaauugcuuuggaaccuuucccuccuguccuggcccacugcagcacucugcauggcuucagggaugaccuaacugagauaaugaggggaugaagacaggacagacacacauacagaaaaguuggguccagcgcccugcucuugcucuuauugagggcaccaacugcagccacaaagcagaaccccagcacguuuauuuucuauguuugaauugaagagguggauuuauuauuguacacgcugaacaaggaagcugauuuagcuaguaucugucagaagucucuguaagacuagucucaggcugcaguuauccugguggaggaggaggaagcugggguugauaguuucuacauacacugccaacauuugcacucagaacugaacucucuugagccucaccagaaagcuuggcuacucccaugggucugaggccuuggggugcuugacauggcugugcucacgucaagcagcacccauccacgcaggaucugccucaucugcucugcacggucuagccuuagacuugugcuuagccuuaaaccucucagcuucaucgcccaaggauucuucccaacgccaacccacccaaagccacuacaauccuguuagcauauccuuuauccgauucauuucaaaccuuuccacuaccaaacccuaucuuuaaaggaaauagagguaacucaggaaguaguguagaucaaaggugagcuguugucauucugauggaagggauaaagaaaggaguccucuccuugguucucugaggaaguccuggcucacaccacccgccucuuucuaacacugugaaaaggcacaggcaugaaaucccacagauacaaccagucaggcuagaacuccuagcuguuccugagcucuguucucugacuccugcuugcucugcugaaaaccccaagucuccagguuuuacuaccuguccagucaguucccacagagccuucuuccccucugccagagacuguucucuuugccuuuuuuccucugguccuagauaucucucuuauuugagcacccuaacccaaaggauuuuucuaccccacuuguaaaguauaauauguaauauguaauagagauucuguagcuuauuaaccuaggaggcuuggcaggagccaccacaccaaaguacuaagagaacagaguagaccuagggccuuugcaaaacuuuaccuagaaaagagcauugacuuucuaggagaaagugaucugacauuccucucugggauagccugggccaaacaugcuuuauugucugcagugauuaauauuaaugagcaauuggacauuacaagucgccauggagacaaaccuuuagauauguguguaagggaauuucuaaagugagcuaacagagguggaagaucucugcuuccuggcugcggcuguaaugucaucauuugucucaagcucccaugguuuuuccuccgcccaccuuuccccacaaacugugugccaaaaguaacucuucuuuccucagguugcuuuugccugguauuuuguuacuuugagaaaaguaacuaacauuaauggaggggugguaucuuugugaaggaucuugccacacuguagaaaguuguaaaacuaaggguccuguugcaagccuguggucccucuucuggggagguagacgcaggugggucaggaguucaagggcaucccgugauacauacuaaaucugaagugauuagcuauaugaaauccuaacucaaaacacaaacaaaaagccccaaaacacacacacacacacacacacacacacacacacacacacacacacacacacaaaaccacaaaacaaacaaaacuaaacaggaauggaggaaaagaaaguccacagaauggugaauugucaaauuuaagucuugaaggugguuacuauacagagcaguuguuccggguucucuuguuuguuuguuuguuuuguuggagucaggguuucucuguguaaccacucuggcuguccuggagcuuucuuuguagaugaggcuggccuagaacucacagagauccaccugccucugccucuugagcgcuagaauuaaagugggcaccaccaccgccccgccuugcuucagacuuauagucucuuguuuaaaguagaagaaccagaaacacagaaguauaccagcaagaaguuuuacuagagacccgacaaguuugggguguacugccaggugagccagcagacaacaggaguggaagggcauucaaaggccccagcucuugucuuuuucugagguccuacagaagagggaacugguggcucucugguugagagguuucaguuacauaaccugucuucuacugcaaaugaccuuccuugggaugcaguugauuuaaucauguacaaccauuuaugcccaggcauaagcuuuuaaugagauucugucuaaaaacucauucaggacauguaugcuaagccaguccugacuugaucagcccaucucccuuggugucgggguguguucuagaauaucuuugaauacauacagaaacagagcuuucacaaggggagguaacuuaaucuuauuguuuaaagcugguauaugugcaggcuuauggauacaggucccagguugccuagaggaugcuaggaguguuguuagggaagugguguguucacugaagucuuaugcuugcuuugcucaugagcaggguuggcauacagucauuccuagccugaagccugaaguccuguagucuccucaagaagcaaucagugaauagcagauauauucuaucgucacauguucugaugcugcuccgaggcagggguuaacugagggaaaggauaccucggcaucuugaucacuaucauccugggucucugggaagagcagggcagaauugauucuuguccuuuugggaugauugagcccugauaggagcagccgccugggaagacuuuucucuucucacugucucagaugcagaagcaggcauuuccuguucgucugcugcaucaacagccuucuguaaacccuuucugugcuagggacugagcaggagcucuugguguuaaaugggaacaccaccaaggguguuucuaagcugacccaagaggcugaagaccuacagcaguccuccccuuagagacaucuaagauaacauguaagaacagagaaggcacuggccaagccuuggcccucaguuccucuucucacacacuucucuccaccugcccucuccagcugacagaaacagcuuugguuugaggugauggcucaguccccaugcucuguacgcaugagugcagauccucaggacgggcauagaaagcuagccuuagccaugugugcauucaacuccagacagagcugaguagggggaaacaggccagucccugaggcuugcuggccagcuuucccagcugaauggaccugacuguaucaaucagcagaggugacaaacaaucuaagaaaggcaucuuacaucgaccucuggccucaaaaccgacauggacacacaugugccuguacuaacaaguauguggaaugcauguagcauguuccacaaagaaacauagccaugcuucacuucucauguuaacuuguuugucugucuaccccugccacuuuaagaggaagcagcaguuaacccuuucuggaaggcuaugaauuacuggcuuuugacuuccugauaauuguguauuucaagagucccaacuaaaggcaaaugcauuuccaccuuaacacagguuugcacuccauccauggagccuugcucccucuugccaguuaucauccaguucuggguuaaguuuaauuuguauccuucuuaagagaagagcagaacagugguggaaagaauaggaaguaagaaaaauguccuacuacuucugcauagucuaggacuaaaucuucccccaucaagcagcucaaagacaaugggaaagcuggguguucacaucgauuccuaccacuuucaaaaaggaaugcagacagaaugagccagacccaauggggcccaugcucucacccgucagacgauucuccacagucugcuaauucccugcacgcucucauuaccaauagucucuuauuuaacacaggaaaacaggcucugacuuuuucauuuuuuuuucuuucuguuugcauuacuggaaaacccugagauugcaaaucugaccugguuggcuugauaaacuugcucauugaaggggaagaauccagucaaguuuguuuuuugaaaauuggugaaguguuucuaaaaacagagcacuaaaaaugaugcgccugccaugcucuggggaaggggguggcucucccugggguuugucaguggugucuucucuguggacucuugaggagcacugccccuggagcacaggcacugucucccagacuugggaaacuuccugauaaaugcagcucagggaaucauaggcguaagugauuuuaauucggccuaagagaaauagaccuucagagguugggaaauuucagcuuuuacuugggggaauugcaccaauccagacuuucuauucuuuucaucuuaaaaagacacccccuuaaauuauuauaauauaugcacaugggauaaaauucaccagauguguaauguggagcaaaauauagcuuuugaauuauuguaacauaggucuguuacugauuuuuuuuuuuuauuaacguaagugccccaagccugaaagagccgccuuagauuuguagacacguggagugugcauugcuauuccccagucaaugguagcuggcccugggcuggacaaucuugagcaguaaguuagcucaguuguacucuauggagaaagagucugcaucugcucagcgauggcuucuucccacaucucauugcugugagaugcucagaucuccucacagcacgguuacuaccuaaugagcaauauaaucucuaaccaugacuccggcccuugugggaaugcauuauuucauuaggccacuuguaucucuuggagcagcaaacuguucauuuucucaauugcucccaaaggaugcacaaggccaaugaaacuccuuacuuacacuuugggcacaacuugaugaccaggaaagcucuggcccaaauccagaagacuaacucgggagcaugccugugaaagccaccauaauugaucugagugucauagacuuuaauaguucauguuucuguacaauguugccagcaauguuuauauuguucuuguauaucaacucuugagaguuaaaaaaaauuaccuguuacuugaacaaucauuguuuaauucauucaacaaauauuuuucuaggagaugaacauucuggaguggcucaugcugagcacgaagcaagagaacaaauauggugcuuuguggauuguuccuugugaugcucagagcacugauguaucguccauuaauaaguagcuauagcuauauauuaucacuuuaauuccaaccuaaagcuucccacucagugucuugauaucuauccaccuacucaggccuaaagaggaagaaggagugucuccaggaguagcuccaagugcuuaaggguuaugguaacaccaaagcuucucuuccuucacacaggaaggggugcaaagcuaagcccuggagguaggacuggccuaguggugugaucagccucagcacacuggaaugaagugaaccuuuaggaguccucacccgagucuggaguuucccaggaagacaguaggaaaguuuuaaugucuccugucucucccgcuccuaagaauccacugcguacuuguguauacauggccuuucacucagucacugacuagagcaaauaauuuguaaauggcagcugccuacagcugccaugcuuaugcuguucucagucaccucuacuccaucugucacaagguucauugugaacauuacugugugugcaugaguuugugcaugcuuugaagcauuugggaaaguuccuuucuccaacccaucugguagagaagggcuuucccugugggacugucugauuuccagggcccucuccaagcauaguccagaggugggaugacuaacugcauuuuaagcaauaguuaauacuuucagucuggacugugaaaggccuggacagaagacugccuggcaggcugcuugguggugacuggucaucacucgguagcaguagaucaacagggccaggcauagauagcaacucucacuguugguggcagaguguugcugccucuggcuuuuuuuuuuuuugucagugcuuucuggauggcuguaagagaagauggcagauuguaccauucuuaucagauguguaccuuuccagcuacccagugccauccucacguugccaauguuacuguaauugccuucugcaccugguggugccuguugacuuaaaaccuuauugauuggguggggaaggacaaaccuugcugugaaagcccugacacugugaagacaaggaaauggggggagauucagggcuuacugugaugcuguucugggguagcagcgaagauuuuuuuaggcagccagcuuccaguuucugggauagugggaauuugaauuuaugaguuccacaguuagcccuauugcuucauuucacuccaagacacucaucacauuaauaagugcccaagcagugaaauuuugagauguuauguuuccucgguuaacuucugugauccacagagacuuacuaacgccuaaggucaaguuuggguuucuaaauaagcagagauuaacuagccugggcuaaauaucgauuaaaugaaagucuagcuuacugguacaguguaagaugagucaccuauuguaugacacuaaauuccaaaaaucucugagucuacuuuuaguucuuaauggcaggucuuggaauuaauuaauuccuuuugguauauaaauggcacuuaagcucugucaguuauccauauguuagcaggaacaaacaucuucaagucugaucccuagagauccuagagaucccuagagauagcacguguguguguguguguguguguguguguguguguguguguguaucucauuucaacccuccugugccccaguauaggguuugaaagcucaguguuagaucuuugucucuuuucuuucuauacacacacacacacauacacacacacacacacacacacacacacacacaugcacacacgaguaagacaaggcaaagaguaaaauaguuugguacuaucuccccaaguaggaggacuugguguggugaaagcaguggagagucccccauccugagcuaccuuauuuaauagaagcuugccuacuagucuaauuuuucucaagagaaggucacuguaguucacucauugacaucaguacgagauuuggccuagaaagacuagaaaaguuuugcuagcaguaacaugaacaagguuccuuacacauuacauuccaugaaacauggucaugcuacuguuaauagguauaauguaucaaaguguucugcggcccagcaccucugacauauauguguuaagcuagaaugcagagcuugguaguuugugagucucuaguacucccgccauggucccuugcucacuaagccuacugggcuccuuuugagagaugacugcaucgugacugaggggcuccaccuucugcucuccugcucgcuuacuuccugcuuugcccucagucuccccucaucugugcugcaggaauuaaggacaggaccuaaguuuugcauuaauugagugaacugagcucuccagcauaugagaagcauugcuacagcacagcagugggugggcugccaguggaggaacccugcuugcuugugguguuugaauccuaagucuguuuaucuuauuacaugaugcuaagcaucuacccaccgcuccuauauaaucuacacugaucauagguaaguacuuguucuuuuuuuuucuuuuccauuuuuuauuagguauuuagcucauuuacauuuccaaugcuauaccaaaagucccccauagccacccacccccaccccccuacccacccacucccccuuuuuggcccugguguuccccuguacuggggcauauaaaguuugcaaguccaaugggccucucuuuccagugauggccaacuaggccaucuuuugauacauaugcagcuagagucaagagcuccaggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguauacaauggugucagcguuuggaugcugauuaugggguggaucccuggauauggcagucucuccauccuuucaucucagcuccaaacuuugucucugugacuccuuccaaggguguuuuguucccacuucuaaggaggggcauagugucuacacuucagucuucauuuuucuugaguuucauguguuuaggaaauuguaucuuaucucuuggguauccuagguuuggggcuaauauccacuuaucaaugaguacauauugugugaguuccuuugugaauguguuaccucacucaggaugaugcccuccagguccauccauuugacuaggaauuucauaaauucauucuuuuuaauagcugaguaguacuccauuguguagauguaccacauuuucuguauccauuccucuguugaggggcaucuggguucuuuccagcuucuggcuauuauaaauagggcugcuaugaacacaguggagcaugugucuuucuuaccaguuggggcaucuucuggauauaugcccaggagagguauugcuggauccuccgguaguacuauguccaauuuucugaggaaucgccagacugauuuccagagugguuguacaagccugcaaucccaccaacaauggaggagcauuccucuuucuccacauccacaccagcaucugcugucaccugaauuuuugaucuuagccauucugacuguugugagguggaaucucaggguuguuuugauuugcauuucccugaugauuaaggauguugaacauuuuuucaggugcuucucugccauucgguauucuucaggugagaauucuuuguucagcucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacagugucuuuugccuugaagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuagcucccuugucgaagaucaagugaccauagguguguggguucauuucuaggucuucaauucuauuccauuggucuacuugucugucucuauaccaguaccaugcaguuuuuaucacaauuguucuguaguaaagcuuuaggucaggcauggugauuccaccagagguucuuuuauccuugagaagaguuuuugcuauccuugguuuuuuguuauuccagaugaauuugcaaauugcuccuucuaauucauugaagaauugaguuggaauuuugauggggauugcauugaaucuguagauugcuuuuggcaagauagucauuuuuacaauguugauccugccaauccaugagcaugggagaucuuuccauuuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguauagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuacguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaaaaguuugugcagaacuggaauuagaucuucuuugaaggucugauagaacucugcacuaagccuguugguccugggcuuuuuuuggcugggagacuauuaauaacugcgucuauuucuuuaggggauaugggacuguuuagaaggucaacuugauccuaauucaacuuugguaccugguaucuguccagaaauuuguccauuucguccagguuuuccaguuuuguugaguauagccuuuuguagaaggaacugaugguguuuuggauuucuucaggaucuguuguuaugucucccuuuucauuucugauuuuguuaauuaggauuuugucccugugcccucuagugagucuagcuaaggguuuaucuaucuuguugauuuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuucuucuuggaggcacucagagcuaugaguuucccucuuagaaaugcuuucauugugucccaaagguuuggguacauuguggcuucauuuucauuaaacucuaaaaagucuuuaauuucuuucuuuauuccuuccuugaccaagguaucauugagaagaguguuguucaauuuccacgugaauguuggcuuuccauuauuuauguuguuauugaagaucagucuuaggccaugguggucugauagaauacgugggacaauuucaauauuuuuguaucuguugaggccuguuuugugaccaauuauauggucaauuuuggagaaggucccuugaggugcugagaagaagguauauccuuuuguuuuaggauaaaauguucuguagauaucugucagguccauuuguuucauaacuucugguaguuucacugugucccuguuuaguuucuguuuccacgaucuguccauugaugaaagugguguguugaagucucccacuauuauugugugaggagcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuguugauaacuuuggguuggaagucgauuuuauccgauauuagaauggcuacuccagccuguuucuucagaccauuugcuuggaaaauuguuucccagccuuucacucugagguagugucugucuuuuucccugagauggguuuccuguaagcagcagaauguuggguccuguuuguguagccagucuguuagucuaugucuuuuuauuggggaauugaguccauuaauauuaagagauauuaaggaaaaguaauuguugcuuccuauuauuuuuguuguuagaguuggcauucuguucuuguggcugucuucuuuucgguuuguugagggauuacuuucuuguuuguucuagggcgugauuucuguccuuguauugcuucucuucuguuauuauacuuugaagggcuggauucguggaaagauauuaugugaauuugguuuugucguggaauacuuugguuucuccaucuaugguaauugagaguuuggccggguauaguagccuggucuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuucuauguucauggacaucucuuucuuuauguuugggaaguuuucuuuaauuauuuuguugaagauauuagcuggcccuuuaaguugaaaaucuucauucucaucaauuccuauuaucuguagguuuggucuucucauuguguccuggauuuccuggaugcuuugaguuaggaucuuuuugcauuuuccauuuucuuugauuguugugccgauguucucuauggaaucuucugcaccugagauucucucuucuauuucuuguauucuguugcugaugcucgcaucuaugguuccagaucucuuuccuaggguuucuaucuccagcguugccucgcuuuggguuuucuuuauugugucuacuucccuuuuuaguucuaguaugguuuuguucauuuccaucaccuguuuggauguguuuuccuguuuuucuuuaaggacuucuaccuguuugguuguguuuucauguuuuucuuuaagggccuguaacucuuuagcagugcucuccuguaauucuuuaagugacuuauggaaguccuucuugauguccucuaucaucaucaugagaaauguuuuuaaaucugggucuagauuuucgguuguguuggggugcccaggacuauguggggugggagugcugcauucugaugaugguguguggucuugauuucuguuaguaggauucuuccguuugccuuucgccaucugguaaucucugaagcuagcuguuauaguugucucuguuaagagcuuguucuucaggugacucuguuagccucuauaagcagaccugggaggguagcucucuccuuaguuucagugggcagaguauucucugcaggcaagcucucuucuugcaggcaagguaucugguguuugaaccggacuccuggcaggaguuguguuccacucaccagaggucuuaggaucccguggggaauccugugugggcccuugcgggugucgggcgccuccgcuggcaagguaccucggggcuugugccccaggucaggcccggguaguccgcuucccuauuuacugcagucucagguuccgcgugauuggauuggggcagaugcuguguuccacucaccagaggucuuaggaucccguggggaauccugugugggcccuugcgggugucaggcgaguccgcuggcaacguacccuggggcucgaguggagcggaaggggcuugugccccaggucaggcccggguaguccgcuucccuauuuaccacagucucagguuccgagcaauuggauuggggcaggggcugugucccacucaccagaggucuuaggaucccguggggaauccugugugggcccuugcgggugucgggcgccuccgcuggcaagguaccucggggcuggaguggagcgcaaggggcuugucguaaguacuuauucuuaaacuuaaaauaaguugugggauuuuauuuuaacuuuaacauauauggaauuaaggcacaauuauuagcaaaacuggcaucacacacuaaauuacaagacuguugcauugugaauuaaaacacaaaucuacauuauagacacaaaaauauuaauuauaaaagucaaauaagaaauuuagcauuuacuugagagcaaugaagggcaggccuuggcuuuuggcaguguguggguagacuggcagcccuagugucaggcauuggagacuggcacaaggauguccuggaguauccagaaagcagcauguagcugccauccuagucuguggaggagaaggggaaagacucagcaauccaaaagcuacaauucugagcaaguucuacauguaagaaugauaaaacuaaucacagugugagugggucaccuucccuguggcucucggcaucaauacagaaggccuagucaacccuagugcuagcccugacacucaguacaaaugcacagcugggcucuugagcaaugggaguccaggaaggccugcuacuuagccuugucucuaggugugaccuugaacaagucacacagacucaguccaguucugcauuucauucguccugaccacaggggcuuguguagaagugggagcagagucugcaucucgagucugggcuucuucucucccuucacuccuuuucuuugggcagcuggaaucucccuuauguaacaugcucaggaaaaggaggacaagaagguaaaaauauuaccacagagcuggguucuggggauggaagaaugaagauggaggacccaaagggaaguagagaggaauggggcaaacauacagagagaugggucacccuggccccugguauucaucuaugcuugaucuuucugcucacugcugggaccacccuaagaccaagaaccuucauggagggucuggaguggagacacauccaucaucauugcucaguguuuaauauuccagaaacugucauuaaaaacauuucacacaccauuguuggaaagaaauuaccagugggugauuugacugagguuaucaccaggcugguucuggaugcuuaaggucuuugugccuuuugcuuuaaaaaaaaaugcuuguuagaaaauucauuuuccagacaaucuuaguaaucaccuucgcaagggucagagggaaagaaaagagacaaagaucagucacugagcuuucaaacccuauacuggggugcaggaggguugaaaucaggaggcgauaaccuugggaccaaaaggaggggcugagaagaugagcuuuccagugcguuucugccauuucaugcugagaagagccuccuuucauaaauuaaggcuuuaucuuuugugcagcagcuagccucggaggcgggggacaggcagagggugguggaucugaggccgagcuauguauagauugcagggcuuugguuucccagacucuggaacccuucaagcacuccgagagucacgaagaaaugaucgcucuguuuguuccuugaaguauaaaaaugguuuuauuuuuagacaugacugugugguuuuucuuuuuuuuuuuuuuuucuuucuuuaaucuacugacagcugucuucagaggcagccaggggaagcagaauucugugaccaggggugggcacaggcaggaacugccuaagaugccaagcugccucacccucagcacccuucacauuugggguuugauccuccuggguuggggagcugccuugagcaucuugugauguggaaugggauuucuuaccucugcccacuagaugcuaguagcaccccagcucaagcuaggaggaccacauggugcugaguguucuccaggacagaauuggcccuaggugaaagcauggcucuaacuucaguucuucagucauugauguucugucuucagcacagugggaaagcauuuuccucuccuuccacccccauccagagaacacgcguaguuugugccgaucugucaggaaauguuugcauuguauuuaccaaauguauucccguuaagugaaacuuggcuaaauauguugcuucagcuggagaaacacauuuuauguuggcuuuguuuguguguguguuccaaggcaggccccguaggccauguucauccuggagacguuacgguucuaguugugggauuuguuguuguuguuguuaauuuauuccuugaugauuuaucuguggauguaguauauccagucauggauacccugccccuccacacaaacucuucuccuauccucccuuccacucccuuuucaauagguccucaguuucaugucuuuuugauucguuuauuuucauuuguuuuguuuuguuuucuuugacugucuauguucugugaccuacuggguuuaacuaggccacuuaagugggcaaggauguuaagacauccauccauauuuggauuccagucugcuguuuuggauacucuccucccuaauguuuggacuccuagaaggagaacagagagacacgaucugcugguagcaggacuuaggucaaagcauggccauauucccugguaacauaaggaugugcugccuaguguggaacccccaggcuucagauaugcaagcccacuccccacugcccuuaaguguaugccaaagaagagugacuauuuucuuaggaaaggcaaacuaagcuaugaaaucaaggccaggauugaaaucuaaauuuagauuuuuggaaguagaaucuggcaggaaucagaaauauuuagaagagcaauauuccucacacacagcuccagggaugacagcaugacuccuuguuuagaguaugccuuccucccugggaugcaaggcucuuggaccugcuucauaugcccaucgcccacuuauccugagcaccugauucuucuccucagagccagggagauacugugggccaucacuuuuaguucccagacauaccaaacucuuucuuuccuuuauuuggagagucccacucuucucacacacccgaaaaauuccuacuuacucuuagccugauucacacaucuuuuugaugcugcuucugggucuagugcugaugcuauccaaggaaauaauggaauugcucuuugcugcucuucuaugaguuucgagucuaggugcaguuuccuagauauucucugcauugaggacuagaguggggcaugaucccagucuuacagaaguaacuuacauuugccauucuagaaaggacuuuuggugauuuucagagaccucuguccaggcccaaccugguauaugaggcucucugcuucugacaccaaccugcagguuguguuugucaugauccuuuauugcgaguuucccaguggcaucuuggaaauacuuucccuaagcuuuagcuguguuuccuccuuuccuucacucuccucuauaaagacauggguggcccacuuucagaaagaauuucacucauugcuaaauuagcaaauucauuaguucuguaaaggcaucuucuauccuauaaauuuuaaucuauucaaauuaauuaauuaaugaaugcaucuuguuacucuuuaaauaaugagcaucucagagauguagagaaauuacaguuuuaucacaaagagcucacaguugcuucauuuaacauuccuucuccacaaaccauguucuaggggauucugcacugggaacugaccaagccauuaagggaguguaagaggagagacaguacuggacaggacauagguagauaacaacaguacuggacaggacauagguagaugacaacaagcaacuuaagggaggauccaugguuaaggugaauuuaccuauaaaauaaagacaauaauucuuuucuuuauuuuauuuuuuccuucucuauaaacucauuuugaagaugauuuccuaauugucagaggcaaaagagccuccuguccaagaauaaaacuaauuauaaugacaaauuguccaaaaugagaaaaauaaucuguaggcugaaauuuuccccaaagcaaugaaauaaauaaaaugucuuuuuaaauaccugguggaggaggcugauaaaagaaauuuaacugucuguugguuuuuuaaaucaauaauaugugaauuuaaaaugaaaaaauauagaaagauauuuaaggauauaauauaaaauaacagaauuucaugagcuuugugaauuugcagguugauggaaaauauauucauaguaagauagcuaaugaaucuuuagauuugcuuugaaaaacagcaucucucacacagcccccuuccccucuguauuaaauugcuucaggugagauggcuggacucauuauuaguuuuguacuuugauuuuuccuaaaauuucccucauucucauaagugaauuagccaaaauaagaagauaacaaauauuuagaauuucgauuuuuggggggaaguuccacaauaaagaaaagaguuguggacccagguaaucaggcaaguugagagaggacuacuacuguaaguguacuuuaccugucacuaugauccauuaugacagaccucaaaaaugcccuggauauaguccauucuaaugggaccuucucugacccaauccuuaaccacaggcuaccaugcuucucaaggagccggcaaguucccagucuugugacacuuccuccauaggucaccuucuuucugcaucuccacauggcagaagcaguugcaagcucucgagggccucuucuauaauagcacuaaccccauucuaauugccuuccaaaaaccccaccucuccacauuacugcauugggauuagauuucaacauauuauuuagcaaggaaagcaacguucaggccauaguagaucucgacacugauggacuuaauaugcucacagaagccugggagauuuauaaaacauagagacacugaaagaagagucaagaaagagggcauucugugagaccaaaguggucagacagcaggaaauuaagugggcaauugagaaaaacauggacaauuccauuauuaccgcucugaaaaauaauuuaguauaaaugcuuuaugccaagauuuuaaacagauaaaacuauagucaucuauugagauucauuaaaaucuguauaaacaugcauauacauauauacacacacauauauguguguguauauauauaugaaucucauuauguacauauauaaauuaauguauucaaugagggaugauaucuucuaacauaacuagaaaccauguucuggcuaaauuuuaaagaccuuauuguuuggcacauuguagcaguucuuuugaauguucagaaaucaucaaaaugagaaacauuaaacccuuugggacuccuacauuagacgugucuccccauugguagugccaggugauggccuacacuggccaguaaucccauaugcaaucaacccaaauaugacucggaaaugaaaaguaacacauuuagcuucauugaguucuuuauuuaacaaccacaaaaauaaacugcagcaggucccagucccaauaggcugaccuuugagugacuuggccaaagagcauauuagccaaggcagaaaaggcaggagcuggguguuacuggccaaucuagaggaauaaaauuuaggucuggcccuugaaguagaaagcucuuaacaucccaaaauagaacauucaggggaagagccaaugcauacauuuuaggacuguugauagccauaggauggaauauuaacacccuaccagaguucccaauagucaagcaucagcuguaacgaugcacagaauuuaaggcauuuugaacauccacgggugaauuaguggcaugggcuuagacuucauggacagaggcuaucuaugaucagacaggcuguucggcaauggguuuuaagauggacuacagcucugaugagagcuguuguugcagaaacauucuuucugcccacagcauccaucagugaguagagaugugaacugcagcuccaugagcacuuagcaucagagcuuccuacagagcucgggcacugucuuuauagcacuacacuauaaacaggagcaauuugguguccaauuuaccagcccucucuuugcuuggcauacgauggacaguguaugguucucacaauccagaaauguugaugccaucauuccacuuuacagaagaaacugagccaucagguggcagagccacccugcaugaccccaguguauacauguucccucuacugcuuccauuugagacaaccugagcuugaauuuuuguucacgagacacuggcugaguaagguaucucaucugucuuucaguaugcaagcacaauggagaucaagacuggugugugcugaaugcuguggggccuguaguuggaggggauaucacuaacuagccaaugccaaagaauacagagugauauccaacaggaugcauuucacacucuguuuuuuccauuuuccaacuaaggugcccuuuugcuuguuggcauauugagcuguuagaaggaaaauugcuaaguuugugcaaguuaccauuauugugaaugguaaguccaaacucaagcauucuguuagccgggguguuggcugacuggaagaauggcgacauguuugcucacugcuguagauuagcucucuuaauaaaggcaaaccagaggaaaauaguucccuucaucucuuaaaguaugucuacuuuguuuggugggagcuagcaauuuuauagaccuaccuacauuauuuucuacgauucaaguacuuugggagagcaaacggugcacccugcuguauacaucaugugcuuugaaauacauuccuuuuugaggaacucaaauuuagcaaaagcuugaaaguuuugaauguaucaauugggagagcauggaauggcugauauccagauguaaaaacccucaggcguagcuaugggucucauacucaugucaucccaaagguauagucuauuuugcccugugcuggcuagguuguagagggacugagccuagcuaucuauagccuugugcacaccugaguguccucugagcaccucauuuucgugaacccauauuuucaucuauaaaaccgagaaaauaaaacucuauccuuuuauuccuaagagguguagggaagcaaaguucaauaggucugauauugccaagaaaugacuuacagaguguggcauuuaaucuucacaggaaaucacaguauuuaaagaacaaacugacucucagguaaagagugagcuacugguucaucuuagcuugucacaaguccacucagccccuccuuuuauuuuguauuguuucccuuucuaaaugaugaggacuaauucuuauguuuuggcaaugguucuguugcuggguagacuuccaacacugccucaugauucauugucugcauacuguagugagaauuuugauuucuuuaaaaaacacagaaaucuuauaagaauacauuuuuguuuuaaucccgggugugggauaugcggcugcuucagauugucuuacagaagcugacuaugauuugccucaugcucuagcaggggcaugauuuugccagcuacagauagcuugugcaaguguagaacauuuggaaucuggggucuuuugagcauguagauaaaugcuggggcccugaggggauguugguggguuguugguugcuugguguugguugcaguuugguaaguagucaugugcaaacaagaaacaacaagaagaaauaagauaucuucacagcaaagaucaaacuugcccccaaggaccucgaugucccuaaucagcaggaaguaguaguuucucaauauaguaauccccuuuccccucuauccuuuuuuucucuccuaucugauguuuggggauggaaagagugggaaaaguggguggagaaggauaaaaagaacacacaacauagcaaaggucugucuacagcauauauuccauuuuaguuuauauuugcugugguugauaaacauucaugcucuacuuagcucacuucugccacaaagaauuccacaaccgacauccucauuugugaccuuugaagaucuauauggaauuacuucuuagauuugcccaggaguuagauccaugggucaugugauauaugcaaauuucauuucagguuggcuuuuauucuggaagccauauaugagaggucccauauccuuaccuuuccaccauuaaaugaaauacgucuuggucauucugauaucugaaaguggcauuuaauuauuuuaguuuccauucuuuugauggcuaguugggacugcaucuuuucacuccuuuuuuaaucuaauguuccuuucugaaaaugaguguuuuguguccuuuaucuacuuuacauucuuaguagucuuaguguaagucccuuguuagcuucaaaugcuacaauaauuaacucucaauuuguaauuaaauaacuuaucaauuacaucuucuuuuugccaaauauacuugcuaugucaagcaggcaagucuggcauucuuauauuuagugguuaguaacucuggaauuaauuuuuuggaaauaguuucuacuccaaauaaggacuuuggaucuuuauuauaaaugaggaaauuauuauuucauccugcucaaucagaaacaugacuuaaaacucaguaauuaacucuucacaacuuagaucaugauauugacaacauuuuaaaagcaaucagguaugggggaggguauaggggacuuucggagaggaaacuaggaaaggagauagcauuugaaauguaaaugaagaaaauuucuaaaaaaaauaaaaaauaaaauaaaauauuuucugagucuuacucaaaguucucucaaaaaauuuucccauagccucucauucaauuccacugaacuuuccucucugccccuaaagucuuacacagugucuuaaauugcacugcaaccaagccaguugaaauuauagcuuuggcuuucauuaagcuaauuacuauuuguacccaaauggagccauuuugcucaaguagcaugaauauccacucucuagaguguuucugcuuuguccaggaaaggccaggaaaguacaaagauaguguaugugugccauaucuccuuagguagaaggcauugggcaguguuucuguaaguucuuagugcucuucaaaguuaugagaggaauuggggaggcugggggaccagccggaggcucacauaagccccucccugaaauuuguccagacaaaugcuaccuuuauuggcuuuguauauuggcagguacuaugcacagucuaugugaggagauguccuacugucccucgggaggauggagaggugggguaggguugagaaguacuguaucagagaacuaagcuacuuaauagaacacccacacacacacacacacacacacacacacacacacacacaucucugccuagugcuuuacuauagaacaguuaaauuuauaaaaaucucacaagacagguuuauuuuaacaguuguggccaaaucggcuuauuauuaaaauuauauaguucagacuccauucuagcagaaugcugaaggcuagccaucaggaccaugguggaagaugauccucuaauuccucugcuugugugaagauacuauaccuaguagugacugcaaaggaaaaugugaaaaaaaacuugaguagcaugggucucaugggaagaagaacacccguuuaucgaccagccguucaagugcagccccgugccaggugccucauuucauugcauccuuagagcuucccagagaaggcuugucagaaugagggaguggagccucaucagacgaaggggagaaauuucaccguguuccacccccuguaccuccagcuucaacaccauugcuauuucaacugcuggaucaugauucugcguaagccuuauauaaacucgucuccugagaacuuuccugaagcgcuugcaguuuaugaaggaaacccuuuguaagcacuuuaggcccucacugggcaucuaucugcuugaugccuucaucccuuccagccacacaguccucaccuccugccucaucaccugucacccacagcuacauccauccuucuuaucucccaggucacuugccaugacucagcuagcagcauccuuucggcuuugauuucuugaguugacaacacaggccagugcuauuuuuuaacuugucucagacaggaagauugggaaauggcccugcagccuucuguuuugcuuugcuguugcugcucggcccccucuuuccauucaugaauucuuuuuguccuucuaguuggcguugucuuuguuuuaacucuucagcuagaucccagcaaggucugaagucauucuuggcucuuccugucuuaaaugaguaagcauauuacaaugcagggcugagaagguuucuuucaccuaugcaaagaugauggucagcauccugagccaaacacagcagccaccuaaacaggaacuggguuggugguaagaaacugcucuauuaaauaaaaucugacuccuuuucacugcuugaacuaaaacugucuuguauuuuaugccaggaggcaguuuacucaaauguuucugaucauucuaaaacaaugcaauacaaaugugcauuccuuuagugccuucuagugucugcagcauuuuauaugcauugucaauuucaccuuacaacucuaggguagauuuuuuuaucauuuguaucccacaaaaccagauucagaugcaaaaaguaaaaauuuuuuaaaagccccacauuuauaaucuaguacugguucugaaaaccaguguguuugggagcuuggacagauucacacaggacaagcacgcgcaaguaagcuguuuugccggugugagcggggcuggauuccugggaugaaugcggaaggguugcacccuccucuguaugaaccgauuucccuccgauccucuccugcagaagaacuucugguccccagcuucaccgaccugcuucucuuugaucccugggagcucccgauggaggaggagcaugcacguucuaguugagagaggauugcagguuuucagguuguuuguagagcucauuauuaauccuugccuaacuaaugguguuuucaagcucugaccagacuuuugagcugccaaguucuaugauuaaaggcugcgaaggauccuugucagcugcuucugauagagagguaucucgcuacagucccaugauucauugccaucacaagcgagccaaugagcagacgacugcacuucucauaagcuggagcaucaggcucauugucggcuuaucuguacguuacucaaagccucuucuuguugcauucuuugcuaauucacaaagugcuccaaaacuuuccuccuggguagggaggguaguacacauguuugggcucuuuuguuuuugguaguuuguaugugcucuguuuuuuaucuaguucauuugacaagacaagucuucuugucaugaagguaacaaugacacccaugcacuuugucucucacuguguucucugcucacaaauugggcaaacucuccaaauuaaauguggucuuguuguuccaacaauacaaacauucugcaauuuucacguguaaguuuugacaccuuucccacaagcccuguuuaaguuuucccaaaauaaaguacacauuuuacucucccgaguacauaucuuauuggcaugccucuccucugaugcagcagcugccuuugaaucaaaggucguccagugcaugcauaggguguuauucuguccuaugaugucuuacuaaguguuuguguauccuagguucccuuagugguuucaggcugaugaaggaaauaaaugauucaauagcagagaaucaaaccuugaguucuaugauguauuuucuauccugucccuuacucaagcacuuuaguccucuuccagagcuguaucucuucuuuguagugugcuaaguguuucagagacaaacuuugaauuugagauacuuccccagcuuaauuaaauauauauaaaaugaacucuaugaagugauaguuguuauaggccauaaauagaacaaaggcaaaaauauucccuaauaauuaugaaccauauacucuauacaggaaauaauuuugcacuuucccucuugucaucaauuuaauucuucacuaguauuugauguagauaccaccucagucuuuacgaagguucagaagcuugaaguugcucaagaccuugucuuaguuaggguuucauugcugugaagagacaccacgaccaaggcaacucauauaaagguaaacauuuaauuggggcuagcuuacaguuucagggguucaaucuauuaucaucauaauggaaacauggcugcagaaagauagacaugauacuggaggagccaagaguucugucuacaucuugauccgaagccugccaggagaagacugucuuccauaggcagcuaggaggaaggucacuuccacacuagguggaacucgagcccaaagcccaccuacacagugacauacauccuucaacaagcccaugccuuuucaacaagaccauaccuccuaauagugccacuucccaugggccaggcauauucaaaccauagacuuuguuuuuaaaagcaugcuguuucuacugcauaucacugacaaggucucaggagagagauaagaaauaaagcaggaaagagugugaccauuuaguuacugucagcaucucacucuccuccuuucacuuccucuuucuuccugcccaucauagauuagcauccuguacaacauccauuagaauuaucccugaacagcucugacuauaagggauguucuaggaauuuccaauuaaaucuauuuggauguggcuccaugaccaucucugcacaacuccugguggcuuucuaagcaugaacauuuccucugaagacauagagaggagagagcucuccuguuacaauucaagaccucucauccuuuuuaccaagcuaguaacaaacucuuugguggcucugcuccuugaagaugauuauuauagcuccaauacaucuauucaguaucaugaaaguucaugguuguacucacagagugacccacauuucaucagucucacaauuuaacacucuaacuaaagccagcaagcuucagcacauuggaaaaugacuaugucuaaaacagcuuggauaucaauauuugucauacauucuuccucgguguaacaucuaaagcaauacucauuuagcugacucgcauucucugggagguguuuacccagcagucaucauucauguuuguucaugagguguuggggugaugagccaagaagcuuguauucucagcugggccuggagccugcuaaguuuggcauugauuaaugaugugcggagagcaagcaguaugcagagccaccuuagaaacccacuuagccaaagacaaauagcugaaaguuggcugagaaguaagggggaguggcuuucacaacagaagggucauucagagacaucaguaugacuucuggcuaucuaacuagagaagggccuagcccgagauugaccguguuugggggucuagauguaugguagauacucaagauaguucucugacaugcuauugauggaugggugcucacugacuaaugacacggcuaucuucuaagauacccaugguaagcugaaaauaucacaggucaaaaguaaauuuaguugagcauagugguauagaccuguaauccuagcuauucaggagaagguguuacuuaagccuagaauuugagggaauccaggacaacauagugaggccccauuuuaaaaacaacaacaguaaaugcacuucauuuauacauauacauacauacauacauacauacauacauauauguuauacaaauaucuuaucuugcuggcauaaugcccuguuuaguaucucacagccccacaauuguuuggcaguguuggcagauucucacuacccaguaucaggacaaggugcuaugccacacaucaugaucuaggaagagaucaaaauuaaggggcagcuucuacuugagauucuuggaaagaucuuaugcuacaaugggaaggcuguuuucauguggucuuguugugcugacagcgccaccugcacuucuuucucauuucauuuuccuacguggcagguugcuuggacauccauuucuuuacuauucucucuuuggucucuuucuaucauuuaaguagagcguaagaaagggauaugaugguuuuuaaauuguagagaaaugccauuguuguuuuaauaaugagcucaaauuaaacacaaaacuuccuaaaaguuauuucacuuuacaggauagauaccuuuucucuuuaccaucauguggauguuugucccuggcagaaacaccucccucuguguuaguguuacauuccagugauagugcuggaccaaaggcuuuaagaauauuuccugaagacaaaaucguuauuguauggagaaaggguuucucacaaaccugguaacaacacucagaucaaaagacauggaaauccaagcucacuuggagaaaauacagaaauauguaaggaugcaccuuaugaucagaaauuccugauaccaggggccucaggccuaggcuucgcugauagucuuuggcuuuuaucauccauccuuacauaucaugcacuuccaccaucauuuucagacugcaucauuccauguagcugcaccaaguguccauacuuugaucucaaccugucuucaaacuccuaguucuuccuaaaugaaaaauaagcaccagccauuuguauccaacacccucagagaaucuuaacaagauucucuuuuuuaaucauugggggagggauuguacugcacuguccaguuuauugugaaucugagacuuagagcaagucagauauuugaccaaggaugcacagauggugagugauugagccaggaaucaaauccaguucuccugacuccauuacaacauuucccuuggacuuuacucugaaaugaucagagcaguggccuuuccgucagcuuagaaguccuauccaccccucuucuuuuuagaaaucuuacccucuuucaugaaccugcucagcucacagaggucuucuggacaucccaccuggauggggcuauuccuuuaacccacagagcacuuggggugaucacugggcaucccugccugcacagcagacaguaagaagccugagaguuauaacuuucagguccauagcauugcuuuuccacuuucuagaauauuguuuugaguaacucacugaauucugucucuccguugcuucagccugucucucaauguuaacaucagccccaaauuccaggauucucaacucauuagagcuacacauacauagauacauaugaugcacauacaucugugaccugugccaagcucacuuccuuuugcccaaugucuaguagacuacucaugcagaagggcaauuaaauagguugagagacccauuuacucuuuaguucuaaaucucacaccccuauuggguaacaauucuggagacuuuuuagaggauacauaaauaacaggguccugagaggugucaggaaaugugggaauuguugguuguggguuuuuagguagucaugcacaaagaagaaauuacauauccugaugguacagaucaaacuugccccaaggagcuucaugccccuaaucauuaggaaguaguuuaaugauaucauuuucccacugcugauccuggacuuuauucaaggauaucuuuccuuuccucucuaucuuuuuuucuuuuuuaucuaguguuaguggguugaaaggguggaagaaaggggguagagaaagaaagaagaacaaaguaacaaaauaacaacgugcaagccacuagauauuaaauuauuuucaguuuuaaaguauauuuuuacuuuaagaaugaaauacguaacgaaguccaacaaaagguauauacuuuucuugaugaugugugggggagugagagggaagaguugccauaaauguggucaagaugcauuauagcauauaugaaauuaccaaagaaaaaauacaaggagucaaaaagaaucuuagaguuaccacgauguuguugaacaucuauuuauuucugaagcuugcucuaguugucacuuugcaugauagguaccuuuauauguagcagaagauggccuaguuggccaucacuggaaagagaggccccuugguauugcaaacuuuauaugccccaguacaggggaacaccagggccaagaagcaggaguggguggguaggggagcaggguggaaggaggguauagggaacuuucgggauagcauuugaaauguauauaaagaaaauaucuaauaaauaaauaauaaacauucuuacagaaaaacccaaccuccuuugauacuauccuuccuucuuuaaaacauaccauguuuaacauggcauggauucucuggugaugugcugauuagcaguaaggacaacuucgggcaaagcagucaggugaacauuugugaacaucaucaaauguacuuacacuagguggcuacagugccauuaggagacucaaguuuccaggacacugucaugggcaugguccuucucaagaaguacauguguaucugagcucucucugcauuauguuccuuuggacauaaucauuucauauguuuguguuuuauauucauuucuuaacuuugccuucauaaccuuguuggauuuuuccugguuuccuuuccuugcccugcucccucccucccucuuccuuccuuccuuccuuccuuccuuccuuccuuccuuccuuccuuccuuccucucuuucuuccuuccuuucuucucuucucuucucuucucuucucuucucuucucuucucuucucuucucuucucuucucuucgucuaagaccucaaaucccagcuguucuggcucucuuuuaaugaagagggcacaagaacaucuucguuauaugaauacauauguauguuuaaaaacuuaacuucauucuuauuauaauucuaaaauauuuccuagaaguuaaauauacuccaguuucccuagcaguauaaaacauuggauuuuuaauguagauagaguuguucuagguaucagaaggucuaucacuggaccuaaugucugcuuauaguuucauucauucaaugguauuccucagccccuccagggugcuugauauggcccauaggucaauucuuaccccaaauauuaugccauuuucagagauauguauaugggcuucaaugaucaagauggcgaugauauagaaauaccauuuaguuauuggacugaacaaccaaaaacccaugagcacauaaaaacacauucaaguucaaguuauaauauguuuuugacuaaucuguaaggaauuucaguugguagacauuggaacuuuugagaauauuugauccaaagguauugcucauugcugugcauuaaaauuaacuaguguuuugccuuugugcaugaaguucaauugauggguagcaauaucuugcuuugcagcauccuggcucagagggaggaaguguuguaguaaguuacugaugcggaccacuggcgggguaaaggagaaugcuggugugcacgucacaccauugccauccaugcuguuccuugcuuuggaugcaaagagagcaucagcaucuagagagcauggcagacccagugaacucuuuggaagccacgggacaguuugcuucagagcugugaguggucuggacgaagaacagaaaaagauacuggggggagggaggcuugcaagggggcgcagagcccuuucaguucugcaugugacuugagacagcaaguggcagcaaguuuugcauagucacuuccaccacuuuaauugucugagcaugguggcuguaauggauggcaggcucuccuuuaaacauaauaaauggcucacaauuacuuuacuuuggagagugcucuucugcccugggacacuauaauaaccugcaaaggaaagaaagggccuagggauuuaugagaugucuccauuucaaccaucugggagaaauacagcacagugccgguguggccaugugcuuacccgaguuaaucuaucaucgcuccugcuaugagcccuuuucucaccuguuuaagacuaucacagggauuugucccuggucuucacaaagacuggccagaaaucauauuuuucauguaccucuagaaauacgguccaguugaccuucaauuuacuggaccgauggggaauuuuucuaguuagaaggaauuuuagaauccaguggugauauuuuuaaaaaagacuaaugagauguagucucuuccuguagaguuuucaaggucuuacuugagagacaaguagugaauaaguauucucugugugcucugagaaaugcgguuggugaaaccuggaguaagacuggagcucugccugaugcggaagcgaggggacugcuuaacucacucugaaugcccuuccgugaauuauaugaagagccugcacccgcagagcgcuuuccgaagucacugggacuuuuuuguguaccaucuucccugcuguuucucugggugaccacuaggucuaguucuuggcccugccagcaucucacccagugaagagcauauauauacugugagugugaaguauuagcugagcagaugcaagauugauuauaguucuaaauuuucuuuuuaaguuucugagaacuucauacaugaguaucauauaugaguauugcaucuacauuacuccccuacagcgucuccugccuugugaucucuugccuuaccucuucagcauuuccuaccaguaggcaccaccacaaccagccaaaucaucuaauaccaauaccaggaagcaaaacuuauuacauaaacuuaaacccaaauguauuuauccuuaggaugaaucagcuggacuugguagucucaugguagucucaauguuccaucugagaauagggcuuuuaccaugucacagucagccuuguguuuucuguauggggagagguaguuagagacggauggugaggacagccagcccucuauaucuauagacaugguauccagauuaggaaucaaaaaucuuuggccauggaggguugucucuaugcugaguguaugcagcuucuuccuugucuuuauucuauaaacaguauguuaggaaagcuacugaacagcacugauguuguguuagguacaguaccucauuugcaagugauuugcaguagaggggaggauauagguaggcguuugcaaacacuaugccauuuuauguaagagauucagaucuucagauuugagaauccacaaguauccucaaaccaaucccucgaagauacugaaggguggcuuuacguacaguugaguguugaccagugugcuccuguacccaccacccaucugucugcacaaggcauccccaggguuggaugccagcucuuuauggaggaugugcugagucagcuauggaggaugugcugagucagcuaugcaauguccucagcucuacagccuugccuggcaccagggcuucuuuauggaaccagacguucuuuucccacuccauuuccucugaguuugagccuaagcagacugcuuuuaaaguuuauuaaaucucccuuccaguggagcagguucuccacuuucauuugucacuauuuaauagugaauucaaaacaggcugagagauuuaaaccggcacagcuuagguuuuaccuucaaaaugagaccagagacacuucauuuacuccuuccuggugucugauugccacaucauaggaggcuguuuuauguguacccgcuauguuccucuucucuuccauucacuccacaagugaauugacaacaagaaauauacagaugaguuaagugaaauuccaacauucagcuguugagaccaaaggaguagcccaguggccacuggcucccucauacaggccuuaaacauggagcauaaaggaggcagcgauggaccucacgcggucugcaagcggcuguagugccugcuggcaggagagcuaugcagaccaugugaggaggagcugagguaaggguggcucagcaggguaaaggugcacccuaagcaagcacgagauccggaaucccccgacaaccauauaaaagguggguguggcagcucauguuaguaacuccgaggcugggagcaggguggagcccugggagugacuggccagcccaccuagcaaagucuugcacucuggcuuccgugagaagccauguuccagcaaauaauguggagaguggcugaggacaacaccuaacaguggccucuggucuccacaugcauacacacguacacacacaaagauacacacacacacacacacacacacacacacacacacacacacacacacacagcgagaagaaaaggcugccuaacuuguguuaauuucccguccuaacuaaagaucucagcaaagucugauucuuccuccucccccauuaccgggcagccauaguucaaugaccacagaccccccccccccccaccaacucgcaguagcucucauucaauagacuuuccagcugggaguguucuguguaaauucaaaaggccuugcagggacuguacuucggccgugcuggcagcgugucuaugagauucgugagcaggaauuagaggaccaaaauguaaugugcuugcuaaaaauaugcuccccuuuuacccccaaccccaauaaggaaaaaauacaagcccccuccccugcccuccuuacacacacuuguaguggcuugccuguccugucaguuuauuuaaagccaugcauuaaaugucauucucuaaugugauuggcacaauuccucuuugccucgggcugauucuaucagacgcuggugaaaauaucuuucucuugcccucugggaccuucaguuugcuaaccagcaaauuuagcccgauugcccauguuaauuuggcucccuguuucaguggggcaacgugguuugucacagugcuacaugccuccugaucauaggaaugcaacucuccagcuuccuccaugaaggagcagaggcggcagggaggagcaugcgcuucccuggccguuguucuucugugaccccagcgcugauugccuuuuacaugacuugccgguugaaagguuuacgauuuuuaccaccuauauaaaugccuuaaaccuuacauuaaaaggacuccccaggaagggcagaacagcuguucacauuacccaccuuagucuucagaacugggcaucucuguauuaucaucugcauggaacgcacugagucagccauuauauaaugaauuaucuugguuauaacgcccaagguccucagagaucucuguucagaugaugacaggaugcuugaagcugucccacuuucucugaagcaaaaaccaguuaguggaggaggaaaacagcaacccccuucuguuauggucucaagguacacuugaaaaaucaccuuugauacucucacagcuguccucccucagcccuaccuggacucugccagucacaaguuugccugcucaggauugauacacaguggauggcugcucugcucuagucauguauuuggggaugcuaacucugacugcugcccaaggaauugugggcuccuuaggaaaauguuugccguccuucuaaaagcauucaugauugaaguuaccagaugccuucaacacaggcucuguggcuacaucagaaagagacagcccaggaaacaggguaugacccuaguaaaggugacaucugaggaaccuguccaaacaggcugggagcagucacuugccuggcuauagcugcuugcucuuggugccugacuguucuuggcaagagcacugauguccucuauauuuuaguggacuggcaggugguagcagcuaaugacucaaguccucagcuggcaucuguaugucacacuaggcaggcaugcugagagcaagagcagccacacuagccuucccuggcgugucaguccucuuaccuaucucauccguccucuuugcucaagcccagauuccucaaccccaaguguaaauuagcauccuggaaggaacccauuuccagaaacccuuccuagaaucaaagucuugauguuugagccagacaaaacucauccuaaacucuguuuuucucugaugguuggaaaccacugacuuugggggcuuucuucuagauucuuucuuuugacguuugaugaaccuucaaaacauaaagaaaacagauguuuuccccaauaacuacuccaugacuggauugcacagguucugaagacagaguaauaagugaaggagacagggagucuacauguggugcaggcaguacugucauaggggauguaggaucaaaucccaggugugcagaaagaggaaggcauaucagcaguguuuucucaggcagaacuaaaaggagaacagguauuaaaaggaagguucaauagcagaaggaaagagagcaggagggaggguaaaagagccaacgugcugacuaucccguguguggagagguuucggaguucacguguggggcccagcaaagaugagaagaugaaagaugccuucgugucuuccuuucuguugccgggacaaaguucaguaacaaaagcaauuuaaggcagaagggcuucuuuaguucacaguucuaggcugcaguccaucauauccagaaaagcacuggcacuuucgggaacuggucacaucgcaucccuaaucagaaagagagagcaaccaucucugcacaccagugcucuguucauguucuccaucuguauauucuguucaggcauuuucugucacucauucuggaagggucauaccaccuuaauuaauauaauaaagauaaucccccaaggacaggcccagagccucaucuccugggugauuuuagccuuccauucaauugacaauuaacgcuaucacaaccagugacauguugacuguccagucugcacaccaaaaguaguacucagucacuauaguuuuuaacaagugacugacuuggcuuuaucauuugaaaggggguggaaauuggaaggagaggcuagaaaggacagacuuaaguucaaagucuacugaucaaagcaggucagauauggggcaacaguucuaggaaaggucagcacauacacuaugaaaugaacggaaggaaagggcaggagaaagagucaacaucccacuagacuucacuuggcagccaugacccuagagcaacauuuccagcucuuugugagcaggugaccaccuaaucccugaugguuccauguuuucugaucauugguucggaauucacgaguggguuugcuuggcagucauaugaguacaggugucuggucccuucagaacaggcuuugucauguggaugaaugagaucucagaacucuagcuggaaauaugcuaauaccauagggaggauucagucuccagaaaacuguuccucuucccagcucaugguccucagcuccuuaacagaaugugccaaguaauuacuauacucugaaguggugcuguacagagaaagaaaggacaagucucuuuguccucauucaacacaggcugguuuuugucgacaaauuaggccuuguugcuccuucagauagacaugguagaggcaggguucucagagcaucaugaggaggaccacacuaaagaaauggagacaaaguaugguuaacgauaccaaagaaaaucauaucguuugugagauggaaaaaagccaucucaggugggggaggggcaguguauucugagagcuuauuuagaacaaggcacccaaugucccucagcaccuuuaccugaguuggaguuuacuaacaugugaggggugagagaauggcugacgcucuggaagguuguaggcauaaagacaaggccucagcagaugggaauaggaacacagagaagcucugugggucuuggaguaggacccaggaacaguuuaaaugaauagaaguuagauugacuuacccaaggccugucugguucaguuuuuaaaacagucuuccaaggagccaagcuuuucucugugagguacaaauguccuaugggaaucccacacuguguuguuugauaagaccuuacagagaacaaacugugugggguaaacuacccaggugcugcagacaucgccugaguaauggaccaaugccaacacaacaacaaaugcauaucguaagagcucaaucccuuuggugucuguggcaguaugggcacccuggguaaaguguuucauuagccauuuacugaugccccugccuuaucaucugcagauuuuucaaaucaauggccgaugauuccaugucuuucaaagaacgguguugaaagugucuuguucuguucuauacaugacaugacgagaauucacaucauuaauuacaaaacuguaggagcuagaauuuauuuugcaaagagcuagagagauguuucacuuacuacuuuaucaucuuaaaacuaacaaacaaaaacaaccuaccgacucuuccauauguugcuuggcauugagaguaacauuagaacuucuuagggccagcaccagaagaaagugagcccggggugggaaagcuaguguuggcccaccagcugcucaucuaugcuucauacacuccauucuuauuccuccuccuggcugcagaugccagucaacccgucuacuuuuagggaaaguuuuaugcuuuuuguuuuuccaaguugaaaggaagauuuaaaggccuuucuucaagguauucuucccaguggggauaguagucuuguaucagcaguuaaugaggcucgagcaucagguuugacuagaaauauguccaugaauuugguaagggauucauuguuuccaagcaaauauucaacugugguauauaaugaaagguaaauuuaaaagugauuuuccuuuuuaaauucaaauuuuauuuuuaugugcaccgguauuuugccugcauguauggguguguaccacuuauauggcuaaugcccacagaguccagagagcauuggguucccuagaacuagggugaaugacagcauguggguucugugaaauaaacccaaguccucuggaaaagcagccguuucucuuaaccacugagccaauucuccaggcuaucuucuuauuaaaguagugccaucaacucuauucaucuucccccuuggcuccuucugucuguuuucuucggacccauaagaugcuauucucucagaguucaccagauauuuguugggagucugauugaaaauagcaagagucccauucauaucaacuuaagaaaguagaauguauauccacuugagaagaagaaaauuuuaagaaaagaaaacugauucagguaccaaaauaucaaaaaguaaaauuagaggaauuucagauugcacaaagcauaaccucugucaguccucuacaauuagugcccggccuuuugccugauucuguuacgcugucuagaugucccaucauccucuguauuaagggguauguuuuuagucuuaaccugagaaagagcaggcuuuggguauaucgcaaguuaaauuggaacagccuggacaagggugcugauggagcaguuaggucacaugaucaccuaugagcccaagcauaaaucucagcagcuaugacguggaaacugccaucucuugggacacuuccuuaaauacaugcauugggaaaaccacccagcucucugaacuuccaguuuuucauuuguaaaacaaaggggauggagugagcuccacacugugucaguuuuguccugauacuguuuacaaugccacuucuuuauuuuaauuauugcaccauucucuugcaugcuccaccauccuaccagaagagcaaauaacacuggaaaaccauuaccucacuggcuucacuccaaggcucccuaaaugggcagcgggcaacccccaauggcaacacaccagaauucagucuugagcacauuuagcuguugauuaugcuucauggcaugaaauauuuagaauuucaaaauuugucaagcaucccaaauugacaauuaugccugaguauaaaaacagaugcaguugaaguucagcuggaaaguguccugucuuguuacacuuggagcauggaaugaagcuuagguagucguuucugauuuaguuguagccccgguucagagcugcuaaugaguggaaguguuguaggcuauuugucugaguauacaccaguggaacccccauuguuccucuaaagaugauaucaaacgucucuugaauacagugucucccaucugucaggagugugucaccauugguucucuccacacuucuguugugaucuugggccuuauuuccaucucauuagaccguuagcccacagaaggcagagucuguaucugcuucauaucucuucaacauaaagucaauauuauagccaucauacuugguccccgagaaugcuucuagauuuauguuaggcaaguuaucaaucuucccucaguuccuuuauguguacaauacuccuauccuguuccucucuauuagagaggggauuaaaugagaugaugccuaacagagugcuggcuuccacgauuuucacaaagcagaugcacauacauaguuuuaucuuauuuuuaaaugucuaaacagcacuagggaagggugggauaagaagugguagaauauuuacaaacuugaaauuaaaucucagcuuaucugcauaccaacugacugugauucuaagcuaauuuauuaauauuuugaagcuucaguucuucauaaaauagaaguuauauguguuugcugauugaaguggguaaagagaaacaaacacacacacacacacacacacacacacacacacacacacacacucacacaguaccugcuagggcaguggguacuugguagcaaacccaaucaaagguaacauuuguaauaaaaguucucauuuguaaugaaggaugaagaauagcuacuggauacccuguggguccucugaccuuuuuuuucuuuauguguuugaugaagaugaauaugcauuaauauaggcaaugguugauggccccauguggaccugucuaggggcauaaauuaccauguccuuauuuucuugaaguuuccagugcgauaugucuguuguaauauaaugauuucucugcuuaguggccgacucaaagagaaagaauauguacccauuuccaaaugcacaauguguaugaagacuuagacccuagugauaugaggaugaggucugagagcuguagguaucucuguauucauuugaguuggugccagccaaaccgcacaguuaauuuuaucacagcaauuuucuccuggaagaaauaauuaauaugcaggcuuuuagcugugguuuggccuuuguugcuuucugacuuuugaguuuguacuguuuauacugcuauaucaguagcugucagauaauauauagagcaaauaggcacucuccccugcccuucacuucagcuuagucuauuuucuuccuugugguucccacaguuuaagaaaaaauagaaguauacauaaugaaaguuuaucuuuucagaaagcacacucaagguuggagcccagaggucacacugugcuccagggagcaaggagcuuaacgugggagucguuucugaacaggaaagguuggccccaggaauguaaugaucuuguuuuccguugacagguaaugcagguggugaaggagcagguuaugagagcgcuuacaaccaagccuaguucccuggaccaguucaaaagcaagcugcaaaaccugagcuacaccgagauccugaaaauccgccagucugagaggaugaaccaggaagauuuccagucucgcccgauuuuguaaguaacccacaucugcucggucucuacuacugcccccuaaugaccgggugauguaacagcagggcuaggugucuuguuuucucacgugaagcuguauuucacacagguacuucuuaaguggcaaaaugucaugcuuuccagagagaggcacaccaaucauuaaagcauugagauucugagguagcauaaguccuagggggagauguggagggaaagggaacaacccucugccuuccccgcagguaggccagcgguuagcaucagagcaucuccuguaggccagcgguuagcaucagagcgucuccugucgccuuuauagcuguaaaucuagaggaucccagggggaaggcagcagagacuuccuuuauuuauagggcuuugcauuaaaugucacuugcaaccauuccaaaacuucauggaucuccuucucugaaguguucugaaucuggaaaauaagagcucuuuuguucaccucaucucuucugagaccuggccuguuuuucuuugcuaagaaccagauuagauucaucaccuuuguauuuuauagaaaaggacagagggguaaaggugggaagcagggaagggacuccacaguuauuucugcucugucacaagaggauuagaagugacuucgucuggacuuuuauauguauuaucuacuuuucucuuucucgcucaguggcaugugucugugucugugugugugucuguguaugugugucuguguguguucuuugcuuauauacacugauauuuuuaauggcugacaauucacaaaacccccuuuacucuagcucauuccucacuucccuugagguaggcacguguuauucccaaagagggagaagcagccuaggcaagaagcuggccuugaaccuguugggcucugagcuccuccuucauccacaccaucagauuggcucugcauguacaagacugagaguaaguuaaggaaauguacagguuagagagcacaguacccaaguggugacauauuucaugcgcuuucaguucuuaagcaccuccagaagcuguacguuagaacuguagacuucagugggcaugaacuucaucagcaggggccagagaaugcuucuaggggacuuggcucaugucauuuuaaacccuaagacauaucgugcauauaauacugguccuuuuaagagacacaacuggguuuuuugguugguuggguugucgugguuugguuugguuugguuuggugggauuuuguuuguuuguuuguuuguuuugauuuuuugguuugguuugguuugguuuuuuuguuccucagccacaagauaguugcagucagaaauaccaagcacagggucacuggaaucaguaacuaggucuugagaaaagcaguugcucacucagaaggaggacagauggugacacaccuuuucaggaccuaccuucacagaaugcuagauuugcagucaucuguccuagccaguaugcaaacacaaggacacuuuauuaugcucugacaauucuuaaaaccuaaauggagaacugaagaguugauuaaaugaaggccaaguggcucuaaauuacuaccacuucagcggagccaagugagucugauucagugcuugaccaugacuguuggagaggaggaugucggcucugcccagagugagcacugcccugcucugccuuccugugcuugcaaagcucugcuccaugugcugucacagaugugacuuugauaccccucuugucuaggagacuggaaagcaccaggucucccuggaauuguugguaaacauaacugcagcacagugauaacgagcugauagaaaaccuuagcguugcaaaaagaagcugagggaccagccuguagcuauagccucugcuagcagcagguaggaaucaggauacaguuugucucugagggggaucuguuugguuuauugcuaugaucugcuagauggggaacuuaucgugggguuggaugaaauguaagucaacuuaaaaugaguuaacaugacucaagauagacaaagucaccccagagaacgaggaggaucgcugugcauguuuaguuucuuucuuucuuuaaucauuuuaacaaaugcauauugggcaaucccuccauggucagcucagcccagggugcugagaagcacuaaggugccucaguauccagacuucacaaguugggggaauggugcgguugaucccagacugcuagguguuauaggaagcacaucuaaauuuccacaaagaucacaggaacugcauccaugucagcucagugcuuaggguaccaaagcugguaagccugucuaguucaagcccuaaguuugcaaacaggggcaucagccaggcuagaacaugggcaccaggccacugcucuucacuggcucucuagcaucuccuccauugcauucuguccugcccuuggcugccugagcaucacacauaacacacuaccaaaccucagcuccaugaaaaccucaucaaccuugccuugauaaaaaauggucauguaucccaagaaggaaaaaaggaaacucuacccaaacaaauguuuggugaagagcuagggcugaagaagcagccuggauuauuuccugguuccugaugaaugauuuccaagaguagcuauguuuuuguuugccacuuaacagagaagauaaaucuauucucauuauugguacaggcuaauaaauauacagagcuuaaacacuccagaaauaggucauguaggacugaguuagaagaagagaggagacgaggacagagcaguaaagcaggcaaguaaaaugugcugaaaccuggagcucagacaccagcucaguucucagugaagccauuggcagcugugucacauugggaaguugcacaguccauucuaagccugccuauucccucuccaagcagugaacaccauccuuuuguuaggcugcuacaaggauucacaugacuauguguauaugaaaaggauuucauauguaugugaaaacugaccagcacaugcuuaguuuaugcuaugcacugagugaaugaucacucuuauuacaaaacacagaacuuagcaaauugucauguuaguaguguacauaaauagaaaaccuaaacccugagugcauuuguauauuugucacaguggcuaaaaauauacaagagaaaugaaucagaaaaaaagaccuagaaguaaggcugauauauacauacacacagacacacauacacacaaaccgcaccuuuccuaaagacuaaaaaccccaaaugguuccagcaaaguccuaaccauuaugguucuagaugccucccuagaaucaccuccuaaagaccagcuaaccagccuagugcuucacucaaagccguuucuaguaggucaguuuauauagguaugcauguuccguguucaaacaucuaacaaauauuuaucaauuauaucaaauauaauuauaaaggugguaaaauaucucuuuaauuguaaugaugacauuugaaugaagauauauauuaggauucaaggagcauacaaauuuguauuggggugaaagaauuacuugugcauguauccugaggucauaagguguauacaacauauacaccuuaugguauuaaauuuuagagggaauaauagauaauauacauguauaauauauguaaaagaauagcaaguuauguugugauagaauggcuauauagauugaaagucuacauggggcaagauaagaagaauaaaauauaauuauaaaggugguaaaauaucucuuuaauuguaaugaugacauuugaaugaagauauauauuaggauucaaggagcauacaaauuuguauuggggugaaagaauuacuugugcauguauccugaggucagagcacaccuagguuuuuagugaaccaugagauaauguagcagaaccugagggagugaguacaauggcgauaggaggugauucuagggaggcaucuagaaccauagugguuaggacuuugcuggaaccauuugggguuuuuaguggacaacaaccauggaguucugcauuggaaacacugugaggagacccauuuaaaggcaagaagggcagugagggagcuguaauaauaauuuaagcaagagaucauaagauuagguuuuacucugcauuaguuauauuuugaagaaaagggaaaugguauuuccuggcagauuuuauguaguuguagaaagagaagaaucaaagaugggcucuaggucugggccuaaaccgccgaagggcagcacucugggauggauaaugagagcaaggcaccaggaguucaucucugaacauuccaggcuauggagcauccgagacaguggucaggcagaugaguuuggaggucagcagauggguguagguuagaaauacaaauuugagggcugucauaauaaaauugguacuuaaacccauggaucuguuuagcuaagaagcagacugggacugggcccugaagcucucuacaacugagacaggaaaagaucaguuucuaggaaacugccauucucacucagcccagugcuucugaagugcccuucuccaucagggguccucgaaucauaguucuugggucaagucuacacacugucacuuucuguacaugaguuugacuaaaauucagccauauucuuucauuuuucuauuaaccuaaaaaccuagaaagccuaaaacauuuacuaucugaugcucuuuagaaauauuuaccaaaccauguucuagaugaccaguaguaucugagcuggguagacagaaagcuaagaguuaaacucagucuagugguguugucugucuuccaaguacugcacuggccuugcugagcuuugauuagaauuguauucuagagaagguucuagacugaacugcugucuaaucuaccugauuuaaucucucucuucuuucauuuauaagucagcguagaacccaucaccccaaacucaaugacaauaagcuaaacauuucagagggggcuauagcccaguguuuucuuauguggcaugccuaagaggucauaucucagucacagaaacacauugguaagagucaucugggcuuugggugaauauauggcuacugagucuauuugcaagaaaaucgaagaaguuaaaaaaauauuuuuaagucuuucuuauuucccuuugcccaguuguuuuagagcuucauuuaagaaagaaaaagagagagagagagagagagagagagagagagagagagagagagagagagaggagggggaggggaggggagggaagggaagaagagaggaaggaaggaagaaaucugacucuuaaaaguucccuugagagauacagauuuaguucuucuuucaguacaucuacuggauaugguaaaggcaugugugaugauaaauauauccaaguuuuauucaaaacgugagacaucauuaaaaucucuuggacuuuccuauuuuucaucucuacauuuuaauaucuuaaccauggccuaucaaagcuauccucaaaauugauguguuccaaacucuuuucuccugugcucucuccauccccagaggauuccuuuucuucuuugcccaguuaccgagacuuagaagacugcagcugugauuuaccaccaugaacagcugccuaugcaguccucaacguccccauuccaugcaggguucauuaaagcugugauuugcuuaguguacuuuauaaaaguugagcacgaauaaucaauaguuauaauugugaucuggaauccugaccagaggcccuccaaggccuguggacagaaagcuucgcaaaugcuccaagcucugucauuaguaaggcacuuccauaccacacaggauuucaagggcauuuuagcucccaaauguguacuaguugucauaaugacuuuucccauggcugugacaaaauauccuggcaaaagcuaguuaaagggacaaagucuuuauguuggcuuaugguugaagguuaguguacaguaugccagagaaguuacagcagugggagcuuugcggaauauaaagaaugcuuguacauggcucacuguuuuuguuuuuguuuuuguuuuuuaauacaguccagggagugauaccacccauaguuagcagcucuucuuaccucaauuaacacaaccaugauaauaucuuacaacuauacccagaaaccuaucuaccaggauuuguuaaguugaaaauuaaguuuaacuaccacauuaguucuucuuauguuacuuuuucaaaaacaaacucuuuacuuauuuuaugcauauaagucuuuugccugcaugcauguguauauaggcauauacaugccugcugcccacaguggccagaagagggcaccagauccccuggaacuggaguuacagacaguugugagccaggugggugcuaggaaccaaaucuguuuuuucuacaaaagcaacaaauguucacagcugcagagccaucucuccuguccugcuugccuuucucuuucauucauauuaucacaagaaagacuggagucuuuacucuguucuacccuuggccuucaugaggaguugccacaucuguaggauagaaaugguaauauuaaauacucauccuccaaauuccuggaagaagugaaauuaaaggagguaaaauuacacaauguacuuccagucucgugaguacucgcugagcacaagugccuaccccacccacaaaucaagaauagguggaagcagauguccugcccagagccagaaagaguacagacucaagaucaaaucugaugaauacaugagccuuggguaccugucauaauggucauuuagaguguuuagcuaagcaaaagggaggugaucaccgagguaugugaucagcacugugucuauuacuguccaguguuuauaaagacagugcuaacacugucuccuuugggagucauagcauuuucucaagaccgauucuagucuuuguucacaguuaagaaacugagacucaaaugagcugugugaaacacuagucauagacauggccuagacuggaccugguuuucugaugucuggauccauguuauaggcaauacuuuuaacacaucucugaggacugagcucugccgcucccuguacagcuuugaucagaauacugcugacuuuacuagccucgaaugccaggaugcucauaaagcuuuguaucauacaaaucccuuaaagguuucggaaaccacugcacucugucauggaagcuuugccguguaguucaucuaaaacuaaauuacauccuauuagccugagacaaguuagaaauaauuuuaauuuaucccaucauuaucucaaucucugugggcuagaaucugggacaguguuaugguucucauuugugagagauugaauggaaagcaaaaagggauccuugcucaagguaccguuagugaugggaucuagcaauugcauggucacccgacauuccuguuuggucagccacaaaauaggaaucuauuucuuggacuuuugccuaaaacgcaucuaugacuuuguaaauaaggacuuucuuagaaggcuuuguucuggggaaaagucacaaaaguggcugguacuuuuguggauagucuguaaaugucagaaacccaauacuguuauuucaacaggaaacucaggccuagauuuuccaaacaccacuuagaaaaaucucuaaaugauucucuaaagcagugcugagaagguccugagguguugaugaaagaaggccgcuuaugcucccugcccaucagcucacagugggcuguuuaucagggugcacuguguaauacaauguguuuauucuccaauagggaacuaaaggagaagauccagccagaaaucuuagagcugauuaaacagcagcgccugaaccgccuuguggaagggaccugcuuuaggaaacucaaugcucgccggagacaagguaugguuuaaggaauuccauauaccagcagggaaaacaguagcuuguuucuugguacucacaagaacauagugucauucaaggacagcauugugcuugauaaaagaaugucaguauagguuaguucuuguuuuauguguagggagaaccaaaauacaaaugaccaaaagauccauggagcuaaagggcuguucuuuggcauuuagucauacaaggcuacuacuagugguggugccaacaacugcuaauacaugcugugauugaacccugugcaaggcuauucucucaauauguuuacacacagccaucaaucaugugucagucaacaggggaccacacauccaaugguggccacuaggaacuuuguaccaccuuaguuuguguauaaauguacuucacaaccgucacaugauggaaucaccugaagaugcauuucuuggaauguaucaccauaauugaauaauacacaauuggauuaaugaaauccaucuucaggauagcccuaugaaguacuuauuauaauugugcacauguguacauaacaaaauggagguccugagaguugaguaacuuguaaaguucugggaaagcaaggaauugcccucuaaagcuacaagcccuuucuucuccuuuuugcuuuuuaaauaucuauuuuauuuauccuuauuauaucugugucuauaucacuuauguguggguaaaguuguaugcaugccaugguacacaaacggaggcuggaggccaacuuuugugagucuuuucuuucacuguaaguucacaaaauuaaacuugugucaauagacuuccacagcgagugcuuuuuacccauugagccagauguuaccagaugaugcugagccacugacaccacauccuucuuuuugugacccccuugcaccaucaggaaauuggccagcaugucugggugcgucuuggcacuugcagcauggaugguucauauucucaaaucucucacacugaugcuguuucaggucagcguuauuuuugagggguauaaguaaggugauuuaagaaucuauuuccagaaucuuccaagacagauuucugaucugucucugauuucugaccucaaaaugucaaaucaaaaaagacagcaguagaccaaacacauuaggugagaagcacccccugacuguuccucugccuugauuguuuccuugcugucucuaugugcuugugaccguacaaagcauuaauaccauacuguccgagaagaaaacaguggggagacaaaacuaagauuugagaagaggugaggaaacugagaaagagccagccauaagcagaagcaucaacaacugugcgaaccaguauuagugaugagcugggagcaacucuggcagguaguucuaaaacccaauagaugcucugcucagacacaaagcucacccacuaaugacaguaaucaauuuguguuugugcccaucuuccugccuguuuacuuuaacugcucugggcugagugcucaguaauugaaauaugucgaugcuaccauugaaaaucacacugaaggacuucaaaagccagccagaacuuccuagaguaagugaggguuauuugaaaaggacgagaagccugaagauuuacacuaagccuaggaaaaggauuggggagauagagaggggggcacagaguaucgaaaggcugaguugaaccugagaaaggcuugcauuauaaaaggaauggagaagagaauucaucuccuaaacuuagcccugaacaaugaggucacucccuucuuucucuugcauuccuuuugcuggucuucauguccaagcacacgauacuccaagaagacauuauacucuagugcuaagcauuggcugcccuuguacaacuauauggacuugagcaguuugcacucaguaucaauaccuguuucccaagacuuuugcaauguagcccuaggagucaagcuaaaaagaaucgcuguucuuguggaagaguguguaaaaccagaacaaaacaaaacaacaacaacaaaacaggucugauagugaaaagacucugucuuggcuuucucagcccuacagcuagccccauuagugucuucaggcaagacaucugaugucugcaaacccuacaaugugggagucuagcagcacucucaucucugagaccuauuagcuaguuagcuguaugcccucaucuccuucuugucucugagcagaucaauauccagaaucuauaggcccaugaguguaacuuaaaacauuuucuucuuguacuugacauugagcaaaagacccagaaguauuuggaaugggaaaagcauauagacacacuaaaagcagucacugaugccaguagaaucccagugcuuggaguuacacugaaccuucagaccaguauccuauuugauauuccuuucuggcugaaauggauagacuaccaaaacuuccuuccacuauaagauaauugcagauuuuuauucuaaagaauauuuauccuucauuguugguuaauuuucuuucuuucuuuuuguuuuuguuuuucgagacaggguuucucuguguagcccugacugaccuggaacucacuuuguagaccaggcuggccucgaacucagaaaucugccugccucugccucccgagugcugggauuaaaggcgugcaccaccacgccagaccagguugauuaaauuucuaaugaauaaagguguuaguaucuagcugaugaauuagcaacaccugggcagagcaauacaagucugauuaucagcuuucugcuugugauacacaggcuuucccauugcuccaucagaacacugcauuuagauuuugcacagccaagucagcugggcuguaaaauugauuuccacuccuucaaguacauacauguucaaggagacuuugucauagauuagaucuguuacucccugcguaggagccauggccacauccuuugucccguccaacuugucuaacagggaggaggacauggaugagcagauucaguaguuaagcucacagggaaaacugaaaguucccugucucacagaacuggaaguggaggaguuugcaaaacaucuuuuccuuagcuacauuuugucagaaugcaguuggaauuugccuaucauccuaucucauccauaacucugauacuuggacaaucugaugcaaacaagucuggucuucuggaauaucuggccauauucauaccugggagacgacagucaugugauacauauuaauguggcuuaagucccagucucugcauuccagucugggcaaucuacuccuugaccgaccuggacucuuuuccucuccugucauauaaagaugauauuacuuccuacacacaguggguagucgcaaggguuaaguaaaaucucuuuaggacuuaauaugaugcaucaagcaaucaaaacuacucagaauuauuguagguugcacauucugggcauauaauuuuuaaacauaggaagcagacugcuauuggauaucuaaggcuugcuuuucucuuugugcugacacaauguaaggcuugccauucuucucuguccauguauuccuagaggggagagcaaugauauacaccuagaaguugucugugguacagccauuauugcuucaugagaguguagucuccaacauuucccucugcuuucuacauuuuagaaauucagguuucucagaaucacuugcauugaauggucuugauaacccuugggcuagauaccagagacucauuucaaaaaaugauaccauaaagcuugcuucucacgaaagaugccugguagcuuccugucuuuaagugccaacaugacugaguuaucucagaauucugcacugaguuaagcuugucuucccacuucagccaccaaggccuuuguaccucacacaccucucauaauuuagucagaaaccuggagccaaauggaccauucaggcgcagcaucuuuaucaacccuuuugggcagcaagcugcuucuuuccucuguuuuaauuacauuucucuuuugguguuucaugaaaccuaaucagcucauuuuaacaaaaaggcagguauaaauaagugugcauuuccaaaugaaggaaaaacaguugaauuuuggaaaaaaucauucaauaggucaaaauaacagguaaccaccauuucggaaagguggaaggguagacagugggguuaaagggacauguccucggauuggaaugagcgugugcucguagccaguucugugaaggaugcaggguguacacaucauguaugcuuuacccaugcaguuaagcuaucacuuugcaagugaagaacagcagucucucaggcuauaauuuugcuaagggcuaaagcugaguaucggaaucagguguauaaucaaggucuacguguuuacuccacuaucuacuaaggccagucaucuuccugagugugugagaguucuggaauccugagcuaggagaggacacaaugccuccaagaggcagaauucagaugcaugacacaagucucugguuuugaaaaacauucagugaaucgagaaguauuuggaagguagaauggacuuaccugccaaccacaggugccauuccccuccaugagccaacagagaaaucugugggucucaucacugggaaagugacauuucucuuuugaggcacaguccagaccuguucugacuuggaaaguuugagucuuaggcaagauguggaccuucugaacacaauggugauuugauagaguuuagggcauccuagcaaaauggaacauccuaauggaaaugcucuaacaacauagguuaggaaaugcuuccccaugucugugacaagagguucucggggcaugcuaccaaauguggcugugcaccuaacucuaguaaguccccugcuuccaaagcagaauuaaacagacucaauucuuaugucuauugaauauccagcacgucacacaccacacguuauuacucaauauucuggucuucuaaagaccaaaaggcauacuuaccugcaucuaagguagaauaaugagggaaauuuuaaaauuuauuuucuuauuggauaaaagaaaugcagauaauuuucauuauuguagaaaguucuguuggacaguguuacaaaacuuucacuucucugcuuuguagcuuuuaguaauccacaugacaucagaaguugcuuuaauuggaccuuuccccagguuucugggcucugcugguuagcauucacugucagcuuggcauagccuagaaacacuuaagaguaaagcuucacuuggagaaucaccuagaucaaaccagccuguggcaugucugugguaucuguggugauuguccugauuacugaugcaagcgagcucagcccacugugggcagcaccauccccaggcagguaggcagucuugggccaucuaaggacacuaacuuaaguaugaaccugugaacaagccaggaagcaguuccuccaugaguucugccuggccgucaacucuccgcaacuacagauugugacuuggaacuguaagccaaguaaagcccuacuacccaaccccagguugcuucuggugagaguuagugcaguagagaaaagaaaugaaaauaagggcuuugaaacccucugauccuuaacauggguagggcacauggagggaggaaggcaagguggggggaggaucaaugacaaagaaaaggaaaaaugggggagggacugaaagacaaaaggaauaagagcaaaagaaaagauugaagcacaaaauugccuccauauuuuuuaguuuggagaaggaaagacaacuguuaauacauucuaguuuguaauugacugcaaggccuccacauuagcucucacauccuccauagaugccaguaaacaaucuuugauaauguucucauugcuucuugcuaauugcuuuuaauggcgagauccacucuuguguugcccaaagggacugaggagcucauagcaucacgcugagucuuaaaaggaaaaugcacauuuuucucacaaaagcaaacuaccaauuaagcugcugcuguugacugacacugaugucucugccacuguguuggugucccugacacugauguguuggugugcugugcuugugggcacaggaagcuucaugcuccucuauggcagcccuagcuuugagacagaauuaaacaaugccaugauggcucucacccuaagggcuacagcuuccaugccaaagaaaaugcuaccuuagcauccucccacuugaucacaaaucaagauguguuuuuugucucuucagcugcugcuucauuguuuuguaauccauccaaaacuucuaaauugcugagaaagagaggaaugcauugcuuccaucagucaugccuagucccuuuugcucuuggccauucuaguaguggacaguaaggggaacuuggauagagaauaagagaagaacuagcuaaagauaggaagaaaaccagggaagggugaugguucuguaacacaagguaauuuaaaccucuucaaggaaaaaguucuguuuaguuacaaagcagauagacaggccagagaugcagguagccucuuguguuucuguaaguaagcuuccaugcaucuuuuugaaguauguggucuuuucuggcaagcgauaauuaagaaugcauuauguaagcaagagaaauucccuccucuuauccuagauugucuuugucccuacuucccaggccuggacacaucauuuauguggucuuucucucuaacugccaccaugaauugacggaacaucuuuguggcagucuucgagugucagucuuuuaugucugucauucauuuaaugauugcuuucuauuccugaagaauucuugacugcaaauauucuuagauaaauaaauuuauccuaggcauaagcagcaauacaaaaauuaauauaguuuacaaacgaauauacauugugaaacuucaugccacauugucuuaaacuagcucaauuucauaauucuuuccaucauaccaagcugaggauaaaugaucccugcaccauauggacuuaauggcuucgcagaguacaacucaaucaugggcuacagccagccugcaaagaagguauuucucuaaagagcagacagauuuuaaucaacagaagagcugagaggaucccagugucacacuucacuggccuccuucccauuacccaucaguaacacacuuagccccaaaaguuccucagagguaacauaccuuacaaaacgucguggucaucauaggccauguagaccaggccauaggccgugaaguguuugugugcagagaggaccaucaugcccugucaucucaggcuccaacaguucugggaugcucagaacacuugauguccucagauuuucacaauuccuauuguaaauucuagcucaguucccccaaaugcauucuucuuguggaaauccaguaauauuacauuuacugacuauaauggcuaugaauuagugagggaauaacuugcuuaacucucuuugaaguccacuccauaaucaccugugauugcugaauauauaaaaugauuuuugagaaguuggcaagcccaaauaaauucaugggcauugcauaauccuccucaauucaugggcauugcauaauccuccuccuccuccucuuccuccuccucuccuucuccuccuccuccuccucuucuuuuuuuauuagauauuuucuucguuuacauuuugaaugcuaucccgaaaauccccuauacccuccccccacccugcuccccuacccacccacuccaacuuccuggcccuggcauuccccuguaacugggucauauaaucuucacaagaccaggggccucuccucccaaugauggccgacuaggccaucuucugcuauauuugcagcuagagacacgaguucugggggguacugguuccugcuccuucucuuccuccucuuccuccacuucuuccuccuccucuccuccucaguguuucauuuaguuuuaguuuucagcagaguucagacuccuuuaaguggcauguucuagauacagucagggauucucaaacaauucuaaaauucucuuauccucuaggaagucaagaaucacagacaauuuccuuuccugggucaaguugggcauuuucauuguugauuauguagccuuuacuuccauuuuuaaagcuuuuuguugauuaagugaaucaugguuaagauaggacuuuuucagugaaacaauuuuauauugaaaaucuucuuuucuuaaaauguaauggacagccagcauuuuugucagaguaguuucagagcaauuuaggacugcggguacaguaaugaggugauuugaccaagaccauagggugaaccaggugcaugaaaguaccaagaggcugguagggcccagaugccgugugccuggugugcuugaacuaaaucuccuuaagucuucauuuuccaguuuagcccagcaccaaccgugcacacauucaguauccaguacuguuccaaagcuuugggaccauagccauuaugagcacaguggccgacguccauacacuguccagggugaugaggacccuggaaucuuuugucugaucagcaacuguuugugguauauccacuagggaaagcugcuugccuuguguguaccagggggcauuaccuuggcuugcuuacuuuggguuucacagcagggaacauuaagauggcuaacauguauauguaaaucaugucagcccauguuuuauuugugcacauaauuucuggagaagcucagaucauaauguuacucaaagaagccuuucugguggaggcaacaucuaauugagccuucauagcuauacaaacacuggagccaugguuuaucuucuugaucuguaaacauauaggucuacaccaguaauauuugccuuuuucucccucccuuuguccugcucauaucuucucaucacccuugagagcugaaggguugaaacugugagaauccagaguaagaauauccuuaaauucuuggccacuuccauucaggcacuauacugaaagguuuaggagggaagcugcuuguguauaucuucauucuuucccuaaauccuaaauuauucaggcaauuucugauggagcccuaccuccaaguauaugaccaauaucuugauacuuuauucacauauuguggauauggacuguuagcaaguguuuguacuaacugcaguaugaccuuguguacggcugucucagcaggcugaagaucaacgcagaagcaucucaaaccccccaaagcuauucuucccucaccucucuccacucugccaagauuuuguggcuaaggacuagcccuguuggugguuacaggcacugauagaaugcccauauaaacuacccucuugaaaaauacuuugccauugagauagaaggguuuggugacauucucguuggucaccaauguaugcagugcaugaugcaaaaauaccaaaaucagaagggagcuucaccauccagcacacuaaaauccaguauuucuuaaguucuaaaacuaugguucucaacaaccuaugguucgcaacccucuuugcaaaccucugucuacaaaaauacuuccacuacaauucauaacauuacaaaauuacacuuacaaaguagcaacaaaaggaauuuucugggugggggucaucacaacaugaggaacucuauuaaagggucacaccauucagacgguugagaaccgcaggucuaaaaucaaaugaaugacuuuucuccucuagguagcacuguuaagaaacgucaugacaauguuuuugaaaaccagaaucauuaaccguuuaaacauguguuuuucuccucagacaaguuuugguauugucggcuuucaccaaaucacaaggucuuacauuauggcgacuuggaagagagcccccaaggagaagugccccacgauucccugcaggacaaaugugaguggcuccuucucuggguuaggacaccuagauuuugguucacuaguuauuucucuucguucuuucuuucuuccuuucuuucucucucucguucucucucuuucucuuucuuucuuucuuucuuucuuucuuucuuucuuucuuucuuucuuuuuguuuuugaguuaggguuucucugcguagcccuguccgccugccuaugccucccaagugcugagauuaaaggcgugugccaccacugccugaccauuaguuauuucuuauucauaguaucccauacagaaaucucuuaacuuaaaugaacacauuugcacuugacucauccuguaacuucaaucugugcauucccaccaagaucacaaccuggaaggauuugaggcucggggaugaguagaacaaaugucagaguggugcuuacauacguuuccuaaagggugaaguaggaguccaagugucuaauuugaauaguguguauguauauagagguauuuuaagggauucauauauaaacuugauuuuaucaauuguauuuccaaguaaucuaaaauaauuucuuauaacuuauaugaagcaaccucuaccacauaugguuuagugugcccuauaaucagaacauagaguuagugaaagauucaaauacuacuuuugagaacucagaaacuuggaaacauaugauaaaugacccaggaagccaguaauccuccaagguauguauuauuucuauuuauuuaccuuuuacaugggcuuugcuuuaacauguguuuuuaaagagacaguagcaugugacccuuuuaaccuaauaccaaagcagguaacaaguuccaagauucagugcuaaguguagagacuaaaagucauuaaagcaacauuuaaaaaugccaggauggugaauuaauuuggaagaaaaaugagacagaaguaauauagucuuagaggacacucuagucagagaaaucaaccagggaccaguugucaagacaugcuuaaauaaccuuuaagaguagcacugauccugcugugcuuagacagccauauccagguagugucuuugaccuccuacugccugcugucucacaucugcccuuccaucaccccagggcccaugaaagucaaaucuggacugccugcuguacagcucaggaccacaggaagcaaaaauaaaccugagugggaaacuuccugacacuuucagacucugugcugacauuucaugcagaaagccuagaacauuuaaucuuccuccaguuuaaaaaugggacagccuggucuucgaagugucauacaguucauuuccaucugcaggaaagcugcuuucccagaaugcauccgugacaccccauagcagaaaauaguaaucugaaacucacaacuaaaggcuaugccuggaaaccauaccacaccauacgacacacccccccgccccccuccacacacacagaguaagaaaggcuuaaucuuaaaauaaaggacaguccuuucugcucauugaguucacuaugugaaaagcacacuccugugucccccuuuuucuccacuuacuguuaacugguaaaagaaaaauuucucaugagcuaggacauguccauagccagugaucuggaaaagcauuagaaguuucugguccccaaacaacuacuacuguuuaggguaucaucucccaggaccuucuucaccuggccaagagauggagaaaguauucugggcaaaagaaucacuacacuccuggcucuacccugaaaaucuguucuucacuuaacugagcauauaauuuauccucacgccuacagauagacaauccacuucucaucuugagcauaggcauguagcuggcacuuugccaguuuuagguguaauacaaucaaugcuuagaaaaugagaagcccuagagaaaguucuagaaguuggcuggcccuauuaacuaauggucaguuguugggauuucccaccaagcaauguccccucaccuccaaagccccaggguagagaaaacuagcagucacuuagguaugcaagaagagcucuggccuggguucucacaggagaacacagcugugauucuccuuucuccacacagguugcauaguagacagggacugauauggguucugggagaagguagcagucuuccuccugaagaugccuccaagaguucccucccuuuccucugcagcguuucaagcccagggaugcagaauuccaaaggccaccucacacuguaucucuugagaaauaaguagaaauuauauaaguguaagaguguguggggugggggagguuguguguuggugagauucuaucuaucuacguaggggucagagcaggggguaugcuuacauuacaaaaugaaguuaaguuguguaccuaagaaggcucugcccugcccuaggaaacuaaguuuacagcuuccagcacacacuugguugcuuucugugccaauucuguauucugccuggacucuuagaagcagaaaagguauuccacuagaaaaaugagugagagaccuugaaauguucaacccuaaaagggaugucuccaucacaucccuucucucagggcucagggaacccugcagaugaugaugugggaagaauaugcgagccacagaggcuagaggacaccaaggaaacaaggcuuucaaaacacaacagggccaaagcaccuaugaacucauggacugaggccguauacacagggcuugcaugggucugcaccagaugggguccuagggcuaaaacuggacacacgcccugucccuaacccaaauucuaucuccaaccaaaaaccacuugcaaaugaaauuuuaguuuuccccaagggggucucacugaaguaacaaacugcucuuaagguacugacugugugccgagcaguaaaaggccaacagaacacaaacucaguggcaucuuugaagguuccuugguugauaaugcuguaucgggacuuuucuuuuccucaacuuuuaaaauguuaucuucccucccuccucccaaccuugguucuuugugugucuauugugccuucugguuuuguauuuuuauacgaucccugaguguguaacaggcugcucucugugaugacaucugucucuugggcucuuuuguuucuguuuguuuuguacuacuccgauguguuuauuuuguuuuauuuuauuuugucucauuuuuauuucuuuggagacuguucuuuucuaauaagagacagaaaggggguagauccagaggagaggggaagaggagaggaacuaggaggaaagaaaaacuguaaucaagauauaacuuuuaaaaaaaaaucuuacuuuucaauuaaaaggggaguuacuauuaauuagugguaagagucaucacguuucuguguauguuuguucucucccaaggccaggaggacuugucuuucacuccuugaguuaaccagggcugcacaguaaaggacugaugaaucacuugguuaccuggaccuuuuuuuacuacuaguccuagugaggaugguccuccauuggcugucuucuucccuaaagcuuugaguuguugcucuucguaugcuuucugguccacaggaacuaggcccuugaaaaaucuacauucccucgcaucuccucucuggucccuccucaggcuuaauaggcugccauccccaucacccuaucacuccagcucauuugcuuuagccgugccuacugcccucuaaggccucuguuugaaagaaucuaggccaguguucuuugcccccacaucagagggacagggaggaaagcacaggcugaugcccccucaaagauuaagccuauuaucgaggaugacgagagcagcugacagccaggcaaagugggggauuugggucaugaaagcacagugaagaauucagcucccuccauccacugagagaauuaaugcagauuaauaguaauaggaauaauggcugaugcuauuugcuaagugcauaagguaugccaggcacagugcucagagcuuauguaaguuaucuacucugcaaccugaaggaaaggcucauccauguuuuauagauaagaaaagugagguagagaagcauuaaguauaacuaguugacagccauggguuaguaaacaguaagaugaagguauuugcaggcagccaaacagcuccauggccaauuguaauucacuauuuuuuuuucugucuggacuaaaaaugauuugagacucugaucuggagcaggcccaacgugcuagaacaagagguuagucaagccccuaaagccuuaguuucugguuccaaagguaagguauggaucaucccugagugcuguggggcugauaugcuagauuaggaaggucgggcucuguccuaacugcuggagcagccugccuccauccuguaucucaucacucacagaagcuucuacugaggauaucugcauauagcagugucuacaaacacuguguucucaaggcucgcagcccuuccugaagauguuuucccuugacuucccccagggaaaaaagcuaaaaguguuugcaucauaguggccacacauuuguuuuuuagaaauauuuugucauuuaaauuauaaguaagguuucuugcaagaugcuaguaaggaucgagucucggccuuuuggcuaagaucaagugaagauacuaguaaggauuccauguccuuagagugaaacccuuauuuguggcugaucucauuaugaugcaggugcuuacaccuuccaaacacaaaggaacagaagccuaguaagggaccaugggacacuaaaaucagaucugucccuggcuagcugugugacauugugcaaggaauucuucaucuugaaccuuaggcuucccaucugcccaacccuucucaaacugagcaaauaugagagaugaagaugugccauggaguaagggugcugcuuccuucccugaugaccuccugcuucucccagcucuaugccucaccauguuaucguucucccauguugaaagaacaaaucacaaagcuagcuuggcuuugaaaucuucaggaacucccuacugugugagugugacccccuuuguuucuaccccuggacuggagaggaaauuguuuucaguucuccccauguuuaaucuuccagugcaucuagagaaaagcuaugaaagaaaggaagaaagauagaaaugagagaacagcuuuucaauacgacgauauuuuuaguaguuuguauuuucuuuuagucuuuaucccaugagcgacacagcaacuuaucucucugauaagggacaauggauauuuaaauauaaaguauguauggccacaauaugaaaagagauuuucuccugugaauccuuugcauuaagacaauccaaagcacuuuugucuucccugucccauucuccaugucuucaaagccaaacaguagcugacuuuuguagagaauggauacuggaguucaugaaacauuucgcaucuuauaacaaaggauuuccuacaauguacuugucauuucaacuccagcggaagcuuuaggaagguuuacgaauuguuuugcuaauuagauuuuaaaauucccuucaaugucucuauugcaaauguaaccaacuuccccaagauuucaguuaugcccugcagacagaucagccacagaggcagcaagacuagcuaguccuugguuaugaacuuggacuuguaagacccgaagucaguguuuaagauaggcucaggauuuuuaacacccaccuacaggauuccuauucaaaggaguuggagagagggccaaaaaggcagcugaggcauaggguugaguugaaccagagcaaacagccccucuucuagugugcacagcaaaagacuuuccacccauuauguugaugaaggacccucccaaucacucagggccacaagcuaaucuccuuuugacauacagacauaagugcaaaaucugaauauaacacaagaagaagaaauggcagauuagaacuucagccccuuagucuagauaaguauuuucucuuacaucuugccuagucacaagaucccagcuaaccauaaacguuucuggggagcauagucuucuuguguccgugaggaggaggaaccagacauugauauugaaauugaaugcaaguacucuggacagaguggacacaaaucaggcuacauggugggggaguagauguugguaaguagaugcuggcgaagccuccugagauuaaagcucauaagaugcgcccuuccaugggcuugagagcucuggguuuguuuuccaaacuacgcugaguuuuaguacuccugggacauuagcucuuacuguugcuucaauauuccauaacuuuauaauuuuguuguuauccacauuccaauuaacuucuucagugaacauguauaagcuuugacuaugaaaucugccauuauguucuccuuuuaaaaaggguaaggaacugguugcuuacaacccucuuuuagcaaacccaggcuaggcagcauaugcagcuggauucacaaucauuguuggacugaacaauuugggauuggagaaggauggauaacauagugguuguuuguuuguuuguuuucauugagauucugugccaugcugcucguccuugucucucuuauuuaauuuuaaagaguguucugaaugcagagccuuuucuguuucuuaucuucucccugcucccgagcaagccguaagauagcaucauucucucuaacugcauuauuuuccaaaggcucaguaagaaaggaagguuuccuuuauuuuauugaguugccuguugaacaaggacaaccaaaccuuacugagcugcuaugacaguucaugguuuuggaaagagagcuauuuggaaagaaagcucggaacuguuuggagucagauuggugaucugagcuagauccacuuacucaguucauccagcccucagacacaaacaacauaggugcaagugcuguagcuagagauaccaauacauaugaagcacuuggcauugcuccuuggacucagaagcccuuacaaugucaguaguagaacuacacauauugcacuguuaccuacuguagcauuuauuauaauaccauugcuuacaacaccacuaucauggguauuauuucaggcuuuagugaaccagauuauauuuauggaaauagcaugcuagagauacauuuuaccaaaacauuauaugcucagguaucuaguuucuagacacugccugacuucucuuccucuugucacaucucugccuuucucuuucugcaguggucucaggcagugccaaccaugguagcaaacucaaugaguacauucucuccuuuauugacauuggugcuuccaguggugucuuaacuuuucauuauuuuuaugaauugcagugccgguggcagauaucaaagcaguggugacgggaaaggacugcccucauaugaaagagaaaggugcccuuaaacaaaacaagguaugguuuucuaaaucacuauaaauaccucugccuauacacugcagugagccagccuucgcguaugcauguauuggaugguuccccgugguauuuuaugucagguugcacaucucagcucuucucuuuucuucuuucccaauccauuccuucccugaguggugcuuuuacucuuucucugucacuuuucuagugccuguucccuccugucacucucugucuacuucuaaccuuagaaaguacaauggcugcccucccucugucucugaaugagccuccuccacuuaucuucauccauucugcaagcuucuucucgccucuuauguaugguaguuccucuccguacaugcucucacugagucucagugaagccugagacaggccgauaccagccucaugagucaaaggauaugagaaaacacuaagcaccugagccaucagagucauagagaguagucuauuaaguauccaaaugagguuuaaaggaggguaauacacaggaguacaugccuaggugccaugaacaaugcagcuuuucuccccauccccuuuuaguuuaccaacaagcuucuaucaugaugguccacaauguuuucugaguaaacaggguggggauacaaucuugaaaaacagaaaauuuucucuguuucuaggucagaggguccauuaaggauccaguucuuugcauauacccaugggcaucuuuuguucuaugcuacaucaacaaaacaguuucacuauguguggugguauacaccugaaacccuagcacaaaagaggaagaagcaagaaaacaaaucauuagccagccuggacuacacagcaaaauccugucucaaaaacaaaacaaaacaaagucuagauuuaccuggcugcucuagaugccaaacgcugcauggaucgaucauuuauuucuuugauucuaaaaacagugucuaaaaggaaugaauaauaaaaaaaucuauccugcuuaucaaucagcguuaucccuguuuucugauuucaaaugaagauaaaaggucacugcauacaacuaugcucaaagaaaacaaaagguacugugaaggcauuguucaagaugucagaaggggaagauaaaggcgaggaugcugaguuacaagauccuugcugcuguguuauguggauagaauucaacucaaguucauguucgcuucuucuuucgagcacuggccuauaagauguuccaaugaccagcauaauacuaugaaguaaugcuagagagacuagggcugggguaaucuguugcguaacaccuguggggguuuccaugucagaaagacaaggauuguauugugcauagacuccaacgagcauucuaaacuauggcaacaagucugagauuucaugguuugccucuuauggugcugacuuccuuccacagcagcagggacugccauauguuucacaugucagguguuccaucugcagccucggagagcacagacucugcucagcuucagaaagguucuugguuagauaacacuugaacugagcaggaagccaugugcagaaauugacaacacaagagucuaacccagagggcugggaaggauggcuggcaguggagcagucugccaggacuugaacaugcugacugggaacucggaauucuguaaaauauguucagagaggcuuccuaccucagcccagcacguggaggucuugagagcugucauucuccuccuuagauuaagaugcugaacaaaguggcagguuuagccagagaccuuggggcaguaaguaaaauggaaaaugaucuaggaagucaccgaaugucaacuuugagccugcagauacaggugcaugaguguacauaccuguacacucaaaacacauacaugugaacccaaacauaugaucauucauucauaccacauacacauaugcaugcaaggaaaaaaauuuucuugcuauaguaacauaaauuaucacucuaaagaccucacuaugucacuccauauuacuaguacauuccaaaguaauuagaggcaugccuccucuuacccuaaaaaggggugagguggggcaggcuacagaaacaagacagccaucaggaucagggaucuaguucucuuuagauuguguaaauucuuugccuauuaccagaacgacagggauagagaacucgucggauuggaaaguaauaacuaugauguaaaauguuuuaggcuacaauagaaaaagucaacauuauacaagaaguguucaaaugaauugguucugacagaauagacaugauaaggccuagaaacuuagaucaaaguagaagcaagagucauaucagagaaagcaaaggggaagauaaaauaaaaauuuuuaagucauccacacgaaagccgugccacguguucacaguagaaagagugcauugcagugggauaaguggauaagugguuaagcggagccaaugggagcugaauuaaggagacaggaaggagcaaucgccacacucauuaaaagggaaggcggaagggaaggggcagaagaaguagaucauguuaucaacaugcucauguugaucuaaacauagcacugaucaucuucacuauaaacaguaaguacauuaagagacaaucuuaaaacugaucuuuauuuaaaaugaucaaaguguauuuacuuaauauacauuguaaaggguuuagccaacuuaauuuaaaaaaagaaaacaaaaauaucaccacagcucgaaaaacaaucuaaaaaagaaaaagaaaagaaaagaaagaaaauuaaaaaaaaaaucaccacaacucaagaaacggagaucuguacauaaauaaagaaaggauagaccaucucaggaguaacuaugaugacacaggagcgaggcuggacagauggggucagugcgcuuagccaugggauguuccagagcucagcagcagaauguguguucaaagggcugugugggguuuuccuagcagguucuugacagagaguaaaugcuccugaccuuauacggggcagaccacuuaaccuuggggauguccacacuggagugcugucagggucuggggaacacuggauagcuguaaagguagcaacuguggaauuguagagaguuuauaucucagaucuucauagcucuauggaugugccuauccauuuggaaaggcugucggauucagaagcacagauauuugucaaucgccagacauucuggggcucaucagcuccugcuccagccucuugcccauagggccccagguggcaccucauuuguagaugcuggaaguggcuggguagcgauucggcaaagcuguuacugagcuguugggcuggcaacaggaacauggagaaggcacagcaacuacaaauugauuuucauuaaauuaaacuauaugaugucuguaagaaaccuaauuccaguguaacuuuaaaguauuggaugggaaaauacaccauacugauucuaaucauaagaaagcugagcuaacucuaucaaccuuauacagaucagaucucagaagagagaaaauuaucaaggagcuauuuuccccaaagacacaauaaccuuaccuuacacacaugcgcacuuaacaagaagcaucaaaauacacgaguccagaaacugacagagcaaaagggaccucagcaaccaauagagaucaagcaaaggccaaucaaauggauugauuggugcuaugaacaacaccaucaaucaacuugauuuaauuggcauuaauugaauauucuagccagcaggacaauacucauucuucuugagcucaccaaaaacaaacaaacaaacaaacauucaccagguuacgcauugagccacuaaacaugcuugauuugguuucaucaugacaaaaauaaaacguuauguuuuuuuuccagaacaauaauauuacaaagcauauucuugggucaccauaaauuuaaaguacaaaccaauagcccccccccaaaaaggaaaccaaaaauguaaauauuuggaaauuuaacaacacacuuuaaccaauaauuuaaagaagucauaagauaaauuuuguaucucaaaaguaaauaaaauucaaaacacaaugugugcuggaugcagugaaagcaucauuuguaaggacauuuacauuaggugcuuagaagagaagcgugcucugaaagcaauagugucccugucauagaguacuauaaaaggcacgaagaauagaaauuaaagauaaugaaacugaaaacaagggaaaacucaaguguaaaaggaaaaggggauuaauucuuuuguggccuggugaaaggauagggaaaggaggagagagaaaccgguguggagacgggaucgugagaacacauuacaaguggguacuuggccuucuucuuucagacugcaugccacgcacuuacaaauucacaaacaaauuagcaaauauuuucuaaggugcugguguuuucauuauuuucaggaugucauuaaaaaaauugaauagauggauggacuauggaaagcugcuguagggugagguacacagauggguggguaggguauacugcuguaaauagauaaacuugucuguaagucgaagcugcuuccuugugcuuaccagguguuccagacacuccugccauuuccagccuaacgcaguguuccaucagccuggcucugucauuugcauauacuugagaauuauuugccuugugauauuauuauccacagaccuuauuuuucaggcagugucaaaagcagaaaggaaagccacaauucuuccuaacccacaacuauuuuuccaguacccaaagacacugucacccccuuugagacuuauggguaagaaaaggcuaucugcaguuucaaggaagaguuagccaaaguaugcccacagcaggaccaccucugccugguguccaaaagccaagguauaguguuagcucuucagacaguuuuugcagcuaugaaacagcuucugagauuuugugcaacagaacucuccaugaacuaaacugcugaacaaggccaucuuagguauuagcauccagaaacaagagacuuuguucauagcgacuuagucuuguagugccagaggauggcaauauaaagagaguugauccuucccuugaggugccuacugcagagcaccugucuguauauuuagucagucagcauugaccuucacagaucugaugaggucuaacaaagaauggugaccagggcagauguggcucaagcucuuggaguuagaauagugguucccauccuuccuauugcugcgaaccuuuaauacaguuucucacguuguggugacccccaacuauagaauuauuuuuguugcuacuucauaacagcaauuuugcuacuucucuguaucauaauguuaauguuuuuggagacagagguuugccaaagggguugagagccacugagcuagagucuaaaacauuuaacagagguuaguacaacaggaagauguuuauggaggcaagaaguaugaggucguuuccaguagaguuuuaugacauuugaauuaucacagggggauaaaaauucaauuuuaaggaaacuagggauuguaaauucacagucuuuaauuuugcaagucuuuggugucuuguggugugcuuuagucuggauucuuggugcuuaucucccuagucauggggcuuguaguuaagcagccaucaaccaugaccaaaacauagacuucaguucuuccgcgcgcccaacuggccaggaagaacgacgcugcaacaggauccuucugcacacguuuauucaguccuguuucuucuuguuuauaucucccccgaacccuggaccucucacucuuuuauacucucaguucccauccacgcacagcaggccacgccaccucaccaggcacgcagcuuaagcuaaucagggcagcaggggcauauccccaucaaaauggauucaccgguauccugguacaccugcgcagcucucaagauguuuguggcuuauaugaggaagucaggugcaagucauaugacuuagcugcagucccuggcgccuuugggacugccgccacacccacuccucacauucaguggaugcuaggcguucaaauaggaauauauuuccuggaagagaaacuacuguguuuucaugcucagaaagaaacauauuguggcuguuaguagcuaucuagggaucacugaggucauucucuggcucagacaaagaaauggacaucuugaaaagacagaaggccauguauggaggacgagaaaguaacugcucuaucccuucaggaugagcauagccuuugggaguccacaaaaugaauggaauuuaaaaggggcugcuggguccccccuuuucccuuauugguccuacuuugauauccacccccaugcaguuuccccuugcaguguuuugugacaagagccaccauuacagggagccugcuuugcuuucccuggcucccuaugucucucugacugcuccacagagcccaguuucugucuugccaggauaaccaagauaagaagcagauucuacuagaccuugauguaugaguuuaaaaguucucauuuuaacuaaauauccugcuauuugauugacuucauucaucuuuaguuaauugaguguauugaacaucgucuuuguugccaggugcuagaaaugcagauuaguaugguccagcccuagcucuggguguccaguggucuaagauuuauguaugaacauagucauauguuaucuaccacauaccuuaaaaaugcaaauaaaaacaaagguaacgaaggcaaaucugagucuagucaggagaaaauggcaguugagcugggcuuuaaaaugacauuccccagguagugagcaggcaagcuuccagguaaagggcacaugaagagacccaggugcacuuccucaugggaaagugucccaugcaugacuagacaggaacaagggaagucacugguuugagaacuguccagcuguuccgauaaacuugagccagaaccuuugugaaaagggcaaucgcuguguuaaacgaguaagagacagcuuuucuucuuuuaacauagaaacucaaguucauagguacguaaauuaauagcuuuggaaucuacuacuaugucuauggucauauuuaacaucuacaccuaugaaacuauuucauguaucucaucaaaacacuuacucuucacgugacuggcuagcuggagaccccacauaguucaaugugcucuggggaaaauggccaauguguuguuacucaaagcaauaugaaaaaugacagccaacacuguauacuaaagauauguuguguaaauauauauuucuauucucauugucaguccaucguuuaccuaugaaaaaaugaauauucaaaugccuccuuaugcugaggcgcugcuucucugaguaucugcgauucugcaugucuucucaccgaucccagagcuacaggacagagugugagauuaggaguucagaggccucagcaggugggggguuguucagcuucucuugucccuucucucuccucaucaaggcucaugcacagccuuccuggacaaggcaaagaaguccuguaccucaguggaacagggcagagaugagcugcuaggagaucuagcuuuucacauaaauccggaaggaacagaagaccuuucacagugagcaacaaagccccgagguauuagauaccugugagugguguguguguguguguguguguuaggaggcucagagggggacacugcccaaaaucagugucagccuguucggcugccaccuggagcccaucuuccuuaugggaguuuggacagguggcaguuucuggagaguucgccugggagguacuguugcuuccagcucugccuccucccuucuuaaaguggugggaagccagucgaccuucagcaaaugacucagugacagcaacccagggaugucaauaaaacccauuaaaaaugauagcacccuuucaugcaggcaugcagcuccgagaaugaguuccucccacccucccaggcagcccugggaagauuagagugggaauugacauucucacaaauuucccauuuccugccuguguuuaucaggaaucuaggucacgacagcucagauccuucauguccugagaaauguaugcccaaagagggcaaagcccaaggucauugugcuucuuccugugugccuucuggcucucugcaaaagagaaaacgucucagcuccaacauccugguugccaguggcuucuguaccaacugaagggcaugcguccuggcugugugcuauucacaccagcuguuggcacaguuguugcacagguuugggcagaaagaccucggugaaaugcaccucuuccugguuauuuuccaaaggaccuccuugaagcuagaguuucaagcaaagcaaagccaccccuccuuuuccuccagucucucaaguaugagucagaguccugccaaugaccgacuaucagaucaauaaagagaaagucauuucuauaagaguucuaauccagaacaauuuuaucagaaacauaccuuaaaaggacauaaugacccauagucggagcauucaauggucauuuucuuuucacaaucucacugccaaucacugucuacaggcugcauuaucacaacuuggaucaauaggcacauuucuucugguuuuucuuuucauuuagcauuagacucuccuucauaauuaucucaccauuugugauuuccuuaauacucaaaggagcaggagagauuuaauuucucauaacguuccuacaaguaauaauauguaacuuugcuugcuuugggaucuuuuuuuaaauacucccaggaguggaauucaugguugcugauauguggggggguuuuauugauuuuuuuuuaaagaugacaucaauuuaugguaccacugcuauaacuaucaucguuucgauuauaaauuuaaaggccuugagauaguguuguggaaacagaugccaaacucaaugcaaaaugugcuugcuugcuugcuugcuuacuugcgugauuguugcauaacuucacugaagccugaauggagggcugagggagaaagugaauaagaaauggagagaggaguuuaugcaggcaagcauccaugacucagcauccuuuccuuccaggguuucuauuucugguggaguaaggggccccuuugagugugagauacaugacugucuagguuuugugcaaagcugcccccuccuagagagaggacaacuggaggugaaccagacagagaaccccaugagagcccaaguaucuugaugguaggcuguguuccgaguggcuccagacaacacacggucuuugggauuuauuuuggaagaauucuuuaauucaucugaacucuucauucugaggcauugugauaugagucacuugccaaaggcaaaugcucucauagauagugaauaggaaaugauccagagaggucuggcuuucuuugcggucagcuucucaaaagugcuacucccagauccuaacagggcagaggcugagaucagaggcaccuaacagaguugaagggacauguguuagagcacacauuaucacagucagaaugcugcuauuaaaacacuugguucuucccuccagaucaagagccaacaggguucugaugugggcuauuggcuauuaccuuccagucaggagccagcgggguucugaugugggcuauuggcuauuaccuuccagucaggagccagugggguucugaugugggcuaucggcuauuaccuuccaggagauccauucugcugacuucuccaaccaguagggugauuaugguuccccaauaugaguacagcacaaacucugagcaguguuuuauggccuauguauuagacauggcccuaggugugucagccaaauuuauccagccacagugcagugaaaguguccuuuagcccuuggcacuguagguccggcucaucgucugcacucaguaaauucacaucaguaauuuaaugucuucugacccugacauccacacuucuccuugguauccuauagccucaguggauaugucuuggauguguauauccuuuguuugguucaaaaauaggguuuacucagaagucuuauuaccucugagguagcgucuauauuuaggaggguccauaccucuauggguuucugucugcuaggaguaacuaaaaaugauuacccuuaacacugcuaauuaaaggcuuuacuaccuuucuaucuucuuggaagggagauacacaguguuggccaugugccaucgagcucuuaaaacccugccccaugaaaaggcagugguaacgcuugugccuguguucguaugaaagugagauggcucgugcaggccugugcugaaugcagaggaggacucacgcuggcacccgggagcacugcaccccucauuccuuuugccagcuucauggcuccuccuguucuccaaacagaagagaggccauguuccauguuugagcucacccaccagcuuuguuuucugugaugguucuuuguucucuccuaggaggugcuugaacuugcuuucuccaucuuauacgacucaaauugccaacugaacuucauugcuccugauaagcaugagguaagaggucuugguaaggguuaauugaugagagaaaaauaaguaaaauucuagcauagaagaaacaucacuucuuguagaaaccugccuuugaaaaucaugaauagaagggugucuuguugacauggaaaccaccagcucaaacuucuuagccgcugaaucagccccaugcguuugcccagcuguccuucuguuaccauaacaaaaagcccgcgguuugcauuugauucgggaauagcaguuuacauuugaccucuacuuucugaggcuugaggcuguggucaguugcuuuagauugggugucaggugcacaugaaggaggaaacugcuugcuucguggcagcaaugaggcagagagaaagacagggccaaugucccaaugucccucuucaggaauuuaccauccaaaguccuaacucuucccacugagcucaccuccugaaauguccagcgucucccaauauuuuuccuuuaacacagcauuugggggauauucaaagucuagacuguagaauggucuuaaagaaaacugacucaggaucagcaaggguuuagccaauccagaggcagaggaggcccuggcucuggcuuugauguguacugaauauuuaauuuuugcucuagacccucuccagauaaacuaaugucucuguucgugggaccaucugaugaaguagcuucuauacgaagucucuuuucgcuauuuuaagaggucuagggcugucucugcuguuggaauuuuauuuccaagaugcuuucauuccguuuugacaucuuguuauauguauaauuuguuccucuucuugaagcacacugucagcuauauuuaaaauauuuagcauaagucuaagaaaaugcacuuguaaaauaaaguagcaguuaccauugauuuaacuuuuucgcuuguaaauuagaccccccccacacaccaugcuugaaacuuuauuuuuagauaauaccauucaaauuuuuguuuugcauguaacugcacaaacagcauuuagaaggacaggaacauuuuaauagaaucugacuuuuguucucaucuccccgaggagauugaguucauuuaaaagguauuuagugucugguuuucucugguuugaagguuuugaauaaaauuauccaucccaaagaaagaggaaagauuagacacaaauccugcauuuagaaugguacuuaaauauaauucugugucacuugacauuuaguuugcagaaggguaagacuuugucuucaucuuucugaaaauagaugccauaucuuccuauuucuguuuuuaaauaaaguuguaguuaugaacaggccaacauauccaagauauagaagagacauagaaaacaaccaaaaauagaaguugggcuguuacuuaagucagugccaagcuauuuuccccagugugugcauuaauuccagauaaggauaaaugcucuacgacugccaagcuuuuuuuuuuuuaacauagcugccacuucuuauagacucuauaugcuuauaagaacuuucaauuccuucaagacacuugcauaucuaguaucacuuuauuuucauaauugcugcaugaaauagaagguucuuuuuacagauaaucucauuuauccaggaaggaaagaggccucccaaaacugaauacgugacaauggaaaggauaauaauagggucugggaguguagcuuggugggcaaagccuuugcuguccaaagguaaggaccugagcugugauaaccagaacucaugcaagagccagguaccauaacuagcaugguuaguaucccagcacaucugcaguguggugagaagagaagaauucccagaaguuuauaggccagcuagccuggcauucacagcaaugaacaacaaagagacccugucuuaaacaaggaccaaggcaaggaccaacgcuuuccacccugugguacacacaugcacauguguuuguguguacaugugcacauacauacuuacacacacacacacacacacacacacaaacacacacacacaggauaaacuacuucagagaccaccuggauucuuuggucuuuaucaguucugucaauggcaacuugaguucucucuggaaaccuuucucacuuccuauucugugaugaagucauugucuuucacucuucugacacuuucuucucucugaccuuaaaggcccuuggaauuacacugggucaccuagauaaucuaaacuaaucucucucuguuauagucaacugacaucagccuuaauuuuuucacacaacuuaaguucuucccuagguccugugagcagauaucuuugaaaggcgaguuuucugucuaccccaagcugcagcaucauuguaguaucucuuucccaagaguuccugguagucagaagucucaccuauuucaagugcagccuuuaaguagccccggugguguuuucuuuuuguugcuuugccucuuuuguaaagguuaguguccacaaaugauugauugcugucuaaacucuggcuccacuagaguuugcaaaaggccuugucucagucauucccauuuuauuuaugagugagaggauguaaagagaaccaggccucaacaacugcuuguguuccuaaaauuagaacacaugauggcgggacaaauacuugauuccuucacaaauuacuaaaauaacaagcauguccuaaagaagauaaagaagguaaguuuggucuuugaauaucauuaugaugucagaauuuaaauauauuugugucuuuauaucuucuugcuguugucuuuacuaguauccagguuacccuauccuaaauaauacaagcaucaccaaguuaucuuaugaauccuggugacauggcccuaugucuuuaaugucuuucuggcuuucuggcuuucuggcuggauaacauaguccagauuccccuuguauguuuccugcuuuuuuuuuuuuuucuaucaagccuacuuacuuuuaauaggaauuuuaguaauuagcaaacagaaccuugguaaaaagauaaaauuaucacaauucagcuauaauuuuauauaaucuucacaaaacagcuaaaagcgagauuuuacuguaaaauauaucgugaauuaguguugagaauuucaacucaaauuuaguaguacacgauuuuuguuuauaggucaauguaauuguugaugaaaaggucgccgccugcuguuucucaaaagcacuauugcuguagguuaaucuguaccaggaagguagccaaggcugggaagucuuuguucaaaggacaauaguccuaggacuuagggaucacugugacaugcgaccagagcugugaaggccuuugggaacacagcacucaguggcacccauaccuggcuguuugucagaacgaacugggaagcuuuuguaaauaaagucuccuaccucugaccaacaaaauccguaaucuccagccaaggacuuagguaucuauuucugucuguuucugugagcagauguggucaaaaugucugagauauucaugagcguacuugugcuucgagaaauguuuuaacagugcauuugaguuuugaugggcuguaggcuuuggcugagaucacacagcugagguagaaagaaauccuuacagauuaaugcugcucuaaucaggcauagcucacaccagugccuuuggcaugcaccguggaagacuuccauagagucacagugguuguugguaucaauugcuucugcugaaaucucccaucacaucgugggacacgcccuagguagccagacaugugguucguaagcucauugggaccuggaauuggagcuugacccagagauuacaggaaaagauggaaucuagagcagauguuagaaggcauuccaaaccagcaagaaacaaaacaguugucagcauggaauccuaaauagggcagcuuaacaggugaauaagcagcauccaauaugcaggccauuuucugagaucuuggcucuuucuccagcugcuaaugguucucuuuugaaguuagagcagaacucuacugucugaagaggaaucugcaaagaacaauguagguuuucugauaaauggcauaugguuccuucucccccaaaguucacagucaacugaacagacaaagacuauuauuuguuuuauaaagaaaacaaaaaugcuuaauaauguaguccaguguguuuuccaaaagaaaugauggggugauguccccaggaauagauuacuagaagcccuggguauuagagaccuggacacaggagguucaggcaggcagucaaccuacaucuuccuaagauaaccaaugauguuagccaauuuaguuaucaaacacugagcagcugaaggcuauuuucucagucuuauuuugcuaagaaagacaaaggccaccuuggcuucaugaugcagcugagcugucaaugucuaugcuuaaauauuagacaugguaagaagguacuagguacuaaacagggaacuguguuaaauaucaaggaagggaauguuuggccugcugcuaagcauagacauuggaauacauucuaccaacaucuuaauuagcaauaugagggaauccaauucuucauguuccauagggaaacacuauugcacauaagagcaugcuucuagagucagguugccugagugcaaaaccuacccacucucauuuuuuccuacaucacuucauccucugugcuuugauuuucuuaacuugaaaaacauaugauaacagaaguuccuguuucuguuaaauagaagguacagagagggugcgaguauuagaugaauaccaaagacuucccagcacaugcuggguacuaagugccuauaauugcuguaccuaugauuaucaucaaugauguucacugccaccuccucucccaccaguacugcaucuggacagaugggcugaaugcacugcuugggaaggacaugaugagugaccugacacgcaaugaccuggacacccugcugagcauggagaucaagcuucgccugcuggaccuggaaaacauccagaucccggaugcaccuccgccuauccccaaggaaccuagcaacuaugacuuugucuaugacuguaacugaacuggcugcacccagacgcauuccucccaaacuggaagaucuagcuaucagcagagagcagagcaaacacauccacaugcugcaacugcccuuggguggaggggaagcugcagcuuccuuuggccucauuuuuaacccuagcgccaccccccccccccaucuucucuggcaucucaccuucuacuucaaucuauuuccugacgcaguguuuuagauccucuaccauugcuacagcucagcgaugggucaugagcaaaagucaccacuaguaacagucgaagaguccucucauuauauccagcuaugggcauuuccuuccuuccuuccuuccuuccuuccuuccuuccuuccuuccuuccuuccuuccuuccuucauucuugccuggaguaggaaagccaguuagccccaagcugccccauauuugcucaccaaaccaagagaaauuccuaaggccaggguuggauaaaauagcucugcuacuggauuagaagaccaaaggccuccuaccccuucucucuagggucaccucacaccaucagcucuaugugaguugagauugcuuucacauugccucucucucccuuuccugccuuggccuugcucugguccacuuuggucucacuuguagcagcagcauccucauuguaguugucuacagcaucaggucucccaaacuguccacagaguccaugccuguuccuugucugcacugugaccaugaccaaucccucuaucacacugucuagucuugggcuuccucucuuugccccagcccaggccugccuucuucauuucuucgagcucccagcccuuagcagaaagcacaaaugaagucaguaguccugcuccaucucugauaaacuaaaccuaaccgccccuaaggcggcuguugcuaucuaacaguuccgugugaccuucucucuggggcuccugcuacagcccagguuuuccaggguggucaagcugucagacauccaaguuuacaucguuguaauuauuauaggucuuuaaauuuuacaaggguuugggguuauuuuguuuuguuuuguuggcuuuguuuuuguauaaaagagucuaacauuuuuugccaaacagauauauauuuaaugaagagauacauaaauguguguacuuuccagcuuuuuuuuaauuauuuuaaucccaaacaucuuccugagaguaacacucccuuaaacaugcuguggaauaaaauuaaaugugaagaguuggggagcugguguuuugauuuaguaaugugggcgcuugcuacuccagcauauccaucaccugggaauuuguuagagaugcaaagcagacagccccuccagacuucugaaccacgauguuugaguagguguucauuugggaagcacugaucgugagcucuaaagcauugccgauaucauuucuaggaugcacaccccaacucaccaaggaaaugagacucacuguacaaaaauaugaucuauuccuuuuauauugcugcuuccucggcauacuuucccauuauugucuccuuaccauuucaugacuuauagagccaguccaauuaaagacacuacugacaccaaggggacauguugaaccacggaaaaagaauacaaaccuacacaccugaaaucaguuacgccaaagccaaucuuacugugaauuaauaaguucccaacagagcacaacagagauuucuucuuaagucagcuccccuacaaaugucauauggaucguaagcucuaagggcugggagggaugacagaaccccaugcagugcagcuaagccacucugaacuggcagccaagaucuagauacaugcaggugacugcucuuuguggcugucaagauggucaauuacagguuggccugggcuccagugacaugguccagagcacuccauaaauugcaaaauccauagucauucacaggggucauucuuuccacuagagugcccacaucggaguguuaggcugacauuuccuccauccuuaagcuuggaucuuauuaacaugcaugcccuuccugauggagucaucuacuguucuaccugcugugugauaaguuagauaaaaggaaguggauagaggcagagcacuuuucacuucaaaguuuaagagaugcaccuccuggggccuggaugggaagaauucaucuccugguauuccuacuuuggcccauaaauuagaaauuuguggggacauuuuuuuucuuuuucauguauauauauaauacuugugcacaagugugggacagcauaguguuuugguccauguuacacuggguagugagaaagucucucuauugccaugaccauuuaucauaucuauauagugaauacacuggaaauccccucuucuagugaucucgagauauacaaucuugugaacuguauccacacacuccugcacuguaggaccccagaauguagcccuccuaacuaucauuguacccacuguauaccccaugugcucucuccagccuccaguauugacuccuuauucagcuacaggauuccaugguggguguucugcuuacuguccuugagaauauuucauuuaauaaugucuuccagucccacccgagguguugaaagugacuguauuuuaucuuuuuauggcuccauaauaguccauuguguacccacaccaccauuuauuuuuucacucaccuguugcuaggcacugaaguagaucccacauccccagguuuugugaauacugcugcaguaaauaugaguacagguuccuccuggugagcuuuuguauggaagacacaccuuuucauagacugacagcgucuuaaggacacgcucucauuguucugcauuucuuuuauuuuguggcaagguggggaaggaugguugcccauauucaacaucucaccuauuucccaaggcugcuuaagacauuucccacacacauugagacccgugccucaaguuggauacuucuggcgucaacuguccaagccccauguagugcaaacaagaauccuguuuaucaugaaguccaaguucuguucuccaaucuggcuuuaucugaaauaaaaaauuguaucugaau

SEQ ID NO: 6916 - RNA, 28205 nt, Mus musculus
cucaggagagcugucaaggugcaaugugucccagacccagagaaaagagaggaaaggcucaaaaaacagugucccugauaaccuggaaccuucuuaagccaugaguagcagggcacaagcagagggauggauaauagccuugaaaugugacuuacauauucaauguagacuaccuugcauaacuuuauaaauaugugaugacgaaagaaguugucacuuuagaauuguguuugggagguucagcagaggcaguuaaccaaugaauacauauacggaggaaaagcacuacauacagagcaucaaugaugagcuuuggaguuauuucuuccuagguuuucauccuggaaguacaaugugugauccauguagaguggucuaaaugagaauggcccacauaaacucauauaugugacugcuuaguccucaguugauagaauuauucuggaagaauuaggagguguggccuuuuuguaggagguguguuacuggauuugagauuucacaagccugcuauccguaauuccuuuugcagaucaggguguaaacucucaaugacuucuccaacacccugccugccugccugcccgccugccugccugccugcucccaugcuccccaccaguggucauagacuuacucacugaaacuauaagcccccauucaacucuuucaucuauaaguuaucuugauuaugguguguuuucauagcaauagaaacguaaugaagaugccaugcaccuugaaaaguugucucguuuuucugaaucucguuucuuaucuuucaaacaagaaaaaaauggaaaagaaaaaaaaaaccaaaaaccuaauacaccucucaucugcuuguacauuacugauaauaacagacaaaaccucuguccagugcauggcccacagugguggaauugcuaguuuuaguucuaugaugacagggcauguguucucaacuggcaggcacuaacugugcacuugcugggggagccccacugcauugcaggcuaugcucuguguucuuguugaaggagguguacaggagauccagggaaguacaaggagaaauuaacuuucuaggcagcagccaccaggaaguucccugugcucuugaugucagcgaaggcuguaaaccuccugcuagguccacuaaauuguagguuuccaaugcuuacuugggaccaccuacaaaaagcucgugaugaaaggcuucguuucuacaacuuuugccuuccucauauauaaaaugaauauacucauaauguccaccucccuggcauguuuucaagauagugccuguggaaccuggcccguaaugugcauccagcaaacacugucaauuauaagcuacuucccucuuuccauccaaccaaaaacagggcucauggguuuuggagcugucucagcuccaguaaugcuauaaaaauuuaacuagggcauaaaguacacauauaaucacacuagguccaaaaaugauucuaugauaaugugauuaauaacgaguucuucgaucguaauagcaucuuaaguugcuucuguagacuuguaaauuucauaggcuccagugcuuaugaaagugagacuggcggcucauugccagggcagcaagcugcacauuaggccuguauugguguugcacacucccuaaauagcuuugugucucaggucaaaacuucacauuugcugcaaucucucuggggggacugacuuuacuugugugcucuugcuuuuccuugcugagaugugaacaagcuugacaaggaaaucgaggagaguccuuggaacggugugcugguaucugagauuugucaugaccagcaccucccuccaugcuccugguaacuuuuaucauuuccagggcagguuuucuaugaauugugccaggugcuccucucgaacgccuggaaagaaaggagaaugauuuucauuacuguuuuuuagguaagaaaauacaagcuaagcaauugaaaguaacaucucccuccuuggcaugggcuagacaugacuccagaucuuugcuucucguuccuuuuugcaugacugcauugcagguuaccucuguccuuaugccgucuggagacacugggcauuucuauaucuucauaucaaauuguauuugagaaggagugagcuguauaaacacacacccagauucuuuagaugggcagacgacuagaagcucuaugcucauaaagccuguggaugggugggcuuagcacauagcaacugugcuggagcagaaccuguucauucuaggaaugccgggguucauaaccagcaugguguuguaccagaaaugauuuggcuauucauacucauggcaagaagcagacguucucugguuuaaacuccaucccuaacccucccgcccucuccccuccugaauucccaaagccuaaaauccuaccaccucagaucuugaacacuagccaaacuucgaagagauuucaauaaaauagaagcguuuuccuucagagcguauaacagcacucauuauaauuagugugcauacaugcgugugugcauguuuaaaccuugaauuagggguggggggacaggucacaaagcugaguucccagaacucuaucacauccuccucuaugacacaagaaauaagagaugcuccagugaucaagcaaguuguaauauuuaucaaaggacugacaguauuggggggcuggagagauugcucgauggucaggagcgcuuauugaucuugaugaggacccagguucuguuuccagcauccaaauuccaguucaugacugucuguaaggccaguuccacaucuggcucccucuucuggccuuuauaggcaccaggcgcuccuuccuuccuuccuuccuuccuuccuuccuuccuuccuuccucccucccucccucccucccucccucccucccucccucccucacucccccccucucucuuucuuuuuuuaugaaucuuuuucuauuuggagaacuggcugaaccaaagagcccuuccuuccaccacuugucacugguugggcuuauaugguuuuuguuuuucucuacugguuuuauuuauauuaaaacccugauugguaugcaugugucuugcuguaguggucguagaguuuguuuugcaaugauagaaggaacaaauacuuucccacuuaggggccccgaguucaugucauuucuuacaugauauaguagaaucuagaaaauuccuguuuggggagucagguuuaacucagugguagagcuaagcuaaucauguucaagguaguagguucagucuacagcaucaacagauuucuuugcagaaucugucccagaaaacagcuccuuguccuccagucacucucaucaucucucuuccucaccaccuccucugaagccauaggguacuuacauacaugcaagaugaaacacucagacacaugaagaaaugaaucuuuuucuuuuuuaaaggacuauaaaaguacaagccuaggacauugcuggaugugaggaggggcuuagggcaaaggggguggggaagcaggucugaggaaagggagggaggugucuaaccugucucuuucucaaacacgauaaccauaacuaggcuuggaagcagucugaacuaauuuucugguugcuugugagagcuggacauugcagcacucagagcauucagguugcuuugaccuccagccaucugugcccggccuguaaaguuaaauggccaguggcaucagauggugagugcucacaaacgaucccuguucacugccccuguaagagagaaaaaaaugcccccuggagaaauaaucauagaugcuauuuucaaagguggaauuaauuguauacucaggaaagcccaucuucugccaauuauucuauuagggugacagagguauugugccucugaaaacagcaggaauaguuucucaaaggucaccuaccucagcacuccuggaacaaagcccuuggggucacauucucugguggauuagcaagugacauuuuacagucaaaauauguaccuaagaauaggccugauccucugaccuuaagcuuuuaaggaugggagcugucuuuuggugacuuuuuaaaauuacuuuucccccguggucacauaaucuuaaauaugucccuuugucucuauggauaccaaacaugagcuugaucacacauuccacuauauuaauauguccgccucuguucgaucucgucccuccagcuagugagaccugcaacgacuuucacccgauguucuucacccaugacagaucuuuugaggaauucuucugcauuugcauucaacuccugaacaaaacauggaaggaaaugagggcaacaucugaagacuucaacaagguaacggguguggucacccgccaucugacaggucuggggcucacgccucagaugugguauacuauguucccucagcugugcauagaagcaguguucgagggaagagaaggaaaggagugugauuuuaaaucgcacccaaaauggaagcaaccacuagguaucugcuuggggucgcuuuggccccuuugucucagccaaggccaccaacugagaaccuuucuggagaaacucuccuggugauuuuuuccuuugugguuuugguaugggaugcuuugucacugguuugaggcuauuaaguaaggcgucaucccucuaucuguguagaagacaaauggagagccagccaauacagaagacaacuggcugguccauugguauguuuguguaguauggacaccuuaaguucauaugacugcuucuauguccaaauaacaauuauuucuaugauggagguucucucucucucucucucucucucucucucucucaucucuaucucuuucucuaucucuaucucuaucucuaucucuaucucuaucucuaucucuaucucuaucuaucucuauaggguuauauggaccauuucagaggacagcuugccugaguagucaguucuuugcuuuaauuguguugguuccaggucuugaacucagguugcuaggcuuaguggcagaugcuuuuacccucucggccaccucaccagcauuuguuuguucuuccauugucauuacuugugggaauaugacuuuccugcugcgauagaugugagaauuuccgggucaacuuagaggaguuugaaacagagucccuacuuuuagagauuaagaacauauuucucuuugcaacagacauguauaacaguaauggcuaauuaugucuaguuuuagggucuggacagguauaguuuagccuguaaccguuguaacaugacucuaaacaaggcuccagcccuuugcucaaacccacucuccugguucuaaggaucauaacuaucuaagaauuuggugugcuacuucuguggccuugggacauagauaacaucuaaacuucuaacuucauuuuucucccuguuaccuucugucugaauguuugucaccucuauuuuguuuuguuuccaaauucuguuuuguguuaucuuuaaccacucaugguugaaaagaaaggaaagcaggaaaugggcugaagccugagccaggcacugcccuggcauaguuaccucauccacaggucauuucccucuguggugccuuccaucuuuccuuuaccauccaauguguccccguugaaccccgaucagcaaggugcauuugucugaacaucauugucugaguaggcaugauucaaagaagccugagagcgaagaagccauuaauucacuugcaaucacagccacagccuccucuguguacuucacuugauuaugagagacuuugcuauucaggugcaaaucaccccagagaaaggaggccuuccccacucaagucacaagaggagacuuaaaucaauagccuuucaaaguggcuguggccacucugcccuggaucagcgugacucuucaugugcugugggggcaggccagccaagcaagucucuguguucuguguuaggacacucacuccucguggaaggcuaccucaccauccgugauauagauuaacauugguucaagaauuagugucagagaggggucaagcauagaaaagacacgggauuuuaauuucccauaauacucugcuuuuccccugcuuauuaaagaaaagcauauuucaagaugaaugcauaaacacauacaugaauuuauugaaauauaaguacacagauacauagauauagauaaauaguaaauagcauauguauucauuuucuuuuccuacuaccacaaaugacugcagaauuaguagcuugaacaaugcaaauuuuuuaucugacuguucuauaauucagaagcuaacagugucuccuuggaucacaguuaaggcuucaacaagcaauguuucuaucugaauguucuaggggaaaauuuguuuccucacagucuuuagcuucuagagguugcuauauuccuugguuugcauccuguuucucucucuucaaugccaaccgcugugggucuaguccuuucugaugccaccucugaugucuuuuuuuuaagugucccaagauuguuuggaauuuggauaauucacgauaauaagcucccaguguuaagguuggcaaaaaaaaacaaccuuaauucuauugguaaccuaaauaacgcuuugccguguagcacacuuacacaucuuagggauuaaaacaugggccuccuuggaggguauucugcugaccaucauagucuauauuuuaucuguguuuguuuuaucuauaaguguuaauaacaacuuuuaauacaguauugauagaaaaacucuuugcuuguaauuugacugguagacauaauuccagaauucagcugagagcuucucaggcucaauacagauauguuuguguccccuuuccuuugugucccuguucucccugccuuuuuacuuugggggcaaaaagaaagacgacaaugagugugcagugugagagccacuaccaccauuccaugcagccuuuccauuuuuuauuucuuuuuucuugcuuccugccuaucaaccacugugccgcuuuacucaauaauaaauggaagcagagagaagugcugaaauugaaaucaguucacuuuucuucuuguuauuaacuugguagcagaggagauugaauuuaggaacaaauguggguuuggaguuucugguagauuuaaaugauaucauguuccugagauugucuaaauucgaauucaggaauauuuuaaaagaacccaacaugaaacaccauugcuuuugaaauacuuucgauaucucaggcucuggucguuuuauauacagcaugaaauggagauugaauugccuaccucagggccacuaauucaaaauuuuaauuucaccaacauagcacuugcagcacguucuagcaaaggcaggaauagcuucugguggguacccugacuucggcuucagcuugaagguaucuggaaugugcuaguuaaugucacuaguuaaugccacugcuggaagacggcguuuggaaaagcagcuggcuacugcucuuccagucuugaggagcagcagacgggaaguuuucuuauuuauguaagagaaguagaauugggaugauuaaaauacuuaugcuucggaaagaacuuucacuuucuagauauagcagucuacagaauaaucccuugauucaggccauugaguuuguauucuguguuuuggcuuuuauuaccaauauuuuagaacaugcauuauucauuuguaggggugucagggaagagcuaaacugcugccagcuauuuucccacacaaguggcccaaccaucauuugagggcuucacuuauaauguuuuguuuacaggaaucuuauuuuaugcuuguguggguuguaguugucucacuuuaauuauucuaacaagaguuugcaaguggaauauggaucuaugcagcaguaugucucaaaccguggauacauuuggagcacauaggaccucuuagcucagugggcaguagaaccaccgaccagggaaaccauucagugggaaaaagcuauccacgaauuguuuucaugaaguuagaguugcucacucaaggugaguuguaacaaugggauuuccaccuauugauauagauauaugccacacauauuuccaacuaauucagacugccugcauugagaagaguacugugaccauuugucauacucaaaaauuccaugccugaaaauuaacaaaaaagaaaaauggaaaugcugucucaucuucucuuauuggugaugcuauaguaauuggagucauacauguaaacauauguugaggaaguaaauuuauaugcagaugugauacagcuuuuuaaaaaagaaaucauaagauaaaucucaucugcaaacauggccaagcagcuuuuugaaguucauuuuaagcauaucagguuaaaaugguggugaauggugaagauguccgugaaccuuacgccaaguucugaacgguacgacuaaccuaacaguggcaaaaauuaaacuuaugcugacuucagcaauuuguugccaaacagcuuuaagaacugacuugguuucccacauuggcacaucaugauagcagccuaauaggauaucagcaggccucaagaauugugugucccuaacaguugaugagaacuagggccucuccaaaagcugacuacuuggucagacucauuuagugguacucaagucauucuaaggaccaucagcaaucugucuuuuugguauugauggcacuaucaaaaaucaacauuauaaacggagaugacacaacuuugcauguuuccauguaaugaaauggaagugacaauuuuaaaaguggccuuacugcgaaguaaguaauagagcuaucuuggaauuuuauccaacagcaaaaauaggcuaggcacacuuugcuaaggcuuggaaucuuacacucacagaugaaaagucguggaugcuuaaaauaucagagaccgagguggaacaacccggggcuagcaaagcagcugccccuuggccaagcugugggcaucaucugugucaaugggagaaaaucccaauuaggaagaauuggagaauggaccagaaggaaacauucuaagaaauccccugaagaggagucacagaaaauaauggaucuugguguggcauaaaaugggauggugguuaaaauguuaacacuggcaaaugccugggcucacaggggacggcuuacuucucacauugcuuuuggcuuacugacuuccagugugugcuuugcagaagacaguuguauauucagaaguccuccucccagcccugcucagcucacucuuuagguucacugagccagccuauggaaugaaagguagucuguaacucuccucaugaauaaacaugaggcuccucauuugcaugaggcaggugacuguaaaauaggcuugcagcaaguaaugaaaggaagcuuuguguguggugcccagggggagcugagaggacucagaguuguuuaucuucauuagaauuccaucuagugcugcuguuauugaucugaacuggaccugguguggcuaauaaaguagguguacauuuuaauugaaacaugaauauuuaaguagaggagcugucuuuuaaagaaacccugugucgugcaaugagauuauauauuauuuuaucuguccaggcuauuaacaaguauuuauucaaaagccuucucaucugccacaauagguuuguagguuugcaguauagacagacauccucuagaaccaaaugcauuguaaugaaaagauguaguuuuuccuuuaauguuucccaaugacuaguagcgaguggauucuugugcuugugguugucagcugcuaauucgagguagcguugggcuuuguucaugguccuugccacuuuuuauuagauuguccucguucaucauaauuacacucucuuaggacagcaggaagaccaagagugacuuugcuaacuuuaguuugaugcacagcauuuguugaaauagacuguaagguacuugcuucauaaaaaaagaaaguguugguagcugcugacaugaggcugccugagucaggcaggcgacagcaguguggagcuguguuuugcaaccucuucuggucaggcccuuguaagccuuuuuacauuauuucccuucccucaucagcuuuucuccugaaauuguuguugugaucauaaaaaugagaaagaccuaugagaauauguucuggcugggugugugggaagggggugccucagugggcccaugccaaggcaucccuuaccccugagagaccagccacaugacaguguaguauaaaauagaguuuauuuagcucaaaggguggguagguaagagaguaguagaggcagagaaaggcagagagaaggagagaguagagaaguagaggccgguaacggccacgugaagagagagggagaagggaauggggaggagggagcaaggaggcaagagagagaaaggcaggaguaagagagagaagggggcaagcagccccuuuuauagguggccagaccuaccuggcuguuguagcuaacuguggggaggagcauuccuggcuguugucagguaacugugcgggcagaguccagacagaauaccaaaacuuguuguuacagaaauaccaagucuuguguauugguacccaagguagauuuucaaauaucaauaauauauauauuuuuuccuuccuuguauagagaacaacuggaauuuggcuuggucacaaagggaauguguccacaguggaaauacauuccugagugcaggagcuuuccuuuaagguuccugauauuggaaguuuccuuuuccagcucaucucucaauguacuacacauggcucagugccagacacaguggagacuaaaaagccuagcucauccuuccuuguacccagauagccauguggaaagggacucagcagcuugagccucaggggucucaucuguggaauaagagcaagcacuuugccuaccacucaggauggcucuguacucuccuggugucaguagaugaacuguguaucguguuucuggauggagccgguaucaggcaaugguaauauggucguaggagaccauaugcuggaggauuuuagcuacaagcauuuccaggaaaaguagacaagcuugcacagggacauuucuaaaaaagaacaccuguuggccaugguuccaccaucacagggagcgugccucauucaggaagaagcuaagaugaccuuucccagauguucugcacacaacugcuuccgcacuuacaaaugagagugcagggagagagauccaggguucuccaaaaaaucaauuuguugcuucuguucauguaaucacaguaaaaaaaaaugguuaaguuguuuaacauuuguuugaaaggcuaggauaacccuagucugcugaagucauaccuauuguguuuugccuucuggacauugucuaccacuggacauguguaguauaaaacuucaugaguuucacaaacagucccagauaagccugacaaugcuaauagauucagacaguaucccuuuguaauucaagacuaguauagaguucucacuucugaaguuuugaccaagcccauauaacuuucuuugcuguguccagauuuggcaaaugugagaaggaaacaauuagcagguucuuccgcuccacagcagcacaauccaucagucccuugguucaguuacagaccaucccuuaggagacucgucacuacucaccaagcugauugcucuauucauccacaucugaagccucuuucccuucuauuaacuguguuuuggggacugugugugaaugguuaacaaguuucugugaccugaauuccagacuccaguguggaguauaagagagauuucauaauggcagagacaccauuuuauuaguauauguucaauuaacaggaaaucacccgcauuuuaagugaggccuaaugagaugaaagcauuuuaaaugaaagggcagacaggagucagaguugcuuagcuaggaagggguaccauucugugcuguucucuuauaaaguguaaguacuuguuggucaaaaaaaguauuuaucuuguaauugcaaaguaaauuauguucagugggagauuuaaaaaugcaguuguagagagugcagcagaggccauggcuauaucauguggucacucccuauugucaccugaaagggccgggugugaugggcagaggacugaggucaaagaggggacauaaauugagauaacgagucuauauuuaguuacuauuuugcugcucuguuaaaaugccauaaucaaacaauuuuccuuagugcuccagagggcuagaugucuguaacagaggguggggaaggcaugccagcaggaacaaggaacugagagcuuccaucuuuauccauacacaggacacagagggaauaauaaaaaaaaaguguucgucaggguucuuaaaggugaaguggaacaguaugugcgcacgcgcgugcgcacguguguguguguguguguguguguguguguguguguuuguguguguguauguauguauguguguauguauguauguauguuugccugagauuuauuagacugauucacauacagggugugguccaucucguccaacaauagcugucuccuaacggaaaagcuauggaucuggcugcugauccaucuguuauacuagaugucucagcaauaccagacccaggguagagucccagggagguucuagagagcugcuguucuucagucuacauuggacuccugaaggaguauguccucacagcagugaagaagugauucaggaacaggguagaugaacccaauaucgaaaucgaggucaaacaggcagaaaggaaaaacuucugucuuccauguccuuuuauguggguugcugucagaaaguguggaccagccuuagguuggcucuucucaccuuaaaugauauaaucaagaaaaauaccucucaggugugcuaccucuuuagguuuuaguugaguccauauguaguccaguuggaaaccaaauuaaucaucucaaaucggaacugagaugacacuauaagcccuuaaaaaacgcaccccccccccagugauagucuuccaccagaaagucuguacuuccaaaggucccauacccucuccaaacagcacuaccaagugaggaucccaaguguuccaauacaggagccuaugggaaccaauugucauuuaagucaccacagagaaucaaagguaaugauaauuuguaaaggauccaaaacaagagcugugagaaguuagaaaacucuaagugaggucugugggugccaucagcauugaugccagauccggggcuggagugguggcucgguagggaagugcacuggcuccaacucuagguuggagucccagaacccauguguuggcucacaacccucuauuacucuaguucaguccugggggagccaaugcucucuucuggcuuucauggacaccacauguacacaggauguaccaaguguacauuuaagcaaaaugucuauacuuauaaaaauaaacaauuuuuggccagacucccucagcccacacaccagccuacccccucugaccagucauagaccaaaaccucugaguccaaagaccaaaaacaggaacagagagugagaggcaggaauaggccaaaggggagggcuaaauuuauccauaauuucuuuagccccuuuguggcaaguguuaaagggagaaaaaugaauagugaaguuugacuuugagagcucugggcuccuaauuguuuguuaguuuguuuauucucucucugccuucucgcucucuuguugccuguaacugcuuugcuggcucuaaaguuaggaggaagugguccuauaugagucuagguggaagaaaacgauuaaggaggcagucaguccacuuauuucccagguugagccaacaucuucuucagggagguuccuaagccugugacuugcuuacuaacaacuaacucagaugucccugggguaccuaccacccugcucugucgcuguggauaccuauucucuacaacauauggcagugaacuauuaauccuccaguuaucucagaguagaaccuugaauugucuauauucauaagagucuugcacugugccuggguuuggaaagacauuuaaaaugaucucacaaccgcuguacaaauagcacggccauaucuaugucuacgucuuggccaauaaggugauugacuaagcaacauuuucaguguaagucauucuuucuaaaaucuuugggucuacaucagguugugcagcagaauaugaaaauaacagaacacuuucagcucucuuaggacacacaagcuaguaauguucucuuugaagacuauagacuggcuucuguuugaaaccaaucgcuagccggagucauguaagcacuggauaguccuuuauccuuucaucauugcauugauucguagguuccucuucucaucccagauguggucagcuugaugccucgucacacugugcuugcuuggagacaguuguaccuacaagucuuugccauauuccccuuggcuuggucagaaggcuuucuugcaccaaugugauguaaauagaugugauaugagaagaguacauaagagcugugcacuaugggcagcuguugcuaacucagggcaaaccccagacuaacacaucugggugcaguuuucuagagucaacccgacauuuugaaaugucaagauauaaccaaauagccaucucagcucaccuauagaccugggaguauaaaaaucuuuugugauugcuuguuacacagcaucuauauaggaauaacuaagauaccaacuguuacauuacuuaauuucugucuuugaaaucuuguuuucaaaaucaaaucugaccauaucauuccugcuucuagacuuccugaggcuggcuguuaccuggcucugaaaguuucacgguaacauacuuuuccugccucuaccucgcuuucacuccccaccuuuccuaggcugccagcacauccugaaugcccacuguuuuuuuguacgugcuguaacacuuuucaucucucagccuuagcucauccucauucucucugccagaaacgucuucucccaucugccugucgagagccuacuuauccuuuaggauuuugcacaagugccaccucaguaugagagguaccaucuaucucccguucaauucaguacaaagcuuugcaccucugccuccacaauguggaauucaaauauucuauuggaaaauaccuucuagcucuauaguggcuuuuaauuauaaaucuaacuucccacauuaagucuauguuuuacuggaugcagaaauuucauaucucaguauucucucgaugcuuuguaaguauuggcucaauuaauuuggaucaaacccuaaaugaauggccagaaauaucugauucaucacuuaaaaugguccuucuggccaaaaguugaauugauuuauaucauuucaauacagaguggauacuguagcucagcucccagaggccauagguacuaaguauuuugcaguuaugcugucuaaagaauugucuuaucuagacauaguagcacaugccauaaucccagcauuguggaugugcauagauaugaaaugagcagagaacuugggaacuguguacuauagauagcugcuaacucauugcaauccccagacuaaggcaggaggauccagaguccaaagccagcaguagcccaccauuccugagaugucaauaagcuuuacugguaaauccugcuaaaucgacccuucagaaugucuucugcagauaucagugcuuugagagacuuauaaaauaacauugacauuuguuaauuaaagucacaguaauaaccacucuccucccagcauaguuuauauaaagugaugagacccuucagagaaucugacccacugcaaaucaaacucgguuucucuuuuccgaguagcacaguuggaaccgugcucguuucccagccccacccauucauuauaucacuguuagucacgcuuaacccacacaccccggcaggucagggaacccucuagucucccauuugucauguuuucggaccacugagggaaaguaaugucaauaauagcauuuauccuuucccaagauggcugucaagagaucuucuagggcagaggacaaaugcaccguccaacuguccaucccuucgagguuacaggugcuauccaagcagaccugagaacgugagugugagggucgggcuucuuagaugaaaaacaggaauguguuaaacucaucuuagacacacacgcacagagacacaaauagacacacacagagacacacacacacgccacuaugcauuacuuuugccuccaaaguuaucuuaaauuagggggacauugcauuauuccauaaguggcauaauacaggaagacccccucaggauaaauuuauaucuaggcagaauuggagguaauaggcuccuuggaugggcucugguccccauauucuuuuuuucuaguucacauacacauugguguggcaugguuagauuugaaguagguggcauauggcuuuuugcugcuugaacugccacagaaggcaaugucauuggcauagaaugccagauuuccauuuugugaaucacagagcauggaauucuaucugaaggcuuccuggcugcaauguguccuuaaagcagaaggacacaaaagguaugcaucucccaggugugcugcuccuauguguguaauuuaucaugauggaaagucugccggcaauggacauggacgugccaaugacccgagguguggcagaaaggcugugaggcuuguuuaauuguggucacuggguaaacaggcuguuugcccccuagccguaguagauaccagugaguuaugguuguuuucuaaguuuuucagaugaauagaugucuacuugugcauguaccagaaaaaaaaaaaauacaaaagacugugaguaaaagauacuugugcuuagaggauggaguucgccacaauguugcagucacuagaauuucagauuauaagucacuuuccaacugaugcaagagaccuagugcugucacuccuacucuuagccuucgucuccucucccaccuagccucuuacugaggauccaagagaaauuugaagauuucccaaacagaggauuagaaagaacccuaugaaauugucuauacuugacaguuuaaaagguauuucuuuuauuuuugagauugugauuacaacaucuuuccccuuucccguccuccauccaaacucccauauaucucuccuugcucucuuucaaauucauggcccccuuuuucauuagcuguuguuuuaaauacacacacaccuaaauacauuaaaaaagagacagaaaacaccagcuuacccaggcuguguaauauuacauauacguauguuuccaaaauacaggaauguggggcuggagagauggcucagugguuaaaagcacugacugcucuucuuaagguccugaguucaaaucccagcaugguggcucacaaccaucuguaaugaaauaugaagcccuuucuggggugucugaagacagguacaguguacuuacauauaaugaaugaaugaaugaaugaaugaaugaaucuaucuuuaaaaacaaaacaaacaaaccaaaaaaaaaaaucaaaaaacaaaauacaggaaugugaagugguucagcuuuguaauugugugucacauaagagcaaagguggcuacgcuccagaacugaccauugacucccauccugaguuucccacaguacccuuucccccuucauguacccuguucuaugaccacuuaacugaugagagagauugccauagagucuagccagacugccucugagcccauggaaugggguucgguucuagcuccagcauuuccuguuugggugauuaacugucuuguuauuugucuccuuaucucugaauuauaaaacuuaauagaauaguugugaguauuaaaugagucgauuuagauggaacugaaaugcagaauuagucauucucugaggcucauccaguaugucaagcucugccuucuggaaaaguaagggucucagaggaggcacggggaagccugagaucuagcccagaucuuuucauauuuguccaucaucugcucucaccacccaucuucucccaggcagagcuuguguuccuagacucugcauggccaggucuucuguguuuugaauucuaccccucuuggacagcucugggaugcuacucugccaguuaucaguuuuaaucauuacaucaucaauaucuuccucucagggccaccugaaugcacugaagcccccuuacacguucauuacucuaagccagguauccucaaagggcuauaccuccaucugccuucuuuccuuuucauuuacuaauuuacugaaaacgccauccuacacuagguaaaaauguauuccagcaaagagggaaagucugguuauaaaauacauuguuggcucuugagaaucucuuuaaucacaaaauauaccaguuuugucaaaugcagagagacuucugagggacaguucuaaauuucaagcauuuuacuugcuucugugcagcacuuuuaccccuuuggacacuugucuuucuucaugaagagugucucgugguagcuuacaaagcacacaugcaaaaaagauccacacuacauauacacaugccaagaccaaccuacauugagaaaaguuacaugcaggacaugaaaucauuuuugucgccucaguuccuagcauaauuuuuagaaaaaugaaagauaagcaacacuacaacuacauuuaaaaaaugggagcaggacuuucaauaucaguuguguguauuuaacacugagaaaacucuuucaucagaaaagaugcuacgcuguugcuuaguuuuucauaagugcacgucauaaacagauguccacucaccaaagguugggcacccacaacaaaacaaagaaauuauucuaugcacaucaagcuugguaaaguaauaaguuuaauugggccuuauuaagaaaaugggugagaagugccuacagaaauaugaacaguuuacauguaaaccaccaaagaaagggcuauuacucccagaaacuacauagauaucuacaaaaggaggcagggcuuucaggcuccucccccaaguccauuauagaaaguuaauauguccaauggccugugauguaauccaacuaaugaauaauccugagagcucuggagggccauccugcacagaggacaguguuccucaacacaugccauuucucagacaaaaaugggauggaaacuggccaguuacucuaaauguaagguuggaauaaaguucuaaugaaaaggguguacaugacaaaucauaaaacuuacaucauugugcuuauuugcaucucuccuacucugaucccuucucuucauccaaaauauggagacaagucaccucaauccuuacacacuauuuucuagugcuuuccucugcugaggucauauucaguccccgccugucacuguggugacaacuccuccaggagaaaaugcugacucugcugccucucccucuugcugugguccgugucgcuugucccccugcugcuugucuagaguagcaaucagcuccugauugucaagucuggagaucucuccccagagcuagucccaucccauugcucuaaagcgugaccauccugccucugugauccugggaucuuugccuuguuacacucaggcaauuguuccucugaccucuuuagcauaaacauucccuaagcccacccuuuuuuuuauuguauuuguguaugguguccuccuggccacucaaaaucccuugacuuuaacagaaggugaauuggagucuccugaaguucauguguaugaccaguccacagacccuucaaauuggaugggucuaaaaugagucuugcuguuuuacucuccucucagcuggcuuuuagugcuuucuaacucuaggagcucuuuggugaucuacccacauuuuuuacuucaaacaguggguugaucugacuuucuaacuugguuuuaguagguccuuuaauucugccauccugcacguguuggacaaagggacaucugccaccuggugcugggacucuguagcagcuuccaugucuucugcagacuguaugugccuuuuauuguucacugaaucuggacuuggaccauccauaaacugucuagucccuggguuccagaaggaucuuuuaaaaacacagguuuauggcaugaucuuuccauagucaaaacucuuggggugggggggaauggcuagagcgauagcucagagguuaagagcacuugguuuucuuauauaagaucuaggugucugcugugggggauggucaggagugcaucccagaaucccuuucaccugcucaggcuggagugcagcagugagagggggaagucaucaaaaugcuuuuagagguccucaucuccuaagaguccgugaugcucgggagaagaacagaguacccccaaaccucuguacugugccuggagcauccucugccaggcacuuagaggugauccugggguuuagauaaugaauuuaguucuaaaggguuccugggguggaacuggguggguguaacuucacaguaaaaugcauggacaaagcaauagcauagacaguguacagaaaucacucaaaguuacaaaaagagcuacuuuuaggagagcuuuuggccuaugacucagaacacaguagggaaaagcaaaaucggcaaggaguuggagaaggaugaaauauaauggaauacaagaggaaaaaggcucccaggggaacuugauuaacauccagaccccaacugggaagccuugaaagaagcauggcacaugauuggcgcuuucuaaguauucuguuuaguaaagacaccuuacuucaaacugaaauuuuugucgaaauguaauuuuuuuaguguauuuuuccaaagagccaagaugucuaguauaagauagauuccacaacagcacaagcaagaacuuaucugugauucaacacuggagauuccuugagcucuuugcuccguaauucuccugccugucagugugcugguagaacuguaguuauuuggaaacuaugcugcuauuuggaaaccaugcugcauauucucccugccaugacuugauaaaaguaggggguacuuuugcauugcauauuagaggauuacuuaucacccauggggccaauuuuuuuuaucaucaacuuaauaacuacuuucugaaguuagaaacuuaaauaugcaaguaaguagcaaaguaauuaauaaaaucagauuaugucguaucugaauuuaauuccuguacaguugagguuguagagccuguuccccgugagagucagaaguaacgaguccagaacauuuguccaggaguugagacacacagaugucuguagcugaaaguggaaugagggacaguuugaagccauauggcccuuuucaagcagagaaagauugggcuuagagaacaagcagcucaccccagugagggcaacagggcuucacuaugugcaagcacacuguugacauugugguucugaguguacaguugccacuacucaaugcauuuucacacagaguugugauauucccagcaucugaugacaaccacuuuuauuacagagggugaacauaaaaauaacucauucuuauaagucacuuuagaauuuguagguggccacuuugcuguguggaaagccccauccacuguguuccugugccugcuggagcuguacaaacccaucugcccaucuuucucuauccucuucuacaucugcugcaugaccucccugauugugacugccuaacucucucucucucucuccugcgugcugcacuagucgucuuuaccugcuggcuggacaggaagucacuuaccugcuccagcuucuuguuccucuuguucccagcacuguucaccuuuuccucaugccuugcuugcuaugcucugaugcagcgacaggagaccaggaugcaaaggcaucuggccaguugaugugcugauguaucugucaaucugaagcagaaaagcagaggaagcgauagucucuggugcuuaagcauuucauaagagagucagccaagauuuaaucucuaacauuuuggaugagaguagucuucagaaugagaauaucauaaacuaguguuuucuuccucaaaaggugcaauugcuuccuuggggaauggauauguuucagcguaaggagagguggacuccaacaaaggccuggaaacugguguguagugagauccaaagcccccuuuucacaauggcacaaaagcuguuugcauuuuguacuauugauagaguaucuuccuguugacccaguaggcuucugacaccauauugccagggacacacuuggcaacauugaacugagaaugugggcauguucauugccuccuuuuggcaugauucucuccagcauucaauucugggacacauuuuccuagcauauuuggaaaacuuaaauuggcaagaugcugagaucugaguuuucccagcucuucuuucuaagacacucaggauuguuagaaaucuucccuuccucuuucccauuggccucaaguaaguccuuucaauuuugucaagucugccacacuccaaacauccccuaacuggauccuaacccuccugccauuuuggaaaagaaaugaaggacugugcagguuguaaaaugggcuuguauuuuguggauguguguuuuucacaguauuuguagaauuucccuacacuuuagacauuuuugagggaaauaucauuauagcaaagucugagguauuaccaccagguuaaagauucauuuugucuaacuugcuuggacuuagaugcugugagagugauccugcucuagcggcuugcucuggaggacagaggcuauaggaagcuaucuccuuagacagauuucugagucuaugucauggcaguccccuaucauuagguauuggcugaaaacaagguacuuauguauacuuaaggaacaucacuaucuccauuuguaaauggacauuaugauauuagcuugcgaaaaacgugcacaucuauuugcugauaguucugugugugaucuuuaucccugucacaaagagcuuucuggcuugggaccuaaaaacacagugacagaguaucagauuuuguauguuuuguuuaugaaugucuuuacauauaagugagaagccaagcaacuauccauguauagaauaacucuauggacaguuacugaucuuguucuccugagauaaaguuauucuuacauauuuacuuaaaauuuugcauauguuuuuuauuuaaaauaaauaaaguaaucagagaugauuguauuacucaacccaaaugacuggccaacuguauugcucgugucucuggaaugagauaaccaagugaagcaagccaguaauaacuauuugagcagaguuuccauucucaccacauagcuuuauaaacaugguuuagccuaggguuagucagcuuguuccauuuuagaagugaauaaguuugcauguguguguguguuauguauguguguguauguuugugugauguauaugcauguauaguggggugucuuaagaagacaaagaugugguugaaaaugaacuuauugaaauacagacuauuuguuuggaauuucauuaaagcuccacuuuucucucaagacuguguagagggaacuagccacccaaagaaagagccacacagcagagcuguauuuagaacagugaggucaucacuaucacauucauuguagugaugcacaugucuccagaugaagucaaugcugaagggggagaagcaacauguuugggacagagaguuugaaaauagauggguugacuuuuauuacuguuacuucuuugugaugacuagaauuguuguuuuccaucuuuuaaugcuuaauauaacaauaucagguuucuuuguaaauuugaauguuucuuuagaaagcauucuguagcaguugcuguaguuauggggggaauucugucaccuaacagaacuuuuauaguuuguaaaguuuaaaagcauuauaaaaaauauuuucucagauuugaugcaguauauaaggcaugguuugggaaagaaaucaaacuuagaaucugccuaagaaaauguaggacuaggguacugacaaugcuuacccaggguggagcaaagaacacaggcucagugcgcucaaguggaaagagacaucuuccaacuggugaagaccacccagggacucuaauucugauguguagcugcaguucuaaaagcugguguuugcccuucucaucccacaacuuaaagaggacuaugaagaccaugggacuuuaaaagagcagccaccccgugaucuaaggaauacucccucaggacaggacuccacagggagccauggaaguguccauggggacuaugucuuaggaagguccccuugggaaauauuagugaaacuuguuauuucuauaaacuggauccaugaguggguacguuaguagacaugcuuacccugaguaaauaaauaagaaggauuugacaggacugaagcuuuaaaaauaguaguuaacuuugcauuuugacuuaaaaauuaguuuuggggugaagauguuaacuagcuggucuaaaaaccguucuaccuuuacgguuaauauguuucugcauuaaaaguggauauuuacauguuuucaacaaggugagagggucagaguaggucaguguccuuaaaauagaggagucagaaaagcuaucgcuagaagagcuacacuguccauggcccccaaagaggccucuagaaacccccauacuucuucauaagucuguuccuuagagcagcugcugagcaccaugggaagcuggguagucaccucagcuaacuucaggucaugugaugcaauaggaauuugcacucccaacgauaaaguggaccuugauuuuuuuuuuuuuuuuuuguaagaauggcuuuuuggagauggccugaaauagugagacacacauaccaauuuucaaaaauaaugcccuuuugcaugguauaccaugaaaacuaaugugggauucaucuuuuuuucugugcaagcaugucuguagugaucaucaagcugaguugugucuaagaauccucuaguguucucaggaacauguuccauaaaguccucguuuagaagaggcagcgaaaccccaaaucugcauuuuuaauaaggacuuucauacacaugguugacauggggcacagcuagacaaacugaagccagaauccuuuaguccacaucacagcucuaccccuuaauguuuuuggaacuuuggucaaauuuaaccuuccuagaccucaguccguccauccgcauaacaaggacaaugcuauuucucagguucucaguaaggacgacuccugguuaaucaaggccaaaugcuuaagguguuucccagagugaucauuaagcuuaguucugcuuauccggccaagccaacaaguuaggaauauccuggaauagauuauuugaaucacauugauuuacuguugguauaccacugaacacaaccgagagauguacaaagucgguauguucgugagcaagaagucauuuaauggaguaccauaacuaacuaucauugcuuucagaauaaaaccugaccuuucaccuggugucuagaacgcuacuugcuuugccucauaccuuccucuucguccucacugcaucuagugcaucuagucugucucauggacauuccuccaucuuuuccaagaugccaggcuccuagcacaagcccugugugggugugcuccuuauaucaguucauuaacuuugauucuuugguacuuugaauacuggcugauugcacugcuucuuagauaugcuuccuggccucacuaggucagacccacuuucugugcucauugcacauauagcucagaucucuccugcacacccacagguacacuuuauuauguuaguuggcugaacucaaggcugagagcugagggcagaagccgugucacuugguuguaucacuagccuaaauuccugacacagucaacaacugcugaaaaauauugaguuuuguuugaugaaggaucuggggugaaaugacauguuucugugucaaacaaguuggauauuuggaucuuuucaacaagguaagaggguaagaguggaucaguggcauuagaauacaggaaucgguaaagauuccuuucuaaguccacagugacauaaagggaccgaguggaacaucaggguccauagucuucaaggagcaaaucuaaugugaucaaaggcagaucuaaacaccauggaauggaagcugugggauuugggcagguggucacucacuuuaagaauaaagggagcucagagcuacuguucuuuaggaacaaaggaugcugugcuaagcauguaacuuacuuugcuagcagacccagagacauccaaugagccuucucagccucagcccugucaaaaacacgcuucauguaaucaccacaacagcaucauacuugcaaagaccuuuguggaacagacaguuugccuugaggauauagugaugcugauagugacaacagaucugcuuagaccuuggcuuuuuuuuuuuucauaaugucauuuuuuauauaucuauacaugcaugucagagcacagcuuuuuucauguuugucauuuuaugcauauguaggcauguacgugagagauugaugucuugguuuccccucuaaggaaccugacaguuccauucaugcagccauucauugcucaguggcggccccugcugcuaaggagacagacagcagcgcauacggcaucugacauuaauucugaucaugccacgcgugcaaccaggagaauuuaaagcaagcaggaggggaagagaugggagagaugaaaaugugcugagaaaauuaaggaaggucucucauaccuuaggugcuuuggugaaaugcugaugcaagagagagcuuaaccuaaagacuuuauguuuacaaaauccuccggauucgggcaucucaauauuuaaaggcuugcuagaaaccaagacaacacuuucugagaagcaccaguguaaacuuuucuuugggguuuuccaaggcuauuacguaaugauuuaaagauaccccccccccacccgucugcuagauuccaaguuucuguggauuugaauuagguguggaggcucuuuagguucaucugcaucucgaguuggaaucagaguguggauccucccucgggaccccugcuaggaugaaagcuucucucucucccucucucucucuguguuucugggcgugugagcauccccacagcacaugauguauuuuacaaagcaaggcagcuacguagccuuucugucuaaaaacuguaguggagagaagguggaaguaugcauuacaaucaaauaaaaguagaggggggcagagaugagauuguaguugauuaugggucuggcagcagauguucuacacgaauccaacucgcugcagccagucuguuuccauggcaacagaaucaguaauuauugagcccuggcacucccccccacccuccuuccuaccaagguggaggcugaugaaugugaacuaucucccgcuccuucucgguccucuucuuucccucgcuuucuucagucccucauaggaaaaaguagagguaucgaggagaacuaagagagggagcucuuugugucuugacaaagauugugagaaauuaaauugcaaaggauccuuuaccuugugauacuaccagaucagagaaaagcucuucccagaaaagccgaugaucucugaagaugcuaaauaaaugagcaggaguuucccugaaauggaagcucccuuugauuggcugaucuucccacaacuccugccaaucggagcaccccugggcuucagcuccauaaacauaagcaaagcuccaugcuuauucuucuggacuuggagcguauuccauucgaaggugugcagcgggucucuguucacauggcucaacuggaaaccuguuuccugagcaagcuuacugggcagcccucuggucuuccggcacacuguccuacuggggcacgacucuaagucauauuuguggcagcagcuuagacgcaguauaugucguuggggaugauggacuuacggaagcuuggugaguaaaucuuugucuuacacaucugugcacugguauuagcaggcugagauagaauguagcuuuguucuauugucugccaagaaagccgaguuggaaggagcacauggaagaacacccaugcaaagguucccaugauacgggagacugcuucaaaaggcuuccugcuuuguuugauuccggucggauuuguaguugauugug

SEQ ID NO: 6917 - RNA, 1037 nt, Mus musculus
ucaguguccuugcugggguggguggucuaggguuucuuacucguuggaggccauguaggccaugagguccaccacccuguugcuguagcuguauucauugucauaccaggaaaugagcuucacaaaguugucauggagagcaaugccaaccccagcaucaaagguggaagaaugggaauugcuguugaagucacaggagacaaccuuguccucaguauagcccaggaugcccuucagugggcccucagaugccugcuuuaccaccuucuuaaugucuucauacuuggcagguuucuccaggugacaugucagauucacaaugaacacauuguggguaggaacauggaaggccaugccagugaacuucccguucagcucuaggaugaccuugcccacagccuuggcagcaccaguaaaugcaggaaugauguucugggcagacaucaugccucagcuuuccagaggggccauccacagucuucugaauggcagugauggcaugaaucguggucaugagcccuuccacgaugccaaacuugucauggacaaccuuggccaggaggguuaagcaguugguggugcaggaugcauugcugacaaucuugagugaguugucauauuucucuugguucacaccuaucacaaacauggggguaucagcagaaggggaggagaugaaaacccuucuggcugcacccuucaagugggcuguggccuucuccaugguggugaagacuccaguagacuccacgacauacucagcaccagcaucaccccauuugauguuaguggggucuugcuccuaggagauggugaugggcuucccguugaugacaagcuucccauucucggccaugacugugccguugaauuugccaugggucaagucauauuggaacauguagaccauguaguugaggucaaugaagaggucguugauggcaacaaucuccacucugucauguggagagcagacggcagcccugauaaccaagcgcccaauacagccaaaucuguucacaccgaccuucaccauu

SEQ ID NO: 6918 - RNA, 953 nt, Mus musculus
guuauguuugcuccgcucccuugugauacaaugagacaagaagucucuucauugcucccuucauguccuuguuccucaaaguauagauaaaaggguuaagcauaggagucaccaaacuguagaacagagacagaaguuuguucuuguccugggaauuagaagaugaggguuguacguacaugcuaauuacugguccauagaaaagagucacgacaacaacaugagaaccacauguauuaaaggcuuucuucuugcccucugaggaacgaauccuaagcacaguugcuacaauaaacccauaggaaauaagaauaagugacaagggaaccagagaguagaaagucccuacaauggagagcauagcuauauugaaugcaguguuagcacaggacaucuugaucaucaccgggaccucgcagagaaaguugucuacuuuguuguuuccacaaaauggcagcuugacggugaggguugauugaagcaaagaguuagccaagccacucagccaagccauggacacgaggaggauacagaguugcuggugcaugaucgcuggguaccuuaggggcuugcauauggcaauguaacgauccaaagacaucacagccaggaggaugcacucgguagcccccaggaagugaaaaauauaaaacugugucacacagccuccauaacugauggauuuaucugggccccaaagauuccgaagcagcugagggauggugguuguggugaaacacagguccaagaaggagagguuggaaaggaagaaguacaucgggcuguccaguugagggucucuccuggauacaacaauaauugauauauuucccagcacugugcagacguaagcaacaagcaccauuaugaagaggggcauuuccagccauggauggcuggagaaacccaaaagaaugaagaucuuuggagcacuuucauuaccuagguucauu

SEQ ID NO: 6919 - RNA, 75 nt, Mus musculus
ugccuccuuagcgcaguaggcagcgcgucagucucauaaucugaagguccugaguucgaaccucagagggggcag

SEQ ID NO: 6920 - RNA, 953 nt, Mus musculus
aaugucagugaaucgcaucagugcagauuucccagaagauuucauucuuaugggcuuuaccaaguacccauggcuggaucucccucucuucuuuguccuccugaccuccuacauguucacauugcugggaaacauugcuauuauuuugguuucucagcucgauucccagcuccaaagucccauguauuucuuccuuaccagccuuucauuuuuggaucucuguuuuaccacuacgacugucccucaaauguuguuuaacuuacagggacccaacaagaacaucacuuacauaggcugcauggcccaggccuauguguuucauugguuaggcuguacugaauguguucuucuugguaucauggccuuagaucgcuauguggcugugugcaagccucugagguacucugucauuauggaccacaggcucugucugcagcugucuggugcugcuuggcucacuggccuggcuaacucacuacuacagucuacacuuaccauacaguugccccugugugggaaucggaugcuugaccacuucuucugugagcugccugggcuuauuaagaugucuuguggggacaccacagucaaugagguuacuuuagcagugguggccacauucuucauaauggguccccucuccaugauacuuguaucauauaguuacauugcucaaacuguauuucgaaugccuucugcggcagggaggcucaaggcuuucaacacuugcucaucgcaccugcugguggugucuuuauuuuauggaccagggaucuacaucuacaugcaacccucagaggauggcucccaagaccuuaucaaggucuugacucuguuuuacugugucaucacucccauggcuaauccauucaucuauacucugaggaacaaagaugucauaggagcuuugaagagacuucugaggaaggccauuucaacuaaggggauaugaa

SEQ ID NO: 6921 - RNA, 953 nt, Mus musculus
uucauauccccuuaguugaaauggccuuccucagaagucucuucaaagcuccuaugacaucuuuguuccucagaguauagaugaauggauuagccaugggagugaugacacaguaaaacagagucaagaccuugauaaggucuugggagccauccucugaggguugcauguagauguagaucccugguccauaaaauaaagacaccaccagcaggugcgaugagcaaguguugaaagccuugagccucccugccgcagaaggcauucgaaauacaguuugagcaauguaacuauaugauacaaguaucauggagaggggacccauuaugaagaauguggccaccacugcuaaaguaaccucauugacugugguguccccacaagacaucuuaauaagcccaggcagcucacagaagaaguggucaagcauccgauucccacacaggggcaacuguaugguaaguguagacuguaguagugaguuagccaggccagugagccaagcagcaccagacagcugcagacagagccugugguccauaaugacagaguaccucagaggcuugcacacagccacauagcgaucuaaggccaugauaccaagaagaacacauucaguacagccuaaccaaugaaacacauaggccugggccaugcagccuauguaagugauguucuuguugggucccuguaaguuaaacaacauuugagggacagucguagugguaaaacagagauccaaaaaugaaaggcugguaaggaagaaauacaugggacuuuggagcugggaaucgagcugagaaaccaaaauaauagcaauguuucccagcaaugugaacauguaggaggucaggaggacaaagaagagagggagauccagccauggguacuugguaaagcccauaagaaugaaaucuucugggaaaucugcacugaugcgauucacugacauu

SEQ ID NO: 6922 - RNA, 10015 nt, Mus musculus
uucuagaaaaaugguuguguuuauugggauaccauaguugcaaacauauuuaauuaguacugacugcuuuguugaguuuuucuacccaagaaagcuuauugccuccuauuuauguucauauuuggcuuuuaaaguguuuuaaaguuagccccaaguaaauguggcacaucucuugagcucugaguauuuuugcuguugcuuuuguagcuguggucuuuucauucacacucguacuuaugaaggcugauuuuaguguucauaauauccuguuaacuuacuaaauuauccuuuuaauacauuuuuucccauugaccagaagaaugucucuuugagacaucacuaaucucagugauacugaaacacaaacgcgaaaccggauaaggaccggcaugcucacuaugauuagacagaaaaucccaacuucuuuugccagaguaaggacaaaccacugaguggaacuccguggcucccuagaguggcucugggagcaacagggcuccaccgcuuccggccuuugugggaguccgcgaugacuuccgguuccugggagggcuggauucccuucccugcgcaggagcgacgcggugagcgagcucgugcuccaggcggggggagggugcucccugcuaccuagacucucggccuuagaaagaugcuuggaaccgggggaaaggccacccgggcugcgcugcggcugccuaugggucccccuggggcgcggagcuggcccggaccuaggcacgcugcagaacuuuaaguuagagucacagaacuggaggggcaggagaaaagcagagcacccuccccaacuucuaaccuuuaugagugguuaaguuccaacuaaagccaguugggagacuguacuauguauaugugauuugugccagguacgcagaaaaaaaaaucaaaagcagcaaggcaggcguacccuacucuuguacucuuuccguuauuuuuggugguacuguuaguugaacuucccacccgccaggcagcgguugcccuuccccaacgcuaucugcuaauuccaaaauuuuuuguuuauuucaguuaguuguuguucacuuuaggaguaaguggagguaaguuucuucccaagcuuuacucccugaaguccugaaacaauuugacaucuuuuucacuuuugucuauuuuugugaaaguccacguacaauccagucaauacaguagauuaaccggagggcagcuuuucaacucucccacuuaacucuuagaauaggcgguauuugcuuauuguaguucguguuaguaacgaugacuuaucccuuagguccacuggguaagaagauuuaccaaggaguuauuacuugaaagauugauacaucuuuuaucuagcuacgaugacaucuacuagugauaccaaggucuguaagaaccaggguggacuuuuggaaauaaaaauggaggaagaauguaaguauaccaccagacaagauaggaaccuacaaaagaacacuuauaacagagacgucuuccgaaaauacuucagacaguuuugcuaccaggaaacuucuggaccccgggaggcucugagccggcugcgcgagcucugcagacaguggcugcggccggacuugaacagcaaggagcagauccuggagcugcuggugcuggagcaguuccugaccauccugccaggggagcugcaggccugggugcaggagcagaauccggagaguguggaggagguggugacugugcuggaggauuuagagagagagcuugaugaacuaggauaccggguaagaaaaaggggggagggguccucuuuccuaagcgcgacugaauuuguaggccaaagugaaguauaccacuauuuuacaaagcauauugacauuuaguuggauccaaaggggacuuuaagugucaugggaauuuggaguugaacuuguacguuguacauccuagccuugggcuuguaaucuuccugucucauauccuuggugcugagauuacagguauguacguccacuccugucuggucuuaguuuaauuauuccuuuucaucagugggguuguuuuauuucugugcuaagcuacaaaguucuaucugaugcuuaguucagacacacaaggcauauacuacgagcgaagauacuagaagaagaggaagaagaagaagguauuagauggugguaauagggugcgaaacagccucuuguaaagacuauuauguaauauaaacaaguaauugagaaauggguguugagcuggguaggagcacaugccugucaacuagcacucagaugauggaagcacauagauugggguuugagaacaauaugggcuauacugcaagucccuguccaaaaaauaacaagauuggggauauguuucagugcuagaggacuugcuuaguaugugcaagguccuguguuuaauccacggugcuauguguuuaauccagugauagcuauguacacaguuauggagcuguuaauacucccaaguagaaacacugguggaggauaccagcuguuaaucccucuuuguccagaucuguugguggacagcaagacuucaguggugugaauuugauggauucuucaccagugcuagggugggacuugccaccuggugucuuaagaaaccucucacuugugcuauaagcaagcucaaggaacucuugguuggccaagcuagacuuagcugggaucuuuauuugguuggucagugcccuaucuggagugaaaagaagcuuucucacaucucuccaggaaaaacauauauccacugcccugauuucuguaguaaacaguuaaaagauggagguggaggucacuauccugaaugagugagauaugggagcagaauggagaguuagaugggaggguccgugugggggauacaugcuugagggauagaaagcccauuuguguuggaaacgagaacuuuugaguaggaaaguugagauacaguuuaugacauugaccauaaaccccucaguuugaauuuucuucuaguacaaaagcucuaaaucuuuucucuauagucuaaauaagcuauaaaaaauuacauaaaagaggcagaaaaaagaaucauuuauaacccuuuuuaucuuugucuuaacugugacaaggcugguuuucaaccagugguaauuccgagccaaagaggacguuugucaguuucuuagagaaauuugguuguuauaauugaugagcacaggaugauucuacacauguuacaacacacaagccagcuucagacaccaaucaaugcauuugccaugagcaugugagaagagcuaaacuuaggacaucacaguacaaagaggaugaaccugugaaauaaaagaagugcaaccuggcauccagguauaaaauaaaagggagagagaaaaggagccaaaaaguuuaaaauagucaaugaauucacaguuacauguaagagaacugauaauaucauucuugacagaguuaagggcuguagguggccauucugcaggggcuuuuuuugaaugcaccagugaacaucauauacaagcuacuccguagauucuagucuacugagaagagauagaggaaaaaagaugucagauguugauaucaaaagcacagagaaagggguaguaaaguacugagggucacaccauucaacagacaggucauaucacaggccuuaaguguuaccaggauguacaggguagagggaaauuuguagagaagaugaaagaauuaaagaacuuauauauagacuuagagaccauuauagagauauuagauuuuggcaaauggaaagucagugucuagcuuugagcagaaaagaaauauaaaguaaauuuuaaaauaaucacucuaguuguuauauuggguaaauucuacaugguggugaggagaccuguaggucaaaaguugaguuaauggaaaucauuuuaggaaguuguaccuauuaacuagagaugcagucaguuguaaaucgcccaguguggaugcuggagacccuguauucuagaagagcagcaaauguucuuaccuacuguucuucagcuccuuccucuagaauuccuuuuuccuccucucugcuuucuuuccaucuuucccuucaccucuuuuccaucuccaauuuuugagcacuaggcaaagaugugaaaauaacaggagagcaacaaaauauagcaguaucagggaaaagaagguucccuggauugagugacauuuucaaaugaccuugaaaaaugagugcgaucgagacaugcugauugcugugaaaaaagccauccgggcuugagcaggcaggagccugugugaacacuguacucuuucuuguuugcugcucuuagagugcuucucccauuucccccaggccucaguccaaacugaagaacagguaacguuucaggaggugaagccuuuggcaacagagcagaaacccagcgugucccuucaguuugucaaagccaagccugggugugaacuugcaggccgugaagcccaggaggagcaagguaaagaaggggaaacaggcugauaggaccccagggcuuguugggugcuuccugcuguuucucguuaaaagugagagggcugcccagaaaucugaugcucacguguugacaugcauguguugugguuugucacccuuuagucaucuacccucaccccaccccccuucuuucuuuaaacccagaaccucaugcaugcuagaaaagcacuguaucucucuaaggugcauccgcagcccccuuuucuucuuacaaaauuagcaguuuucuaaauucuggcuuuauuuuguuuagguuuacuuaguuucauucuucugauaguuauaaucccuuauucugaccucucugcuacuuguagacuuugaucuaauaaacaguauuuuugucuuccacuuggacagaaauaguucuuuuaguaaauaaguuuuuguuacaugaugucugcagcuuccuaguagucugagaaaaaagaaauauuuaccugacugaaggacaguacaaugaacaugguacugguaauggucaagguggugaccagguggggacucacugucuuccucauuucuucuaacucugauuuuuaauuuuuuaauagguagacuguucuaugguuuaaaagaaggauuuauaaaaguuauccagugaagaauuucugugccauuuaauucaucuauuuuccccacucccaacucugaaguauauugucacuuuuuaaauuuuuucauguguccuucuagagauuuuuuuuuaaguaaacauuuucuuuuccuucacacuaagaugguggacuugugucccuucuauuucuuaacagcugcuuagcauuaaaaaguauagacaaggggcuggcgagauggcucugugguuaagagcacugacugcucuuccagagguccucaauucaacucccagcaaccacaugguggcucacaaccaucuguaaugggaucugaugcccucuucuggugugucugaggagaguggcagugugcucauauaaaucaaucaaucaaucaaucaaucuuuaggaaaaagaauagacaaaaggacaaggaagguuaggcagcugcuccugaugacauuuaucuuuguuguguucucauaacaaauagugcugcaauaacuaacaguauaaauuccuaccuguacuugccgaaaguuguguacuguauaauguuaauaguuauugugaaauugcuuuccauuaacgauuuggauaaauucacaccagcaauuugagauauccauuuugugaguacaguguaguaccaaacuaauuagguaaauacagugagugaaaaauuauaccuuaugcuggcaagauggcucagcauguuaaaguacgugcuuuacaaagccagcaaccugaauuuaucuccagaauccacaguaggagaaaauaaacuucuaaaaguuguccucugauuuccaaccaugugccaugacaugugcacacucaaacagaauaauaaaagaauuuaaaaauuauaugugcuauuuagcucauuuuugccugauaauggaguagugucucucuugugauaagcauugcguguuuccuuucuuggaaaucacauaguuccccucugcccaguuuucucuugcuuuauuaucucuuuauucauuuugggggugcauuauauauuuauuucaucuuguauccuaguguaguuuuguaguuuguaguagaaacucugagaucuuauguaauuuucauuugaauacuuuuauguuacugauaucauaagcuuccauuuacucccuggggaguggguaaccugcaggcugcuuuuuguaguuucagguguugagacuggcaaugagcccaggaaugucacucuaaagcaaggccucugggaagggacggaagcagaacagaauccugcuagcagauuagcaaaggaugcacuugagugugaagaagcucacaacccuggagaagagucuucugguauuucccaugaagacagccagccucugcguaaugaaaaugguguaaauucuccugcgaacucagaguacgcuaaacaccagagcaucuguccagggagaaaagugcaugggugugaugaguguggaaagaguuuuacucagcacucgcgccucauagagcacaagagaguccacacuggagacaggcccuacaaaugugaaguaugugggaaaacuuuccgauggaggacuguucuuauucgacacaaggugguccacacuggagagaaaccguauaaauguaaugaauguggcagggcuuuuggccaguggucagcacuuaaccaacaucagagacuucacucgggagaaaagcacuaccacuguaacgaauguggcaaagccuuuugccagaaagcaggccucuuucaccaucucaagagccauagaagaaacagaccuuaucaaugucuucaguguaauaaaaguuuuaaucgccguucuacacuuucucagcaucaaggaguucacacuggagcaaaacccuacgaaugcaacgauugugggaaagcuuuuguuuauaacucaucucuugcuacccaucaggaaacccaucacaaggagaaacccuucacucaaagugguccuauucagcagcagaggaaccacaccaaggagaagcccuacaaaugcaguguauguggaaaagcauuuauucaaaaaauaagucuuauagaacacgaacaaauucauaccggagagagaccguauaaaugugcugagggcgggaaggccuuuauucagaugucagaacucacagaacauuagggaacccacacugggaaggcccuacaagugugaugaauguggcaagaccuucagacaggagucagagcuugcugagcacuagagaauucauuauagaaguggucccuaaaaguguaaugggcguggggaauuguucacguagaacucagcucuuacucaucaucagacuagucacaaaagagcaaguacucugugugaugacuacagggaagcuaccucacggugucggcugaugaagaguauuguauuuguaaugcuuuguggugacauuucagccuuugcuguuacgagaccauaaauauuugaugagcucccucuguauacuguccuuuguguguggcuguggaggaagucuaacuccagauuucuuagaacauuuacaacuaagccagagauguggaagucuaccauaguuaaagagaagggcaguggaauugaugcucagcgugcuuuagaauuaaaguaguagaaaauauuuuugaaggaccaacuccuuguacaccugcucaggaaagauuucugaaauuauuuuuauugaaaauaaguguuugguggguagaucuggaagagaaaagggagaacacuuuuggugaaauaggugagcagaagcaagagugcagguaguuuggaagccagccuacuagagaguuguuuuaaguguugagcugaugggcauuaaauggaaauagcuugaggacagaguaggaggauggucuaggaaugcuagccaaucaaugcuuguggugcacugacagagcacucuucuccuuugucucuaaaauaucucuaaguauacauguauuguagaagcgauauggucauucauacuuguuuaucacagcauaucucaagaugcugaagcaggaggauuaggaguucaaggccugccugagcuacaugaaaccuaaagaaaaagaaagcaggaugcaggaggcuggagagauggcucagcaguuaagagcacuuguugcucuuguagauaacccggguuugguuucuaucacccacauggugauggcucaaagccaucuauaacugguucuagggcaucugauuccuucuucugaucuguaggcaugagggacaaguguguauguacaugcaggcaaaccacuccuacacauaaauagugcagaugacagcuguuauaccacagcgaggaagaccagaaaccaaguucuuguaucuggcuuccaauccagucugugacauccacuauaccccaacaugggcaaacaucaacaucaccuguggugucguguauuuaaaaugucugugugcacugaaugagguccuggguucaaucucaaagccuugaagguuuaccuggucauggaaguauuguagucccagccucucagaagacugagacaggaugucuugccagccuugauaaaacacaguaaaaaccugucucugaguaaguguuccugucccacucaacaugcucaguaugucugaggugucauugugacucuugaugaacaggaaccacuacagauuccuagaacauuuguccccagcuccacaaggugaacaccauuagggccaaacacuagaauuuugguguggucuuuccguuauuucgcgucuuaaguauuuuauggcuggggaaagggcuggagagauggcucagugguaguuaagaccacugguugcucauccugaagaugugaguucauuucccagcacccacgcggcagcucagaccuguccauaacuaguuccagggcucugauacccuacacagacauguauccagguagaacgucaacauaaaaauaaauuguaaaaacaaaaaaaaaaaccccacauaucuuaaggucuuuuuguccuaguucuguugauaacuggguucuauauucuugagauucgguguagccuuuugguuuacauacuuuacugagugccuaaaagauguugcugcucuccaguaggaggcugccacucaccacccuuguguuguugagucagaacaacugcuuugguugagagccucuggugauuuaauuagugaguguuugaagucucaggauacuagaacuguugagaaaaaggucuggcuuccuucuuugguaaaaggaaaguuggguuuauuugggagacgugaugugauucaccuaacauuggguuguagacacaggacaaagaaucuacugaacagauuaaugugagcagauuaauccgugggcaccuuuguccauucauugguuaggacaaugugauaggaccgacuuccaugacuaaauucauggaacaugcuugcauggauguuaugcaggugccuagcgcugagcuccacucccgcuccuuguguucuuuaaacaaaaguugcugccaucaacuuauuucuaccauucuuuucacugucgcuuaugugagauugucuaagauaggagauuuauaggagagguuauagucugucucugaggcuuuauuaaccauuagauaguaauagacucuaacagccagguuccaugucauugccuuuaucucaggaugaugaugauggaacaagaaauguuguacacauaguaccucagaaucaaacuuuccauauccaaaugacgacccugccacagacuagcucucagugguuaagagcacuucuugcucuuuucuugcagaaaacuggcacccacauggaggcucacaacagccuguuuguaacuugguuuuggggagaucauaugcccuuugcuagaauucuagugugucuuugcagugugaacauucucuguauggauaaaguaaaauaaaucuuuuuuuaaguuucuaguuucucauaau

SEQ ID NO: 6923 - RNA, 3579 nt, Mus musculus
gggggagggugcucccugcuaccuagacucucggccuuagaaagaugcuuggaaccgggggaaaggccacccgggcugcgcugcggcugccuaugggucccccuggggcgcggagcuggcccggaccuaggcacgcugcagaacuuuaaguuagagucacagaacuggaggggcaggagaaaagcagagcacccuccccaacuucuaaccuuuaugagugguuaaguuccaacuaaagccaguugggagacuguacuauguauaugugauuugugccagguacgcagaaaaaaaaaucaaaagcagcaaggcaggcguacccuacucuuguacucuuuccguuauuuuuggugguacuguuaguugaacuucccacccgccaggcagcgguugcccuuccccaacgcuaucugcuaauuccaaaauuuuuuguuuauuucaguuaguuguuguucacuuuaggaguaaguggagguaaguuucuucccaagcuuuacucccugaaguccugaaacaauuugacaucuuuuucacuuuugucuauuuuugugaaaguccacguacaauccagucaauacaguagauuaaccggagggcagcuuuucaacucucccacuuaacucuuagaauaggcgguauuugcuuauuguaguucguguuaguaacgaugacuuaucccuuagguccacuggguaagaagauuuaccaaggaguuauuacuugaaagauugauacaucuuuuaucuagcuacgaugacaucuacuagugauaccaaggucuguaagaaccaggguggacuuuuggaaauaaaaauggaggaagaauguaaguauaccaccagacaagauaggaaccuacaaaagaacacuuauaacagagacgucuuccgaaaauacuucagacaguuuugcuaccaggaaacuucuggaccccgggaggcucugagccggcugcgcgagcucugcagacaguggcugcggccggacuugaacagcaaggagcagauccuggagcugcuggugcuggagcaguuccugaccauccugccaggggagcugcaggccugggugcaggagcagaauccggagaguguggaggagguggugacugugcuggaggauuuagagagagagcuugaugaacuaggauaccggguaagaaaaaggggggagggguccucuuuccuaagcgcgacugaauuuguaggccaaagugaaguauaccacuauuuuacaaagcauauugacauuuaguuggauccaaaggggacuuuaagugucaugggaauuuggaguugaacuuguacguuguacauccuagccuugggcuuguaaucuuccugucucauauccuuggugcugagauuacagguauguacguccacuccugucuggucuuaguuuaauuauuccuuuucaucagugggguuguuuuauuucugugcuaagcuacaaaguucuaucugaugcuuaguucagacacacaaggcauauacuacgagcgaagauacuagaagaagaggaagaagaagaagguauuagauggugguaauagggugcgaaacagccucuuguaaagacuauuauguaauauaaacaaguaauugagaaauggguguugagcuggguaggagcacaugccugucaacuagcacucagaugauggaagcacauagauugggguuugagaacaauaugggcuauacugcaagucccuguccaaaaaauaacaagauuggggauauguuucagugcuagaggacuugcuuaguaugugcaagguccuguguuuaauccacggugcuauguguuuaauccagugauagcuauguacacaguuauggagcuguuaauacucccaaguagaaacacugguggaggauaccagcuguuaaucccucuuuguccagaucuguugguggacagcaagacuucaguggugugaauuugauggauucuucaccagugcuagggugggacuugccaccuggugucuuaagaaaccucucacuugugcuauaagcaagcucaaggaacucuugguuggccaagcuagacuuagcugggaucuuuauuugguuggucagugcccuaucuggagugaaaagaagcuuucucacaucucuccaggaaaaacauauauccacugcccugauuucuguaguaaacaguuaaaagauggagguggaggucacuauccugaaugagugagauaugggagcagaauggagaguuagaugggaggguccgugugggggauacaugcuugagggauagaaagcccauuuguguuggaaacgagaacuuuugaguaggaaaguugagauacaguuuaugacauugaccauaaaccccucaguuugaauuuucuucuaguacaaaagcucuaaaucuuuucucuauagucuaaauaagcuauaaaaaauuacauaaaagaggcagaaaaaagaaucauuuauaacccuuuuuaucuuugucuuaacugugacaaggcugguuuucaaccagugguaauuccgagccaaagaggacguuugucaguuucuuagagaaauuugguuguuauaauugaugagcacaggaugauucuacacauguuacaacacacaagccagcuucagacaccaaucaaugcauuugccaugagcaugugagaagagcuaaacuuaggacaucacaguacaaagaggaugaaccugugaaauaaaagaagugcaaccuggcauccagguauaaaauaaaagggagagagaaaaggagccaaaaaguuuaaaauagucaaugaauucacaguuacauguaagagaacugauaauaucauucuugacagaguuaagggcuguagguggccauucugcaggggcuuuuuuugaaugcaccagugaacaucauauacaagcuacuccguagauucuagucuacugagaagagauagaggaaaaaagaugucagauguugauaucaaaagcacagagaaagggguaguaaaguacugagggucacaccauucaacagacaggucauaucacaggccuuaaguguuaccaggauguacaggguagagggaaauuuguagagaagaugaaagaauuaaagaacuuauauauagacuuagagaccauuauagagauauuagauuuuggcaaauggaaagucagugucuagcuuugagcagaaaagaaauauaaaguaaauuuuaaaauaaucacucuaguuguuauauuggguaaauucuacaugguggugaggagaccuguaggucaaaaguugaguuaauggaaaucauuuuaggaaguuguaccuauuaacuagagaugcagucaguuguaaaucgcccaguguggaugcuggagacccuguauucuagaagagcagcaaauguucuuaccuacuguucuucagcuccuuccucuagaauuccuuuuuccuccucucugcuuucuuuccaucuuucccuucaccucuuuuccaucuccaauuuuugagcacuaggcaaagaugugaaaauaacaggagagcaacaaaauauagcaguaucagggaaaagaagguucccuggauugagugacauuuucaaau

SEQ ID NO: 6924 - RNA, 20026 nt, Mus musculus
uguuguuguuguuguugaaaugauuuacggaaaugagcgcguguuugguuucuucgaaacuaccaggagaggugcgggucaggaaaaccacgaccuggcuccaccggugcaccagagauugucaccaggcuucuaaggagcacaacgcuugccggaaguugccagugagucuccagcuccaacuacaggaagugcccccucggugcccagcuccgucugcaggaagugcccccuguccuucaucccuuuggacuccuucccgccgaccuucaucgucgcgggcucggagacuaacagcaagaaccgccaggcuguggcgcucuggccucuuggcucuggucgcaggcuuuuuucaugagcuucggcacauccucacguccucguagcacacguucccuaaacuuuuaagcagcaaauagacacccuuagcugcugggcgcuggcguauauaauuuuagcguagaucugggcagguuagagcccuggcgaaggcacuacagguacaucuauuacguucguccggucuuuguuggguaucagguacgugcugcgauucuaguuuauguagaggucugccaggagcagggguggcugugcagugaucugcaauagaagcuggagaacggaguacgugcacccagaggugcacacccgguugccaccuguguggcucaguuuucccauuccuauuuuagguucgaggguagccacgauagauuaugcagguacagagcaggucuugugucaguaggaauuuacauuggaaggauagaccaauacagagcaggaaaaaaaacugucacccugaauucgaggaacugggaaguccaugguuuuuuuaguagguaggaacuaacuucuuuuauucuaggauuaacuuuacucauggaaaauaauuaggugcuuaauauacuuggugguaaacuaaacgggagacgcagguaagauuggauucugggaguuugaaguuagcccaaggagaaguuucugaugguugccaugguuuuguacgugcgugugcgugugcgugugcguguguguguguguguguaauggcagucugaccucaaaggacgcuagaaguuuguccucaccagcaagcaagcaaaguuuccucucugaacaccguuugcagcucucuaauucggugcagauggaugguuccuauaugcuguguauacaagacacaagacugguucccacuuucaacaucaguucuaaguuccacuuuauuuuaccuaugcuucugacccacuggcuggaaaucaggguuuuuacuaacugcucccagagcucagaucccacagaacucaggaaacaugcuuacugacguguuacaaagcguauugcaaaggauucaggugaagcagggauagauaucccuguguuuacgaauaaggggugugguacuucuaugcccucuguggaggcaucagucuccaacuguuuggaagcuccacauccugccuuuugaauuuugauggagacauuauuauauagaccuaguuaauugaauaacuguucgguggucauccauuuaacuuacagcuuaucccauccaaaggaguuuuauuuuguuuuguuuuguuuguuuuuaaagcaacauggcucuaagaacacccacacuauuauguaaccaccacaaugaauugagaucugcaagcuaacucagggguuauuccuggauaguaaacauuucuagaugcuauagaagagcuacuguauuccuggauuaauuuagaaaaccacaaaugacagcauuuuagcauugcuguucuucacuuaaaauauuuuauacaucuuucacauuaguacaugugcuguuccuuuucauuuguauuuaauaaauacauguucugccaguguauaauucuuauauacuuucauagcuggccucuuacuaaugaacuuccagcacuguaaaauuauccuuuauuuaccugauuuaauugucuccaaggcuuauuaccucaaucugcuaacuuaggccuuguccugaacauuucuagcuuccauacaaccuaaucuaggucuagaauguuuucagccucugagacuugcugcuaacuaagcuuacucuuucuaguucauucugaucucuagcugguuggccaauucagcuguucugacucaaauuccuccccaugccaacugauucaaucuggcuucucuccucuucugaauugcucgguuuggccucauaaucacuuugaaaauuuguucuaauauuuuggcuccuucucugacuugcucugucuucaccugugucuagcuuguucugucuuuaaccugucucuguaaagcucucaugguaaaauugccucucucauuuuucucucugugggcacugcuuucuuaaguagcuucccuuuucucucucuucucaugagaguugggcagaucuuauucugucaagucuuucucuaauuccucacuuugucugccucucaauuuagauaucacuguuuguuuguuuguagaacauuaauuuaauauuuucaacuguuaauauucaacaaacagaauaguuauuaagauauauuuccuuguuaugucucccuuuucauuucugauuuuauuaauuuggauacugucucugugcccucugguuagucuggcuaaaaguuuaucuaucuuguugauuuucucaaagaaccagcuccugguuuuguugauucuuugcauaguucuuuuuguuucuauuugguugauuucagccccaaguuugauuauuuccugccaucuacuccuccuggguguaccugcuuccuuuuguucuaaagccuucaggugugcugucaagcucuuaguguaagcucucugcaguaucuuuuuggaggcacucagagcuaugaguuuuccucuuaccacugauuucauugugucccauaaguuaugguauggugugucuucauuuucauuaaguucuagaaagucuuuaauuucuuucuuuauuucuucuuugaccaagguaucauugaguagagcguuguucagcuuccaugugcaugugugcuuuccguugcuuuuguugguauucaagaccagccucaguccauggugaucugauagugugcaugggauuaucucaaucuucuuguaucuguugaggccugcuuugcaaccaauuauauggucaauuuuggagaagguaccaugaggucuugauuuaggauaacauguucuguagauaucuguuagauucauuugguucauagcuucugcuaauuuuacugugcuucuguucaguuucuguuuccaugaucuguccuuuguugagagugggguguugaagucucccgcucuuauuguguggggugugauguaugcuuugaguuuuuguaaaguuucuuuuaugaaugugggugcccuugcauuuggagcauagauguuuagaauugagaguucaucuugguagauuuuuuuucuuugaccaguaugaaguguccuuccuuaucccuuuugauaacuuuuuguaggaaguuaauuuuauucaauauuagaauggcuacuccagcuuguuucuugggaccauuugcuuggaaaaauguuuuccagccuuuuacucugacauagcgccugccuuugucacugagguguguuuccuguaugcagcaaaaugcuggguccuguuuauguauccagucuguuagucuaugucuuuuggggggaauuuaguccauugauguaaagaaauauuaaggaacagugauuguuacuuacuguuauuuuuguuguuaaagguggaaucauguuugugcagcuaucuucuuuuggauuuguugaaagauuacuuucuugcuuuuucuagaguguaguuucccucuuuguguugguguuuuccauuuauuauccuuuguugggcuggauuuauggaaagacaguguuuaaauuugguauggaauaccuuggauucucugucuaugguaauugagaguuuugcuggguauaguagccugggcuggcauuugugcucucuuagggucuguaugagaucugcccaggaucuucuagcuuucauagucucuggugagaauucagauguaauucugauaggucagccuuuauauguuacuugaccuuuuucucuuacuccucuuaauuuucuuucuuuguuuagugcauuugguguuuugauuauuauguguugggaggaauuucuuuucugcuccagucuauuuggaguucuguaggcuuuuguauguucaugggcaucucuuucuuuagguuauggaaguuuucgucuauaauuuuguugaagauauuuacuggcccuuuaaguugggaaucuucacugucuucuauaccuaguauccuuaggcuuggucuucucauuguguccuggauuuccuggauguucuggguuaggagcuuuuggcuuuuugcauuuuauuugauuuuugugucaauguuuucucuggaaucuucugcaccugagauugucucuucugucucuuguagucuguuagugaugcuugcaucuaugacuccuagucucuuuucuagguuuucuaauuccagguuugucuccuuuugugauuuuuuuuuaauuuuuucuacuuccauuuuuagaucuugaaugguuuuguucauuuccuuugccucuuugauuguguuuuccuguaauucuuuaagggguuuuuguguuuccucuuuaagggcuucuagcuguuuaccuguguucuccuguauuucuuuaaggggguuauuuaugaccuucuuaaaguccucuaucaccaucaugagaagugauuuuagaucugaaucuugcuuuucugguaugaugguguauccaggacuuguuaugguggaagaauuggguucugaugaugccaaguaaccuugguuucuguugcuucuguucuuaugcuugccucccaccaucugauuaucucuagugcugccugccuucccuuuaccugacuggagccuguccuuccugugaucuuggcugugucagaacuccucagaauucagucaucucugugauccugggauucugggacccugagauccuggugugaccaagcuccucagauccugggauccuggcauccugugguuccugggcauguuagagcaccugggaguggagcuucuucaggguauugugggacuggcugcagaguuugugcccaaccaaggucuacucagagcaccggcccagaccagaagaaaccugugccacuggucgcgcagaguucuuggaugccugggucccacugaucccaguuacucccaguguuggggcaguugucuuccucaccucuaauccuauucaucuaaaagauuuuuggaguuacaagcaagacaacaguaaauaccaaauguacaggagauuuguuagaguaagagcaaaauugugcuuuaggaaauacacaucaaugaugugauguacaaaacaaaacuauugcaauaguggaugaaaaugguaacuaaggaaauagaaaggaaggaauuguugucagagauauuuuauagaaauaauuagccaaacacagcgaucauauagggccugagguuaagccuaacugcaugggaagugguugaccucaauagaaguggaaaaauacauaaggaaccccagugugagguaacccugauuuccuuucaguauguguggaaaugauagcgcaggagagacauccugcuggcacuggaaaaugugggccuggagucuaaaggaagcuuggaaccagaaaaggaugcggauguccuugaaacagaugugcuggaacugagaucacaaaaggaaaaaggagaugaggaaaagaagggaccugcugagccuccacugcuuugggugucugucguucuauaagaauaaaaacaaaacccgaauaaugaaaagagugucuuggaguccuauagauugauuggccaauucuacuguggguccugcuuggggcugcucauacagcuguauuuagcuuauaaauuauauaggcucuaggcccagcuaggguuuagccuaggaggccugauuccaagugaccuuuacaugacuagcuugggucuccucacagcaugguugucuuauggcaauguccuaagagcugcagagaguuuccuuuuucuaugucaugucuguuauacuguuugucaaagcaagccauaggccagcacagauuuugagacauaauuaugggaggcauggcaagaucucacuacagaaggcauuaguggugggaaauuguggaagaacaauaacguaagaucugcauagaaagugaaauauucaaugcauaucgauaaaugaccuuugaauuguacuguguuucugccaagauagcucucuggcuucuccaugugucaaaucaucccuaauugagacacagucucuuuauuuaguccaggcugaccuugaacuugcuauguaguccacacuagcuucuguuccugcaugcuaggauuucaagcaugcagcaccaugccuggagagguauucuuagccuuucuucucucaugguguaucccuuaucucugggcucaaauccuuuaguguucaggauaugacuuugaugcguaggguuagccuuugagcacagcauagucgagacaaaaauaaaaauauguuucauaagauuuuaaguugacuuuuauuuucuguucaauucuuauacuguagauguucaucuagaaaugcauuucugaaacacagacuucagauagcugagcuguucugcagcuucuaaguucaacauguaugaaguuuugcuggguucugcuccugagaaugaaggccgccuugugacagugaagguggaagaucccaccuggggacagccaggcaacucacaggagggcagggcgcaugcucaggaacuuuaccgccugcgauuucggcacuucuguuaccaugaggcagacauauccucugcagagaggugaugaagcggcgacauuacuggagaaucuagccucggaacguggagacacagggcagcagguggggaaauaaugagcacgcuugugugggaagggagugggguaggaauguguaucugcuaaugcgcacccucuuauucugaaauaauucagaauuuagagaaggaccaucaaaacagcauucucuucaccuagauuuagcucuugguaacacugguuccaugaugugccccaccuacccuauccauauuccugugaagucauugugccgaggcaugcacaguuaugcagacuuuccccggaccagaugacaaaucauuguaaauaugccccucuagcucccaguacuucaguguauagcuaugaagagcaaaggcaugcuuuuacagucuuaguaugauacccaagcuguacacucgggcuagaugccuaccacauaaggcagcgugcccucuggcugguccucccaggaagcacacagcgaugcuuuuguccuucacaguucaugcuagugcuugucagaguuucuucucuagggaauuguuuuacccuuuguaguuguuguguagucuguggaagacauuuggcgagaguauacagacccuaggccucauuacauuuuuuacugcuagcucagacaugcugucauuguguauuuccggggauagauccuuucucuuguuuuuccugccuugacuucugaguccccagauucugagggggaccugcguggugaguuugcagcgcuaauaugaauguaugucacuugcuccuccuuuagaggggcagaugagcuuguucugugcuccuuugugggagucucuggcucccaccaggcuacuuuuucaaagugacuccuuugucucuaggcuacucucugugcucaggaacaggacaugcaccuaguggugacagaguauccaggagccucuauggaggaguaucagagccuccaucuccugcagucuucggucacucccuggacaagagacuuuccagagcucccccugggaugugagaggugagugcuaggaaaugaguuuaaugaggacccugaaggaggcugcugagagaccaggguugucucugcccucagggucuucuuucuuggguuguuuuuuuuuguuuguuuguuuguuuguuuugcauaccaaguuauuaagguauuuauccccaccccguguguguguguguguguguguguguguguguguguguguguguguuuguuuguguuuaaaauauguaagugcugaagggauggcucagcacagacaugcuugccucucagccugacaaucuaagggggaucccuaggacccacaagauagaagagaaccaaccuuugcaaguuguucuauagccucuaugugcaugucuguaugcguguguauacacacacagagagacacacacacacauaaaaaauaaaacuguuuaaaaacuuaagcuauuuuugagaucuacuuaacaaauuuugaauauaaaauuagugacacaugcccauaguuccagcuacucaggagcugggaaagauugcugagcccaggguuucuuucuuucuuguuuguuuuuuguuguuguuguuuugguuuuuuggcuuuguuuuguuuuguuuuuauugcuuguuguugcuuguuuuaaagcacaucaccuauacauuaaaauuuuugucuacauuuguucaucguguguguguguaugugugugugugugugugugugagagagagagagagagagagagagagagggacagagagagacagagacagagagacagagacagacagacagagacagagagcgagcgccugcacacaagucacaacuuacuauuacuguugcuauuguuuuguuugggaggguggguuuuguuuauuugcuugcuuuguuuuuugagucagggucucacuauguggccauggcuggcuuggaacucauaauggagaccaagaaggacuuaaaccagagauucaccuaccucucgagugcuggaauuaaaaauauacacuaccauguucguguguguuugugugcucacaggagccauggcaugagugugaagaucagaagacaacuuucaggaugcaauuuuccccuuccacuauuugaguucugggaaucaaauucagguccauggguuuggcagcaagcaccuuuacucacugagccaucuuccuggccccucuguuauguauuuuuuuuaauacucugcugggaaucaaacccauaggcuuuauauaugcuagacagcacucuaccaacugagcuauguccccaccuuuguggggguaggggauacagugagauagggucucauguagcccaugccagccucaugcucacuauguaguucaagaaugaccuugaacucuuccuucuuccgccacugccuccuaagugcuggguuugugucuauauaccaccaacacuaaccagagcccaggacuucaggaccagccugggcaacauagugagacauugucucuauauauuaauaauaauaugauacucaagcauauaauuuauuauauuauauuauauuauauuauauuauauuauauuauauuauauacaauuuauagcuaccaugcuagucauuaaauaucuauuacuuacucuuuuuauaaguuuaugguuuugaccaacauuaaauucugugguuuuguccauucccauaucuaagcaauuguuaaaaauuauacaaaauuacaaaacugaauuuauuuguguauaucuuuuuuuauauauuuauuuauuuauuauauguaagcacacuguagcuguuuucagacacuccagaagagggcaucagauuuuuuguuauggaugguugugaguaaccaugugguuacugggauuugaacucaggaccuuuggaggagcagucggcacucuuaacugcugagcuaucucuccagcccuauuuguguauaucuugaggugggauuugaacucaggaccuuuggaggagcagucggcacucuuaacugcugagcuaucucuccagcccuauuuguguauaucuugagguggggccuuuguguacaugccuuggcaaguguggauaggucaaaaggaagauuaugggagucaguucucaccuuccaucauguacaucccagggaucaaaauuagguccugauacuuaguaccaaguacuucuaaccacugagccaucuugccagcccauauuuagaacauguucuuacucaacaacuaaaauuaauucaguuaaaaauaaauucaguuuaaaugauuugcccaauaccaacagauucagagguaguucaaaaauauaggcucuguguaguccauguuuggguuacaccaugagaacaggucuugugugagaacugaccaaaggcaucgugcagcagcagcagcuucuuccucccuucucucuuaccgguggcuuuaacucauaucacauaugugaguaaaguaccuaccaagucucucacuccugcucagucuugugggugagcaacagcugagcuucagacucuuagaaacguugcagugcuuuuagcucaguccaugaaaucuguuucuugggagaguggauccauacagagggagcuucccaaggcaauuuugucucaggaaggacucuugucuucucccuuuauaagaugugcucuucaaggaguagccugucuccaggaagaaaguuccaaagacagugccguggugccgagucuagcucagcuagguuccaggugagcugccguccagguuuauggaaacuuaguggcaauccucccuucccuuguugccuuucucuuggcccacucucucaguccaaaagccuuuaaggaggugccuucacguucacuuugucucagacuaucacagacuguguauguucaucaugcagagagccuaugaugguggcuucaguuuuauuuugugccauguuuuggaggcacauuuagaucucaagguaucaggguaaagagggugguauaagacugucuauucagccgggcuugguagcacacaucuauaauuccugcacuugggaagcagaggaaggagggucacuucgaauucuagagcagcaugcuuuacauggucauauccugucucagagauacagaaacagaaagaggcacaaacgaagagagagaugcauaggacagaguggcucuuucccauauaagucuuuuucuccauuuguucucucaaggcacugucuuuaugauauugccuucucugcuuuuccaugacuuccuguuaaucacaucagaccucagaccucauguuguuaucaacuacuuuaucugucuguaaaugcaaccuacuuaaacauacuuuaaauaaaaaccuaauugcuguaaauguaguauaacauggauacaaagaaaacaguuauauauacacacauauacacacacacacacacauauauauguguguguguguguguguguacauauauauuauuuauuacaagcuauaaaagucuucaauaugauuauauaugaggaaaugacaaagaaaguaguuagauguuugcaccaauguauaaucaaugacugaaaauuaagaaggaauaauauaggaguccaagaaagucuaggguagaggugugugugcacagaagaugaaagcuaauauuaaaucaaauuauaaaagaccaaacagaccaaaauuuaacugaagcugagcaaacauaugaguuaaauuuuguccccucaaaagauaugguaaguccuaauuguaggugcccaugaagauggccugacuugacaguuaucucuuuggagauguaaugaaguuagaggaugucauaugguguugaaugagccuaaacccauucuuuauguggaggccagugaaggcagagauacacagggaggaugccugggaugacagagccugagauaauauggcacuucuacgaguagcaaaaugccaaggauuauugauagcauccagaagccaagaaaaguggcaaggaagaugcucuccuaggguuuuccaagaagcguggcccugauggcaccugaugguuccuugacuuugacuuuagacuuccaggcuccaguacagugagggaauacauuuuuugguuuuuuguuuuuuuguuuuuuguuuuuguuuuuuguuuuuguuuuuuguuuuuguuuuugaggcaggauuuuucuggauagccccuggcuguccuagaacucacucuguagaccagacuggccucaaacucagaaauccgccugccucugccucccgagugcugggauuaaaggcgugugccaccacgcuggaucauuuuuuuuuuuuuaaacuaucaaguuuggcccuguuagaagagacuagagaaaccaauauagcuuucuaggcaauuauguugauaaaggggagggagauaguaaaaagagguauuaccacuuaaacaggcuuuaauaaaaggaaggcuuuccaauaccaaguaagguugaaaaauguacauaaaaguaacauuauacagacuaagcagguuauauuuaaggaugcauaaguaucuagauauauacauauaugcaugugacaacaauuaaugaaaaacuaguccaugaauuuaaaugagagaaaggagggguauaugagacaguuuggaggaaggaaagggauaugguauaauuauaacaucucagaagaucagagaaauaauuucuaaaaaaaaaguaaaagagaggagccuuauaguaucagaauagucugugugcccauugggacuguguaguaacaagguaaacagaaaugauccaaucuugagagccacuagaccuuuuaucagagccuacauccagucugggaaggacuggauacuguauccuuuucaggcaaugggaaaugaguguaaauaagaacaugaaacaaaaguuaagagauuaaugaaaauauaugugguagacuuuuggagacauuaucaaauaaagacaaagaacuauaagcgaccaccaaaauaauuauuauagcauauaauuuuuaaauaguauagauaugcaauauuuuaaauaauuuuuauuaauaaaauuuuugcaagaucucuacauuuacagagauccaaaucugcuaaaaagagccucaaaacuccuuguuacaucuucgauguuacauccucaaccacugcaggaaaugauacugaacugaacaggugagugaguccauguuuguaacaaugucuuuauucugugcaagcuuucuucuagguaacauucuuaaguuguuuuccuugcuuugguauuauuucguaacaaucucagacaucuuauuauaggugcaguaggccuguguauuggugcagaguuagucuaccagggcacuccaaugcccuguaccaugugggacagcguugcuguugugugggcagucauugucagguauccaguggcaguggauugugcuggugcugaacauaaguaguucauccccagaguggcuggcaccacagguuuacaguguucaacaucuuuaauaccaucuguuuuagucccuguuuuucuacaucuggaaccacagguagcaggaagagagagauucuggaacuggcuugggcuuuugaaauucuaaaggucaccccagugacacacuuccuccaacaaggccacacaacagggacacaucucccaaguaaugucaaucucugaugaccaaccauucaaaucuaagagccugucggaacuucaaaccaacacauucucucccuggccccaauagacuuguagcuguaacauaauacaaaaacuucauucacucuaacuucaaaaaucuacccaaucuauaauagucucaauauuguuuaaaagucagaaguucaaaauuucuucugagacucaagacaaucucuuaacuguaaccccuagaaaaccaaaauugaaagucagaucauauacuuccaacacacaauggcacagaauacacaccauuccaacacacaauggcacagaauacacaccauuccaacacacaauggcacagaauacacaccauuccaacagagaggaaagggagcauagugagaaaauacuggaccaaagcaggacugaaacccagcagggccaacuccacgcugcaucuccaugucugaugucaaagugcuccuuagaucuccaacuccuuucagcuuuguugacuacaacaccucucucccucucccucuccccccucccccucccuuucucucucucucucugacuuguuccacaccuacucugaagcucuucuugacaggugucccucggcucuggcaucuccaacauuuuggggucucuaaugaaauccaggcuucaccuccacuguuucauacaauggccuuucugggcaucaguacaaggacaccccugacaaacaccuggccucagcaguuuuccuuagccacagaggaagauucccaaacccuuucuuguauccuuacucuaaaagcagaaccacauggcugaagcuaccaaguucugcugcuugcuggggcugcaacuugacccccuuguucaaauaccugcuuuuugcuucccaugguuuccugcuuauguuuuucuuuacuuccuuuucaccagcuggaugcuuagcuggguggggucuugcccugaggucaccacucccuuuauuccauauaggaucaggcuuuucuuuaaacuuauuaccuccuugagcacugggguuagcuccauuacacuuucuuuucuccucaaaguaugcauucuguauguuuccuuguuccguuugcuccuuuucauuacagaccugcacaagagugauugcuaauaaccacacaucagucaacacuaggcugucuugaaaucccucugccaaugccucaggcagauuuuuuuuuuuuuugacaugagcagaaagcagccacauucaaaauaucauagaaguaucagucacuuacuauuaucuucucugaaacuucuugagccagaucaucauaacuuaaauugcucuuagcacuacugucuucccuguuccuaguaguauggcccauuaagcuccccccaacaagcagcauggcuagaccuaucauagcaauaccccgcucccugguaccaacuucugucuuaguguucuguugcugugaagagacaccauuaccacagcaacucuucuaaaagaaagcauuuaauuggaacuugcuuacaguuuuagagguuaauccaguugucaucacaguggagaguauguuggcuugcaggcagacaggugcuggagaaguagcugagaguucucuuaucucuuccuccaacaaggccacauguacucuaacaaggacacaucuaacucauugguucucaaccucuggguuaugacccuucugacauccucuaucuccaaaaauauuuauauuaugauucauaacaguagcaaaguuucauuuaggagcgggguauugcuaugauaggucuaaccagguggcuuguugguggaauguagacuuugcauugggaaagcaguugaaugcuuuaaggggggagcuuaaugggccauacuaccauuucccuaaaauuaguaaauguaagcauugcgcaucgccacacccugccgugugugugugugugugugugugucugugugugugugugugugucuaauuaucuccccuucccuccuucuugccccauccucucaccaagguguugagaagggaauugcuucacuggaagccaaccaucaccuggaaucugauccuauccuuucagcuuuaggaggauguguguuguuuagggaaacuggaaacuaauucugagauaacauagaaaucuuucucuuuuuuuuuuucugcuuccgcuuccuccucuuccuucuucuuccccugccuccuccuccuccuccuuguaggaaacccagggccuugcucugugauccagcacuaagcuauaccacaacccccaaaauagaaguauuuugaagcuaaaaggaagaagaguggcucuuuuauuuaaccugguaaagacagagcuaaguuccacuauaggacaggauauggccacucacaggagcaugggaagcugccauuuugacugcuggguauaugucugucagaugcuugaaaccaugauucauagcaccgauuagauuaaaaauguuuuauuguuucauguagcaaaccuaugagguagcuacaguuuguagaccugcuaugauuccugagcucgagccucuggcagacccaugguccucuuccagucccacauccuaacccucucuuucccuugccuuacucuuccccauuuacuacucccagagccugaucucaccauauuggucuuaaugcaccacaggucuuggaguuuagaucucagcauuaaaagguuucaaugucaugauggaagucauaguaucauaaguauugagccagauggggugacucacacuuaucauucccaggacucagaaggcuggggcaagaaaauaggauugccuuauuuuaaacucagccuaggcgacagaguaagugccaggccaagcugggcuacagagugagacuaugugucaaaaaaauuuuuuauuauuauuuaaaagcaacaggggcaggaaagaugauucuguaauuaagaguucuugcugcucuuucaaaggacacaaguccaguucccagcacccacuuuggguggcuuacaacuccuuguaacuccagcuccaaggguucucuuauauuuggccuccuuuggcaccugagcucucauauacauuacacacacacacacacacacacacacacacacacacaauucuaaaacuacaauaaaaaucuuaacaacaaaaagccagcaagauggcucagcaguuaagaguacuugccagucaggucuaaguuuuauccuguggucccaugauggaaggagacaaccaacucccaaaagcugucuuuggaccaccaugcauuccccagguauucaugugcuuccuccuccagagcacaaaauaacaaaugaaauguugagcugacucaguagcagguagaguauagcacugaagccugggggguugaguucaggcuccagaacccacggggaagugaaggucaaaugacuuugcuaaguuaucuuugacuuccacacaagcaguauggaacacucacacaauaauaagaaauaacuuuaauugugguguaauuguauaagaauacugaaauaauccuuuucaucuuaauguugccuugcuuccuuguagaucccacacaaacuaguccaacugcaauaaauuugaguuucuucuuuguuucuccccaaagaaauuuaucuaccagaugaauguaaagcuaagggaugcucaguccuuccuugcucagaaauccugagaguugugagaggacccuguaaaugaucaacugacacaagaggacaucuaagagaggacagggacacaagugggacagauaguucuggaaaucucaagacuggcugacagaagcuagccuugauaaggagcuuaaacacagagccaacuaggcucagaauaaaaaagugccucccccagaggccugcccagcaagacacaggacaaaagcagcauagaaggacagagcgagggagggagggagggagggagggagggagggagggagggagggagggagggagggccagcuucucaugggcaucuccaccauuaguuaggacuugaagagugagugccagauggggagaagugagaaugcuaagugcagcaagccuuucccagcaaaaccagagugaaaaguccaucuccuuuguacuuaccccguguagaagaaagagauuugggguguuuuguuuuguuaguagcauauguuuuuuuuuuuuuuuuuuuuuuccucagagauucuccuucccccacugaaaaggcagucuccacuuugaacacugucgggagcugccacccaccccaugacuccugggccaagaugcacauugcguccuugcaguacauuacucagaaagggagggaaaaagccaaauuuagagugaucgagcugcuccaaggccaugcguuuucugaugagucagagacagaggaagacaaugagccugagguacagccugagagaaagaagauaaaggcauccagcaucccugagaagagcuggaccaaacgagacaguaagccuaacuuuccaagcuggucagcccuggauucuggacuuuugaaucuuaagagugagaaguugaacccaguagagcucuuugaauuauuuuuugauggugaaacauucaacuugauugucaaugaaaccaauaauuaugcuucucagaaaaaugucagccuagaagucacagugcaggaaaugagguguguguuugguguucugcucugcaguggauuuguaaggcaucccagaauggggauguauugggaaaucucugauucugaucagacccugguuagaaaugaaauuagaagggacagauuugaauuaauuuucucaugccugcauuuugcagauaauaagcaccucgaucaaaaagauaaguuuucaaauuugaggccucucauaaagcaaaugaaaaauuuuccucuuguaugccccccugaggaauacuauuguuuugacaagucaaugugugaaugcuuugauugugaccaauuucugaaugggaagccucuucaaauuggcuauaaaauuuggugugguacaacuaacuacgcaaggcuaucugguuugguuugagccuuaccaagaagacucggguguggauaaggagcuggaccuugggccagguggaaaucuaauaaugaguuuugcugauguucuucuggagaaaggucaccaucccuaucacuugaguuuugauagcuucuuuacaccuguuaaacugaugucagcuuugaagaagaagggagugaaggcuacaggaucgcuuugugaaaacaaaacaaaaauguccacuuaugaauguggaacuuaugaaaaagaugaaccggggguauuuugauuucauaguggaagaaaaggaggagauauuuuuaugccguuggcauggugauggcuuuauuagucuguguucaaaugcuguaggcauagaaccagucagcaaagcaagcuguguagcugacgauaaggaguuccuuccuucagguaacauccauugugaaguuaugugaggaaugcaggaaagguguagcuaaaauggaucaaauuauuuccaaauacagggugggauuaagaaguaagaagcggcucuggguuuuggugaguuacauggucgauguagccaugagcaaugcguggcaguugcacagaaucuguaacccaggcuccccuuuagaucucccagguuuccagaaauguguggcauguuuucgcuugggacaugaugcuaaucugucugauuaggacgcguaaagaacacaguaacaacacacacacacaaauuauaaguguaguaaaucuacauuaccaaagcaaauguaauggagaaggugugauuaugucacugguauuguuuacaucaaggauuguuacagcgaacaaugcuuuaaaaauaacauucugugaguguuggauuuguguugcuuuuaugucuaguuuugggucagauauaugaaaugacuuacuuguuaaauauuuuauauauuaaaagagcaaaaaccuaccauuuccucacuuucaguuuuguuuuagagauugacauuuugaaaaugcaggcaauaucacacucuauagaaugacacugaauucauaguccagaauagauacaaaacagauauacaacucaugcgggaggauaugcuaacggauauagguauaagggaguaaauauuucagcuggaucacacuauauguauauaguugagacagggccaggcaugaaaauugcucugugugugugugaguguguguguguguguguguguagcugugccuuugaauacugaagaaaauguuaugaguugggagaagucagagagaggaaaguaaugaagcaaucuguguaacaguuauccugagaagaaagcaaguauaaggugauuggacauagucuagauugaggucaucagugguuacucauccaaugagagacauuuggagcaagugaacuaugacuccauaaugcugaagauuuguagggguaaauuaaacuaaaggcaaggaggauucgacaccauuucugugauuauuauuuaauuauuuauauaaaauaaacaaacacaucucauuaguucuaaau

SEQ ID NO: 6925 - RNA, 5467 nt, Mus musculus
uacauuuauacacauggcuuuauuuaaguauuuccugcuauuugcagauuccuuucccugaacaccaaaaauaaaauaauuagugauauauauauuuacuauuucagguaaagagacaaggagugagaaugggaaucucauugcagggacagacucuuguggaagaauggaaucaucuuguaccaugacugaacccauugaggcccagugugaggaccugagcuugaaaaagaauccagccaugcccaaggaaaaaacuaacagccaaugcuuggaaacuaaggagagacuuguucagaacucaggccugauugaacaugacagggcacauacaggagaaauguccugggaaucuguaggaucucagaguucuguugcugcugaccaucaggaaaucucuaaagacaaaggucaucccugccaagagugugggaaagucuuucagagaaguucacaccucaucagacaucagaaaauccaucuuggggagaagccuuaccagugcaaagaguguggaaaagucuuuagccagaaugcaggucuuuuggagcaucucaggauccauacuggagaaaaacccuaucuguguauccauuguggaaagaacuucaggcgaagcucucaucuuaaucgacaccaaaaaauucacagucaggaugagccccgagaaugcaaggagugugggaaaaccuuuagucgggcccuccuccucacccaccaucagagaguccauggucguuccaaaagacaucacuguaaugagugugggaaagccuucagcuugaccuccgaccuuauucgacaucauaggauucacacuggagaaaaaccuuucaaauguaaugugugucagaaagcuuuccgccuaaauucacacuuagaucagcauguuagaauccacaaugaagaaaaacccuacaagugcagugaaugcaaugaagccuucaggcagaagucuggucucuuucagcaucagagacaucaccauaaaagcaaacuggcuugaugagguucucuguuugaaacauggaaauguuacauugauaagcaaacagcgccuuuugaaagaacucacgacggcuucaggauucuuggaagccauuugccuccguugugucccucucuuggcuuuacuuaaagucauaauuagacuauaauaauuuaccagaauagcagaaucagaguuaaacaaauauucacuacagagcuucucagagcuuucagugugauaaguacuugauuauguaucucuuaaguauuagcuuuaugugugaaugaaguguuugaaaucaguaagucaagugccuauagauuuauacaggacaagaucaagcugauauuuuuguaaguacuguagcaacaggcuccuaaaacauaaaauuaaugaggguuggggauaugcucagugguuuaaccaaguugcuaugcaaguggaaggacuguuuuggauccccagcacccauguaaagucaaaugaguauguggccagccuguggccuguggucccaccccucagguggcaaaaaugggaucuuucuagcaagcuggcuagccagacuagcuguaucagcaaacuuuggacucaggggagggaguuuggagagcagucgguggaguucuugaggaagacuccugaugauaaucuaagugcacauguguccauacguauguagagccauaccugcaaacaucauacaugugaaaagacaaauccuaaggagcuagaguuagcaguuaacauaccugcucuugcagaggacccauccauuuucaguuccuagcaccuccauagcacagcgucucacaguuccaguucuggggaucugcuagccuucucaggcuucuguacacagugguccacagaaacugguggacacacacacacaacugguaaaauauuuuuaagcccaaaauaaaucuaauaaugcuuagaaauacacauccucaagggucuaacguagguuaacugaacauuuucccuguuagguucacacaaacacuggcuucauauccacuuuaccuuuguaccaucaaugaaugcauuucugaaagcuuuugcuguuuaacuauagaaccuacccuuaggauuagcucaugucauuuuacauuuccugcccauuuuaaccacaguaucacaguguuucaaauuauaaaucaaaguuuuaccuaaacuaugcaagagacuuugagucauuugagugaacuguguugaaguauucuaagcagcgaccuccuuacugggcagcaacagugccaguacagugacugcuugaaggacaccuuuuuucaugaaugucccauggggggaaaugggguuuucccccuuugauaccaaugaugcaaauuuaaaugcuacuuguuuugauauuauuuugaccaugcaaaucaaaucagcucggagagaucauggccaucaggucauauugacugucuugcuagugaugaaaaguaauaagcuuggagucuucccaagcccagcacccgacugcuaaacauggcuuaugguugguaauugcacaggguguacuucucagggaaagggcuucuuaaguuaugccgcuuugggaagagaaggggacccuuguacugacuacaacuugguuucacuacacuugacuuacaaauaagccaagaacuuagcaacauagaaaugcuuauuuuucuuguccgauagaaaaggauagucaguccaaaacagauccaugguaaaccuagucagcuugcugccagucaugucuaaggaggggacaggccaaggacugcuaggcaccuaggugcaauucugacauuaaucuucuguuucaugcccuuuuuuuuuuuuuuuuuuuuuuuuuuuuugguuuuucgagacaagauuucucuguguaguccuggcuguccuggaacucacuuuguagaccaggcuggccucgaacucagaaauccgccugccucugccucccgagugcugggauuacaggcgugugccaccacuccuggcucguuucauccccuuuuaaccaaacuuugcucugcacaaaauaaggcccucuuccuuuguuaagauuugaccuaagauacacucuaagcaaaauuggggagagcugcacaaagggacuggcugaacugagaagaaccucucuuggaccuuuugcccacacuuugcaugugauaguugcaacuucagcagucauauggccuuaaaaacugauggcauggaccaagguuagguccucaacaccacccaaaauaacaguguuagcgugugaucagucuccuucauguuuaacuccgauccacaccaaacgugcauguaacaggcauuguaacccuuguaauuccuaagccucagaagaaacacagucuuagaacaugcuuuacaucucuacuguggaacauccuuuuaugcaucacuguuugugugaaagugauguuccuuuucuggccuuucucuuagcuucuccuuuuacuuccaaacagcauggcccuuaaaaauuagagaacuaucaaaauuuuaaaugcacauuauucuucgucaguuuguguguguaauauuuacucaacaaauauauuuaaagcaacauaaaaacauaauuauugauaguguaaagagaauacuuuucuauggaaauaaugauauugacaguauuguaaacagucuguaaaguguuaauaaaguuucaaaguaauuuuugaauaaaauuaaagcuauaaaaagaaaguaaagauuuuuaaaugguguuuccuacagcauuacuuaauaaagaauauaacuaaaccugcauuauugaggauaguuaaguaaauuauuguacccuauacaacggaauauuguugggauguuuaugcuuaugggucugggagaggcucgguugguaaaaugccuaugacagugguagggaugguaguauagagcuauaaucccccugggggugggggauccccagagcuugcuggcagccaauguagcugcaucagugagccccaagauucaguaagagaccuugucuaaaaaauaaaguugaagaguuauagagaaaagccucaggaaucgaccucuggccuccauacccacaugcacauguggauguucauaaacacucaaaacaacaauauuuuucagcugcuauagaaaaaggauugcugucuuagccaaauaauaaagugcaaacuuacauuuugauuuccguaagugcuucaaaagcuauuauucucgaugaacaaaacguucccaaauguccugagaauuuauaagacaucucuaggaagguuguggugguagauccgccaguaagugcuugccaacacaccugaguucaauccuugagacccacaaagcaagagagcuccaaguugucauaugaucucccagucgaauacacaggaaguaaauaugguuaacuuuugaauucaagcuaccugggauuuugcacgcauauaaaaucuguauacucaccuuagggcuuuguuggguauuuacccaacugacuguccgcacaagacccuguaaaggccaacucagcuuugucuuuauggaagacagucuaggaaaauuuuucuuuuguggugcuggggaccgaacccaguaaguaugucaagcaagagcgcucccucagguacauccuacaggguuuuuugguuuuuuuuuuuuuuuuuuuuguuguuguuguuguugaaaugauuuacggaaaugagcgcguguuugguuucuucgaaacuaccaggagaggugcgggucaggaaaaccacgaccuggcuccaccggugcaccagagauugucaccaggcuucuaaggagcacaacgcuugccggaaguugccagugagucuccagcuccaacuacaggaagugcccccucggugcccagcuccgucugcaggaagugcccccuguccuucaucccuuuggacuccuucccgccgaccuucaucgucgcgggcucggagacuaacagcaagaaccgccaggcuguggcgcucuggccucuuggcucuggucgcaggcuuuuuucaugagcuucggcacauccucacguccucguagcacacguucccuaaacuuuuaagcagcaaauagacacccuuagcugcugggcgcuggcguauauaauuuuagcguagaucugggcagguuagagcccuggcgaaggcacuacagguacaucuauuacguucguccggucuuuguuggguaucagguacgugcugcgauucuaguuuauguagaggucugccaggagcagggguggcugugcagugaucugcaauagaagcuggagaacggaguacgugcacccagaggugcacacccgguugccaccuguguggcucaguuuucccauuccuauuuuagguucgaggguagccacgauagauuaugcagguacagagcaggucuugugucaguaggaauuuacauuggaaggauagaccaauacagagcaggaaaaaaaacugucacccugaauucgaggaacugggaagucca

SEQ ID NO: 6926 - RNA, 1737 nt, Mus musculus
uagugcgccugcgcugugugcggguugugcgggagcugcgugcucucuguguugugacuucuggaauaaccgccaccgcggugguugauugaaggcggaccaugucgccuguaucccgaucucgcccuaaugaggacacucugggcucucagaaacgacgacguuucucggagagcccaccgucggcguuacagacuagccgaucaccucggggaggcgguuucggcucucuccucagcgguccugaggggcuccagccuccgcggggugcucagggcguccggccacugcaucccaucagccgccccaggucuggagaacgaccgcuaccgcuggggauccguacgcuugccugcucuuccucucccaucugugguggauaccguuaccaccacaacuaugcgggagauccuucgugggcugaggaccaggagaaggaaaaggaggagaguuauaggcaaaggaggcugaaggaaagagagaggauuggagagcugggagcgccugagguauggggacugucacccaagauuccugagccagauucugaugaacauacaccagcugaagaugaggugaagaaucagaagaguagcaguucagauuucaccaaugaagaaaaaaggacaaagaccagucauucaacaaagaaaaaaagaaagaaaaagccuuccaaaaggaagcauaaaaaauauuaugacagcaguucagacugucauucuagcucugauagugauaaaaagaaaguuaaaaccaagaagaaagagaagaaaaagaaacaucgggcaaaacagcucaagaagaagaggacuaaaaaagaauacaaugacauaagcugcaaagcuucagaaagggacuugccagaagaugcguggauggaacagucgaugagugcagagagcauggauuuaauaggcccagaagcaccugugauacacaccucucaagaugagaaaccuuugaauuauggccaugcucugcuuccuggugaaggugcagcaauggcugaauauguaaaagccgggaagcguaucccacgaagaggugaaauuggguugacaagugaagagauugccucauuugaauguucagguuacgucaugagugguagcaggcaucgccgaauggaggcuguaagacugcguaaagagaaccagauuuacagugcugaugagaaacgagcccuugcauccuuuaaccaagaagagaggcggaagagagaaaauaagauccuagccagcuuucgagaaaugguguacagaaagacaaaagggaaagaugacaagugacaaccuguuuguuucacugugggacguuuaacaacaaaggcuuuguauggccaaaguaauaguaaaugguuuuaccauuuaccagugcuauuguaccuacuguguuaguaaaaagcacuuuuugagaugucauuaaaauuuuuuacaaacauugcagaaaaaugacuaaaaaguugaaugucacuucaguccaugauuuaccucccuaaaaaaaaaaaaagucucuguauccuuccaugguuuuugugcauauacaaguuuguauuuugcaaaauagaaguuaguacuacuaaacugaaaagugccuagucccccaucugcuacggugauuucccccuaaccccgucaggaggauuuuaauuuuuggagucauuuguccccggacaaaaagaacguaagagcaaugcccaagaagcugaacguuuuggaacuauuuggauccaguggg

SEQ ID NO: 6927 - RNA, 3685 nt, Mus musculus
acuuuuaaagcauccauuuuuuuauuucaaaguuccuugaacuagcaaacagacacaagccauggggucucaaggcuccaagugggguauguagaguucuuucuuaaaauguuguguaaaacauaguggaaaaagagaaacugaaauuaggggcuuggcaaugugacauacagauugcuuacuaucacagaauaggaaauuuugacucagucucaauuuccuccuuacauuuacuuucucacaguggguaucugggggcaugcguugguccucuacugaaaaacaaauuuaggagcugagcagccuuagcucucaccugauugcugccugcagcuuauaacacagcaucugggaaccuuuaaaguuagaguugcccacaaccugaccuuugcacaaauagagaaaauacagccaacuuuaguacuuuuuaagaugaauuaugaggucaagugaaaaaauuacucuugucauuuauccuuacacuccagcugguaaagaaaaguucaaucuaggauuucaacaguuugccuauugggaguguugagaaauguugucugcaaaugcuguaaauggaacuccacuugggagaaaggaguggguuaugaguccuuucaggcucucagcucagagaguggaccccauuaguaaccggguagaugauagccagccccccucuaugcuagaauuucagaaacacaggguucugaguuugcuucagccgucaacacagccuuucauuuccacacacugacaauacuaacaauucaagauguguaaacuuucucaaugcaaaaggauacuucaguuauuuaguuaaacaaucuccuuuuuauuauuuauuacuuauuuaauguauaugaguacacuguagcugucuucagacacaccagaaaaggacaucagucuccaccacagaugguugugagccaccacgugguugcuaggaauugaacucaggaccucuggaagagcaguuagagcucuuaacuacugagccaucucuccagccccaacaaucuccuuuuuauaauggguuuuuaucaggaugacaaaauguuugcagaauggaaagacaugauccuaaagugagaaaaguucaguuaauaacauuuagaggcucuguaaucuccccuccacucugcauugucuucagucguuauuuuuaugucucccuguccuuugacuuuucucucuuuaguguccuaacuacugaggaucauggggagauauaauuugcacuggcaaaugccaccacacacaguauguucagaaugacagaagaaagcucauugcuuuuauaauuauggaaaguuauaugaguaagaaguuaauuaucuuauuuucaaccacagcuugagagucugauugggacugaauucuagcaaauaauugccacauugaagacuagccuggaaagcccacugacccaacacauauguccuuauaaugagacaccuucugcauaauauuugagacuaugucacucuucaauaguauuguuagggagaaucuacagccuuucaucuaaucaucucuccuuacccauucauucauucugcuucagaauucuuaccagugcaauauuuucuuuccuuccuuccuuuuuaccuucucucaucucucccuugcuuuucuauuuucuuuuuuguuucauauuccauuuuaauuuucuuaauuuuuaguuuuuuuaaauuucuuuuuauauucagauacuagcccccugucaaauguauauccagaaacaaaacaaaauaauccuauuccuuaggcugcuucaucauuggaauguugguguccuuuccuauaucgaagccuuuuaguuucaugaggucacauuuauuaguuguucauguuaacaucugugccaucagaguccuguucagguccuuuccuaugccaaugaguucaaggcuguuccuuacuuucuccucuaucagagucaggacaucaugucuuauguugaagucuuugguccuguugaagcugaguuuuguacagggugaaagauaaaguucaagcuucauucuacauauaacuauccagguggaccagcauuacugguggaagaugcuauauuuccuccaguguguauuauuguucucuuugucaaaacuuaggugguaguaagagugugaguguaugugugggcccuuaauucuauuguauugaucaacauaccuguuuuaugccaaugccaugcucuucuuauuauagcucuguuguauaacuuggaauuuggauguuuuugacaaagacaguaauaaaaaauauugucaggauuaugaaugaauauuccugcuaauagcuagguaggaauuacuacaaacaaaaauuaaccaauagcaaaaaucaaagaacaaacauuauaaaugcacccaaaugaggaauuuacuuuuuaaaauuuagcuuucaguuuagaggugugggcaugggcacagaaacuuuagaauuauuuaaguaacuggcuuaauuguaacugaacuguuugauauguguguguguguguguguguguguguguguguguguguguguguguguaacuaacaauaccaguugcauaaauguuuucaaaugugugguagaaugagaauauguaaugauaacaguuaaaaaaaugugguuuuaaacaauuggaaaagcuaauaaauacauauuaaauauacuuauguuaaacauaaauaguguaaauugauuuuauaaauuuuuguuuuucaggaaaccauaugcuaaaacauuaaucaugaguugggcaaacgagagcaucacaggcgaguuuguucucuuagguuucucugaucaaccauggcuggaguuuccacucuuuguggucuucuugacaucuuacauagugaccaucuuuggaaaucucaacauuauucuggugucccauuuggauccuaaacuccacacucccauguacuucuucuugacuaaucugucagucauagaucuuuguuacaucacaugcacagucccacaaaugcugguaaacuuacgcagcauuaggaaaguaauaaguuuugguggcugugugguccagcuuuucauguuucuggcauugggggcuaccgaguguguucuacugccagucauguccuucgacagguuuguagccauaugucggccucuccauuacucagucauuaugcaccagaggcucugccuucaguuggcggcuguauccuggaucauuggcuuuggaaacucgguguggcuauccauucuaacucuccaguugccacgcuguggccacuaugucauagaccacuuucuuugugaagugccugcacugcucaaguuguccuguguugauguaacagcaaaugaagcugaacuguucuuugugaguguguucuuccaccuaacaccucucucucucauccuuacaucauaugcauuuauagcccgugccaucuugaaaauccaaucugccgaaggucgucaaaaggcguuugggaccuguagcucucaucuaauagugguaucacuguuuuaugguacagcucucuccguguacuuucuaccaccaucaccacacuccaagaacaggagaaagauggugccacuuuucuauggaauuauugcccccaugcugaacccccuuaucuauacacuuaggaacaaagagguaaaggacgccuuuaaaagguugaucaagagagucuucuuaagcaaaaacuaag

SEQ ID NO: 6928 - RNA, 3745 nt, Mus musculus
cucaggcucccugucagcaucucuguucugagcuguccugagugcagucaugucuggcagagguaagggcgggaaagggcucgguaaagguggcgccaagcgccaccgcaaagugcugcgcgauaacauccagggcaucaccaagcccgccauccgccgccuggcccggcgcgggggagugaagcgcaucuccggccucaucuacgaggagacccgcggugugcugaagguguuccuggagaacgugauccgcgacgccgucaccuacacggagcacgccaagcgcaagaccgucaccgccauggacguggucuacgcgcucaagcgccagggccgcacccucuacggauucggaggcuaagucuuugucuuuuauuucugcuacaaaaggcccuuuucagggccacccacuuaauucuuugaagcgcuguacucaugucagaaggguuagaaaguccucaugaccaagaauacaaguaaugucucugacaugggugaccuacuuuguaauggucagcuuucacauuuuuguguaaagugaacuaauugguguaucagagaguuuuaacacgucaauuaguaaaugccauuuuccuggcuuugugcuuaagacaugaucuuuucugugaucucacuuaucgguauaauugacaguauuacaucacacacacacacacacacacacacaccagcugguucucuagcucucuaguacagauaugccauagagggggggggggggcuuuugaguuuuaggaguagugcuggagauugaauucauucuguagauacaacauuaccagcaucccauaaccuucuguuugccauugcuggccucaaaccugugaucuuucugccucugccucagaaguagccaguauugcucccagaucaugcuucagagcugauuguuuuucccucccagcaacucugauuucagagucgcugagugguuuugcccaaacuaugacuuauuagaacuuccuguggguugcuggucuuucaggcaacauugaaaccccaauguuugacaaugucuuuucauuguccgcauuuggugaguucuaacacaucauuugccuguagaacuuuuaagucacaaacuauuucuuuccacacuccuuuggagaucccauccacugggucauuaaauaguaucuguuccuuaaugacuucuaauuuuauauuuguagcuuaaguuuucuuauuuagcuucugaauguuuaguagccuaaggcuaauaaauacaacacaguguccuaacaggacacugcaaccaguauccuuucucuuuuacaugaaaaugaaagcacaauuaagcaccaacaaaacagcucaaccacugagggauaucuuauucuccauaacaauauauaaccacccaaaugcaccacaaagcaagcacuucaaugguguacagcaacuuggauaaaauuuauaugcaaauauaguuuauuaaauuuauuauggcuggaguaguggcucaaagguuaagagcaauugauauucuuuaggauaagaguucacuuccugguacccacuaugagcaacucauaacucacuaacuccaacuaaagaauaucugauucccucaucugacuucuacaucaucgauguccacaucacucuuuuucuuaaauaaauaauacaaaauuugaaucaauuuaaaugcaaauccuacugcaaagaaaaagaaguggagcaagauuuuauuuauuaauuuuuuguuuuguuuuuuguuuuuguuuucuuuaucuuuuugagauacccccagcuggccuugaauuccugacuuaguuuucugauuuaaucuuuggagugccagaauuacaacauauaacaucucuggcuuauuuuucuuacugcugcaucaggcuucuucauugguuaugaagacaagugucccaguuuggacaaaguggaaaguagcuggaccaaugacuccaguaagcagaaaaauuggccuggacugucguggcucaaccuaaacuccuugaauacucugacguuuuauugguaguuuugcaacuaaaugcgccuaguucuagaaugaauagcaccauuaaauggcuggacuuaggcauuucauauacgaaauauauuuaggauaucaugaauuuuagcauucagguauuuuauguuuaaauaguacaucacauauaccaucagucucuuggaucuuuaucccuuuaugugcauuaacacaacagcacaguuugcuccauaucuauaucaaacacacuuuaggaucuuguuuuaccuaucaugucuguaauuucaaauauaccagaaaguuacauuuauaaugcaaggauaacaagaccaugaauuucucuaaguaugguucaccucuggaaaagaugcuuaaugauaugguauaaaaaaucuaauguuuacuucugcuguauuucaaugauaaaguuaucaaaaguuaaaguuaaagaacauaaaagaacauacuuuuuuuaaaauauaaaaaaauaaaaaauuuuaaaauaacuuuauacuugugaaauggaacuuaauagaauauuuuguagaaaaucugcucacucuuuuguguuguuuuaugaacagggaugaaaauaugaaucccauuuucuacaaagcuauuauacuuaaguauuugugcuaauauuguuagauguguaaucgaauauuuuuguaaaguuucagaagauaguuugcaaaagcaacagagugugccagauaacaacacaucuguggauagaagagcacaguggauuuggcacauucaguccaaaauaauuguugcuguguuaucuugaaugaaaaacugggcuuugguuacggcauagaaaaucuaaaaccaguccaggggcuguguggcaagugucuuucuuaggcauugccucccucaggaugaacucgaguguuucgaguaucagacccucagccuguuuguuucagucccaggucucuggcauugcagaucuuuguugugcaugaccuucagagacagacagcucauuggaacucuuccaaaaccugggccuacccucagcaucuguaccucuccuacccuguaaccuaccuacugucugaagucuuuggccgcaucgucaugcugcugcauucaaguucugaugccucuggaaaaacugguugucagucugaacuuugugucaugguucuuugacaaguguauggaaaggaagaacuguuuguuuuugacaaaauagaauaugccuugcaagaaauuacaucaauaugaggaaggguaauguuguguacuagauauuacaggaucaaaauuauggauaguguuaaaaucaaagaggcuucuaguacauccccagacgaguuggcuaugacugcagucaaauaaucauaacauacauaaggacaaaaccagucuguuggcauuuuuguguuucacuuuuguaauaaggaauauaaaauguuuuaucuuaaaacauauuuugaaauaguugguaaaccuucauauugaugaaauucuauuuguuaacaagggguguacaguuuucucaauuuucuauaaacaauguauaauaguaguuuucacaauuguauaugacuauucccaaauuguuuucuauaaacuaaggaaacaauauguggccugugcuuaacuugguaaacuucaaaaagauccauuauaaccaacacuuuaaugcuuucuuucucaaaauguauccuuuaacuggaaaaauauuaacaauaaagaguuuagucauguaucccuaaguaacagugggggcca

SEQ ID NO: 6929 - RNA, 745 nt, Mus musculus
caucgcaaaauuugcucuucgcguuagauuucuuuuaguuuucucgcaacuagcaagcuuuuuguucucgccaugucugagacugcucccgcugagaccgcggcuccggcuccuguagagaagucucccgccaagaagaagacaacgaaaaaagcuggcgcggcgaagcgcaaggccacuggccccccgguguccgagcucaucacuaaggcuguuucugccucuaaggagcgcggcggcgugucccugccugcccuuaagaaggcacuggcugcugguggcuacgauguggagaagaacaacagccgcaucaagcuugggcucaagagucuggugagcaaggguacccuggugcagaccaagggcaccggcgccucugguuccuucaagcuuaacaagaaggcggcuucuggcgaggccaagcccaaggcuaagaagaccggggcugccaaggccaagaagccugcaggugcuaccccuaaaaagccuaagaagacugcgggggcaaagaagaccgugaagaaaacuccaaagaaagcgaagaagccugcggcggcuggagugaagaaaguugccaagaguccuaagaaggccaaggcugcugccaagccuaaaaaagcagcaaagagcccggccaagcccaaggcggugaagucuaaggcauccaaaccuaagguuaccaagccuaagaccgcuaagccuaaggcugccaaggccaagaaggcuguuuccaaaaagaaguagg

SEQ ID NO: 6930 - RNA, 580 nt, Mus musculus
ggauggcucugaaaagagccuuuuuuuuuuuucuuuucgggugagugaacggcuggucuuauuuucccuuggccuugugguggcucucggucuucuugggcagcagcacggccuggauguugggcaggacgccgcccugcgcgauggucacgcggcccagcagcuuguugagcuccucgucguugcggauggccagcugcagguggcgcgggaugaugcgcgucuucuuguugucgcgggccgcguugcccgccagcuccaggaucucggccgucagguacuccagcacggccgccagguagaccggggcgccggcgcccacgcgcuccgaguaguugcccuugcggagcagccggugcacgcggcccacggggaacugcaggccggcccgggaggagcgggucuuggccuuggcgcgagccuugccacccugcuugccgcguccagacaugguagaaaguagacagcuucugaaaaccguacgcuugcaaagagcaagagcuuggcccuuauaguuuucucugggcgcaaaaaagggccuaugcgauuggcugacuucuucuuuucuucuagacgaaug

SEQ ID NO: 6931 - RNA, 580 nt, Mus musculus; identical to SEQ ID NO: 6930

SEQ ID NO: 6932 - RNA, 8028 nt, Mus musculus
auaggggugagcugugcuacagccuaagagacuagcuuugggaccaacccccaaacuggaacguagaaaaccagggggacuagccagaacucaagacuuuucaggcaagaagcuagaguacuggagaguggugacauuugcuuguggggagaagaagggaguaaagaagguacuaaaggaagaucaaaagaaggaggagguuuguguagccucccauuuccuccaaacggaaacacacagaaugcagggacagacuauugguucccuuuccuagagcugugaccacauaagugacaggaaacacugagggaagggcggggcuugcuuuggcucgcauuauggaauacagcccaucacaguggcagagguauucgagcugggcugugaggcagcugcucacaucaugcccacagucacagcagagagaaaugaaugccggugcucaccauuucuuuuauucagcugggaguucaguaauggguguuaccaccauuucaggcgggucuuuccucuucaguauaacuuuacugaaaacgugcucaaagguagucagucaguccaggguuauguuuccaugugauucuaaauucagguaggcugacaaugaaguucaacuaccacagacuaaaacucaggagagacagagucaggaugugaagaguucuaugcaguaggugccagucaagaaugaagagacagaauuuaagccagguucuuaucugggagaaggcggcuccagcauggaaagccacauuccccugacauuuaccauacagaauaucacuaccuacaaaggacaguaaucauuugccuacauuuauacuaauccgugacaaagaacuucuaguuggcaaugaagauaaauugagaacaagcaggcagaacaggcacugagucccacgucuaggaacuuccuccuuccaaacagcuguuuucucuucuacagugaagaaaaaugccaggaugcaguuccugugaugggacugucaaagggcuggguuuugaucccacaucaacucuggcucuucuuuauaucuuugagccaauccuguaauugcugggagauuuucugugaagaagagauggagaacauucuggagucagaacucagcaccaguaaaagaugaguuauacaaauaaguaugugagugagaauauaaaacauucaggaucuuuucucuuaccugacgucccaggcggaggcugggagagucugaaggccucauaggugccauaucgaagcagugggaagcacuaggaauuagaagggcuggcucagacaguccuaaguccuguguuacgcucaauacaugccaaggaucugugucuccuggaaagaaaggagaggauggcacugcacugagacuacaauguuguagagccaggcccuggugguacacucaccauuaacaaacaguacuuggguggcuccagggcucugaccaccauaauaggaguuugucugggccacagccugggcaacagaugcaggugagaggccaaacacuuguucacacagcucuagcuggaagggcagugcugggagcugggaaaaaggacacugaagacccucacaggugacaucuguggaaugagaauauuuugaaguguaaagaauacauauagacagccuccugcucuucuccaauaguaauuuuuagaacacccacaguagugaccucgugaguucacaguucugcccaacagacccacaucccagaucauuacauucccaagugacagggcugugacagaaaaggacaggagguagggcucuuagagagaacacaugggcccagggagggcauucugcaagaagaaggccuugaguuaggauggguaagucaaacaaaaagaagaaauaaccaacccggaagagagaaaagugaacaugcaaaggauuagaggggagggagaaucuggaaugacugcuucucaaauuggaucauguccacgcugcuuaaaaacccauaucucacaguguucuggguaaaucauacuuccuugaccucacaugaguuccuuccuucacauuugcugagcaccuacaaugcacucagacaucucuugggcaauacugggcagaaaguggcaaccaauauaguuccauguucugcuguuauagcacucagaaggggacauggaaugcuagcagauuagaauguacuaaagaacacagaauaacagaagugggacuuuuuuuuuuaaucuauagagaugaugcaagauauugagggaaggguaucuugaggugagacaggaagaugagcaaacccuacaaaacgggaaauggaucacucugguacauugaacaggaugugccaaauuccuaagcuguagggggcuggugcauugggcagcccaaaauaugcaaagcuguguuauaacagcaguaagaaaaguacuguuauuauucucaguuuagagauguggaaccuggcuaauaacaguuaggcacuugcccaaguuuguccaaaagcacacagacagaaaauggaauuuggacauuuuauuucaugccacuacccucacuugucuucagaaaguguaggaagaauguagaauucaacucugaucugggugugguagcauaugccugucaugucagcacucugaggcugaagcaggaggacugcugugaguugaagguaaaccugggcuaccugguaagacucuguccccaaaaagagaacaaaggcuuagcuccucugggauggaaugaccaaauuugacaaaugauacaggauaccuauauuuagauacacaaacuccccacuacuuuuguacaugugaugcaugaguuuuuaaucugcaucauuuuuguuucuuuucuguaguuuagaaacuacauccuguauuuuuugcccggcaacuacaacauugagucacugaaaugcaaucccauauuuagggagauuucucuggccaugguguagaagucagacugcacaggugaaguacaagcuuugagaccgaagaagucuggguuccagcagcaguguguggcaccucugucaggaccacagaguaagaaguagagaaugggaagauugaaaacuuguucaaguugcaaguguguaagacucggugcuugacaggacauccagacaacgggaaagaggcacaaggcacaaucucuagcccagugagaaaggcuagugauauucuaagauagaauacaggaagcacaaggaaggaggguccauuuuauguugagaguagcauaggagguggcuguuuacuugcuccagucagacacuuuugcaguuacagaaggucagcuaguugugaccaugaguucagaccaucuuuaagaugcuucgguuugggaguuaggugggucacuuacagaagccaaacucagugcaugucugguacaaccacugccggucccccacaccagacacuugcgguucgguguugcucagcugugccacugucucugcccgggaaaagcuuaaacacuucugucccaugcugcgcaagacuaucuagaggagaauacauacaugaacguauagguucacccauuuauauauagcugcauguucccucuucuccuaguaagccagggccaccggcauauaguaggacuacagguaaagcaugaggagaaggguaaguucuugaggguuuucuggguguuaguagucaguggacauccaccagaggggguccuuguaacccauguccuagguuuuaucaucugugagaucccaggcaagaggcaaccguucuaccuguucacucuucuguaagugggguauuaauaguggcuuucaccugagaaacuaaugaaauaaauuuugcgacauguucuuaaagaaccuuguccagaauuagagcaggaaaagugauggcgaaauuuuaacuguagaacgggugugaguguguguguggggggggcacuccuuaagucuaaucucagaacucccuaacacuucagucauaaauacuguugugcacuagcuguuugccagacacugcugcugccaagaccacauaacaagauagaagagauaguaaucuuguggucucuacauuuguauacuguguguuuagcucuugguuacuuaauaagguaauuuuacuaucagcuggaugagacaugcaagccuuauuauuacagauaaggaaucugaggcgaagaggaggauuucggucgucugaacucggugaagguggacgcucagcuuuggcccauuagucucuggcuuacaagcgcguccggguggcuuaccuguacagcccggcgaagccccaaguagggcguggagcggcugcgguuuccccacuucccgagcaggagaccgcagagcuggcgcacgcuuagcggcgcucccgccugcccgucguacugcacggugccgcccaccagcgccugcaacgcucccagcagcuccgccuggucuuccguaagguccagggacccgcaggcgcccaguuccucccucagcacagccugagccgccgggccugcgcgcagcagccgcuccaccuccgugaaggcgguggaggccgccgccagacacuucggaaagcgagaagcgacuuucgcggggggaucuugauuuuccuucuuuggaacugcaucuucuuggggagguucccaaccucacucccuguccucuaaauuuucccucccagugucccgcauccuccuuagcuucugacuuugacucagguagacagaguucacuagagcuccgcccucgaugacuccaccccuaacccaccacgccccuccucgaaccgcccucuacugguuucucuuuagcccagcccucccuuccccucugauuuggauccccacucaucccgacagggucccuccucucuagaagcuuccucaguuuucaguuccagcagcuugcaaaaccagacugcgucccugggcuaaggucuugugcaaccuggcuguccuaaggcugguccccauucugcccugauuuucccgaacucuuuugguucccucgccuuccuccacacucuacaacccgccuaccuccaaugauccuccuauggcgacuugugucaggcuucuggccaccaccugcggcacgcgggaaggacguccggaaacugcagguuugggggagaccccguccccaccccugccuccuccccgcugccacugagcucuuaccugguuauaggcggagaaguccacuacagcgcucagcggugcugaggaggcgacggcggcaaagacuaggugggggaacuacgaaaggaggagcgucagccuaguacaagaagcggugcuugcgcucggugucgcucuccggccccagugaugugcauggcuagggaggagcgugguaguacacucgcgcuaccucuggucgggacccugcaggccgacuuccccaaacccgcccacccgaggaauucugaggaccuucagccgggcccaggucgccagcgagccagcguaggagccuccgaagcagauccaagggcuggaagaagacacauugaggaggccggagagcgccuggcgagcggaagccacgucagccaaccugcaaaggagccaaagucgaaccuuacacuccugggggccacuguguagaaugauaccaaaaccuaagcugggcccaagguuccuuccgguaacucucucugccuaggccaagggagaaggcccacccauuucaggugagaacggaaaaguuuccuagcgccuuagguuaaaaacuuaaacaaaaaauagagggacgccagaggcagucgaggagggcgccccagaagaagaagggcucuaggcaggaugggcuauggaacugaggacugggagaaacucaaaaagaaaggagaaagauaccgggauauaacauccuuucucuuccucgucuuuuuugaggugguuuucagucggugaguagcugccauucgaagccaguagagcuuacugagaacacugagauggagagacacaaagagauggaaacaagaucgauaggagggagaccgauagaggaagagaggugccuaggugaaaaggaagagauaaggcucguggagaacacuaaagcaggugagaaguuggggaaagaggugauggggaugagcaacaaaagugagguacacagaaggagagagacaagugucugggagaaggccacuccuugaagacggaagcacuccaaagcuugaagacugucagcaagaacuggaguagcugagcuacacugugugagugugaauuaacuggaaacccuguggcuccuauaaagacuuucuucugagcaucggcagauguaaggaaugagcuuggagaguccugaucuaauaauuuaugcugagacaggauuccuguucucuacguggaagucaagggcagucacagaggauauggcgauaaugccgcuaagagauucuggugguuuggaauaguagcccacagugagcgcuuuagcauucuuuggauagaaagacgagaauggagggugagagaaagauaaaaacagggagagaaagaguuagagaugacaagagaaagauuaagaacacagagaaagauuaagacacagcgguggauacuaacagaacauuccuguccaaacaccuuccuuccccacucacgcauggcggcuggacaaguagcgaagcagggccagauccaggcccccagcaggcauacucaaaccauagaaucuguguucuaggcuuaucaccagggccccccaggcaggggccagugccgcaggaugcccuguggagagcgcaugguagagagguggaugugaguugaaaaugagcuacggagcuucucaggucucacuauugucaucugccguucccuuccugguccacaccuugcucgcgucuuaccugccaucacugagccaggcccaaggcugcccucgccuccuaugugcagaaauacugguacaucuuggccaguucuguguugaucauucacccaguaccgcuagguguggagaugaggaaaaagaaaugucagugaacauccugacucucuuccuccucacuccagccuuuucuccaagauuucccccaucuacuuaguggcguccuagcugggcuugucuagagcacauaacuauaaagguagacauuagaggcccuggaaugcacugcccagcuugcuguguuuuguaguguguguaauaaaguauuuuuccuuaaaaaauaguagauguuuuuauuuuuaaauccucaggacagagggaguuugcugguacaugggaggccucugcuauuuugugaagcaguccuuauaaaguaaguagugagcagcuugauucaggaacaguguggcgacuguuggagguuauauacagagagggcaaugaagagcgguacauuuguuuauugcuucuugugauuuuugaacacccguugucacuacugguuucaaggcuguuuuggaguucugcuacauguuaaaacuggcuggguuuuuuuccacccuggagacagucuuaugucacccacacuggcgucaaacucacuaugcagcccaggauggccuugacacccaauucuccugucuucaccucucaagcucuaggauuacaggugugcagggcaggguagaaagcaaggaacugggguuggagcugggguuacagacugacaagacagugcagcggacauuggcccccucuacucgccucaccugcaggaagguucgucugucagaugcauugaagggauccaguggcuguucuaaccacccuuguuuggggacagccccaggaccauggccuaguccaaagccuggguguaggcuagagcucuccugaaacuucugaauguguucccucaggcgccugagaagcaaggcugugaaacaggaaggcaucgguguuaggcuggacucuguaagucuccauacuugacccucaaccucaucuuaccuggaguugacaguccccagagggaaaccagaagcaagaaucccaaccauggagccuugacugccauucuccccaguauucuguguuaggaaguguuccaggcacucugcucuuuuguccaucacugagaaccuauaau

SEQ ID NO: 6933 - RNA, 8028 nt, Mus musculus
auuauagguucucagugauggacaaaagagcagagugccuggaacacuuccuaacacagaauacuggggagaauggcagucaaggcuccaugguugggauucuugcuucugguuucccucuggggacugucaacuccagguaagaugagguugagggucaaguauggagacuuacagaguccagccuaacaccgaugccuuccuguuucacagccuugcuucucaggcgccugagggaacacauucagaaguuucaggagagcucuagccuacacccaggcuuuggacuaggccaugguccuggggcuguccccaaacaagggugguuagaacagccacuggaucccuucaaugcaucugacagacgaaccuuccugcaggugaggcgaguagagggggccaauguccgcugcacugucuugucagucuguaaccccagcuccaaccccaguuccuugcuuucuacccugcccugcacaccuguaauccuagagcuugagaggugaagacaggagaauugggugucaaggccauccugggcugcauagugaguuugacgccagugugggugacauaagacugucuccaggguggaaaaaaacccagccaguuuuaacauguagcagaacuccaaaacagccuugaaaccaguagugacaacggguguucaaaaaucacaagaagcaauaaacaaauguaccgcucuucauugcccucucuguauauaaccuccaacagucgccacacuguuccugaaucaagcugcucacuacuuacuuuauaaggacugcuucacaaaauagcagaggccucccauguaccagcaaacucccucuguccugaggauuuaaaaauaaaaacaucuacuauuuuuuaaggaaaaauacuuuauuacacacacuacaaaacacagcaagcugggcagugcauuccagggccucuaaugucuaccuuuauaguuaugugcucuagacaagcccagcuaggacgccacuaaguagaugggggaaaucuuggagaaaaggcuggagugaggaggaagagagucaggauguucacugacauuucuuuuuccucaucuccacaccuagcgguacugggugaaugaucaacacagaacuggccaagauguaccaguauuucugcacauaggaggcgagggcagccuugggccuggcucagugauggcagguaagacgcgagcaagguguggaccaggaagggaacggcagaugacaauagugagaccugagaagcuccguagcucauuuucaacucacauccaccucucuaccaugcgcucuccacagggcauccugcggcacuggccccugccuggggggcccuggugauaagccuagaacacagauucuaugguuugaguaugccugcugggggccuggaucuggcccugcuucgcuacuuguccagccgccaugcgugaguggggaaggaagguguuuggacaggaauguucuguuaguauccaccgcugugucuuaaucuuucucuguguucuuaaucuuucucuugucaucucuaacucuuucucucccuguuuuuaucuuucucucacccuccauucucgucuuucuauccaaagaaugcuaaagcgcucacugugggcuacuauuccaaaccaccagaaucucuuagcggcauuaucgccauauccucugugacugcccuugacuuccacguagagaacaggaauccugucucagcauaaauuauuagaucaggacucuccaagcucauuccuuacaucugccgaugcucagaagaaagucuuuauaggagccacaggguuuccaguuaauucacacucacacaguguagcucagcuacuccaguucuugcugacagucuucaagcuuuggagugcuuccgucuucaaggaguggccuucucccagacacuugucucucuccuucuguguaccucacuuuuguugcucauccccaucaccucuuuccccaacuucucaccugcuuuaguguucuccacgagccuuaucucuuccuuuucaccuaggcaccucucuuccucuaucggucucccuccuaucgaucuuguuuccaucucuuugugucucuccaucucaguguucucaguaagcucuacuggcuucgaauggcagcuacucaccgacugaaaaccaccucaaaaaagacgaggaagagaaaggauguuauaucccgguaucuuucuccuuucuuuuugaguuucucccaguccucaguuccauagcccauccugccuagagcccuucuucuucuggggcgcccuccucgacugccucuggcgucccucuauuuuuuguuuaaguuuuuaaccuaaggcgcuaggaaacuuuuccguucucaccugaaaugggugggccuucucccuuggccuaggcagagagaguuaccggaaggaaccuugggcccagcuuagguuuugguaucauucuacacaguggcccccaggaguguaagguucgacuuuggcuccuuugcagguuggcugacguggcuuccgcucgccaggcgcucuccggccuccucaaugugucuucuuccagcccuuggaucugcuucggaggcuccuacgcuggcucgcuggcgaccugggcccggcugaagguccucagaauuccucgggugggcggguuuggggaagucggccugcagggucccgaccagagguagcgcgaguguacuaccacgcuccucccuagccaugcacaucacuggggccggagagcgacaccgagcgcaagcaccgcuucuuguacuaggcugacgcuccuccuuucguaguucccccaccuagucuuugccgccgucgccuccucagcaccgcugagcgcuguaguggacuucuccgccuauaaccagguaagagcucaguggcagcggggaggaggcagggguggggacggggucucccccaaaccugcaguuuccggacguccuucccgcgugccgcaggugguggccagaagccugacacaagucgccauaggaggaucauuggagguaggcggguuguagaguguggaggaaggcgagggaaccaaaagaguucgggaaaaucagggcagaauggggaccagccuuaggacagccagguugcacaagaccuuagcccagggacgcagucugguuuugcaagcugcuggaacugaaaacugaggaagcuucuagagaggagggacccugucgggaugaguggggauccaaaucagaggggaagggagggcugggcuaaagagaaaccaguagagggcgguucgaggaggggcgugguggguuagggguggagucaucgagggcggagcucuagugaacucugucuaccugagucaaagucagaagcuaaggaggaugcgggacacugggagggaaaauuuagaggacagggagugagguugggaaccuccccaagaagaugcaguuccaaagaaggaaaaucaagauccccccgcgaaagucgcuucucgcuuuccgaagugucuggcggcggccuccaccgccuucacggagguggagcggcugcugcgcgcaggcccggcggcucaggcugugcugagggaggaacugggcgccugcgggucccuggaccuuacggaagaccaggcggagcugcugggagcguugcaggcgcuggugggcggcaccgugcaguacgacgggcaggcgggagcgccgcuaagcgugcgccagcucugcggucuccugcucgggaaguggggaaaccgcagccgcuccacgcccuacuuggggcuucgccgggcuguacagguaagccacccggacgcgcuuguaagccagagacuaaugggccaaagcugagcguccaccuucaccgaguucagacgaccgaaauccuccucuucgccucagauuccuuaucuguaauaauaaggcuugcaugucucauccagcugauaguaaaauuaccuuauuaaguaaccaagagcuaaacacacaguauacaaauguagagaccacaagauuacuaucucuucuaucuuguuauguggucuuggcagcagcagugucuggcaaacagcuagugcacaacaguauuuaugacugaaguguuagggaguucugagauuagacuuaaggagugccccccccacacacacacucacacccguucuacaguuaaaauuucgccaucacuuuuccugcucuaauucuggacaagguucuuuaagaacaugucgcaaaauuuauuucauuaguuucucaggugaaagccacuauuaauaccccacuuacagaagagugaacagguagaacgguugccucuugccugggaucucacagaugauaaaaccuaggacauggguuacaaggacccccucugguggauguccacugacuacuaacacccagaaaacccucaagaacuuacccuucuccucaugcuuuaccuguaguccuacuauaugccgguggcccuggcuuacuaggagaagagggaacaugcagcuauauauaaaugggugaaccuauacguucauguauguauucuccucuagauagucuugcgcagcaugggacagaaguguuuaagcuuuucccgggcagagacaguggcacagcugagcaacaccgaaccgcaagugucuggugugggggaccggcagugguuguaccagacaugcacugaguuuggcuucuguaagugacccaccuaacucccaaaccgaagcaucuuaaagauggucugaacucauggucacaacuagcugaccuucuguaacugcaaaagugucugacuggagcaaguaaacagccaccuccuaugcuacucucaacauaaaauggacccuccuuccuugugcuuccuguauucuaucuuagaauaucacuagccuuucucacugggcuagagauugugccuugugccucuuucccguugucuggauguccugucaagcaccgagucuuacacacuugcaacuugaacaaguuuucaaucuucccauucucuacuucuuacucugugguccugacagaggugccacacacugcugcuggaacccagacuucuucggucucaaagcuuguacuucaccugugcagucugacuucuacaccauggccagagaaaucucccuaaauaugggauugcauuucagugacucaauguuguaguugccgggcaaaaaauacaggauguaguuucuaaacuacagaaaagaaacaaaaaugaugcagauuaaaaacucaugcaucacauguacaaaaguaguggggaguuuguguaucuaaauauagguauccuguaucauuugucaaauuuggucauuccaucccagaggagcuaagccuuuguucucuuuuuggggacagagucuuaccagguagcccagguuuaccuucaacucacagcaguccuccugcuucagccucagagugcugacaugacaggcauaugcuaccacacccagaucagaguugaauucuacauucuuccuacacuuucugaagacaagugaggguaguggcaugaaauaaaauguccaaauuccauuuucugucugugugcuuuuggacaaacuugggcaagugccuaacuguuauuagccagguuccacaucucuaaacugagaauaauaacaguacuuuucuuacugcuguuauaacacagcuuugcauauuuugggcugcccaaugcaccagcccccuacagcuuaggaauuuggcacauccuguucaauguaccagagugauccauuucccguuuuguaggguuugcucaucuuccugucucaccucaagauacccuucccucaauaucuugcaucaucucuauagauuaaaaaaaaaagucccacuucuguuauucuguguucuuuaguacauucuaaucugcuagcauuccauguccccuucugagugcuauaacagcagaacauggaacuauauugguugccacuuucugcccaguauugcccaagagaugucugagugcauuguaggugcucagcaaaugugaaggaaggaacucaugugaggucaaggaaguaugauuuacccagaacacugugagauauggguuuuuaagcagcguggacaugauccaauuugagaagcagucauuccagauucucccuccccucuaauccuuugcauguucacuuuucucucuuccggguugguuauuucuucuuuuuguuugacuuacccauccuaacucaaggccuucuucuugcagaaugcccucccugggcccauguguucucucuaagagcccuaccuccuguccuuuucugucacagcccugucacuugggaauguaaugaucugggaugugggucuguugggcagaacugugaacucacgaggucacuacuguggguguucuaaaaauuacuauuggagaagagcaggaggcugucuauauguauucuuuacacuucaaaauauucucauuccacagaugucaccugugagggucuucaguguccuuuuucccagcucccagcacugcccuuccagcuagagcugugugaacaaguguuuggccucucaccugcaucuguugcccaggcuguggcccagacaaacuccuauuaugguggucagagcccuggagccacccaaguacuguuuguuaauggugaguguaccaccagggccuggcucuacaacauuguagucucagugcagugccauccucuccuuucuuuccaggagacacagauccuuggcauguauugagcguaacacaggacuuaggacugucugagccagcccuucuaauuccuagugcuucccacugcuucgauauggcaccuaugaggccuucagacucucccagccuccgccugggacgucagguaagagaaaagauccugaauguuuuauauucucacucacauacuuauuuguauaacucaucuuuuacuggugcugaguucugacuccagaauguucuccaucucuucuucacagaaaaucucccagcaauuacaggauuggcucaaagauauaaagaagagccagaguugaugugggaucaaaacccagcccuuugacagucccaucacaggaacugcauccuggcauuuuucuucacuguagaagagaaaacagcuguuuggaaggaggaaguuccuagacgugggacucagugccuguucugccugcuuguucucaauuuaucuucauugccaacuagaaguucuuugucacggauuaguauaaauguaggcaaaugauuacuguccuuuguagguagugauauucuguaugguaaaugucaggggaauguggcuuuccaugcuggagccgccuucucccagauaagaaccuggcuuaaauucugucucuucauucuugacuggcaccuacugcauagaacucuucacauccugacucugucucuccugaguuuuagucugugguaguugaacuucauugucagccuaccugaauuuagaaucacauggaaacauaacccuggacugacugacuaccuuugagcacguuuucaguaaaguuauacugaagaggaaagacccgccugaaauggugguaacacccauuacugaacucccagcugaauaaaagaaauggugagcaccggcauucauuucucucugcugugacugugggcaugaugugagcagcugccucacagcccagcucgaauaccucugccacugugaugggcuguauuccauaaugcgagccaaagcaagccccgcccuucccucaguguuuccugucacuuauguggucacagcucuaggaaagggaaccaauagucugucccugcauucuguguguuuccguuuggaggaaaugggaggcuacacaaaccuccuccuucuuuugaucuuccuuuaguaccuucuuuacucccuucuucuccccacaagcaaaugucaccacucuccaguacucuagcuucuugccugaaaagucuugaguucuggcuagucccccugguuuucuacguuccaguuuggggguuggucccaaagcuagucucuuaggcuguagcacagcucaccccuau

SEQ ID NO: 6934 - RNA, 823 nt, Mus musculus
aggagccuccgaagcagauccaagggcuggaagaagacacauugaggaggccggagagcgccuggcgagcggaagccacgucagccaaccugcaaaggagccaaagucgaaccuuacacuccugggggccacuguguagaaugauaccaaaaccuaagcugggcccaagguuccuuccgguaacucucucugccuaggccaagggagaaggcccacccauuucaggugagaacggaaaaguuuccuagcgccuuagguuaaaaacuuaaacaaaaaauagagggacgccagaggcagucgaggagggcgccccagaagaagaagggcucuaggcaggaugggcuauggaacugaggacugggagaaacucaaaaagaaaggagaaagauaccgggauauaacauccuuucucuuccucgucuuuuuugaggugguuuucagucggugaguagcugccauucgaagccaguagagcuuacugagaacacugagauggagagacacaaagagauggaaacaagaucgauaggagggagaccgauagaggaagagaggugccuaggugaaaaggaagagauaaggcucguggagaacacuaaagcaggugagaaguuggggaaagaggugauggggaugagcaacaaaagugagguacacagaaggagagagacaagugucugggagaaggccacuccuugaagacggaagcacuccaaagcuugaagacugucagcaagaacuggaguagcugagcuacacugugugagugugaauuaacuggaaacccuguggcuccuauaaagacuuucuucugagcaucggc

SEQ ID NO: 6935 - RNA, 823 nt, Mus musculus
gccgaugcucagaagaaagucuuuauaggagccacaggguuuccaguuaauucacacucacacaguguagcucagcuacuccaguucuugcugacagucuucaagcuuuggagugcuuccgucuucaaggaguggccuucucccagacacuugucucucuccuucuguguaccucacuuuuguugcucauccccaucaccucuuuccccaacuucucaccugcuuuaguguucuccacgagccuuaucucuuccuuuucaccuaggcaccucucuuccucuaucggucucccuccuaucgaucuuguuuccaucucuuugugucucuccaucucaguguucucaguaagcucuacuggcuucgaauggcagcuacucaccgacugaaaaccaccucaaaaaagacgaggaagagaaaggauguuauaucccgguaucuuucuccuuucuuuuugaguuucucccaguccucaguuccauagcccauccugccuagagcccuucuucuucuggggcgcccuccucgacugccucuggcgucccucuauuuuuuguuuaaguuuuuaaccuaaggcgcuaggaaacuuuuccguucucaccugaaaugggugggccuucucccuuggccuaggcagagagaguuaccggaaggaaccuugggcccagcuuagguuuugguaucauucuacacaguggcccccaggaguguaagguucgacuuuggcuccuuugcagguuggcugacguggcuuccgcucgccaggcgcucuccggccuccucaaugugucuucuuccagcccuuggaucugcuucggaggcuccu

SEQ ID NO: 6936 - RNA, 733 nt, Mus musculus
auugguuagcauagaauacuuuuaauguaaacagaaccuccauacagcccaauccagccaaaccaaacaucuaguuugaguucauacacuauuuucaucccccgagaaaauuaaccuucugucccaagcagaaggcucuauugggauuccccuaagucugcaguaaauaguucuacaaaagcuuaacacuggccaggucuuguggcgcacgccuuuaaucccaacacucgggaagcaaaggcagacaggcuucugaguucaaggccagccuggucuacagaguuccaggacaaaaagaacacugaaaagcaacuuagcucuuuugauuuugugguggcccuaaaaagggccuuuaaguagcauuggaagaaacugagcagcuuaaccgccgaacccguacagaguacggcccuggcgcuugagcgcguagaccacguccauggcggugacggucuugcgcuuggcgugcuccguguaggugacggcgucgcggaucacguucuccaggaacaccuucagcacaccgcgggucuccucguagaugaggccggagaugcgcuucacuccuccgcgccgggccaggcggcggauggcgggcuuggugaugcccuggauguugucccgaagcacuuugcgguggcgcuuggcgccgccuuugcccaggccuuuuccuccuuugccacgaccagacaugaugaagacaagauuguacugcucuaagacgaagcagaug

SEQ ID NO: 6937 - RNA, 719 nt, Mus musculus
guuagcauagaauacuuuuaauguaaacagaaccuccauacagcccaauccagccaaaccaaacaucuaguuugaguucauacacuauuuucaucccccgagaaaauuaaccuucugucccaagcagaaggcucuauugggauuccccuaagucugcaguaaauaguucuacaaaagcuuaacacuggccaggucuuguggcgcacgccuuuaaucccaacacucgggaagcaaaggcagacaggcuucugaguucaaggccagccuggucuacagaguuccaggacaaaaagaacacugaaaagcaacuuagcucuuuugauuuugugguggcccuaaaaagggccuuuaaguagcauuggaagaaacugagcagcuuaaccgccgaacccguacagaguacggcccuggcgcuugagcgcguagaccacguccauggcggugacggucuugcgcuuggcgugcuccguguaggugacggcgucgcggaucacguucuccaggaacaccuucagcacaccgcgggucuccucguagaugaggccggagaugcgcuucacuccuccgcgccgggccaggcggcggauggcgggcuuggugaugcccuggauguugucccgaagcacuuugcgguggcgcuuggcgccgccuuugcccaggccuuuuccuccuuugccacgaccagacaugaugaagacaagauuguacugcucuaagac

SEQ ID NO: 6938 - RNA, 487 nt, Mus musculus
guuagguggcucugaaaagagccuuuguuggcgaucaacagugcuuuguauaaaggguuuuauuuccccuuggccuugugguggcucucggucuucuugggcagcagcacggccuggauguugggcaggacgccgcccugcgcgauggucacgcggcccagcagcuuguugagcuccucgucguugcggauggccagcugcagguggcgcgggaugaugcgcgucuucuuguugucgcgggccgcguugcccgccagcuccaggaucucggccgucagguacuccagcacggccgccagguagaccggggcgccggcgcccacgcgcuccgaguaguugcccuugcggagcagccggugcacgcggcccacggggaacugcaggccggcccgggaggagcgggucuuggccuuggcgcgagccuugccgcccuguuugccgcguccagacauuguaaagauuaaacagccuuagugacaacuguacg

SEQ ID NO: 6939 - RNA, 337 nt, Mus musculus
aauggcuaaacgcaccaagaaggucagcaucaucagcaaguacgggacccgcuauggugccucccuccagaaaauggugaagaaaauugaaaucagccagcacgccaaguauacuugcuccuucuguggcaagaccaagaugaagagacagacgagccaucagcaucuggcacugguuccugcaucaaaacaguagccggccgggccuggaccuacaacaucaccucugcagucacagugaagucugccaucagaagacugaaggaacugaaagaccaguagaagcccugaagucugagacuugccuagccugcaauaaacgggcuauuuauguaag

SEQ ID NO: 6940 - RNA, 1097 nt, Mus musculus
uucccaagcacccaauacaacauucuccucucaaaaaacaauagcaaucauacuggaaaaaaauuuuuuucuggguaaagucuaaguauaugauaaaccuuuaguuacuagagggguuguuauagaaaguuguuuccucaacuugccaaugagugugccagcaacuaaucagaugaaaauccuuuauuagcaggacaaaggggcuuagagcagcauagccaauuacuagaaauauucuaauauuuaguauuauggagucaagagucaagacagaaccaauguagaaggauaaaauguaauccccaaaguaauagaggaggaaacaggucauaagaaugagaacacuccacguagcucggauuucugggcuggcauuauuugcaagccuggaggugugaagguaaaggacacacuugugauguuuauacagacggagcgccauguacccacugcuccagcccaugagacacugaaagaugacaucacgaagagucaugagacggaggaaaagccacuuaacuguguaccuagauggcagcauauagcaauacucauaauacacaccagcucuagaucuauucaaacugcugcccacugugauaugaugaagcaaauuggagcuuaugagaacauuaaagauacaaaggaggaggagagagggaagaacuugccauauuguuuguggucugaacuuucucaaaaaggagguucuaggacugauggugacaaccuggaccaugcugaggagacagguggugcagauggagaggcgacgggccacccuucccaaauaaaccagaguuuuacagccugcaaugcccagaccauuuuugaaaugaaguuuuguggcuacauaucugauccccgaaguaccaauaaugauuacauuugaaaaagccagaugagugaagauaauaaggucuauagguuuuuucucagaacccaugguaaauguaagcacaugucucacaaauauaaggauguuuccuaagauuccaaguccaauaagagaaaggaagauuacucguuggaugagcucacuccaaaucaucuuuugaccucaggugagaacuagccaaauccacuuugaggaacac

SEQ ID NO: 6941 - RNA, 1917 nt, Mus musculus
aaugaacaugucaguguugacuuuacaagaauaugaauucgaaaagcaguucaacgagaacgaagccauccaauggaugcaggaaaacuguaugaaauaacacacccaggaugggacacauaacagaacaaacaaaaggcuccaccagcugcuuuuagaauuauuugaauaaggaaugggaagcccagccugugaccugaagaagucuuuccuguuuucugcgcuguacgcugccuuuaucuuugguggucggcaucugaugaacaagcgagccaaguuugaacuucggaagccgcucgugcucuggucgcugacucuugccgucuucaguauauucagugcucuucgaacuggugcuuacaugcuguacauucugauguccaaaggccugaagcagucaguuugugaccagaguuuuuacaauggaccugucagcaaauucuggacuuaugcauuugugcucagcaaaacacccgaacuaggugacacgauauucaucauucugaggaaacagaaacugaucuuccugcaguaguaccaccacaucacugugcuucuguacuccugguacuccuacaaagacauggucgcugggggugggugguucaugacuaugaacuauggcaugcaugccgucauguacucuuacuaacgccuugcgggcugcggguuuccuagucucccggaaguuugccaagauggcgcugacauccuguguucuaagugguaaacaaauaaucugcgcaugugccaaggguaguucuucacuccaugugcucugccuuccccgugaugacaacucggccaaugggcugcagccaaucagggagcgacacguccuaggcagaggauaauucuccuuaaaagggacgggguuuugccauuuucucucuugcuccugaagauguaaguaauaaagcuuuugccgcagaagauuccgguuuguugcgucuuuccuggccgguugcgaacgcgcguaagacaucaccuugucccagaugacucagaugcuaaugggcugugucauuaacuaccuggucuucaacuggaugcugcaugacaaugaccagugcuacucccacuuucagaacaucuucugguccucgcucauguaccucagcuaccuugugcucuucugccauuucuucuuugaggccuacaucggcaaagugaagaaagcgaugaaggcugaguagugucagaacugaggaggaagacauagcucagggucaucaugaaaaauaaucaacaaaagaaaaauggcacaaggaaucacauauggugaagcuaaaacaaaacaaaacauccguaugagcagacacgaggcccaaggcagcuugggagugaagauuagauuguaaguuuaugauccuuuucugggugaggacucgcugagugcaacucuuaucucaaagcacugcugcugaggggaccccuucccucuggccugucaacucuagaacacacuagauacaaaggcagccacgggcaaagagauuggccagagauuaguggacggccagcaaaacacugcaggaagcaggucaggggaggaaucuacucagucuuuuuguuuuguuuuguuuuguuuuguuuuguuuuguuuuucucuaaggauaaaggaguuuccccuuuucaaacuaugugagcacacacacacacacacacacacacacacacacacaaucuuuucaacaugaaaccagaguugaaagaaaagauaaacaugggagagacaggguuuauaucuaggacagcaaugcuuuugcaaaaggcuaggccuuuuaaagaaaggugagcuuguaacuccuugauaaaagaugucuuaauuauuuuuacugcaacugaaaguaaaaaggucgagccuuuccccuucugcacaggcucagggcuuguauguuugcuacaaccaaacac

SEQ ID NO: 6942 - RNA, 1917 nt, Mus musculus
guguuugguuguagcaaacauacaagcccugagccugugcagaaggggaaaggcucgaccuuuuuacuuucaguugcaguaaaaauaauuaagacaucuuuuaucaaggaguuacaagcucaccuuucuuuaaaaggccuagccuuuugcaaaagcauugcuguccuagauauaaacccugucucucccauguuuaucuuuucuuucaacucugguuucauguugaaaagauugugugugugugugugugugugugugugugugugugcucacauaguuugaaaaggggaaacuccuuuauccuuagagaaaaacaaaacaaaacaaaacaaaacaaaacaaaacaaaaagacugaguagauuccuccccugaccugcuuccugcaguguuuugcuggccguccacuaaucucuggccaaucucuuugcccguggcugccuuuguaucuaguguguucuagaguugacaggccagagggaagggguccccucagcagcagugcuuugagauaagaguugcacucagcgaguccucacccagaaaaggaucauaaacuuacaaucuaaucuucacucccaagcugccuugggccucgugucugcucauacggauguuuuguuuuguuuuagcuucaccauaugugauuccuugugccauuuuucuuuuguugauuauuuuucaugaugacccugagcuaugucuuccuccucaguucugacacuacucagccuucaucgcuuucuucacuuugccgauguaggccucaaagaagaaauggcagaagagcacaagguagcugagguacaugagcgaggaccagaagauguucugaaagugggaguagcacuggucauugucaugcagcauccaguugaagaccagguaguuaaugacacagcccauuagcaucugagucaucugggacaaggugaugucuuacgcgcguucgcaaccggccaggaaagacgcaacaaaccggaaucuucugcggcaaaagcuuuauuacuuacaucuucaggagcaagagagaaaauggcaaaaccccgucccuuuuaaggagaauuauccucugccuaggacgugucgcucccugauuggcugcagcccauuggccgaguugucaucacggggaaggcagagcacauggagugaagaacuacccuuggcacaugcgcagauuauuuguuuaccacuuagaacacaggaugucagcgccaucuuggcaaacuuccgggagacuaggaaacccgcagcccgcaaggcguuaguaagaguacaugacggcaugcaugccauaguucauagucaugaaccacccacccccagcgaccaugucuuuguaggaguaccaggaguacagaagcacagugauguggugguacuacugcaggaagaucaguuucuguuuccucagaaugaugaauaucgugucaccuaguucggguguuuugcugagcacaaaugcauaaguccagaauuugcugacagguccauuguaaaaacucuggucacaaacugacugcuucaggccuuuggacaucagaauguacagcauguaagcaccaguucgaagagcacugaauauacugaagacggcaagagucagcgaccagagcacgagcggcuuccgaaguucaaacuuggcucgcuuguucaucagaugccgaccaccaaagauaaaggcagcguacagcgcagaaaacaggaaagacuucuucaggucacaggcugggcuucccauuccuuauucaaauaauucuaaaagcagcugguggagccuuuuguuuguucuguuaugugucccauccuggguguguuauuucauacaguuuuccugcauccauuggauggcuucguucucguugaacugcuuuucgaauucauauucuuguaaagucaacacugacauguucauu

SEQ ID NO: 6943 - RNA, 896 nt, Mus musculus
caugacugcuuuucaaacucaagaaaaugcuacugugcaaauuugcuguucauacacauaucuagcauuaaggaggcuuucuucagaauguguuugcauccuguauacaaguuuuucaccuaggaaggaagacaugguuuugaaguacauugaggaaauuauuuuccccuccaugacagugcuuggcacucuggggaacaugucuguuucugugaauuuuaugcucaguugguggggaagcccugagaagaagcccauacaccuuauucucauccacuuggccuuuacaaacaucauacuccuucuuacaaaaggacugcccaaggcaauagaaacuuuugguauuagaaauuuucuagaugacauaggcugcaagauaauuguuuaccuggggagaguggcccggggccucucccucugcaccagcagucuccucacugugguccaggccaucaucaucagucccagagcaucuggguggaggaggcucaggccaaagucugcacagcacauccuuccauucuugcuauucuuuuggauacucaaugguuuaauaaguaugaaccuaauacauucuaucauaaguacagguaugaauauaucacagcauaagaauagugacaacuauugcuauuuuaugcaagaaagucaggaaauaaaauggauuguucucccucucaugguccugagagaugcaguguuucagggugccaugggaggggccaguggcuacaugguauuucuucuccacaagcaccaccagcaaguccucuaccuucagaacuccaagcuccucuacagaacuccuccggagcugagagcugcucaaaguguccuccuucugaugcucuguuuuguuuucuucuacuggacagauugugcccuuuuuucuaauu

SEQ ID NO: 6944 - RNA, 911 nt, Mus musculus
cucaggggacacagcagagauuaggaacacaaauaucccagaugaucaggacaaaggggcugagaccaacauaacuaaguacuaaaaaugcuuuaauauauaguauuguggagucaugugucacuguggaaccuauguauaaggagaaaaugaaaucugccaaauaaaagaaaagaaaacaggucaugagagugagaacucucuguguagcucugauuucuggccuggcauuguuugcagaccuggagcuguggagguagaggacacgcuugugaugcuuauacagauggagagccauggacccacugcuccagcccaugagacuuuggaaaaugacaucacgaaaagccaugaaagaaaggaacagccauuuaacuauguuccuggauggcagcauauagcaauacacaguaaacaucccaacuucagaacuguucaugcuacugccugcugugauauagugaagcaaauuggagcuuaucaggguauuaaauauccaaaagaggaggagaaaggcaagaauaugccaugccgucugugguuugaacuuucuccacagugugguccugggacugauggugacagccuggaccacgcugaggagacagguggugcagauagagaggccacgggcaacccuuucuagauaaauuauaauuuuacaaccaacaucacccaggaaguuucugauguaaaaacuuguggcuauguuucugacaccuaugcaauaaauaaugauuguguuuacaaaagccaaguggacuagaauaacaucuauuauuuucuucucaggaccuaugaugacuacauauaaaugucucacaaauaacauguuguuuccuaaaacuccaaguaaaauaagugaaaggaaaauuguccccgcgaugaggucacuccaaaucaucuucaug

SEQ ID NO: 6945 - RNA, 1114 nt, Mus musculus
gaugggguucaugaaaguugucaagaacaaggccuacuuuaaaagauaccaagugagauuuagaaggcggcaaaaguauuugugaauuguaccacacaucuuuuaauauagucuuuuuaccaucuggaacauuugcuuuuaaguaugagcauaacacaguaaacacauaucuguucacaagucuugcucuaugacgcuuuugugacuacuguuggaaacaucauucacaaucauuuuauucugucucuggauauaaaccacucucgagccaugaaugcauuauguugguuuuuccaccucuaucaccaccauaauauucaccauggguggauaauuguacuguaauauauuucuacuauaccaaacaacauaaaaaagcaaguguuuaauaaauacuuauggaaucaauaaauuaaagaugaguuauuaauauuaauaagaaagaagguggcaagaggguaaaacugacuacauugcauggaagcgauuggugaucccggacaagaauaaguacaacacacccaaauauaggaugauaguucauguaacucacagagauaucaucugccagauugcauaugccgguauagaaggggauaugaucgucugugcagcaucugcacaugaacuuccaaacuacagugugaaaguuggccugacaacuuaugcuguagccuauugcuggccggcaggcuucugaauagguuuggcacugacaagaucuaugaaggccaaguggugguaaauggaggugaacacaauguugaaagcauugauggucagccuggugccuucacuugcuuucuggaugcaggucuugcccaaacuacaacuggcaauaaaguuuuugaggcccugaagggagcuauggauggaggcuugucugucccucauaggacugaaagauuuccuaguuaugacuuugaaagccaggaguucaaugcagagguacaucggaagcacaucaugggucagaauguggcagguaacaugugcuaccuaauggaggaagaugaagauguguauaagaaacaguucucucaguccaucaagaacaauguaacuccaaacaugauggaggagauguauaagaaagcucauacugcuauaugag

SEQ ID NO: 6946 - RNA, 5517 nt, Mus musculus
agauggcgacagauucacggcugucgugcuccccagaucuugccauggugaaagcgggagaguugguggagcagcaaaaggcugcgauggaggaagaggcgaaugcagaggcggcggaggaucaggaggagcccgaggacacggccugcagcagcagcagcaagaagaagaagaagguaguuccggggauuguguaccugggccacgucccgccgcgauuccggccccuucacguacgcaaccugcucagcgccuacggcgaggugggacgcguuuucuuccaggccgaggguaagcccugcgucgaaaggagaggugacgaugcgggcagccgggcgcgacucauuuucuuggcuguacacgaaugaggcguggggugcuggcucuuggaaggcuguggccccuuccuagcugcuaaguguguaguacucacguccuuuagguggcaggcaggggcggggaagggaaauggagagggugaguggauagagagagugguuuaauaaggccugaaagagacccacgaucuucucuucuuucuauuucuuaaaauuuuauuuacuuacuacuuuuuguagcugucuucagacacaccagaagagggcaucagaucccauuacagaugguugugagccaccaugugguuguugggaauugaacucaggaccucugaaagagcagucaguacucuuaaccacugagccaucucuccagcccucucaauuuucaaauagucccugaaacuguaugauuagccuccuucagccucuucaccuuuguuuguuuguuuguuuguuuguuuuucgagacaggguuucuuuguagcucuggcuguccuggaacucacucuguagaccaggcuggccucgaacucagagauccgccugcugcugccucccaagugcugggauuaaaggcgugcacuaccaugccuggcucucuuccaccucuugacaugcacaacuuggaaauggagguggggacugguguuguucuuggugcuguucuaauguucaagaaguugucauuugaagggaggcaugaauuaaggaaaggaggagcugccccuuacagacagccguguuucaucaaucccuguaaaguagcgccuaaaccagcagguguggcuuacggcuaaacugaggugugucucagugggugcuugaugggauguucauuguguuuggccuacagaccacuuugugaaacgcaagaagaaggcagccgcggccgcaggaggaaagaagggagcuaaguacagcaaggacuauaccgaaggcuggguggaguuccgagacaagcguguagccaagcgaguggcagccagucuacauaacacgcccaugggcgcccgcaagcgcagccccuuccguuaugaccuguggaaccucaaggugagguucucaguuugucugccacaucuucauuccccccuccagcucuaguccaggcaccccauccuuccugcuagcucugagcagcucccaguuucuucucccgaccuucccuaccgugaccuuuucuucuuuuccuucucacaguauuugcaucguuuuacuuggucccaccucagugaacaccuugccuuugagcgccaaguacgaaggcaacgccugagagcagaggucgcccaagcaaagagagagacugacuucuaucuucgaaacguagaacagggacaacacuuccuugcagcugauggggaugcuacucggccaaauagcuccuggacauucacccagcgucccacugagcaggaguuuagggcccggaaagcugcacggccaggagggcgggaaagagcacggcuggcuaaugucgaggaccaggcccgauccaacagagggcuccuugccaagaucuuuggagccccucuaccugcagagagcaaggaaaaaccguagucaauaagggacuccuggugauggaagaaauaccuaccagcccugcgccauucugaucugcuuccugaagagugugaccaucuaggcagauguuuucucuauuccacacaccaagagucugguaaaggccuuuuguuggugucuuuuaccuacuuugaacaaauccuguaagugccagccugagaaccuuacucguccuauccagggugaagaccacuggaggugccuguuguguuuuguuugauuucugauugccugccucuuucucaguggacagcuaacaguuucugacugaaagaguggacuugcccuccacuaggguaguggucugugguguuuguucacugugguggaaggcugaauuagcaggaauuggauuagagguccaauuugaggcuuauauuugaaaauaaaaaauaauuuauuuuuauaugcuuuuuaguuuuucauuaaguaaguuucaacuucuuuugaagccauacaugccgcucaguuacuuuagcacaggcaugauucuccuccacccaugaaucucaguuacucuaucagauaugaucccaaugcuccuguguuagucaggguucuguagagucacagaacuuauggguagucucuguauaguaauggaauuuguugaugguuuaccgacuguagucuuaacucccaacaguggucaggagcaccugugaauggaagugcaagggucuagcaguugcucagucccacaagacaagcaggugaaggagggucuuccuucuuccaaugucauuauguaggucuccuuagaagauguggcccagguuaaaggugugugccgccauuccuggaucugggacuugcuuugucccacaugaccuugaacucagagaucuccuuucuacggaggaaguaguccaauguaguaaaccugacaccagguuucuggcugaucaccucaaagaaucuggggcucaguguuaguuucugcuauuggcagaucuggcauucagcggcagccguagccaggucagccuuggugaguggaagucccuguuguugagcccgagcauaaccuccaucuccgucaccauagccacuuuguucaugugcccauugagcaaugacagggauggcuggggaaagaggcugacuguccacagaacgggucaucuaauccacuugauuauugaacuccuccuuggcugaagucaccuuuuggugaguguuuaaaugggacacaaauaucuucacauccuuugcccacuuggaaauaucuauccacauacuucuuccccagaugucuuucucaccaauuuucaauuguuaucuuuccaaaucccugaccauccagccaauccauuggcuacaaaccaugagucaguaaacaguuguacaucuggccauuucuuuugccaaacaaacuaauaccacguguacugcccgaaguuuugcccauugugaagauuuuccuucaccuguaucuuucaggguugcccuggaaagggauuauacugcagcuguccacuucuggguggugccugcauaacguauagagcuaucagaaauccagguccuagucuucagucagccaaucauaggaacaccccaugaggcuauaggcacaugcuuggcagcagauggcauuguaauaggaguagaaaccauaggcauuugagcaacuucuucaaguaacuugcuugugccuucaagaccugcucuggcccaaucacauauauaccacuuccauuugauaauagacugcugcuuuguauguccuacuuuacgacuggagggucugauggcacccagcucaugauggauaguucaaguucagguugcuugguaacuugcaaccugauucugguguccuauuaucaaauguucaguuuccacuaaggcccaauagcaggccaagagcuguuuuucaaagggagaauaguugucugcagaugaugguagagcuuugcuuuaauaucccaaaggucuuuucugugauuucccuacaggggccugccagaggcuccaaacagcaucucuaucugcuaccagcaccucaagugccaucgggucugcuugaucauaugguucaggaguagagcagccugcacaguagccuggaccuguugaagggccuucuguuucaggccccacacacgucacuugguauaugggccugaguaacacacccaagugaguaauauacugucuccagaauccaaauagacccacuaaaugugcuuuuuucuugguagugggaggggccaggugcaauaacuuaucuuucaccuuagaaggaauaucucugcaugucccacauuacuggaccuagggacugcucuuuauaacuuucuuauuuugugauagggccucacucaagugagacuuagccuugaacucauucuguaaguugcucaaauuagcuuugagcuaacuuuggucagguaggcucugaacaugaaauccugucucagccucccaaaaacuugcugugaggagaggccuguaucaagaggccuaguuucaauauucuuaaauaaauaaauagaauaauaauuuaccuuccuuuucuuuauaggguaaauccuuaccuggaaaaggcauccacaagcuaucacaugccuuaucuuuuaaaauguuucaguauucauuuugguacaugucuucuguauaaaaacugcaaaaagauguuuacuaauagaucuagggguuaaaaauacugucaugguuugaauaugcuuggcccagagaguggcacuauuuggaggaguggccuuguuggaguaggugugcuacuguggucaugggguuuaagagccucacucuagcugccuagaagucagucuuccacuagcagccuucagauguagaacccucagcucugccuguaucaugccuggaugcugccaggcucccaccuugaugauaauggacugaaccucugaaccuguaagccagucccaauuagaaguuguccuuuauaagacuugccuuggucauggugucuguucacagcaguuaaacucuaagacagagacugagccucucaaagauccuaccauuccagccacuuuuccugucuccauucuccucccucaguccagcccaugucgugggucuaucacauggacugccuuccucagcaccuucugaaacuucgcuuccaacagccugaaccccuggccccuuguucccuuccucacaagcucaagugcauuuccccuucaagauucagucacuuagaaugucaggcuggcuucccccgacuuccccuccuaaggugagcauccugcuucuguggggcuggagcacuguuuucucucugggguagcuccuccuguuuuacaguaauuguugauguuuuuacccugguguuaucaguaugaagauucaacauuaucuuugacucuuuagggcuucagucugguaaauaaauguucacuaacucuuugaguugcugugaggagagguuuuauaaaaauccuaaauaauacacuuucugcacuccacuaccugugauguuugguuugacaaccaguuuggaaagugucaucuacuugugacagugauaaggagcgucaggaaggucuugauccaaacagucacaaagguaauaaaagucagauuuacaucuuca

SEQ ID NO: 6947 - RNA, 481 nt, Mus musculus
cgaaaacacugcauauaaguaaugugccugugccuuccacucuguugagguuuuuucuucagcaaguacaccaugucuggucguggcaagggcgguaaaggucuuggcaaaggcggcgccaagcgccaccgcaaagugcugcgugacaacauccagggcaucacgaagcccgccauccgccgccuggcccggcgcgggggagugaagcgcaucuccggccucaucuacgaggagacccgcggugugcugaagguguuccuggagaacgugauccgcgacgccgucaccuacacggagcacgccaagcgcaagaccgucaccgccauggacguggucuacgcgcucaagcgccagggccgcacccucuacggauucggcgguuaagcgaaucuugcuucugaccuacaaaaccaaaggcccuuuucagggccgcccacauuuucuuauuaaaagagcgaacauguguuuuacguuuugaaau

SEQ ID NO: 6948 - RNA, 829 nt, Mus musculus
uaaacaaaacccaaaggcucuuuucagagccaccacuucuucauauaagagucuaguaacaugguuaauuuagcuuguggaaaaaccuauauuaauguuucaagcacaaaaccauaauucugguaggcugagguaauucuuaggcaacugcuuugucuuccucacgcagagaaauauuggauguagcauaaacauagauuuacacguugcacaaaacuuuuggucuugcaguccucuacaucuucguauugcuccggagaggcagcagacauucgggguugggagaaaauacaaagggucuuacggaaauuguuaggcaagucuuuacaaagucgcaagauucaggauacuugaccugugguuccuguuacauuacugcuugcuuugugucacuuuaaacacuccuggagcaaagacguaguucggcuugagucaaggaaaaaggaccuaggugcauauuuuacauauagcaaaccuggucucuuuuucuuccuccuugguugccaccucuugauuugaccugucucagaccuuggggccagggaacucacccaagagcaguuucccaauaaaccucccuuugauauauucaaaucugguuuggauuggcucauuucaccggcugagaaauaacguaucaugugcagucuaggcacaagaagcgggaaaauaaaaccaaaggcggguagagaacauauuuuccagagugguuuguggauaucuagggucaugagauuucaaauucaagauuucuuugccucaaauucuuuaagcgacucgauacaaggauggaaacauaaauuuaagaaagcucgggugugccagacua

SEQ ID NO: 6949 - RNA, 1733 nt, Mus musculus
gacaaggacagccaccgcuuuauuuaaagagcaggaaaggaacggaacaguucaauaucucuuuucuuggccuaccuucauucucuguucacuaugccugagcccgccaaguccgcuccugccccgaagaagggcuccaagaaggcccugaccaaggcccagaagaaggacggcaagaagcgcaagcgcagccgcaaggagagcuacucgguguacguguacaaggugcugaagcaagugcaccccgacaccggcaucuccuccaaagccaugggcaucaugaacucguucgugaacgacaucuucgagcgcaucgcgggcgaggcgucccgccuggcgcauuacaacaagcgcucgaccaucacgucccgggagauccagacggccgugcgccugcugcugcccggggagcuggccaagcacgccgugucggagggcaccaaggcugucaccaaguacaccagcuccaagugagugcucaagacucagcucuuaacccaaaggcucuuuucagagccacucaagacuucaaaauuggagcuuuaaugcugacuuagugacuaccgggaaaauaacugacuucaucugcaggauuguguacaaacacuuaugguuuaguaaaucaaaagauagacauugcccaucaguucugucugguccacuuaaauaugcuuuuucuuagaaguucuaagaacccugucauaccuaucuagguccaguccuugaguuucaaaaggccaaauacccaaauguuucaguuuuccaguucagggaaguaaaucugcaugguuugccacuguacuggcuaguuuugucucaacuugacacagcuggaguuaccacagagaaaggagcuucaguugaggaaaugccuccaugagauccaacuguaaggcauuuucucaauuaguaaucaaggaggaaaggccccuugugggugggaccaucucugggcugguagucuuaguucuauaagagagcaggcugagcaagccaggagaagcaagccaguaagaacaucccuccguggccucugcaucagcuccugcuuucugaccugcuugaguuccaauccugacuuccuuggugaugaacagcaauguggaauuguaagcuggauaagcgguuuccuccccaacuugcuucuuggucaugauguuugugcaggaauagaaacccugacuaaaacagccacuaaccuguauuucugaauauuuuaaguggaauguuuaaaacugaaacuccaaauagccuggguaugauuuuguuuagggauuagguggguaaaacucaaaaauaaucaggagaucaggaguuaaaccauauuuuagaaucacuuuuuaaaagcuauguacguguaacuuggauucaaauuauuugugugcguaugucuauacauauggauggaauacuuuagaaauauauaucagaaauuauauauauuaggaauauguauauauuagaaaaacaaauuuuuaaauagcaacuaugugacucuccaucuuagcuggugacuuuaccacgauguaaguagccauauggcugccaaccaccuuuacuaagauuuaaauguacaugccaugugacuuuaccaucuuaagaugaucauauguuuaauaaauaagguguauuucauaaucaagauuuauaaauuucuaaagucuacucauguucacuauguauuauuugucgccuuuuaaguuuuagcuauuuggguaaugaacuaagcaaua

SEQ ID NO: 6950 - RNA, 2875 nt, Mus musculus
ugcuaccuauuuauuagcccuauuauuuuccuucugaaacagugcuugguuucuucauguagccauagcuguccuggaacuugcucuguagauaguccuuaauuucagagaucuaccugcuucugccucccagguacucggauuaaaggcauggaccaccacaaccagguugauuuuuauuuuauacaaccacccuuuccuguagauuugaaagucucuagguauuagaauacccaagaaugugucucccuguagaauaccucaugaggcuguaaucucucaccuguuacuauaguaauggugugcauuuguguguauguguguauauuugcuuaucuaacacaaaauugagagaagaggacgaagccauaaguuucacuguucucacaccucuuagggauuuuuaucgccuguuuuuaaucucuacaaaauaguacaagccuuacuacagagaauaaucugcuguuuuucaggauguaauuauauuuuggaguuaagaccaaaaccacauuugugauauuagccuccacagucaugagugggaaugagugaagcuucuuaugguuucaaguuuguagucccaugguugaucccuuuuccagaaacuuuauucuugcugcaguuaucauaaugauaacugacuaugaaauguuuaaguccuuugguggauaccaccugcuaauucuuuuguuugugacagacuauauuauauauguaauauauguaaugaggucagcagcuaucauggaaauuaaaaaacagauuuucuuucacauucugcuuguuuuuaauaaugaaauucaaaucauuuuaaaacuggaaauaugcagaaaacuguugugauaaguguuggcaaggggaaacagcugcauaacacagguccugaaacacggcauauaacacagcuguaaacuuuguacucuaaacacggagugaguugcuaagucagguuauaucucacuguucuucagcucccaguugcuaaacuucuguuccuucuugaccuagguaucuuuuuucuguacaugugauaguugguguacauuucucuaucaaaucugaaaaauaugugcuuucagcuuuugaucuacaauagggauggcacagacucaucacgucuccagaaaauggcuaaaucacuaaaacaggaaaaccgaaggggaauuacacacugguaucucaaauaucauuaaaaaauccaaucgauauuuucuacaauaaucauucccccgguaugcacugcuuucccaucuagugccaauuccuacagcuuggugcagauagcccuggaagcuuguguuguugcuuucucgaaaaacucaaauuucccuauguauuuccgugaaaacaaguuauuucauagaguccugaaaugauaagaaugugaggaaccauguccugaaacaaaaguuugcuaaugaccgcgagagaaguaguauuuuuaaggaaaaccuuaaaguugucccaauuuucgucaaguuugaaagagaguuggggcaaucagagaaguuucagggugccgauuuugaacauaggugcacaaauuaaggcaagaauguagccuacaggcucucggaucaguuucccccaagucccuaauuauuucgugcccauauuuuuuauauuuuuauacuuuuuugaggggcaacaaacacagccacaaggcaaagcugaagauccuuucucuggcaacgcggcgcacggcgcacggcgcagggaaccaaucaccacgcagcuucucucuauauaaacccagagccugcagcacugggaacaaccuucucugacuguuugugcuuacuuuuugcuuuacuaguaaagcuuagaacauguccgagaccgcucccgcggcgccugcugccccugcaccuguggagaagacaccugugaagaagaaggcgaagaagaccggcgccgcugcugggaagcgcaaggcguccggacccccgguguccgagcucaucaccaaggcuguggccgccuccaaggagcgcagcggcgugucccuggcugcgcucaagaaggcgcuggcggccgcgggguacgauguggagaagaacaacagccgcaucaagcucgggcugaagagccuggugagcaaggguacccuggugcagaccaagggcaccggcgccuccggcuccuucaaacucaacaagaaggcggcuuccggugaggcuaagcccaaggcuaagaaggcaggcgcggccaaggccaagaagccugcgggagcagccaagaagccuaagaaggcgacuggugcugccacacccaaaaagacggccaagaagacuccgaagaaggcgaagaagccugcggcggcugccggcgccaagaaaguuuccaagagucccaagaaggugaaggcugcuaagcccaagaaggcagcaaagaguccagccaaggccaaggcucccaaggcuaaggcuuccaagccuaaagcuucuaagccgaaggccaccaaggcaaagaaggcugccccucgcaagaaguagaguggugcguccugcuuugaaaaucucaaacggcucuuuucagagccacccacaaccucauucaaaagagcugagccuuuuucugguuuucucaugguauguccgcugacucuggcuauguguuccgaagcagaucaauucugugcacuuuguuauggguacauuuaggagcaucuauaaacucuaguugagcgauagauuguaucauuuucagcucuagcuggacuucuggccggcaguuuuuugcuucugugugugcuccacacacguguucauauuccaagaguuuggcgggaaguccuuucuaaugucgccuaggcgugauaaggcauuagggggguucucuaggaagcuacucucacaauaguggcuacaggcug

SEQ ID NO: 6951 - RNA, 2875 nt, Mus musculus
cagccuguagccacuauugugagaguagcuuccuagagaaccccccuaaugccuuaucacgccuaggcgacauuagaaaggacuucccgccaaacucuuggaauaugaacacguguguggagcacacacagaagcaaaaaacugccggccagaaguccagcuagagcugaaaaugauacaaucuaucgcucaacuagaguuuauagaugcuccuaaauguacccauaacaaagugcacagaauugaucugcuucggaacacauagccagagucagcggacauaccaugagaaaaccagaaaaaggcucagcucuuuugaaugagguuguggguggcucugaaaagagccguuugagauuuucaaagcaggacgcaccacucuacuucuugcgaggggcagccuucuuugccuugguggccuucggcuuagaagcuuuaggcuuggaagccuuagccuugggagccuuggccuuggcuggacucuuugcugccuucuugggcuuagcagccuucaccuucuugggacucuuggaaacuuucuuggcgccggcagccgccgcaggcuucuucgccuucuucggagucuucuuggccgucuuuuuggguguggcagcaccagucgccuucuuaggcuucuuggcugcucccgcaggcuucuuggccuuggccgcgccugccuucuuagccuugggcuuagccucaccggaagccgccuucuuguugaguuugaaggagccggaggcgccggugcccuuggucugcaccaggguacccuugcucaccaggcucuucagcccgagcuugaugcggcuguuguucuucuccacaucguaccccgcggccgccagcgccuucuugagcgcagccagggacacgccgcugcgcuccuuggaggcggccacagccuuggugaugagcucggacaccggggguccggacgccuugcgcuucccagcagcggcgccggucuucuucgccuucuucuucacaggugucuucuccacaggugcaggggcagcaggcgccgcgggagcggucucggacauguucuaagcuuuacuaguaaagcaaaaaguaagcacaaacagucagagaagguuguucccagugcugcaggcucuggguuuauauagagagaagcugcguggugauugguucccugcgccgugcgccgugcgccgcguugccagagaaaggaucuucagcuuugccuuguggcuguguuuguugccccucaaaaaaguauaaaaauauaaaaaauaugggcacgaaauaauuagggacuugggggaaacugauccgagagccuguaggcuacauucuugccuuaauuugugcaccuauguucaaaaucggcacccugaaacuucucugauugccccaacucucuuucaaacuugacgaaaauugggacaacuuuaagguuuuccuuaaaaauacuacuucucucgcggucauuagcaaacuuuuguuucaggacaugguuccucacauucuuaucauuucaggacucuaugaaauaacuuguuuucacggaaauacauagggaaauuugaguuuuucgagaaagcaacaacacaagcuuccagggcuaucugcaccaagcuguaggaauuggcacuagaugggaaagcagugcauaccgggggaaugauuauuguagaaaauaucgauuggauuuuuuaaugauauuugagauaccaguguguaauuccccuucgguuuuccuguuuuagugauuuagccauuuucuggagacgugaugagucugugccaucccuauuguagaucaaaagcugaaagcacauauuuuucagauuugauagagaaauguacaccaacuaucacauguacagaaaaaagauaccuaggucaagaaggaacagaaguuuagcaacugggagcugaagaacagugagauauaaccugacuuagcaacucacuccguguuuagaguacaaaguuuacagcuguguuauaugccguguuucaggaccuguguuaugcagcuguuuccccuugccaacacuuaucacaacaguuuucugcauauuuccaguuuuaaaaugauuugaauuucauuauuaaaaacaagcagaaugugaaagaaaaucuguuuuuuaauuuccaugauagcugcugaccucauuacauauauuacauauauaauauagucugucacaaacaaaagaauuagcaggugguauccaccaaaggacuuaaacauuucauagucaguuaucauuaugauaacugcagcaagaauaaaguuucuggaaaagggaucaaccaugggacuacaaacuugaaaccauaagaagcuucacucauucccacucaugacuguggaggcuaauaucacaaaugugguuuuggucuuaacuccaaaauauaauuacauccugaaaaacagcagauuauucucuguaguaaggcuuguacuauuuuguagagauuaaaaacaggcgauaaaaaucccuaagaggugugagaacagugaaacuuauggcuucguccucuucucucaauuuuguguuagauaagcaaauauacacacauacacacaaaugcacaccauuacuauaguaacaggugagagauuacagccucaugagguauucuacagggagacacauucuuggguauucuaauaccuagagacuuucaaaucuacaggaaagggugguuguauaaaauaaaaaucaaccugguuguggugguccaugccuuuaauccgaguaccugggaggcagaagcagguagaucucugaaauuaaggacuaucuacagagcaaguuccaggacagcuauggcuacaugaagaaaccaagcacuguuucagaaggaaaauaauagggcuaauaaauagguagca

SEQ ID NO: 6952 - RNA, 5657 nt, Mus musculus
ggaacaaccuucucugacuguuugugcuuacuuuuugcuuuacuaguaaagcuuagaacauguccgagaccgcucccgcggcgccugcugccccugcaccuguggagaagacaccugugaagaagaaggcgaagaagaccggcgccgcugcugggaagcgcaaggcguccggacccccgguguccgagcucaucaccaaggcuguggccgccuccaaggagcgcagcggcgugucccuggcugcgcucaagaaggcgcuggcggccgcgggguacgauguggagaagaacaacagccgcaucaagcucgggcugaagagccuggugagcaaggguacccuggugcagaccaagggcaccggcgccuccggcuccuucaaacucaacaagaaggcggcuuccggugaggcuaagcccaaggcuaagaaggcaggcgcggccaaggccaagaagccugcgggagcagccaagaagccuaagaaggcgacuggugcugccacacccaaaaagacggccaagaagacuccgaagaaggcgaagaagccugcggcggcugccggcgccaagaaaguuuccaagagucccaagaaggugaaggcugcuaagcccaagaaggcagcaaagaguccagccaaggccaaggcucccaaggcuaaggcuuccaagccuaaagcuucuaagccgaaggccaccaaggcaaagaaggcugccccucgcaagaaguagaguggugcguccugcuuugaaaaucucaaacggcucuuuucagagccacccacaaccucauucaaaagagcugagccuuuuucugguuuucucaugguauguccgcugacucuggcuauguguuccgaagcagaucaauucugugcacuuuguuauggguacauuuaggagcaucuauaaacucuaguugagcgauagauuguaucauuuucagcucuagcuggacuucuggccggcaguuuuuugcuucugugugugcuccacacacguguucauauuccaagaguuuggcgggaaguccuuucuaaugucgccuaggcgugauaaggcauuagggggguucucuaggaagcuacucucacaauaguggcuacaggcuggagccucuguuuuaaguuuuccaauccggcuacacaaggugguuuugagaauuaaccaaucaagccguacuuucagucauggguguugcaccaaucagagauugugauauuaagauuuacauuuacguacugggacgcuggcguuuuuucucuguccccgccccuuuguucacuucagagcucuggaauuccguccuaagaauuuuuaauuguguuuuccgagaaauugaaagcgcuccuauuuccuccaaacuuagccaccuucgcaguuuuuaggcacugaucacauugccacuauaaguguggaagcuuuuuuaauacccuggugguuagguuuuaguaaggaaauugaacaccacugacaguucugcacauuccuuccucauacauuguuuugagguuaucuguucucccuuauuuggucaguagaccaauaguaggcugaggacgugaaagaaaaaccauuuuggaagguuugguuugcaguuugacuucacaaauuugggcaaacaaaacaagcacauaaaaacacaaaccaaccuuaacuguccuucaggaagcugauccaaauuuggggaugccauuuccauuuaauuauugaaaguauuaaaguuuguguguguguguguguguguguguguauauuauauauauauauuuguauguauuuauuuauuuaaaauuggggcccccuuuucuuuuauccugaugauguaagaauucuacagauguuuaauugagcuucucauaggaagaaauuacauaucauuuaaaaaauauuuuuauauuauguguuuguguguguguguaggucagaggacaaccugcaacagucagcuggggcuucaggucuggaggcaagcaccugguauaagccaucaacucuaucgucuacguuucaaucuagcauuucauuagaggagaguagguaaaggaucuuguauucgagccucaagagcuguguucaauccagggauccauauguuggaagaacacaggcuccuaaaagaugguuuuugaccuccacaggccagugcuuguguaagucacccucugcucacaucuagcccagauaagguaaagcuauacugauaggcacugaauuacugaauuugauuucauguaauuuaaaaaaaauacuguaaaggauagguaaguuccuauuacauuuugacgugccugugauaucagaauuguauguguaaucagauguuuguagaauacucugcaguuauugugucucugaaugaaguucauguguaugaguguuccuucugucugcugauggaguugauuaucugaugauguuaaagaaugcucaauaaauacacagguaaaauaugaucauacuuacuacuuuucucaucccccacacuuuaaguccuuaaaggucauuaucuuaagaaugugcguuuauguguguuuacauuuaccacagccauuuucauugacuacacaacaaauaggaaauuuugggcuguugaacaagucuccaguaggacaaaaccugauuuaaaugcucguuuccauguuaaugcccuuuaaucccaggcagaugcaggcucaucuuucucuuguuucccucuacuuuaucaauauauuuggaagaauuuccaaaaucucaugaacugaauuagaauauugucugauauugauuggauuuacagauuuagaauaaauauauaaccauauaguaaaauguuuaugaacacaugggaauauucuucugaccuugaacucuauggucuaauuucuuaccaucucccuuagcugcucaaucaugccacuucaaauuuggggaguccauaaaauggaaaaauguuaguaugugaaacgucaauauuacuauuuguggauggauuaaaaauucaggaaaauaaggaaaugucauuuuugaauuuuuuuuuuauuuuuuuauuuauuuuuuuguuuuuuggagacaggguuuuucuguguagcuagcccuggcuauccuggaacucacucuguaguccaggcuagccuugaacucagagauccaucugccucugccucccaaaugcugggauuaaaggcaugugccaccacugcccagcuauuuuugaauuuacuugcauuucugcuaacauuucugugagauaaagcuguugguuacucaugaaucauauuuuuucuuauucauuguugaaggucauugucauggaacauacuauaacaacaaaagacaucuuaguuauauauagcaaaggagccuuuggacuccaaaccauugguuauuuaaauacuuuauucuucaguaauaaaacacugauagugucauaauuuuagguguacugcauagucuuuauucuaagaccacauuuaaacuucacacuguaggaaggaauauccauacaugcacugcucaugauuuguuuaguuaccugaagucuguuaucacaugacugacuggcucagguggaaugcuucaggccuuugguauuuuuuaauccuucugcaacagaggcaagauaauacuggaaaagcaccaacaucauaaauaucagaaaaaaauauuugauaucugaucagaggggcagcacuaaacuuguaaagacugacugcugacucaauuucuccacccuggacaaccagauagguuggauagauggaggaccagucucuagaaagcuacaggacuugcugcuuuuucacaucauugugacaucacaaacacagguucaagagucaauuucuagaaaaacaaaaaaauaaaaaacaaaaaaaaccaaaaaaacccaaaccaacaaaaagaugcuauuuuaaauuuucugcaugcgagagacagagcugcuuaaaucaugugccacugugaacacuguguagauuuaugauuauaggagaugcguaugauuuaccuuuggucuacuguguggagaaaugcagccagauuuguuaacauuucuucuuugccucugugcuacaucucucuccugaguauggacagaacucuuuaagugguaaugcuucauuuugaucaacuuuuggauaagggaggucuguggaauuuuuaaaaucaucaucauaacuaggacugcaagacuuaaggaggcuggugaagaugaauguuuuaauaguuguugcuuugggaaaaauagcgaggucugguuuucuuuggggaugaguuuuuaaaccuugcuuugggaggagguggagaaaggagagcguugaagguaagaacuuuuauuucugaaacuuccucuaagacuuaggucauuauauuaauuugaaguuugaaauuauuuugaggcagggucucauuauguauuugggauggauauagauguaacuccugauauagaacauguuggcuuuuuacuaauagagauccaccugccuuuguuuaccagucuugggauuaaaggccucauuuugaauuuugagacagauacuucucacuuauuucaugauagacucaaacuugauauauagccaaggauaaucuucaauuucugguccuuuucccucaauuucccaaguuuugggauuacagacuuuugcuaccuugcaaauauucugagaguugaauuuuggggguuuaaaauaauuuuuauacuuguaauucugaaaugacuacacaacauucugugucucucagucuaugucacauggauugucaucuuuuaguaucagaguguaugcacuacgugugugcaugugcugaugaacagucuagguaucgccauuauuuuucauaaauuucaaugugggagaaaauacuuaaaguuggaaguaccauguuaguuuuuuuuuuuuccaaaugagaauuucagcuugcagagugaacgucugaacuuuuuaaaaaaagauuuauuuauuuacuuuaugcauaugaauacacuguagcugucuucagauauaccagggauggcaucggaccacacuaccaaugguuguaagccacuaugugguuguggggaauugcacuugaucucugcaacaguagucagugaucuuaaccccugagccaucucucuagcaggagagccugaacuuuuacagguauauuuuuacauuacauguuggaaauaaaguaauaaaguauuaucaauuaaaaaaauaacugaauuguguaguauaagagauacuccaaagugcuuuuguuaugaguuguauuggguuuuaagaagguacauauauauuacaagauucaccugugaucuuaauugaauuauuugaugauucauucuaaaagcauuugagagcaccaacuauuacuuuuauugguugugaaaauuugcauuagauuuagaagcaauugaacucuggcaucauccuugauagggucggcuucugauuccaccacugaguccauacuuaguguauggaaaauaaaaggagggagguaucaggguuuuuuuaaauuacauuagggggaaauccaccuucucuuugccagaaaaaugaaauuguguucaaacuuuggccuuaguuagacacauggcauucuaauuuuaccuaaaauuuagaacacuuuuuauucaucacuuugcuagacgacuccuccagccuccacucuccaccucccaagcca

SEQ ID NO: 6953 - RNA, 1109 nt, Mus musculus
cuuuuuuuuuuuuuuuucugaagccaaaagcccuuuagccugcauuggcugggcauaguggucaagccuuuaauccuaccaaaaggaagguagaggcaggaucucugugagauugaagccaguuugaacaacuuaaugaguuccaagacagccggagcuacuaguuaagacgcugccuagaaaauaaaacccaaaaucaaaagcaacccuccaugucauuagcagggcuuuaccuacccuauugugucagaacguuaugugcacaguaacaugugcagaacauuuuaaccauguugccaaauaauuacaauucuguuguuucauggaaauugauacucuuggcauaaaaguaacuucacggucauuuugcucauaugcacacauguccuagugggcaaucuuaugaaucugaaaaaaauugacccauuuauuggagaagcugggggacaauugacagguugaauuuucuuaugccauugaauacaaaucggaaauuuuaguccuaaauccacuuaaggcuuauaguauuucagcacuuuacugaauuaagugaauggcucugaaaagagccuuuguuuuuuuuacgagauuagaagaaagaucuuauuuccccuuggccuugugguggcucucggucuucuugggcagcagcacggccuggauguugggcaggacgccgcccugcgcgauggucacgcggcccagcagcuuguugagcuccucgucguugcggauggccagcugcagguggcgcgggaugaugcgcgucuucuuguugucgcgggccgcguugcccgccagcuccaggaucucggccgucagguacuccagcacggccgccagguacaccggggcgccggcgcccacgcgcuccgaguaguugccuuugcggagcagccggugcacgcggcccacgggaaacugcaggccggcccgggaggagcgggucuuggccuuggcgcgagccuugccacccuguuugccacguccagacauugacgcaagaagguaggaaauuauaauugcaaagaauuacaacgaagcgguacuaaaaggccagacgagaagcuacuuauacucguacauggaaguggaaaagcugaugugug

SEQ ID NO: 6954 - RNA, 743 nt, Mus musculus
gggugggugcugggacuggcucgauacauaguaucuguuuaggcagguccaccugucuaucuucaguauugauagccuaaaagcaggccuguugucucauucuuuaaugcugacauucucaggagagggcugagggucagucaagauccuuuuuuccaagucccuuaagguauagaugcuauccugucucaaaaccaaacccucuaaucaauccaggccuuggaaaccuaggaacacugaauuauguucaaguuuucuaaccuggagcuuucuacaauuucuuccccucccuccuuucauucuuuccauguauucuguguaauagcccuggccuggaacuuacucuauacaccaggcucacagauaucuuccuaccucugccucccacguacugggauuaaaaucgugguccaccacacccagcuuucucuaacuuccuaaucuguaaaauaagcaccagagauugacguguaaaucuucuaucuauuccucaaggaaaacuucauaugguccaggacuucauuaacuuucgucagcauuaucaguuguucccaaagagucaccagagaagaaacaucagugucugcuaagaacuuaaaaaauuuuuuuuauuuguguuuauauauuucuuaccuuuauauacacuuuagggacuaaacucaggccaccaggcacacggagcacaugcuuuagcugucccuccagcccuucccuccaagaauuaaaaaaaaaaaaaaaaaaga

SEQ ID NO: 6955 - RNA, 9045 nt, Mus musculus
aauccuucauuagcauaaacgcccuauaaguaggagaaguccguucccagcccacacugagguuccuguguuuggaaauccgaagaugccugagccugcgaaguccgcucccgccccgaagaagggcuccaagaaggccgugaccaaggcccagaagaaggacggcaagaagcgcaagcgcagccgcaaggagagcuacucgguguacguguacaaggugcugaagcaagugcaccccgacaccggcaucuccuccaaggccaugggcaucaugaacucguucgugaacgacaucuucgagcgcaucgcgggcgaggcgucccgccuggcgcauuacaacaagcgcucgaccaucacgucccgggagauccagacggccgugcgccugcugcugcccggggagcuggccaagcacgcggugucggagggcaccaaggccgucaccaaguacaccagcuccaagugauccugccaaguaagccuccguagcgaauuccaaaggcucuuuucagagccacccacuuucucaaagagagagcugugguagaacagugcguucaguuuuacccagaagcagaugacaggugcuuauaaaucuuaaaggcagugggauacuuuuagcuuaauuucagucuugguuacauuuagcuacaaccauuuuguugggagaaaaaaaaaaagccuugcaaacgucacuuccggugaggcggacuugaguccaucagaacaaaguuguaggacaggagugacagacuuugaagaggauaauuguugccauuaggaaguuugucuuuuauaaguuguagguuuuacuuuggaaagaaguggcuccaagacugauguuaaacaugaggggucuguaacaaaggacaggcuuuucauuuguagauuuaauaucagauuaccgagcuaucuagcaugaaaucuuagaccaguaucuugguagaguauucuaaaauaugaccuggaauugucaaacuuacggcauugaaguucugguaaaagacggaacugaauuguucaaaugcaaaugcaaauguaucacuuuaccguacuuuggccauacuaaauuuucauaguccaagugacgugaaaguuuagagaaaugagaagauccgaagcaagcaguggggagaggcugaacuggaaggacuuaaugcaagaaaucccaaaacgaacgccguugcugugucuguugacuuaacaauucaaaauauaaggacuucagagucauuagcggaguuuaguccucugcuuguccaaaugaaaggcgaauauuuccaucacccuaguugcccccugaacaaacuuggccauaaauacuggcucgcuucuuccggccccacuuaucuaagccuuugucuugccuguucgaagaaacaguacacuugcucucuuccccacagaaguuaacagcaugcuaucaucuacaucauuuauuucuagaagcugugccuagauaugguuuaggauuacauuaugagcuagcaguguggggaaccuuuucagccuucugccgccuuaugucuccuuagugcugcagcuuuguucuugcacaacucuccuuuuucugguucgcauuugguugaauuguugccaaaauccacaaaucaggcucagaaguguauaaaaggcuccaggguugaaguagauugauacuuuucauuugaccagcaaaucauuggugauuuuuucacuucugccuuuggugagauucauguuguuucuuuguuuggccuguccuuuuuuaaucuccuuccaaauucuaugucucugucucuuggucccccccuucugcucugugugugugugugugugugugugugugugugugugugugugagagagagagagagagagagagagagagaaagagagagagagagaagagagagagagaaagagcgagcgagagaaagagcaagaagaaaucagugaaacagcaguaucuugucucgacauucuaaaagucacgauuugguaauuccaugccagauugucacaugcaguguuauuggcuauguucuuuuuauugcaagguuccagagaggagugagaaaaagcauaaacuugccugcugaggcagaauguuugcuucugcuauguauaaaacaguauuaacaguauuacuuaaaucuuaaugaguuaguuuauuauaagggauauggcauaacaguagaaugucuaccaaauuugaagaacaagaggaucaguccuguucugaauagugcucuccugacacgacgucugacuuaaaaucaauacuuuugucucauuagucauaauacuucaauagauaccuaugucuuuguucauugaccuucagucuuuucuguugucccaguuagcuccucucacuugcauaauugcugugaauauuuccuauuuuaugaauauaaauuugaggacauugucuaucccagcaggaaaugaauaaguuaugugauuuaaguguaaauugguuuuuauaaagggucuaaaaaaauguaucaacuuuaauuaauugaaaaccaucaauuacuauaaauuauuucacauucuuaggcauuacauuaagguguggccucuuuuaagguuggauucaaguuuaccuaguucuagucauaauugcauuuguacauuuuuuguuuacuuaauaauuugacuuuuggcuuaauuguguuaagauggaucuuuuauuauaauauaaaaguguuagcauaauaauguaguuuacagaagcuacgauuuguuguauaaaaaaacuacauuaaguuuacaaacuuuuuccacuaaauuuauuuacuugaauaaaaucacuuuuuaauauaaauaacauacauugaacuaagucaaaucacaaaguaauuuuaaaaauggaauuaaaacuuaaauaacaagugguaaggacucaacaugucagguuaaaaacugaauucacuggcaaauaauuacuuuaagaacuuagaugaaucguaaguggagugaauuagugucuucucauuagauacuaugcaauuucuaacuuagagguuacaaaacauaagacauuggaauguuugcucugugcaaauacccuauuguuacacagguuauaacaaauagcgcuuagcaaaauagaaaacacggaucuuuccauuuaacauggugagaucauccuuuccuuucccacuuagauuuguaggauugaaaguuacuggagaaaugccauggccuuagagaaccaggcagguuugggacuggugcuuguuaauguauauauaccggaacacaauugcuugcuguguuuaaagguguggcuuuaauugcuaucaaguucccuagcgacagaagaaaacacaauuauacaggauaaugauuaugcuuagucuauguuuuaagggaguuggcauuguuaaguaauauaguaauucacuuuagcacauaauacucagggguguguaccagacugucucuguuuucuuuuuauguagcugggauuuguccucauaucuuaauguagugaucaguugguuaccaaucuuaaaguucaugacaauaaauuuuuacaggaugaguuuuacaccaaaaacccauugugagguuuuucucauuuaucucuugguaacaaccaauuuuccuuuacacuacaaagaaagguuaggauucuaaaauaaucacuguuugaguucccagggacugucuacuuguaaucaauucuuuucuguuuguuuguuuguuuguuuugagacaggguuucucuguguagccugggcuguccuggaacucacuuuguagaccagguuauccucaaacucagaaauccgccugugucugccucccaagugcugggauuaaaggugugcgccacaaccgaccggcguaauugauucuuuaaaaauuguuuugaaaagaguacugaggagauaacucacugagcuauaugaagaccggaguuuacuuuucagaacuuguguaaaaauugcccgagguggugguggugguguugugugucuguagucagcauaggagaaaaugugugcuaauaauuaacucaauguccuugagguauuggcaaauggcacuguucugaccuugcacaguacaauaaucagaaggauggguugagaggugaaggaaacaugaaauggagaacccugaccugagaacugguucacugcugcaaaccauuguucugcaaggagaaggugaagccuuugagguugaaguuaaggccaaucacaguuucugugccucaguagcaucaccugucccuugaggauaaugguacuaguacuggccuucuggaaauaauacaacugauuaguguagcauugcaaaguaucuucuuugggguauggugaaaauugucacuaaguggcaguagagaagauacuaaagaccacuguuuuuguuuuguuuuuuguuuuguuuuguuuucauguaaaaagccuauugccaauucuaauauuuugaacuuagaauuucaaauuaagauagguaaaagggaaaguugucagagaaagguaaaaaauaugguuuuuuuucuuuaaaaguuacauuuuauuuuauuuuauuuuuuaagucuacuuccuccuucuaccugugacucccagggcuugagcucaggucuuuaggcuugguagcaagcaccuuuagucucucaagccaucuugccaaggacaagguuaaggucuuuaauccauccauauacugucugcugcuauugucuggcaauguuuauacauuuucauucuuacauuaaaagggcuuucagcuuaauaucaaaauuuugggaauaguucaucuaucacauugagagauagaacuuuacaaauuauagauaaaaugucagguugagagaaaaugcauucacccccugcgcccuggguggcuaagcucacagacaaugagccaagaauauaauugcuuuucaucuuuucuucaagacaggguaaacccaguuacuuaggugcuaaaaaaucaucuugcaagcauuuagguacugugguugguuauaaauaggaaaaaggaagugagucuucuuaagacaccuuaguucugaguggaaaaaaaaagaaguagcuggggggugggggugugaggcucaguggucaagugccugcuuuuguagaggaccuggguucaaauuccaguacucacaugucagcacacaaccaacuguaguccaguguauaugaugugccuuucuagucuccacaggcaccagucuugcaaauaauccaugccggcaaaacuaaaauuaaauuauaaaauauaauuaauauaauaaauuauauauaacaauauaaugauauaauacaauaaaauuuaaauacuauaauaaaaauaauaaauaaaucacaaaauaaaauuuaaaaaaaaguggaguauuuuauucucuuagaggauuauguagcccuaaauuguaaugugcaaauuguagaguauguagaguucauggccugcuccuggaucucucagcugcuggcuuguaaucgaugaagaguuuuaaaugacaacaccugucuaguucugauaagacaaacgugucaagaggaggcaacucaguacauucuugaccugcaaucuuggcuucuucagcuguauccuauuccccaacacuaaaauaucuggacccaagagcaacaaauuaaaacagaugaacaaucugaugaaauuuagacucacaugggaaccuaacagugugucugugaggccaugucugcaaagauuuaccccugaauggaggccaugccaucgcaugagcugaugaugagagggugaucucugcuuccugacaggggauguagugcggccuguggucucacagcccagccugucaugauggacaggaccuggagucacagucagcccucccuccuuccuuuggcugcuuugucacaguaacaagaaauuaaaaaauaauaauaaugauaauaauaauagaucuuuauucucgcuuugcuuuuucuuccuccucucuauuuucuuagguauaauuuuucucacauuuucucuacucucauuggccaaacuuagaaaaguucgucauuuaaauuuucaacaaauaugcauuucuauuguuagauuuuccuuaaacaauugaaguuauggacaccaggcucuggguuuuauacauacuuuuggauuuuaauauacugagauaaauauaaaauucuuaacauguguaacauauauuauaaaauuauuuaggaauucuacauagaugauucagguuccaaaauauuggauagaaaaacaaauaaaaaacccaaaacacuaccacuugcaagugugcauuagaaaugcacuuuuuaggggucgugcauaaagauagugcugaugguucuagacucucaagaaucaaaggcuggucuuuuggcucagucaauuguaaauauaaagaggaacguuaaucagauaaauguuaggugaaaaaucaaugggccucagcacacacuggcauuguggguguuucuggaguggccuaaacacaugcuuguuuuuccuuuaggacccucuacaaucccucgagacacauguggcuuggugggcugguucuuuacagccucugugcuccgcucugugcucugcucugccauguuguguaucccaggcacacuccuagccccugcuuguuucuugucuuccuuagcugcuggaucucuugaauuuuccccauuucuuucugcguggcaaacucuucccagcaucugcacagccacuuccuuccugggcagcgucuaauccaccucuucccacugcucuggacagcagugugcaguguggacuugggguuaccugucuguaaccucaguuauccuuugguuuaguuacccgagcauccccagggcagaucccucagucugccacacaguaggcacacauacaugacaauugaauggauccaguuugaaaauaaauuguaaagguaaauucuacacuucccaugcugugcagauguagguuacaaaauccaaaggugccuuccuuuagagaucugccguuuccugacagaagcuugucagaaacuacugaagaacugcucugacuccuuuuuuuguaagugucugcaaaaugcaugaugaaaggaagucuuccuaaaaugaagcgacagcuugaguauuccaggggucaagugagagucacaaucaccuucgaugggcuucacuuccggcccacucccugccacgcugauaugccagcccacagcuauuagagggaauuaucuaucaugcaaacccugcauacauuucuuguacuggccuugaucauguagaaagcauaauucaagauauacuuuuguuuacuuaucaagaacaaucagggaaaaaaauuaugacacccccucauuugacuaagcauugugggggggggcacuuuuucauuaaauaguuucuauuuauuguaaagaaagauagaagugaccuuucuagcagcugccugacggaaugaguauuugagaggauggagguuuuuggaaacuuaaugccugccuaaugugggaauagcaaacacuacuuucucaaacuguucucauacaagaacacuugugguccugugcaggcagcuccauggggcugcuggggaagccggugcucgaccuguaccauccccgcuccugggcagggccagugcuuugguuaggaacaaccugugcucucuguuuucaccuggcagaguccuaggcuuccaucaaagggaacuuccagggaagacuaauuagacggagccugcccauuaauucuuuaccccaaccaggcucaagggguucagaggguugguuuuuacugcauaggcccagcaucuauugauaccuggguaaaucaaucucucuguugcugaauuucauuuucuauaaucaggaggggaguagugguaguuauggcauaaugugguuaugaugacuaagccauugcguaguauuuauaggcuucucagaacacaagcgaucucuaagaaaaaccuccauaugcuaguugucauuguucugucuuagguagaacagaagguaccugcaggauagcugagugagucaaccuuucucucucucucucccucucuacaggaggagcagaccugacaucguuuguaccacucaacagugcuggaugcuguaaccucaagacagugcaaaugggugauacuagcagauuaaccaccauaguuucagaacucaaggaacaacugagaagcaccauuuuaaauucuauaaaaauguucacuguagaaauuugugauaagaaagacacacagacguagaaaaugagaauacuugcugcaaaauuaagaugcuccuagcaaaagaaugcuuuuaaguguuugucauguauggauauauaugauguauauauaauaaaugucauguaaagcaaaaaaaaugcgucauguuauaucacgucauaagaauaauuuuaaguaacuaggcucaugcuuagaaaucaugauuuauguauucauaccuaugugauuguuuguguuuuuaguuauuuugagccucuauuuuuuuguggaauauuagaaaguacaaaucacaaaucuuuauaaauuuucacuuuuuuuuuucuuuuuuugacuugaagggaaaacauuagauggagcaauugaaguggaaugugcaggauggagcuacagcacauguguguguguguguggaaggccuauucucagucccuaggacuguuguucaaagagaaaaggagagagagagagagagagagagagagagagagagagagagagagagaggaggcaauguggugacuuguaacuccaugacugacugaggagccuugggcaagaagacugggagcugaaggguagccuugacuauacugggaaacaaaagacaaaccuggacagcuuugugcauguaauuuuuuuucuuaaugcuuauuuucagcugccugggacaaaauaugaauccaagcuuuuuuguuuucuggauuuuaaauuauagcaccuaaaucuucacuaaaugcauuccauguuacuuuuaaagcaauagaagaauauauucugcgaaucuguaaagaucucccugaugcuuagaugccacugauaguuaaugaccuagaaauuuug

SEQ ID NO: 6956 - RNA, 914 nt, Mus musculus
cacuguuggcucuccuuuaguuuucacuugguguaguucuuguccagcucuugaccaugucggaaacggcuccugcggccucaaguacccuuguuccagcuccuguggaggagaaaccuucaucuaaaaggcgagggaaaaagccuggccuggccccugcucgcaaaccucgggguuucucaguuuccaagcugauuccugaggcccuuuccacaucgcaggaacgggcaggaaugucccuugcugcccugaagaaagcccuggcugcggcugguuacgacguggagaagaacaacagccguaucaagcuggcccucaagagacuugugaauaaaggaguccuggugcagaccaagggcacuggcgccucaggcuccuucaagcucaguaagaaggcggcuucugggaacgacaagggcaagggcaagaaaucugcuucugccaaggcuaagaagaugggcuugccccgggccucgagaucucccaagaguagcaagaccaaggcugucaagaagccaaaggcuacgcccacaaaagcuucugggagcggaaggaagaccaaaggggccaagggcgugcagcaacguaaaagccccgccaaagccagggcagcaaaccccaauucugggaaggcaaaaauggucaugcagaagaccgaucugaggaaggcagcagggaggaagugaguuucaaagccaguuuucaaaaacccaaaggcucuuuuaagagccacuuacauacuucuuaaaauggccaaacacuuugaaccaaaguuaaggugggcaguuacuucaggucgaccugucguugaaacccuagaguagaauccuagggucccuauguguagaauauuuccaaauuugguuguguauuuguggcuuuacgccagaauaaaggucaccauugaaacacac

SEQ ID NO: 6957 - RNA, 1564 nt, Mus musculus
agugaaugaaaacuaaacgcuuuuuauuagaagcauacacuuucaacagauagccaauuuaacauuuuggauuguacaaagcauuaccaagaaaccucaguauucauacaaggucaaucuucagugacgacacacacguauaaagcaagcgcuucgggaagcugaggcaaaacaaaguuaaucuacaacuaugcugaucaaaauaaggcaaagcaaguguaauugguaaugguaaaaaacuugaaaaaaaaauggcugacaaaagguugugacgcaguucaacccacaacuccaucgcuguggcaaacaaaccgaaaguacgagaagcaaucgucucagucccgaguccaacuuaacugugcaggcuagucguuccggcagcuaccccaugucuuuaauauuaaggaaggcaguucguuggcgccagcaccccaccuucucccaaacuuccaggcuaacccccacaagaggcugagcauagaagccaccuacaagccccggaugcguuucuccaggcaggaagcucaaacuucgggauggcgcccaaucaaacgaagaacuagaguccugggccggagugagccaacccacaagcagggcggaacuuucaaaucaccuugcaguccaauacgaacuagcgccgaggguugcuuucugcugcugacagccgugggaggguguuccagcccauagcacuuccugagcagcccagcacaaacaagucuaggugggacacgcaaccccacccaucccaccgggggagcgagugcugccgggaucgagucccuugcaaccuugcuucauuaaucacacaaaugucacagcucuuaagugggagugguggcucugaaaagagccuuuuggauuguuaggggaggcagccuacuuuuucuuggcugcaaccuucuuggccuuggcaaccuugggcuuggcagccuuuggcuuuacggcuuuagacgcgcucuugaccuucuugggcuuggugaccuucgccuucuuugggcucuuggccacuuucuuggucacagccgccgccgcgggcuucuucgccuucuucggggucuucuuggccgccuuuuuggguguggcagcaccagucgccuucuuaggcuucuuggcugcucccgcgggcuucuucgccuuggccgcgccugccuucuuagccugggguuuggccucgccagaagccgccuucuuguugaguuugaaggagccggaggcaccggugcccuugguuugcaccaggaugcccuugcucaccaggcucuucaggccgagcuugaugcggcuguuguucuucuccacaucguaccccgcggccgccagcgccuucuugagcgcagccagggacacgccgcugcgcuccuuggaggcggccacagccuuggugaugagcucggacaccggggguccggacgccuuacggcgcaccccggcgggcuucuuggcggccuucuuuuuggcaggcgccuucuccgcagggggcgcggcagcgggggcagcaggagcagccucagacaugaugagucucuggaagucaggaacuaguggcaguacgccgaua

SEQ ID NO: 6958 - RNA, 749 nt, Mus musculus
uacuucuuuucuucgucuuggguauagcuguuguuuauucaucagcaaccaugucggagacggcgccagucgcucaggcugcuucuacugccacggagaaaccugcugcugcaaagaagaccaagaagccggcaaaagcugccgcuccucggaagaagcccgcgggaccuucggugucggagcucaucgugcaggcaguuucuucuuccaaagagcgcaguggcguguccuuggccgcgcucaagaagucgcuggcugcggcgggauacgauguggagaagaacaacagccgcaucaaacuggggcugaaaagccuggugaauaaaggcacacuggugcagaccaagggcaccggcgcugcuggcucuuuuaagcugaacaagaaggcugaguccaaggccaucaccaccaaggugucagugaaggcgaaagcauccggggcugcuaagaaaccuaagaagacugcuggggcugcagcuaagaagacugucaagacuccgaagaagcccaagaagccugcaguuuccaagaagacuuccaagagccccaagaagccgaagguggugaaggccaagaagguagccaaaagcccugccaaggcgaaggcagugaagccuaaggcuuccaaggcgaaagugacaaagccaaagaccccagcuaagcccaagaaggcagcgcccaagaaaaagugaacaguuggaggcuucuucuauaaauaacccaacggcucuuuucagagccaccaacau

SEQ ID NO: 6959 - RNA, 749 nt, Mus musculus
auguugguggcucugaaaagagccguuggguuauuuauagaagaagccuccaacuguucacuuuuucuugggcgcugccuucuugggcuuagcuggggucuuuggcuuugucacuuucgccuuggaagccuuaggcuucacugccuucgccuuggcagggcuuuuggcuaccuucuuggccuucaccaccuucggcuucuuggggcucuuggaagucuucuuggaaacugcaggcuucuugggcuucuucggagucuugacagucuucuuagcugcagccccagcagucuucuuagguuucuuagcagccccggaugcuuucgccuucacugacaccuugguggugauggccuuggacucagccuucuuguucagcuuaaaagagccagcagcgccggugcccuuggucugcaccagugugccuuuauucaccaggcuuuucagccccaguuugaugcggcuguuguucuucuccacaucguaucccgccgcagccagcgacuucuugagcgcggccaaggacacgccacugcgcucuuuggaagaagaaacugccugcacgaugagcuccgacaccgaaggucccgcgggcuucuuccgaggagcggcagcuuuugccggcuucuuggucuucuuugcagcagcagguuucuccguggcaguagaagcagccugagcgacuggcgccgucuccgacaugguugcugaugaauaaacaacagcuauacccaagacgaagaaaagaagua

SEQ ID NO: 6960 - RNA, 392 nt, Mus musculus
caugucugguccuacaaagcgggguggcaaggcucgugccaaggucaagucucgcucuuccagggcagguuugcaguuuccugugggucgugugcaccggcuucuccgccaagggaacuacgcacaacgaauuggggcuggugcaccaguguaucuggcggcagugcuagaauacuugacagcugagguccuggagcuggcgggcaacgcagcccgggacaacaagaagacgcgcauuacuccucgccaccugcagcuggccauccgcaacgacgaggagcucaacaaguugcuuggccgcgugaccaucgcgcaggguggcguccugcccaacauccaggccgugcugcugcccaagaagaccgagagccacaagucccagaccaagugac

SEQ ID NO: 6961 - RNA, 392 nt, Mus musculus
gucacuuggucugggacuuguggcucucggucuucuugggcagcagcacggccuggauguugggcaggacgccacccugcgcgauggucacgcggccaagcaacuuguugagcuccucgucguugcggauggccagcugcagguggcgaggaguaaugcgcgucuucuuguugucccgggcugcguugcccgccagcuccaggaccucagcugucaaguauucuagcacugccgccagauacacuggugcaccagccccaauucguugugcguaguucccuuggcggagaagccggugcacacgacccacaggaaacugcaaaccugcccuggaagagcgagacuugaccuuggcacgagccuugccaccccgcuuuguaggaccagacaug

SEQ ID NO: 6962 - RNA, 10111 nt, Mus musculus
auacaauguucaacaggaaauugaaguuuauuuaauauacaguuuauaucugacacugacaaaaaugaaaaugcuauuuacauaaaacggauuaaaaauacacacuaucuguauuuuaacauagugauagccccaggauucaaaccuggcuuccagcacuugcaccguguaguuaguuuaccaagagcuauacuaaagggcaacgcuggcagugcgucccacaccucauguacacggccuagcauccguggaggaagacacagucucuucagcacacgucccagcuccugagucuuccaguucugaauacucaacagcuucuucuucagaaucaaauuccugacuauccggugauucaaaguuauccagagguucauuacucagccucuuuuagggaauaaaccaguaauuuauugucaagaccucaaaacggaaaucuacuacuaaucauacugauauagcaacccaucaauguuauucacuuacaguaaguacaucaaagucuauacacugcuauaucauauuucaguaaaauucacaguaauuugcuagcucuuuuaaugcauugacugagcuccucaaaaaagcauaauuuaaaaugguacuucucuggggacccacagaacuguguguuagcuccauacuaccuggagaaccauacuuuuaaagccacagagagggcuaguucaaagacugucauggcagggcuggagaugacuuagugguuagagcaugcagccuuccaccugaggaccaguucccagcaaccacacaaggugucuguaacucuagcuccaggcuagacucuuugcacagcacauacuuacacauaauuaauaacgguuaaaaacacugucaugagucuaaaauauuaaggaagcaauuuaaugugagaagguuugacuugaaauuauucccauugguaagauggauuugcuuugcacaaacaacaaagacugaaaacguggaucaagccaaaccuaguaaagucacagaaaucggcauauaauaauaaacauauuagcugcuucucaaauuuaaaaagucagauaaagccgggcagugguggcgcacgccuuugaucccagcacuugggaggcagaggcaggcggauuucugaguuugaggccagccuggucuacaaagugaguuccaggacagccagggcuacacagagaaacccugucucgaaaaaccaaaaaaaaaaaaaaagucagauaaagucacaaagccuauuuauuguauaaaugauagcugauaucaugcuuauaaaaaaaaaaauagaaccuagaaacaugucaccugugcaguagaguaaauuuuccuaucuuuuucacaugugggcauuucgcucccaguuuacagguaaggaaaaugaaacccugacaggauaaauaaccguucuauccaaaccucaguggugcugagaaccacaucacacggcugaacacucgcugaucacaacacggccaaugacugagccccugacugugggaugaccuaccucgauuaccuccgccauguacugcacgugcucagcuacuucugccaagucuuuauucuccuuucucaggcgggcaaucucacuguccuuuuguucaauuucuuuaugaagcuguauaggaagaacagaaucuccguauuccacagaacucugacguggagcacccucccacgccgcaacacagcacgacucauucccucacucgguucccuuagaccaacacucaagcuagucuauggcaccgucgccuuccuuacuacgcugaugagagagcaccagcgaaccgugaauggaacgaagcaacgcuuacuuucucauucucuuucagcgcuucguagagagcuuuccuccgcugcucugccacuucuuuccaauacugagaagauggguucucuggggaaaaaaaaauuaguguuuuauguaacuucaaauaucagugcucuaagccuggucguagcagaguauaccuagagugaaaacaaguccuuguuucaaaaauaacaaaaaaaaaacuuagcugggugugguggcacacaccuuuaauuccaguacuugggagucagaggcaaacaagaucucugugagccugaggcuagccuggucuacagagcuccagcacagccaggguuacacagaaaaacacugucucaaaaaauaaaaacaaaaacaaccuuacugcuaaaaaaaaaaaaaaaaaaaaaaaaaagcaauaauuuauuuuuauucaaaaaucccaaucucauuuuauuuucucacaauaucaucaaaguuuucgaucccugagcugcaacagaaggaaaauaagugcauugcuuaauauuuuacaagaucuguuuugugcuuauucacuuuuuauuuaaccuuuauggggacucugccaccacucaguccaaauauaagauugaaaagucuagacuaguuaaucugcauauaauucuuaauuuugaauuuguuucaagcucaacaucuguggcuagaauauugcacacaugcgcuguguucucagugaaucaucaggaaguccacagcaaagucacaaaacugaauauaaaauuucaccaaguugauuaagaugccauaaaccaaguuucucccugguaaagauuguuuuucuugguaauuaguaagagaucuagggaguaaaacuugaguuuguuaaucuauuccccaaccaauuuuaacacuacuaugauucuugccuaaaucaucuguaacucaccacagcagcugacuuugaaaugaauucucccuuuucaguuuucuauuaucacuacagauucauauguuccuucccauucaauguacuaagacuaauucugucugucugucugucuguccuuugagacauguaucccagguuagccuggaacuucaugaacagcugagaauggcugugagaugacccuaccuucaccuuggaaaacauguauuacaggugcgugacagcacugcucauuuugacggugacguuuucacccguuuaaucaaugugaaucuguuucuuaaacagguccaccauguucccuuacucugauauaagaaacuuggggaucacuacccagugcccugcucuccuggaaucagccacuuccuuaagagcauccgugcagagcagaguuuaaaaaccaagaacuggcucucuggugugcuuccugcuuucaguagagggcuuuuaacuauccauucauacuaguucucccaacuccaguacaagaguucacccuucccuucuucauuccacacaugguuuucccauucacccuaguacggaccugccucccaacaaacacaucacucauugcuccauuccaaagcauacacaacauuuuucuuuucaagaguacacuaaugcacuaccaacagauuccacaaaacucaggcacucugcgcaagccucuuacuucuacugauacaucccacuggaauucugaagucagaggugugcugguacuuucaauacuaggacagugcaugaucacugaugauuaugugagccauguuuuugccgaguauggagcuaacccuugacagauuuuaaccuacauuacgaguacaaacauuuaaguucuguucugucucaugaaaaagcuguuguggaucuauccaguugcccaacuguuucuugguuuugggguuuuuuuuguuuguuuguuuguuuguuuuuuugguuuuuuucaagauaggguuucuguguagcccuggcuguccugaaacucauucuguagaccaggcuggccuugaacucagaaaucugccugccucugccuccuaagugcugggauucaaggcguguaccaccacugcccggcugcccaacuguuucuaacuuugcccuaucgaaguacuuucugcuucuaaacuuccuuacaacaucccaaguaacuaagaucaaaccuaccuguuccuguguccuugaacaagccuaugcuuaaauuucucacggccacugaccaauacagaagaaaaaaaaagucgucucacugaugagccagguguggcagcucaagauugucacugaagaggcugaggcaaaaauucaaagccagaccggggcuacacugaguucuaggacaguccaggcugcagugucucacaaaaaaagaaaagcccaaccacaauguuucuaaaacaucaucaguuuccucuucagauuucuucuacuccuccauuaaauacuaccacuuuuuaaaaguguuucggcaggcagugguggcacacaccuuugauccuagcacucggggagcagaggcaggcagaucucucauuuggaggccagccuuuucuucagaaugaguucuaaaauagcccggacuacacagaggaacccggugucucaagaaaaauacaaaaaaauaaaaaggaagaaaggaaggagaaaaaaagguguauuucucauuuaccuucaaccccuuucuccagugauguucccccggucccauuacuuaguguucucuuggaauauucaaauccauucuccauuaacacuuuucugaaaagcccauuucugggucuuaaagaucccaaugcaacuuacugagacgccaacucagucacuguccuguucuuuaauauuucacccacacuggggucuugccaaacaaauggucugucccaugcguccaaauuuagaguauuuucauauuuacaacacaaaauuuuaaauuaucaaacagcaaccccaccaaguaagacaccauaauuuaaccuuucaaggcaagacuuauguugguuuuuuuuuuuuuuuuugcauaccuuuacuuauaagaucaaaggcuuccugggugaggucuccaacauccuuauuuucauuagcuucuggaccacagcuugaagucugagaugcuagcuggucaucccaaagcuuccuuuugaacaagccuuuuggcaacugugauuugaugaacaagaaagcuacauuauuuacuuauguaguuaagaauccauuuuaaaaguuauauaauucaaaaccaccaaaauagggcuggugaguuaguucauugguuaaugguacuugccaccaagacuaacaaccugcauucuauccaggggacccacacagugaaggaagcagagucccgaaagcuccucugacuucaguuggggacuguaguacuuaugggcuuuaaagaccaugcaaacauauauauaccuacacagguaugugcagauacaaaauagcuguauuuuuuuagauuuuauuguaauuacguuuuuauaucucuguguuaguuuauacauuuacaugcaguucuuggccagaaaagggugucccaucccuuuaaggaaaagcgacaggcaguugagcugcccacugggaacugaacucagguccucuucagcccagaaauguaauuuaaaaaaaaaaaaaguuaccagaauguauaauauuauuuuaggaaucuuauuugcaauuauuuugguuagaacuacagcuuagcuacaauaaagaaaagauuaggggguggagagauggcucagcaguuaaaagcacuggcugcucuuccagagguccugaguucaaaucccagcaaccacaugguggcucacaaccaucuguaaugagaccugauaccuucugacagcuacaguauacuuauauauaaugaauaaaugaaucuuaaaaaaagagagagaaaaagagaaagaaagagaaaaaggaagaaagaaaagguuuguuuuuaagaaagucggggaaaugucuagugcugacuggcccacgguccacccauccuagcccuguacacauaccucauuuucucugccaacaagagauccaucugcagaaggcuggaucaucuucagcguucuccuugggacaggacuauucuaaaagucaagaugauucauuaucugguuacagcuguaggauuacuuucugaguuuuuacauauuagacuuagucuuacuagaauuugaaaggaaaaaaaaaaucacuaagaacacaaaauuuggccugcuauauacauaaagucucacagugcuguauccaaaccagauauuggcuucaucaaccagcagacucaucucccaagagaauacuaaagcuugaaaagaucguuaaugggcccuaccauccaaccagauacacauaacuucccucauucucacacauauucucacuguacucacagucaacuuacuuaucucaggcaaaacacacgugacauacuuccuguguuggcauugauuguccaaacacuagccgggcagcgguggcgcgagccuuuaaucccagcacucaggaggcagaggcagguggauuucugaguucgaggccagccuggucuacaaagugagcuccaggacagccagggcuacacagagaaacccugucucgagaaaaaagauuaaaaaaaaaaaagauucuuccaaauuuggaauuuauaaacacucuacuuacaagagguaaacacugagagaagaguaaguuaaaccacaaaauacucucuaauaaaaaagauucaucucauuucagaacucuaaauauucccaaacaauaauggacauuugugaaaaccugcugguuaauuuuuaccaaaaaacaaaaacaaaagcaaaacaaaacaaaacaaaaacaaaaaaaaaacgaccguaucugggaaaagggaagcucagcuguugaaaugcuauuaucacaauggccuauagacaaguggggggcggggaggaagcacauuuucuugauugauugucgaugugaagggcucagcuguugccaugcuaucccugggguuaagaguuggcuagaggugagggguuaggggagaagccaguaaguaaggagcguuccugcauggccuaugcuucaguuccugccuugaauuccuguucugcccucucucaagggucagacagugacucaagagcuagaaccugaaauaaacucucauccuguuuguuucugcucaugguggguuuguuguuguuuugguuuuucugagaccggguuucucuguguagcuguggcuauccuagaacuuacuauguagaucaggcuggccuuaaacucacagagauccaccugcuuauaccuucuugcugggacuaacgggugugucaccgugccugacacaaggaauguaacuuuuagcaauacauuguagguggaauuguaagugggaacaaaugcauguguggauaaugguagccccucagcuauccccugacaguagaagcaguuuugcuacaaguccauucauuaggacauugauagaaugucagugcuuuaggcaaauuaaauacucugguccaggcugguagcacaaaccuguaaucccagcacuggguagguugggaggcaggcaggagaagcucucuugaguucaaggccagccagaugucuacaucacagugaguggcacaguaaccagggccacuuacugagaaccuauaucaaaaaauaaacaccaauaacaaaaacaagccagacuugguggcauaaaccuuuaauccugccacuuggaaggcagagauaggagaauuucuaugaauuucaggauagccacggcuacuaguaagaccuugccucaaaacaagcccuuccaaaaacaaacaacaaaagccuucuaaaaugcccaagcuauuauuuuaaaaacaaaaaguugccuucuuuaugauaugcaaauagccccuguaguguucccgauuugaaaguuuuauuugggaaagaaaaucauuaguuauacugccaccaugggacagcaaacaaugguaaacacucaagcaagguuagcaagaacaugacaccacaccugcgugagaaaguuacugugcuucacacggcugcguccaccuuucccacgguagccucuaguguugcuuaucucgcugugcaacggagggaccaaugccagccaccacgagaacaaauauuaucacgacaucucagauacaauguaggugccagauuaaucaagucuccaaacagaagaaaauacaacuaagugcuugauguugaucauggucaaagaagccaacccaccugcugucaugcucacguucacacacaacacuuccacgacuuccacuucauagauguaagcuuucugaacgauagcccacggaauguauacuacuauauccuuuucucuaaacacacagugcacagaagagcagacuucuagacuccaaguuucacucauauuuaaaucuuaacccucuuccuaaaacuauauacaagcguauacuccguucacucuggcacuggaggaaaucucagcccccgggguuuggggccagccugggcaacacaacaaaacuucaccucuuaauuaaaacaaauucaagcacacugaaguggcuccauuacauaccuucacauucucuugggcucccuccugcuucugcuucauacugagauucauuuuucagcuggcaaagcacaagaagaaaaggugauuucaguauuuauaucugaauguggaaucuagauuuuuuuuuuagaaaauuauuuauaccacaaaaaucuuacuacuuuaugguagaaccacuaucuguaacaauggcacaguguccuguacaaacuacagagaucucaaaaagaccugagaaaagggcacugggaaaagccaaacagacacuugggcccauucacccuaaagaacagcaucaugcacaugacugcaauccuggaacacgguggagauaggagccuaugggagccuaggcuacgcagccaagagccugucucaaaaacaaaaacaaaacccaagaucuuuuggcuccaaccaagaugucgagcucagugaguacugugcauaacaagcaugcacaaaggcucagcucaguuccugguacugcauaaccagacacaaguccauaauaccagcagcugggcagagaaccagaauucaagguuauagucagcuacguagcaaacacaagaccaagcugaauuuaaaaggaggcuagggggaacgguaaacuguaccccccaccucuuacuuacauguaauuaaaaauuuacauugugcccuggcacucacccauguaugcaaauauaaacaacuuauagcccagccagagugguguucuguuauuuccuauucuauuucaaguuaauaaaacccgaucgccaaaaacaaaacaaaacaaaacaaaacaaaaauugggcagcgguggcacacgccuuuaauccuagcacuugggaggcagaggcaggcggauucaugaguucaaggccagccugguuuacagagugaguuccaggccagggcuacacagagaaacccucugucucggaaaaacaaacaaacaaacaaacaaacaaacaaaaaacccgaucggaaaccuauucgcaggggcuuugauguauuucucuuuucuuuuuaaauggcuaagugggcaaagcugaccuugaacuccuguaccuccugccucaaccuccugggugcaggagacugagcacugacaccaggcccagacuuggauaacgaaggcagugggccaagaucccgcuaucauuagugagucgugagcacagagacagugucggagaaccuacuaucaccuacagcggcaccacugggagagcagacgcaggacucaaugcccuugucccaggaguagcguuugcugcaguuggugagcaggcgggagggaucuacacccaguucaaccccuagccgugcaaucagcccggacuccgaggcagcaaacuuccccgggcgcgccggccccgcccaacgcggcgcgcgccagccaauaggaagagcgaacaccagagcgcgccaaaaccgaccucaccaauggcgcagccccucgucucagcucgcccagcuuugccuugcagucgggccgagacucgggucccuuucaaguccccagacucgggucccuucaaaucgucgccucccaggccggcuccccguggcugagaagcaggccgggcauucgggccagcccggcgaucccgcggccggaguugcacucgccccgcccucggucucccgcgcccucggacucacagacagcaaugcucaguucccggcgagcgugagagccgcacaaggcccuggcaccacaccggauucaacgacgccagaacgacccgaaccugcagacuaacccgccgacccgguagcugacgcgccgaaaggcggagccucg

SEQ ID NO: 6963 - RNA, 2241 nt, Mus musculus
cuacaaucaagcucucccaauaaacgugugcagaacuacagggaguauucagaacugcaucacggggaaggagcaguuaauaaagguucccgcaaaacagacugcugagaaggauccggcguggauucagaacucuucagcugaggaacggugguaccuguaagucucccaaauugauccccagguuaaagggggauauguuuuuuaagaaaaagaaaagggaggaaaaauaaaaggaaucagugauaaagaaaaggaaauaguaaaggaaaggaaaagggaaaggaaagaaaaaaaaaggaaagagaaaaggaaaagagagaagagaaggaaagaaaggauugagaugauaagguucccggcuuugggacaaguuaagguucaugaguuaugcuuuuuucucccauugacccuuuguugguaggucugauaguuuuggucuuguuuguucugauauauggacucuguuacuguuugaaacuguguguagaggcagucaagacaggucagaaaauccuuacagagcaacaagaaaguaugucggaagaggugaagggcuuaaaaagaaaaaggaaaaagaaaggagacacaguguuaucagguggaccagaagaagaaaguauauagcaagcuuauggcuugcuuaaugaaaguuuaaaaaauaauggcuugauuauugcaccagaaaagguacagcagucuaauguuagucauuuucuaggagcuacuauuacuuuacgaugugucaccccacaaaagauuaguauaagaaaagaucaucuaaagacacuaaaugauuuucaaaaauuauuaggagauauuguccuacagugugguaaauguguagaauuuauuaaugcaccuuccauggguauuaauccgcgcggauugcgaccccuagauguuuggcaaauggacgucacgcauaucccaucuuuugggaaauuacaauauguacauguauccaucgauaccaguucugguguccuacaugccucucccuugauaggggaaaaagcaguucaugucauaucucacugcuuagaggcuugggcugcauggggcaagccccuaguguuaaagacagauaauaguccugcauauacuucuucuaaauuuagccaauuuugcaaacaaaugcaagugaaacauauuacuggauugcccuauaauccacagggccaaggcaucauugagagagcccaccgcacucugaaacaauauuugcaaaaacagaaagggggaauagaggcuaugaugccaaagauggcucuaucccuuacaauauuuacucuuaauuuuuaaaaauuggaugaugcuggaagaucaccagcugaaaggcacggacaauggccucaaucgcccaaugaaauggucaaauggaaaaauguccuugauaauaaaugguauggcccggauccuaucuuaaucagaucccggggagcuauuuguguuuuuccacagggugaagaaaauccacuuugggucccgacacgacugacaaggaccgugaaagagcaagaugaacccccaagaugauucuccugcuccugaugauugaaaccaggauaaguauaccuuuaugggccauaguaagaucauggccaguaccuuuaccgguacauuccaauucuucuaccuagccuuuguuuuuugcaaaggaauguuuuuuggaugugccuuaugcacgacaaacuccucaagagccacggguguauaagaguacuaguuuucauuuaaauuauacauuaugcuuugugcauaauguagauaaaccuuuuacacccuaaauauuuuuuaagaaagauuaucucuaauugggcagaucaaauuaauacugcugacacuauaagucagauagcagaaaaaacaucugaagcauugcuuacccugcaaaggguggauucucauaucaccucaggguuaauguuagugaaucagagaguggauauuuuacaacaugacaugggacagaugauggaugucauacaaaugaguuguguggcauccacaucgcauguaugcauuacucccaauagguauauuaauaauucuuuuauuaaaaguacagaccuaucgaauuaccugaaggggaacuggucgcaggagcuggaaagguugcagacaaggcugcagauacagauccugaaccuuaaugggaccagaguggaaccagugacccucggagacuuuaacuccuggcuuaccucuacuuuuucuuacuuuaaggaauggguggga

SEQ ID NO: 6964 - RNA, 13602 nt, Mus musculus
aggggaaggaggggccgaggaggccugaagguugcgcgugcgcgcuggggcgcuaaagagugaagguaacccgugaucaucuaggaccagggcgaccggggcgcgcgauccuuucucccgagcacgacgcgacagcggccgggcuugcagacuugaccuuccacacccuuguccucucacaaacgucucuuccagaguucauucucgcagagcccagacucuugcuuugcguccacgaugagcagcaugacccagaaccuacgagaaguaaugaagguuauguucaaaguucccgguuuugauagaguuuuggaaaagguauauuuauuguaggcgaaguaucuggugaaggggacgaaccuaguaaaacaccuuaguggccucgcaaacgcaggggaagugcguggcguggauucucaucgaaacguaaauaagcauguuugguuuuuuguuuuuuguuuuuuuuuuaaccagcaaacuguuggaguguguggagaaaaaaugucagcguaccauuuaagggacgcuggagccugcagggcuaguauauaggaauuguuucuuaagagucaaggagguuugagguacggaagugaaugcgagaaccaccuguacguguguuguauuucuugcuuuugagacuaggucuuuguaacuaggucuauguaacuauguaacguuuguuggcugagaacccuuguaguccaggcuggccugggagucuacagaguuaaccaggaccagugccugcacccugccauuccacaugaacuaacguagacuacuguuuuccagacuuuauagacauuguguucuauaggaagcaauccuuaauaaauauccguagcagaaguccagugcgugguauugucagaguagaaagacacuuaaccuuagaacuugcugcagacuuuuuaauaaauguuuuaaugcacgcaugucuauuuuucugauuaagaaaaaauacuuggaaauuuaaaaagaauuugggcaugaaauauaaauuuuggucaacaacaggcauuugaaaucuuuuuccugaacacgcccccucuuagaauuuuuuaacuauguucauaaagugucaaaaaaauaggaaauaacccuuagguaaauauauuuaauguuuuccaauaggaaauauuucaaaacuaaggacagcauuugacagugacuuuuagaaagauaauauuaccuaaaaagaauuuuaaugauuuaagaggaaauuuuaauucuuuaaaaacaaccaaaaacaacuuuaugaggacugggauguaguuaauccaagcuugcaggugggagcccgucauugacaggguugcaggugggcaccugucguugacaggguuccauagccacuucuccguaagcuuuccucacccuccuggguauuagaauauuuuguaacguauuuauuugguuuuauuuauuuauuuauuuucuauuauuuauuuaaguucuauccagaacuugacauguagaccaggucauccuggaucucacagagauugaucagccucugcuacuugaguauugggaugaauaguaugugccacagcaucugacuguuuuuuugugagguaauuuugacauugguuugauugccuuugaguaacuaauuaaaauucucauaccuacguucagcuugguaccugccuguaauuccaggcuaagggaggcugaugcaggcuagcuuguaagcuaguuacauaaacaaaucccucaaaaaaaaaaaaaagugauuuuuuuuuuaaaacacuuaauaguugaaaauuagcauaaaucucacauuuguaguauggcuagccacacugcacaaguuuauuauuuauagguagcagcuaguggcuguuaaacuacauggggucgauaauauaauaauaguuauugugugauugauaacuuaugacagacagauaagagguuguuuugguuuuuuuuuucuuuuuuuuucuuuuuuuuuuuauuacguauuuucuucaauuacauuuccaaugcuaucccaaaagucccccccccacacacacacaagagguuguuuuaugugggaugagaagcuaagacuaaaguauauauuuuuguauaauggcauguauauguguauguguggguuuugugauuuccuuuuuuuuuuuuuuuuuuuuuguuuuguuuuucgagacaggguuucucuguauagcccuggcuguccuggaacucacucuguagaccaggcuggccucgaacucagaaauccuccugccucugccucccgagugcugggauuaaaggcaugcgccaccaccgcccggcuguuuuguuuuuugagacaggauccugacuggucugaaacuuguauugacuuuccaugccucugucucccgagugcugguauuacucaugugguguauucugucaccaaugauucauaaaagauugcuauacuugcuaauucugcaaggacuucaacauccuggucgagucucauuuucauaagacaauacaaaacaccuaacucuucacuuuccaauuuuuugugcucauguggcucggcugguagaaugcuugccuggcacgcacaaaccccugguuuccaucucuagcaucacagaaaagcagaugugguaacacgcaccuguaauguaaccagcaacauucagggaaggagacagaucagaaguucaaaaucauccucaaguucauaccuaguucaaggccaaccugaauuauauaagagacauugucucaaaagaaaaagaaaaaagaaauuaugucugcaugauacauguuuuccuacaguguaacuuucccuggggagaaaugaacuaacaucuguucaccccagguaggguagcaacaguaagccugcuaacacagugaccucgugaguguuuuagaguacacagcacucggaggcagcugcaucacugaaaagcccaccccuccacgagugggaacucaguauugcugcaucucugaagcgcccuacuugcagaggcaggccagcuagcaggaaacugucgucccuccaugcuugcaaauuugguuugcuuccaaaagggaaucuuucaaauugucuuauuggcaauuugaauuauuauugggcagccuuggaaauccagucacgagggcacacaguuugcaccucauguuaggagaacucaggcacacuaccacauccuggugagugaaccugagcuuuagaaugcauucaagccagagccugcaaaagagcuuccagccagcugcaggacagaacuccgaggcccugcuuucuuuuuagaaagauuguuccauuuuguagauacacuauacuuuauucaaaugcccucuuuauaggaacacuugaauauaaagaauacuggaauacacuuaagugcuuguuuauaacuuucaagguucugcaaggaaggcaggagaccucguaagggccagcagugccucccuagauuccugccacaggcuuggguauuuauuuucaccagccuucucuggcugccuccuuuggaguccuauccaaagacacauuuacaguaauucauagauucuaguuggccuuuucaauucuagaauugagcacuacuuauauaaagcugcacauuuuuugagaauuuuuuuuguauguugauuauucuuugagaacuucaaauggaauguauuugaauggacucacuccguaguccucucagaugcacucgcugcugccucccagugugauguccuccuuuugcuuuuuguuuuauuuuguuuuggaucgguuuuaucaauucagaguuuuucuguguaacagccccuaguauccuggaacucacuuuguagaucaggccugccacaaacucacagagaucugccugcccccgacucccgcauguuaggauuaaaggcuucugcuaccgggccuggcugccuuuuuggucuucuuuugaaacuuuagucuuggcugcacuggagcucccugaggagaucaggcuguaggcugacuuugaacuccgagauccuuccgucucuggcucccaagugcugaaaugaaagacaugcagcaccacacccuccuuuuuucuucuucuucuucuuuuuaaaauaacccaguaaguccaguuugugcugucgugaguguggggcauggggccaugugcuagaguguagcuggagggugcccucccucagaaguggucaccucucagcaacucuucagcugggguggagacucgugagccacuucccuuugggcugcaaugcugaccacuuugauucugugaagcccuuauucugguacccaccuugauucugugaagcccuuauuuugguacccaccgcugcugaguucaugaaggcacugacucugucuugugaggaagacacuuguacuuuagagacuauuuuuuaaccacaguuuuaauggaauaagagacagagauguuccggcaucuagcgaguagagacuagaaguggugcucacuaaccuacagugcccacuuuacaccccaguguccccaucaugaagaauuacccaguccacacggcagcaggacugagguggaggaaucuugguuuaggcuguucuguuaauuaaauacuuugcuuugaguccaaacugguuacauugcuaaccugucuuuucuaaauauauccuguguccuuauacccuggacuuagaauuccuuguucaucuugaggcaucucauauguuggcacaugagagaauguagcucuccccugaaucucuggcuaaugauuauuaucuaaggacuuggggcuguuacacagugguaaaguaugcacaugaggcccuggguucaauuccauuauuaacaaauaacugauucuuuauauuaucuuucaucagcugguaugucaucccuggaacaucuuaguauuuuaugaaugaagguugacucucuaguuguuuaaaucugacacuagagacuuuuuaaggcaagcaauacuuuauuuaaguuuccaaaguuguuauuuugcaaggguuuguguguaugaauguguaguugugagugcaggugcccauggaggccgcaaaagguauuggauccccgggagcuggaguuacagacaauugugaggcuucugacauggguauugggaacugaacucuuaacuuugggaagaacaaugcacauucuuaccagcugagccaucucuccagcccuguacuugaaauguuugagauagggugucacucccgaauccuggcucugaacuuacuugcuccguagcugaggaugaccuugaauucuugaucagccugccuccaccuccagaugccaggaaucaccgugccuagcgcgucugaagucagugaauccagcguugaugugauuaggcagaucacugggaaaguaaaggaagaaagagggcugugcuugucacuuaaacaaggcuauuugugauagcauuugagguuagauagggaggggucaggaauaguguaacacugugaguccuuuauauuuaacccauaugaguauauaaggugcuggcugguaagagacgacacacugaaggccacauagaaagaaacaggagauugugugugcgugugcaaaacguagaguuuuuuuucuuuugagacauaggucuuacugcauagcccaggcuggcugugaacucacaauuccaccugccacugccccuugagauuaauaauauucacaacacagcccugccgaaaugauguuuuuaauaaacugaagaguccagugugucagagguggcuuaguucaugccaaccuccugaagucauucaccuccuggcaucaugggaauggaacagacuuggcuucaagccgaggcaggaaauuuguuacaagcccagccagcccagccugggcuauauagugaaaaccugucucuaaauaaauacaaaaccaagcaaacgcacuacgagacacugaguuaaagugagcuaagcucucuagaggaaaaccagucacuugcuuugcuuuugucaucuuagccagagcaacguuccagacucaaggagaacuuguuuguuucucaagacacuuugucuauguagcccuggcuuucauggaacucacuggguagaccaggcucuccuggaacucugccugccugccucugcuucccaaguguuggaauuaaagaggaaagggaaccuccaaggacuaaacuaaaguuuaaagagcugguaugauuuagaaagauaaagccaaccugcaguuguccucugugucagcaggcgcucaggcacacgcauacaagcaaaugaguagauguaccuuuuaaagaacaaaccuccaggaacuuuugguguccacauggcucucauguuucuggaccuggcuggcuuuuuccugucuucacuaacuggccuuuauaagaauuucagguaucauuuuccuguaagccuuuccuaaucccucauaagaacagggcuuugaaagugagguacguacauuaaaacaagaaaauaaaggcuuccuuuauuuuaaaaguaucuacuucaacaaaccuguaucagacuagucgugguggcgcacaccuacggucucaacaaucaggaggcugaagaagaugaucuagacuuugaaggcagccugagcugcacacgcaguaagaccaccucuaaaggaaaagggagcaggcaggcagagaggcagacuuccaucaugcugucaacagucaccuugcgcugcuacuucauaugccugacuucggacugagcucugcaaaagcaggcauuaaaugucccucauguggcugggacuggugucacaucuggaagggagacaagaagaucaggagcugaaggucaucccagcacugaugacaugagacuuaaucuccaaacaaaaaggaaacucauuccuuuugcccugccaauccuugacuuaaagacucauguugaguguagcucacugauagaauaccuggccagcauacauaguaaggcccuggccuacauucgggaccucccugcuguguagcauugguuugugagaauaucccguggcuggacucuuuauuguaauacagacaggcaacgcugacauuuuccuguuuauuuaccuguggcauaaaacacagcauuguuugagguggcucguuucauuuccguuuuuuccuuuucauggucuuuguaguaugaaguacauuuagaagcuacauagucucugauuuuuaagccaaugauuggaaucgggaauaauagagugugccuauaaucccaacacaggguggaggcugggguguguggggagggguuucucagagucagccuggacuguaggagacccugucucaaaaauuaaaauauugacaauaggagguguuuguauaugcuugacccagggaguggcacuauuaggagguguggucuuguuggaauaggugugucacugugagugugggccugagaccuucauccuaguugccaggaagucagucuuucacuagcagccuucagaugaagguguagcucugccugcaccaugccugccuagaugcugccaggcucccaccuugacaauggacugaaccucugaaccuguaagccagccccaauuaaauguuguccuuucuaagacuugccuuggucauggugucugucuacagcaggaaaacccuaagacaggagguacacaugaaggugacaagccucgagcaaugucccaguucuaucacacaugaggugacccugaagugaaccacugaguagaucagcaaaauggaaguuaucuacguagcauuugauaauuauacaucacauaguugacauuuuugucaagcuacaugugcuacggaggccccauaaguuugauacuagaggugaaaauuuccugcaguccagugaauacauaguugaagaaauaagagaagaaaacugcagaaaaagaaccccuaagucgggaggcagaggcagguggauuucugaguucgaggccagccuggucuacaaagugaguuccaggacagccagggcuauacagagaaacccugucuugaaaaaaacaaaaacaaaacaaacaaacaaaaaacaaccaaaccccugaggaaauucacaguaaagcaauagaagaguuuacagcucucagcagguccuuaaaaagagaaaaugagggugcugaggaauuguagcucaguuggugcaaugccuggcaugcacagaacccaggguuuaguccccaguacuguguaugccgggcaacugggcauggugggcacaucugucaucccagcacuuagaagguagaggcaagaucagaaagaaguuagaggucauuacaaauuuugucugggaaaaccaaaaaaguguucucaauagugaaagauuuugauagaggaauguucaccgugugugaccugcuugcaagcacgugugauauggggaaaggaagagggagggaacagccuguucgugggagcacguacgugcaguuccuggagcaggcgaugguggagggaaacacgcugugccugccaccauagacagaccucugaaagagcuuccgaaggaacacugcuuccgaccuggugucuccugggugaugcucuccauuguacguuagaaaucggagaggaccugcaagcagugaucugacuuggcugaauucuaugauuucacuucuauuuucuguuuaaaugggauucugauuuaagcuuacuaauacuugaugaaugaugaaacguguccccagccaguuuaagcuguuuugaaacuauucaaugauucauguagaaaauuacccugcuuauauaaaaacuggaaaacacccaaccuaaaucuuuuuauaggcguuuagaagaugacagauucuggaggucgguuaauagaaagguccaaagagccaggccuggugaugcaggccugugaugcuaucauucgggaggcugaggcaagaggacaguacguuuaaagcuaacuaggacuacaaggcucugucucaacacaaaucaaauaaauauucaagaagucauuaggaggggcuagagggauggcuuagcuguugagagcacuugucacucuugcaaaggaccuggguucaguucccauuuccacguaguggcucccaaccauccauaacccaguugcaggggauuuucugacuaagugggcacgaaacauacucaugauguacacacacacacacacacacacacacagacauucaauuacaaaaacaguaacuauuuauuuuuauguuuuguguuguguguuuucuuauggaggcgccacuggagaccagaagacucuucugaaacuggcguugcaggagguugugcgcugcugugugggugcuaggaaugaaacuuggggccucugcaagacuaucaaguuucuuuuucuuuuuuuuaaagauuuauuuauuuaauauauauaaguacacuguagcugucuuuagacacuccagaagagggagucagaucuuguuacagaugguugugagccgccaugugguugcugggauuugaacucgggaccuccggaagagcaguugguguucuuaaccacugagacaucucuccagccugaguaucaaguuucuuaacugcugaaucacuuuucugcccacugaucugaacucugcaaagugaggaguaacaaaaaacaaaaacaaaaacaaaaacaaaaaaaaaaacuuuuuuuuucucucucucucucuaaaaaccauuggugucccuggcauccggcauccggcauccagccuccagcugcaugcuaggcccagaacccaaaaccagcacuccagcucuccucaggcaggaaucugaggguguacacuacugucacacguuauucugaaaguuggacucugucagagguugagcuagaaaauaagcuguucuaauccaaaagaauaaguaaauaaaaauaaaagcgauuuacacaaaugcuaauuucuaccauuaaccaacaaguuaaauggacuucucugcccaccuuuuuaggcagauuauuuuucuacaaaugacuuuauaaagacaauaugucagagcuggacacacuuacaggcaaaacacacacacacacacaacacacacacaugcacgcacuuuuauuuaaagacaaaugggcuggagagacagcucugugguucaaaccauaccacgcuugcugaagaccugacuuugguuccuagcacccagguuagguaguuggcuuacaauuguuuguaacuccaucuccagacaaucuuacaccuuguucugugcucagaaccuacaugccaugugcauauacuuacagacccacacauagaaguguaauuuaaaauaaaauacauacuuuuuuaaaaaaaggauuuuuuuuuuuaugaguacauuguagcucagacacaccagaagagggcaucagaucccauuaccgaugguugugagccaccaugugguugcugggaguugaacucaggaccuuuggaagagcagucagugcucuuaacugcuaagccaucucuccagcaccuaaaauacauacuuuaaagagaucaugguuguagcgcacccccccccccacccaagccuugacucagcaaguccuccucccuugcgcccaugcuagaaucacauguguuccucuguaccaagcuuccagcuucgagaucacucuugcccugcuguuuguaucugagcuguucuaauaccacagaauuaauguuguguucguuuccuuucccauugaauacuuaggugacgcuugucucggcugcuccugagaaacuaaucugugagaugaagguggaagagcagcauacuaauaaacugggcacgcuccauggaggcuugacagcaaccuuaguggacagcaucucgaccauggcucuaaugugcacagaaagaggagcacccggagucaguguggacaugaacauaacguauguauccagaggccaucccggauaauuucuuaaaaacaaacaaaccaacaaacaaaaaaaacaaaccccaguauucauuucagauaacuuauacuauauuguuuagggaauaaugacaagagucuacauuuuggggacaggugucccuuuuugucgacuaccuucaauccacaguuguuuaaacucaagauuuuuuuuuuuuaauuuuuuacuuuuugguuuuuugagacaggguuucucuggguagcccuggcuguccuggaacucacucuguagaccaggcuggccuggaacucagaaauuugccugccucugccucccaagugcugggauuaaaggcaugcgucacuacgcccagccuuaaacucacaauuuauaacuuugauauaguccuuaaaaguaucacuuguaaguacauuccuuugauuucaggagaaacaggcaaaucucuggguucaaggacauccuuguccaaaaagugaguuccaggauagccaaagcuacacagagaaauccugucuccagaaacaaaaccaaaagguaucacuugagccagguauggucagacagaccuuuggacccugcacuugggaggcagaggcaaguggaacucugaaguccauucaggccgauugguuucaaaacaaaaaaacaacaacacugaaaacaaagguauuagcaagaugugcugcuauaaccccaaccaacacuugguagagacaggaggaucagaggaguucaaagccagccucugcuauaugaaacuccuuguuccccacuccuauccuccgccaccccccaagaaaagcaugaaugacauuuggaggaaacuuauuggccauuuucuguauaucaccaaaaucuugcaacaaggugagcacagguaccaggaaggcauccugacucucuccuaugacugcuuauaaugacacagcagugugugcucuagaccccggccugucacuauuggaaaaugucuguagaagccacuucuccaaaauggaaaauuugaguuccauggcuaggcaugguggcucauaucuguaaucccagcccuugggaagcugaagcaagagaaucuuuaguccacgcuuagccuaggcuacaaagcaagacccaguuuccaaagacaaacacaagaaacuagcaccuugucaguuucucuuaaacccggggaauaagcggaguucaguaagcaaaucacaggacaaaauguggaagacaagauggacagaaaagagacugcgcugagccauauccagugggcguuauuuuaccuugugugguaaacaagcccaacuggugauaguuuuacaugaaggcucuuauaaaugggcagaagugguggagagauagcucagugguuaagaucuuagugguucuuguagaggaccugaauuugguucccaauacccacaucaaauagacugccaguaacuccaguccagagagaccugacaccucuggccuccuuggacacucauaugcacauauccacaugggguacacgcauaacgaaaauaagauggggcuggagagauggguugguggacaagcaucagaaacaacuuguggggcuagagagcugauugaguggguaagugcgcuugcugccaaaccugcugacaugcgauugaacccuggaacucacguaguaggaggaaaaaaaauccccacaacucacauaauggaaggagaaaacugacauugucaaguuuccugcugaccuucacucaaacaccaugaugugcacgagcacacacacaaaauaaaugcaaauguaauaauuaagaagcccuacaauugcuugugaagugaaucuugacuugcauguugaccugaacauuuauggguuugguguaucuagacggguguaucuacaccauccucaugcauacagggcagcuguauacgcucuuuauuucugauggcuaaaaacuucauucucacuucaccuucuuguaguuucuucuaugaguauguaucagaguacauguguguauaccaaccacauacauccagggaccagaggcuggaagaaucgacagaucccccggaauuggaguugcagaggguugugggcugccauugugggugcugggaauugaacaugggucuucuagagcagccaguccucuuagcuucugggacaucucuccaguccacuccuuguaguucuucugucauuuuggaguugaauaaaguaugcugauaagcuauagacauccagauacuucccuuaggaagcuaagcagauuaaaugaaagcuagagguaaguguucagugguuucaaauaugaaauaggaaacuuuuuaaaaaggcauggaaaucccauuuuuaugugaaaagaaacccauggauaaaugaaggaugggucagguagagccccaugcagcccagccguuugaaucugguaccaaaauuauuuguagguugcuacacaggaaagcugguaggacugucacaaucuuucaacaguuccuuaccacuaacuauacuuaaaccuguuuucucucaagguacaugucaccugcuaagauaggagaagaaauagugaucacagcacacauucugaagcaaggaaagacacuugcauuugccucaguggaucugaccaacaagaccacaggaaaauuaauagcacaaggcagacacacaaaacaccuggggaacugagaacagcgggaagacccgaagaagcccaacaaugccaaguaugguuugugaacaacuuucugaaauaaauuaucaaaaccagaaguagcuaag

SEQ ID NO: 6965 - RNA, 10502 nt, Mus musculus
gucagucuacaaauaaaacacuuuauuuacuguacauuuuuucuuuacagaacauuuacaaaaaaaaaaguauucuuuauucacucugugaaguauuuccauuuuaccaguaacaaaacucaguuacuuuucuucugaauuuucuucuuagaaaaaaaaaaauaauucucacguugcuaagcuggguuuaaucauugccaagaugaacuuugucaguucccagcaaauaacuaccacuaaucagaacaguaacugggagucaguggaacugugacugacucaucagucacuauauacuaucagcugacaaaauuaagucugauauacaacagcugucaucuacuuuacuacgguuggucacggcuuuuucacuuacauuucugaacuuacagaauauaagacaaugcagucucaagaguucaauggcuuacuuuuucucuuaauaaaaugauuuaaaauauauuggugccuaauucaaacaauaguuagcccugagauacgcccauuacuugaaauccugauggcaacaaugacuuugucacaagcggagagguuauguccuuuaaaccaaagcccacacauucugacauaagcaugcuuugauuuauuacaaacaccaguucuuaauucugaggacacaagauacaaaguaaaacguuagcugcuuuugcuguaguaaucauccaguuuauuaauucuucuguauuagacccagauguccugaaagguugagaccuacacaaauucagaacuagugcuaacaaacguguaaagcugcaagugggaagcuuuucacaauacuacauucaaggugcacaagagcccccagugaucacucggaaaucuaccacaguccaguuuuuccaacccaacaaggucuaaacuuugaggaauaaggugccccucuucugcucugaaaaauauucgaucaaaacgaugcuuauaagcagcagggauccugagguuguuauuugcuuucguaucccauguauacuggcaauguuuagguuugccuaaaaauucccaggcaucaaaaacguugucagguaaaccaccacauuugauaaccuggcaagagaaagaauauuaugaaagguuuauauacuuacucccugcccccaauuuaaaaggugucugauauuaucauuuguaaguacagcuuuuguuguuguuuuucaagacaggguuucuguguaucugagcugugcuggaauucacucuguaacucagagaucugccugucuccgccucccaagugcugagauuaaggcaugggccaccacacccagcaagaaaguauuuuaaaaaguugauuucaacucagaagagaauuagaucuucuuauacacagggaugcuacaaauacccucaacuuuuaaaauuagaauucuuauaauuauuaucuuauuuuaauacuuguuuaucuaacauauaagaggauuucuccuaauagcuuuugugcauauuuuaaacaaaagcuacaacaguguuuucuaacuuguauuucaaguccauaagacuuuggauaaaaugaaucaaaauuaauuuccauagcaauacucuccccacaaacauugaaucaauucuguuacuuacuucuugaucucuuaaauuuguaucuccugcaaauauaaccgugguugaaucuggagccucuugcauuuuuccaagaacaguuuuuaauugucuuauucguuccgcagaauguucucuggugcucuccaaaugggaugucauaaggcaaaauucauuuccacccaaacucaccuaaaacagagaaauuacaguugaacuggccacugaccacuaaugcugauaacaggcuccaacgcagauuaauuaacuggaauguauuuacucaacugaaaccagucaguacuguuccuaaaugaagagcagaaggugcaacccaccccaugauaacuauuuagaccaagaacuauccacagaauagcucuucugggccccuucuccaguagcuccaggccaucaauggcucacaccucucuaggauccaauuccaagguaaacagauggcuagaaaaggucccaaacgaguaaaaggacagcuacuuccccauuucaugaagccacgaguuauuugcaaacucagauaacucuauuuauugcuccaacaauauccaggcacagauacaaggaaauaaucacuuaacugaaugaagucauuuaucauuugcaaugaagauacuaguauacagaaugugcugcaaugccuacagaaucaucuuaauuuguucaaaccuauaaucuggaucccgccuacugcuuaaccuccagucaacacuccacuaccucuccacacucaggauggugguuaacacugucaaacuuuauagaaucuagaaucaccuagaaggcaaaucucugggaauaucuagggaaauuugagauuagcuuacuuaagguggaagacccaccuuaaaauguuaaugggcaccagugggagaugaggucccaaacuaaaaaaaagguggggggcgaagcaagcuuaacagcagaagucaucacuuugcuuucugacuguggacacaaugugacuagcugcuccugccuuacccuacaacuaugugucaaaauaaacucuacuuaagacugccuuugucagauacuuugucacacuauuaggaaaauaacuguuucucacaccacccugaacauaagcucauccacagcacagguuuacccuugcuacaacuugcaaagguuuguccugggugcuuccuuuuccaugggguggauuccugugcugaauaaaggagacaggagaaagcaagcugauuccucuaauuccugaguuggagggcagccuggucuacagaagcccgauaggaucacaccuccacugccaugccuucccucaacggugagcuaaaguacuaguguguuccuuagagcuaucuauguaugugcuguguuauuuuucucacugauauaacaaaugacuugacaaauguucuccauagccaacuguugucacauacuuaagaaaacaucuaaucaauuaagaauucaacuuugcauuuuuauuuugcauuuuugcauauuuauuuuauauuuuaaagucugcaucuaaaauucugagacccaaguuuucuggaacuauuuaaaaucugcaugugaagggccagugagacgguucaguggguaaccacuugcuucauaagccugauggucugaaaccaauacacacaacuacagugggaaugaaaucugacuccagaccccagacacacacaaauaggguuuagaaaaugucccagugacacggcgcagcagguaagagccucugccaaguaaaccgaguuugaucccuagaaccuggaucccuagaaccugugguggaaggagugaacugagucauagaaguccugacuaacugauacagacagacagacagacacaaacacacaaauaaaaaugccuuuauaaauuuaucugugggcuggugagauggcucaguggguaagagcacccgacugcucuuccgaagguccagaguucaaaucccagcaaccacaugguggcucacaaccauccauaacaagaucugacucccucuucuggugugucugaagacagcuacaguguacuuacaacauauaauaaauaaaucuuuaaaauaaauaaauaaauaaauaaauuuaucugcgcacgccuuuaaucccagcacucgggaggcagaggcaggcggauuucugaguucaaggccagccuggucuacaaagugaguuccaggacagccagggcuauacagagaaacucugucucgaaaaaccaaaaaaaaaaaaaaaaaaaaaaaacaaaaaaacuguaaaggcaauaccuucaaaaaccaaacaaacaaaagacgccccaaacuuaaacuuacauuuacgcauagcagguuucucaucauuuugguauuuggaaaaggaauaaucuccugacuuuuaaauuucacucuuccuuucuucaauaguauagcugugaaauauccuucuucauuaccuucaaacauuuguggaaaaaaguauagggaaggaagucaauugacaaaauugauggacuggguguuaacuguaucuucuacuucacaaacgacauaauuguaauaguugugcuuaauuuaaaucugagagaaaagagccuuucaauugaacaaaaaggggaaauguuguagauugcccugguacuguuuauauuuugauguuaauuccacuuucucaagaagggcugcuacaagccgggcguggugguacacacgccuuuaaucucagcacucgggaggcagaggcaggcggauuucugaguucgaggccagccuggucuacaaagugagugccaggacagccagggcuacacagagaaacccugucucgagaaaaagagaaaaaaaaaaaaaaaaaagaagggcugguacagccaggaauggaucucauucucagguaaguucauguaaaccuauccccauuuuaacuagucaaauaaagguuagaacccgugauuggccaguggaagggaaaagcggggcuggagguuuuagagaggcagaagagauggaggagacaaggagauagagagagcaagacggaggaagaggagguggaaggaagauggagcaaaaccacauggccuggaggagccgcaaguagcaagggaucucaaagcugagcccuaguguggugcuaggcgugcagcucauaaacauuuuaacugaauuguguguucuuugcacggauuuauugggguuggauauuuaccacaacagagcaccuucauuuuaccacaagcucccucacuauaacaaggagcaaaucauuuaaaugggagcaaaucuuaagccucuacuuugaaguaggucaaccaagugcuauguuucugucccuuaucagaguuuaacaagagauacaagugauguuuaaguaagaacaaaugguggauaagggcaugccuccauauucaauuucagcaaauauacaaaucuaaaauuuuagaacuuuguuuuccuaaaaagaaauacccguuucaauuauuuuuccauuuauugacauuaagcuguaaaauagcuauuaaucuuuuaaguaucuggugucuugcugaguuuccuuaaacccaucugugcccuuuguaauagccucucauuuuuuuuuucuuuauugauccauuuuucaaagaaaaagguaguuuagguagcaagaagagcauuaccuguaauaauuguguaacuggcugcucucuucuuuagguaggcacaguauggggggauaacuuccuguagaaauaccacaucuggacuauaccuaauuaaaaagagcaauuuaccaagagcagcaaagcauucauuuucagauacauagagaaaauuccacaauauauacacauaaaacaacuguuaccuggaccccuaguacucagugcucacacugaccuuuaucuagauaugauuuacuacaccgugccauaaugaccaacaggcuggguguguaggucagugacaacacuugccuaacaaggccaaauucaaccccagcauccccccuacacaucacccacacacaauauaccacauugagcguuugcaaucguuauauauacaccaagagauguauucaaugcuaugauaucucuucagguucucuuaaaaagcuguccagugacaacagcucuagagaacgugagugcuuuagucacaaagcucuccugaggccaaaaacaaaacuuuuaggaaauuuucacuucauaacaauacuuauaaacaaaacuauguauguaaagcuuacaauucuagaaagaaucucacauaaaccgguguuccaauucaccaagacccucccagaucaacaccucagcucuuaaauauuuacucagaagcugaccuuaaagucaaauuuucaaguacacaacuguugcgcuguagaaccauuaaaacacuuaucaaagucccuaccauggaaaagagaaugcuuacaaagcuaggcaggaacacaccccucgagcccucucgggcagauugcauccaucuaauccaucaauauuccagguaaugaaagaaauagugcugcuaucuucuagaggaguuccagauggacuggcuucuaaaaugguuguaucauuugcauccucguugguuagaucaacacugguaagaucaaaauaaaggauuaaaaaaaaauuaugaauugcuugcuguaguuggggguuauggaggcaagaacccucacauuuaacacuggaagcuguggcauacuuguacucucaacacugggaggccaagaccaguagauacuugaggccuguuuuaccuuaaauggugagugcauggucccagugagagacagucugaaaaaaaucaaggagaacuaugccuggggaauccaaaucggaccucuggcuuccaaauguagagacuguuugaauuuuguuguacauguuuguccucaauuugaagauauaaacaaaucacuucuaaucagaaaauccaccuucuaaauugucuacgaaacucaaaauaauuuuuggucccaacacuucagauaacagauacuuauccuauauuuuucuuugaagacuccuaagacucuauagaaaaggaaaaguugggcuggagagagcuuggugcaucaaggugcuugcuuccaagccuaauggccugaguucuaucucagaacccacaugguaaaaaagagcugcacacuguccugucucgcuguucuccuagaguugcuccuuguuucacaaugcgauccuccugcacaauaaccauacaacuaccgcaugaccacaaauaauggcuuucuuugacguauucagccucgggcaucuuguuaacuuuugagucuuacaauuacugacuuucaaaacagaaaagcaguaaaaacagaaccccuaaccaacuauguacccgaaauuuacaaauacuaguauuuucuuguuuaauuaacaauuauuuaccuuagucuauuuccaaaccacuuacuucuauucuucucgaaaggcuugcuugcauacauaccauacaaccugaaccgucagcuccauuaccaucaauauacauauauauauauauauauauauauauauauauauauauauauguguguguguguguguguguauaaacauauauauauuuuuuagucuuccucaugaggcauuuuugaagaguacaggcuacuuguuuuauacaaucauuguuuuauacaauaauucaguuaaucuugauguuuucuuacaagucuagguaugaacuuugggacaggaaugacagcauuaccaaugcaugguuaagguguuaaccaaauauccccacugaaaaguacugauuuuucccauucuccuuaguauuuuguggguuuuaacuauggaagcaucuuguuuaugacucaacuuucauccugguuuuacugcccguacuuaacugaaacauuucuuuaauaguucucaagagauuuuucuaauuccucaagccuuagaaauuuagcaguuuaaauuccccuacaacaguaacuagucggguuggagagauaagaguaccaacugcucuuccagaggaccugaguucaauucccagcaaccauauggugacucacaaccaucuguaauaggaucggauucccucuucuggugugucugaagauagagacaguguacucauguacauaaaauaaguaauuuuuuuuuuuuuaaaaguuacuugucccacaaacagcagauacuuacuuaaauauggguucguauuuuauugugcagacuacaaccuguucugaaauacccaaguauuccuugucaccaauuuuacauuaauccuauguucuccuggaacguuuccaacauucucuggcuacucccuuacuucccagcacuguagauuauucuaaauccaucuccuagcucacuuacuccugccuagaaucagucauccuguucuuucuagugaagauuugaagccaaggucuugaugcaagauaguuuaguaccaauucuaaagcaaaauaugaaauguaaacacccucuuugaaacaaggucucgaaauguauaccugcaaggcucaaacuuacaagcuuauaaaguaggaacuuuagcaaguauauauccagacugccugcccuaggacucaauacuuuggcuaagcuggccucaaaccuuuggcaauccugccucagcuucccaaguaacauaagcuaccacaucuggcuaaaaaucaucuguauguauaaaaguauuuuuaaagagaaccaaaaacuauguuuaaugccaaguuccuuuuggaacuucacccaucucagaaagcuuucuuuucuaacauucaauauuauacuuuuucugcagccuuaccaaagagaaaaggcuaagcaauuucagaacauuaucugaucuuaggcccuucauuuuuaacuaaaaacauuugagacagaagagaucacuuuaggaguacuuggucuuucagaggacuuggguucaaguccuagaacugcagcaugcauagcucauaacuaaccccaguuucaaggguucuuaugcccucuucuggggcugggcagugggcacacgccuuuaaucccagcacuugggaggcagaggcagacggauuucugaguucaaggccagccuggucuacagagugaguuccaggacaagccagggcuauauaaagaaacccugccuccaaccagaccagaguuguugucuaaccuacacacaaguaacuggaggagguggggaggggguacuggauagguggacuccacucuuuauuuauuuauaaccucuggagugugcagacccaacauuuucuaaacaacuucccacguaauuuucagcacagcuguuuuaugaugauugcccgucucuucugacacagacaacucccauguaagacacucuggaaagaacaguggccaauucguguacaaggcccaguacggcaccuuaguuuuauucugcaaacuguagaacaacaacaaugaaaaucggaggcagggcauugagacaacaggaacagcauacacuaaaaacaaauauuaaaccuggcugguaugguuuuuaguucccacaggcugaggcaagauugcuaggagcucaaugccggccugaacuacacacaaacuugugccaaacuaaucaaacuugaaacaaaccugucucaaaagaaaaacuaucguucuuuggcaagaggagagcagauaaacuaugcagaaacaaggagacuuacagguuaccauucuucaggagaaaaucucuaccucuguuuuuuuucuaaucuucaguuuacauaucaccaauauuucaggucaguaaguguauuucaguagccaggguuucacaaaccuuuaaucccaguacugggccaauggaaggcaagccuugaccacaaaggaguuccaagucagccuggacauauauggcucaaauaaaaaguucggguagggagugcuggaaucagaugcaaugcuagcaaaagggaggcuggaagagagcuggaggucaggauuauugcaagccucugucucgaaaaagaacaaauaacgguaacauuaaacaaaaauuccaucccagugugguggugggcacucuaaauccagcccauucgauucugaggcagguagaucuguguuugaggccaaccuagucuacacaccaagcucaggccagccagggauaaagggugagguucugccucaaaauacauaaaauaaucuucagguuuaagaaauaagauaaaauaaaauaaaauaaaucacguuggaagccaguucuaguaugugccuucaacgugccagcacugagagggcagaagcaagcugaucugaguucgaggccagcuugguucaaauaacgacgaguuccaggccagccaagcgcuacacagugagacucgucccaaaacaacaaagacaagucccgcugggaagugacccugcauccucggaagcauucccugagauuuccagcucuggggcgccggccgcccuuuuccaggucccgguccucggacgcccaagcccagcaggcggucccuccccgcccucggcgagcagcccgcgacccccgucgcuuacuaggccucggacuugaaggacgugggaggcuggcgcggccacccuuggucguucucuggcagcucgaaguaggcgcucagggcuuucugaaaagcaaaggcacaaggcugcagggcgcgccccgccucccgggggagagcggcggaagcgagagacgcgaacugaccugcgucugccagucguucucccgcaggacgcuggggaccaucguggggucgcauccccccaccaacgcaaagcccaggcacugaagccgccgccucuucacccgguccuccuccgccugugcugcuucgggcgccgacgccgcccgcccugccggcccugcgggcuccgccgcaucggaacugcugccagacgccaucgccgcaggguccccucaaaacacccgcucuucacgcugcuucccgcgcgacugaucgcgaacgccggaaccugcgcag

SEQ ID NO: 6966 - RNA, 1324 nt, Mus musculus
uaaugaucaaggagacuuuuaauucacagaccugaggaguagcacucugggucucagaacgggaccuccacaauuuaccccaacaaaauugcuaauagacugauggagacaacuucgugguggaagagauccaagaaugaauacauccagcaucaauucuacaaaacuagaaacuucaaggacgucugguaaugugguuuaagggaaggugugucuaugaagggucgcacagaaucguuuagggugacguauucauuagcucaguuagagcggcggcuccagggcauggacauauucaucacauuauacuuaguauguguaguuuauucuaagugaauuauaccccaauauacuuuuuaaaaaauuacuuuuccugcagugcuaugaacugaauuuagguucucacacacguagguaaauuccuaguuguaaauugguuuuuguuuguuuguuuguuuuauaaauacugucagggcugugcuacagugucucaaaauacaguggggagagagagagagagagagagagagagagagagagagagagagagagaaaggaagggaaggaaggaaggaaggaaggaaggaaggaaggaaggaaggaagaaagaaagaaagaaagaaagaaagaaagaaagaaagaaagaaagaaagaaagaaagaaagaaagaaagaaagagagagagaaaguuaguuugcagcagggacagaauguccuuuaauauugauagaaagccacugagcugagacuggucaauucaagcugacuguccucaagaaggacccgugaguuucagaaauuguauuuguuuucccaauauagauacagcaaauaauaguuuuagucuuuguucauuugggguguguguggugugugugugugugugugugugugugugugugugugugguuuuguuuugauuugagacaggcucuuucuacggagccugacuguucuagaacuuacuauguagaccagguuggccuugaacucacagaaaucugccugccucugucugcucaaugcugggaucaaaggaguaugccauuauaccuggcuaaguguuuuagucuuugcagacaaccccuauuacaguccauuuaaaaccuuuuugugggcuggagagauggcucaguggcuaugagcacugacugcucuugcagagguccugaguucaauuuccagcaaugguggcucauuacacauagugguggcucacaaccaucuguaaaggggaucuggugcccucaucuggcguaucugaagacugugacaguggacucacauacaugaaauaaauaaaacugaaaaaaaaaaagucuuu

SEQ ID NO: 6967 - RNA, 4380 nt, Mus musculus
caauaccaaaaagugugcuucccaaaguaaugcacuuguaagacuauagugaggccagagcaacgcuuagccuacagggaaggaauaaugaagugcuuccaccccaaaauguaauuaauucaccucacauaaaaggacagaaccggcaguuuaaaguuuuuaaagguggcuaggucagguaggguuuuugagugacagugcuccuuaaagggacuguaaauagcaaauacugaguuuagugauugagaaagcagucacacaucaggugugagcaaagaggugggauccggucuguccuuaacguucagagccucugagcccaugugggcagagcagaggucauccugugaagugauuccugacagcagacuggaauaggcuaaacagcucacugacaggcugcugggugcugggauccaggagcugcgcucagcuucauuucugugauuggcugcagugaagcuacauuugagcuucagugugauaacuuaaguaauggccaaagagguucuaaugggaggauccaaacguggguguaucauguacuuucucacagaggacucaauacagucaguauccugucgacuugaagauguuuggauuucuguaagcuuuaaguuuucuuuaucugaugccuguuacaugcuaugcucaggcacugaacaaaagacaaauccucuggccauguuuagacaggcuuuuguccauccauuacagagcaaaaucacuggcacuguguggcuggguugagggagccccugccugcugugcacaaggcucugggguucgccuugccauuuacauuugcuaauugcuguccguguaccaaaacgauggcccuucugcuggcugugcucuuuagauagguuggaccacuacuuaaaccaaaugucccauugugcuuccugcugugccuuaggagucagaguguguacucacagcagcugugccuuccuuccuuagugucuguaguuguacuugacuguuuagaaugggagcacagagaucagcagugaggagggccaguguggccccuuccccacgccccucucuccuccucccacuguuuucaccagacauaugacaaaauacccaagauaaacagcuuaaaaagaggaaauguuuauuugggcucacaguuuucggccaugucagcgccagggugcuuggcccuguugcuuuggggcuggggaagaagcagggugcuguggcagaggggagcugcccaggucauggcagcucagcuggcaacagagaggcaaggaaggcccagggguccugauacaacccaguacguaacucuccucaacagaguccuacuccacaguuccuaccuucuuuaagcuaaggaucaagccuucaacauaggagauuugggguacauuuaagauccaaauaggaccagccaccacuaccaaggauuuuuuauaggagcaauuauauggagaguguuaagagcuaacuacacccuuucuaggcaagagagccagguauucccacagaaaaggagguggguugauaaagucccaagcaccggcagcaaacucagaggaugcagaagaaagagcuugagaggggaccucacagccugcugcuccuaucacacggcguccacacauagcugaccauauuucuaggcagccuggcugucccagguuucgcuccaccggagaacuacuuuguccauccuggagaugacuuggcucaagaaagcggggcugaauagaagagugccgucuuuagucugagcugaagcuguagacaugaagugccccagagagccgggcuccccaagaacuccuuccagcagcaacaaccacuugguucuguggaggacacaagacagacagcacuagugacauucccaccaugaagcagacgucauucugugcucugaaguacacauaaaagcaaugcuggccacaccccacagccagaacuugugucucucucuuuguucagacgccacuuucucagaucugauaaguuccaaaccccacuguuguacaaggggaccccagaaccucacuguggucggugcaugugcccacaucuggaguggcgggggcuugcacgggccaccuucacaaagcaucccugcugccuacacuguucucaagcucacuuucagaauucucuccagagucugcugcagguugugaaacauuguaguaauggcaaaucuucacaacaguucaauuugaucuuggggaauagccaaaaguuauuuuagauuuuuguuggugaguaguguagcugguuaugcuggcugauagcacuuuagacagcaggcugugacauuuaucuuguugguuguauuuuaacauuaauaaucccaaaaugauaauaaugguagcaauguauuguggccugaucauguaucaggauucuagguggggcccuuacuggcaccgccuuauaauacgccaaggucagucaacacaagagaaaaauaaucuuuucaguuggcaaagugguaauuucuucucuuccauuuuuuauguaauuacuaauuuacuaaaugugcuuuuacuuuggcuauauucuaugucuccuuucuauuuccuggucaaaccaugcuccuccccaaaaguuaaacuuccuggcugcuugccaucucccuggucuaaccaucucagaaccacgaguucugcauagacagccacugucuguaucccugugucauuguaccuugaugccaaaggucuuagcugcguuuuaugcuuuggucuaagcuguaagcggagacuuggccgugucggacugcucugucuucucggcuguccagugaagcagagucaauguccugcugaggcucaccaacugacaugggcacaaugacagugccagugcuccuuacacacgucuccagucccaccagcucacguguccuuccuuccugaguccuaccucaggucucagggaaaggccacugagcuaauagccugucuuaguugugagaugggaaagugggggauguuaauacacaagugaacugcaguuaggaaggcuaacuuguagaguuaacagaguuaacuguaaaguccuuuccaaugaccuugaucacugcuacccuuggucaguguuccagacaaugucuaauuucuugaaaaugcauaaaauuguaaguaaaagccaagcauauccuuuagagaauccuuccauaaacuuaauaacugcuguuucuaguagcuaacccuggucugucauggucugucagugaggacuguuggccaccagagggcaacuucacugugagucugccaagcaccucccaagccuuuaccagauugcugucaccaguuuaggacugcccacgcuugggacuccugcucacguugccccccagcguugccccccagcugcucgucgugugccagucucacagaccuguguguaucuuccgagcagucggcauccuuccuuuguuaauagccuggcacagucuuaaaauaccaguccugggaugagcaaaugcuuuuguggguuaguuugguuuccuuuguuuugacacagggucucacucuagcucaaguuaacuuggaacucuugagucccaggcuggccucagaugccuaccucagauucccaagugcugggauuagaggcaugagucaccacaccuggcucuuuauuaguauauauuaagguaaauuucuuauauuuauugaaauauuaaauauauagaagaaacuuuuaggagucccacugcuguguuucuugccuacaaggauauuugcauaauuauguaaaaauacaggugcaaaaauguucacuacagcacuaucugcaauaauaaaaaaauggaaauagcauaaauauaagaguguaauuuaauugaauuauggacuguccaaaaaauaaaguauuguguaacuauuggaaguacucauugaaaggaaacaaaggugccuaagaguguagccaugguguaggugucuguccagaccagcaggucucaaccuguggguugugaccucuuggggaucgaaugacccuuucauggggguugccuaagaccaucagaaaauacagauguuuacauuacaauucauaauaguagcaaaauuacuguuaugaagucgcaacaaccauaauuuuaugguugagggggucaccacaacaugaggaacuguauuaaaggauugcagcauuagggagauugaggaccacuggucuagacuuauuaaaagacggaccaggcacccaggauguuacccaugagguugcugccgagccugacagccugaauucagucucugagacccacgaauggugggaagagagagcaaaggcucuccccugcuccucugagcaccacgaguauacuguggcucaugaacauacuuguaacacaaauaaacauguuuuaaaaaucag

SEQ ID NO: 6968 - RNA, 1166 nt, Mus musculus
cgcacuagguacgcgugucccacuucccagagccugcagugaagaugucccacccaucccgggcagccacgcccuccaacuccaagaacccgcaagucuucuuugauguggacguuggcggggagcgaguuggacaaauuguuuuagaauuguuugcagauacuguucccaaaacugcagaaaauuuucgugcauuguguacaggagaaaaaggaacuggguccgcgaccgggaagccucuccauuuuaaagaaugcccuuuccaccgaauuauuaagaaauuuaugauucaggguggagacuucucaaaucagaaugggacagguggcgaaaguauuuauggugaaaaauuugaagaugaaaauuuucauuauaagcaugaucgggaggguuugcugagcauggcaaaugcaggccccaaauacgagugguucucagcucuuuaucacaacaguuccgacuccucauuuggaugggaaacaugugguauuuggucaagucauaaaacgacuagguguggcaaggacgcuugaaaauguagaagugaauggugaaaaaccugcuaaacucuguguuauugcagacuguggagaauugaaagaaggggaugacuggggaauauuccccaaagauggcgauggugacagucauccagacuuccccgaggaugcagauauagauuuaaaagauguagauaaaauuuuauuaauaucugaagacuuaaaaaaacauuggaaauacuuuuuuucaagucucagaacuggaagauggcuauuaaaaaauaugcgaagguuuuaaagguauguggauaguucaaaggcuguuauugagaaagcagauagauccagacugcaaccuauagccuuaagucgugugcugaauauuggugcuuguaagcugaagaugucaaauuggcaagggguaauugacaguugcuuagaggcucuugaaauggacccuucaaauacuaaagcacuguaaugaaaagcgcaaggauggcaaagauugaaggaauaugaugaaacauuggcugaucugaagaaggcacaggagauagccccaggagauaaagcuauccaggcagaaugcuuaaagucaaacaaauaauaaaggcacagaaagauaaagagaaggccauguaugcaaaaauguuugcuuaauaagga

SEQ ID NO: 6969 - RNA, 733 nt, Mus musculus
cuauuaagaaguaucgugaagcuuugcgcuuccucuuuccagccagcgccgagcgaugggcaucucucgggacaacuggcacaagcgccgcaagaccggggguaagcgaaaacccuaccacaagaagcgaaaguaugagcugggacggcccgcugccaacacgaagauuggcccucgccgaauacacacaguccgaguucgaggaggcaauaagaaguaccgugcccugagauuggauguggggaacuuuuccuggggcucugaguguuguacucgcaaaacaaggaucauugauguugucuacaaugcauccaacaacgagcuuguccgcaccaagacccuggugaagaacugcaucgugcuuauugacagcacgccguaccgacagugguacgagucccacuaugcacugccccugggccgcaagaagggggccaagcugacuccugaggaggaagagauuuuaaacaaaaaacgaucaaagaaaauucaaaagaaauacgacgaaaggaaaaagaaugccaaaaucagcagccuccuggaggagcaguuccagcagggcaagcuucuagccuguauugccucacgaccaggccaguguggcagaacagacggcuaugugcuugaaggcaaggagcuggaguucuaucugcggaagaucaaagcccggaaaggcaaaugagccucaugcguaguguaauaaaggugucugcuguucuauaaaaaaaaaagu

SEQ ID NO: 6970 - RNA, 733 nt, Mus musculus
acuuuuuuuuuuauagaacagcagacaccuuuauuacacuacgcaugaggcucauuugccuuuccgggcuuugaucuuccgcagauagaacuccagcuccuugccuucaagcacauagccgucuguucugccacacuggccuggucgugaggcaauacaggcuagaagcuugcccugcuggaacugcuccuccaggaggcugcugauuuuggcauucuuuuuccuuucgucguauuucuuuugaauuuucuuugaucguuuuuuguuuaaaaucucuuccuccucaggagucagcuuggcccccuucuugcggcccaggggcagugcauagugggacucguaccacugucgguacggcgugcugucaauaagcacgaugcaguucuucaccagggucuuggugcggacaagcucguuguuggaugcauuguagacaacaucaaugauccuuguuuugcgaguacaacacucagagccccaggaaaaguuccccacauccaaucucagggcacgguacuucuuauugccuccucgaacucggacuguguguauucggcgagggccaaucuucguguuggcagcgggccgucccagcucauacuuucgcuucuugugguaggguuuucgcuuacccccggucuugcggcgcuugugccaguugucccgagagaugcccaucgcucggcgcuggcuggaaagaggaagcgcaaagcuucacgauacuucuuaauag

SEQ ID NO: 6971 - RNA, 1635 nt, Mus musculus
aguauaaauauuccauauuuggauagcaugugcuaaguggaaaugugguuuguuuguuuguuuguuuucuuuuucuaucuauuaucagcuauuaacaacucuauggaaaaauuaagaaauaucagguuugucauacuugcagaauaaaauagggagaaagucuuuucugggcuguuuauaaacacacaagauuuaggagaaugucauucaaaccaaaacaacaggaaaucacucucgcucaaagaucgggcuuagaucacggugaguuccucuccaauccugcuaaagcaaguuucugcaugccuuccggagccuccgccuacagagcuguuaggccagcggccaacacauauauuuaauuauguaaguauucagugcugucagccagcugcugccgcucuuaauacacugaccucuuucacuccuccucuugcagaaaccggcaaaaacaaagcaacaguugaugcggcaguaaucaugaaauaugcaaaauacuauucuccaaaaaagguuucagauaacuacacaauucagcuuugcauuuuuaaagugauuugcucccucucaagugcuuuucuguuccuucuuugcaaaugcaauaacugaucuaacuggaaguuccuuuuuguuucuauaccuuaaaaaagucaaccaugaauucaaguauauuuucuacuuucuugucaccaaauuucucacuggaacacacacgaggcaauugccuuccaucauuccauccaugucuguucugugcuuacaggacaagcaacggaacacauggccuauaugcccaucacucucaguccucguuuucaaaagaaaaaaaaaaaaguaaguuucauuugaugucccuagaaaguccauucugccaguaguacccucaauuccaaaguagcuccaagggcugggcagguagcaaagcccccagaacagcagagagcagacuaaacagaacugagacacauaaauaaaugcaaacaaaacaaguccacacaugggggaugauaaccagagcuaaccgugaacaacucaccagaaaagugggacuucaucagcucagguuagcagcacgugugcuacagagcugaggcaccucacugacagucucucuuuccucacagagcugugucaccccucacucuagacccuaagguaccagguuaacuuucccaaacaauuccuuccugucuucuguuggcagagaucugguggcuuuuucucacucacagaaacuauaaacaaguugauguucaaauguaagccagugcugugguguuaauagcagacaacacgggagugacaauagcuuugacugggacacugacagugagcugagagacagugucagcaggagcaugaaaacugaacugaggcaaauuaaacaaacaugcacacagugagaaauaaucauggugucucagacucaggcaaaagaccaucgguccuucccugugacucaaaaugacccagaaguacaauccagaaaguacccuagcugguuuaguuggguagagaaaaagguccugacauucacagcccagagcuaccagcauggccaggggacuccaaggcacaaggacucauaauguugucauaacaucccucaggaaagaaacuggagaccaacugugacca

SEQ ID NO: 6972 - RNA, 1635 nt, Mus musculus
uggucacaguuggucuccaguuucuuuccugagggauguuaugacaacauuaugaguccuugugccuuggaguccccuggccaugcugguagcucugggcugugaaugucaggaccuuuuucucuacccaacuaaaccagcuaggguacuuucuggauuguacuucugggucauuuugagucacagggaaggaccgauggucuuuugccugagucugagacaccaugauuauuucucacugugugcauguuuguuuaauuugccucaguucaguuuucaugcuccugcugacacugucucucagcucacugucagugucccagucaaagcuauugucacucccguguugucugcuauuaacaccacagcacuggcuuacauuugaacaucaacuuguuuauaguuucugugagugagaaaaagccaccagaucucugccaacagaagacaggaaggaauuguuugggaaaguuaaccugguaccuuagggucuagagugaggggugacacagcucugugaggaaagagagacugucagugaggugccucagcucuguagcacacgugcugcuaaccugagcugaugaagucccacuuuucuggugaguuguucacgguuagcucugguuaucaucccccauguguggacuuguuuuguuugcauuuauuuaugugucucaguucuguuuagucugcucucugcuguucugggggcuuugcuaccugcccagcccuuggagcuacuuuggaauugaggguacuacuggcagaauggacuuucuagggacaucaaaugaaacuuacuuuuuuuuuuuucuuuugaaaacgaggacugagagugaugggcauauaggccauguguuccguugcuuguccuguaagcacagaacagacauggauggaaugauggaaggcaauugccucguguguguuccagugagaaauuuggugacaagaaaguagaaaauauacuugaauucaugguugacuuuuuuaagguauagaaacaaaaaggaacuuccaguuagaucaguuauugcauuugcaaagaaggaacagaaaagcacuugagagggagcaaaucacuuuaaaaaugcaaagcugaauuguguaguuaucugaaaccuuuuuuggagaauaguauuuugcauauuucaugauuacugccgcaucaacuguugcuuuguuuuugccgguuucugcaagaggaggagugaaagaggucaguguauuaagagcggcagcagcuggcugacagcacugaauacuuacauaauuaaauauauguguuggccgcuggccuaacagcucuguaggcggaggcuccggaaggcaugcagaaacuugcuuuagcaggauuggagaggaacucaccgugaucuaagcccgaucuuugagcgagagugauuuccuguuguuuugguuugaaugacauucuccuaaaucuuguguguuuauaaacagcccagaaaagacuuucucccuauuuuauucugcaaguaugacaaaccugauauuucuuaauuuuuccauagaguuguuaauagcugauaauagauagaaaaagaaaacaaacaaacaaacaaaccacauuuccacuuagcacaugcuauccaaauauggaauauuuauacu

SEQ ID NO: 6973 - RNA, 79491 nt, Mus musculus
ugaguuucgcgggaggaccuuggcgcguaaaccguaucccuucauucauugucagcagcagcuuccuggagccauuuuucagcugccggccgcagcacccgggcugccgccaccgccucgcaauccguugcaucggcugcccccgacgccuccaucccuccucggggccugauauccgugcggccgggacccuccucucuccagacccccgauuauuuuuggcccccggggccugugcggugcggaaaaauaaaaagaaaagagagagagaggguucggaagcgccgggaggggaggcgagaaggagagacuuggaaacuccggcugcaaauaauaaaagaaauugaaagcaauacguuaauauaucguaacacuaaaaaagagcaggagcgagagaugagaaaggggauccagcccgcccuggagcaguaccuggugaccgccggggguggggagggggcggcugucgucgccgccgccgcugcagccuccauggacaaaagggcacugcuagccagccccggcuucgccgccgccgccgccccgggcacguacauccagauccucacuacgaacccuuccaccacguccugugccaccucccuccaaaguggcgcccugaccgccggcccccuucuccccaguguccccggcacggagccggccgccagcagccucuacaccacgccacaaggacccuccagcagagucgggcugcugcagcagccaccagcaccaggacgcggcggcggcgguggcccaccgguaauacccuccucagcgucccuagcccaggugggaggcgggcucccgggagcgguggcggcgggagcgcgaggcugagcaucgugggccucguugcugucccuuccagcgugugcuuauuguuagacucggggugcuuuccugcggacguugggaggacgugggggccugggcaggcacgcggggcaguggggagucccucuuugagaaccacauccaacacuccaaaacuuuucgcgcccccccccccuccacuucuuuuccugcacuuuucccuacccccacucuccccucccuugcaacucgaagcuuccucuuucucgggcguaggaaggggucacgccccggauggagaagggggugggggagggaguagugcacuggagagugggggaccccagaggauguaaacugggggacccgaggcgugcaagccuccucuccugucucugcugccccugggcgacugggggucccgcaggcgugcuccgagcgcaggggcgccagugccuggcaccuuuggggaccuagcuccaggcaacaaaggggaucugggagguggacggguaucgcggugggggagguggagcugagagccccggugggccagggcucgcgcugucugcgacaaggggccggcgggcgggugcuccggccugggcgcaucuccgcgguggcagcggcggcgcccgcguggccggagcgcuggggccuugcucuccgggccccgggccugcccuugacccgccucuccccuugccccuuccuuccccgcccugucccccuccccgcccccccggcgacggagggcgggggcagccggguucccgucccgccgccaggaucugucccuucucuccgggacccgccggugacguuucgcacacgugcgcggaggacgcgccugugacuggggaggaggcggcggcgggagggggcgcuggagggggagagggggcacccacuuccuccugcucgccggcucccaggccugggacggucccggcgcccucgcacccggcaccgccacccucccucucccguccccacccccccacggcgcccgcccucgcccggcgccgccgcuccacucggccucgggcccccucuccagccggccccccaccucccccggagccaggcugcuuucggaaaugcccuuacagcagcagguuagugaccuggaccgcgcgggggcccgagccaccgccgcggggacccgggauccccggggggcccgagccggaggguaggcgacggagcgggguuuuggagugggaacgggggguugggugcuugagggaaaugaguaagcaagaaaaaucuaacuaaguaaauccccggccuccgcuucuaggagccccggggcgggaguggccgcccccgggguggguauaguguuuacguguguuucuuuugggggguggauggaugggcaauugaaacccugaugagggcuucacgcccguggccgaguugagcugcuuucugucuugcuucccuugugcuggagggggagggggcgggucagaggguagggugucugugggguucccaggccacccgccacccccucccuuugucccuguaauuuauaaagcgccuuugagagaugauuuaggucaguaugcggcuuuccuuuuuguugcuacuagaaagaaguguggccccgaggucucccucucuuccuuucucuccugcauuccuuccuccaugccuucugucuucacccucguguugugccuuggcccagaccagacuagaacccacccggacucggauaccuaugguugcaugauaauaccagucgaagaucucaccuagucuuaggucuagguguguuuguuucugcacgaucaguauuuugcuggggucucuuaagaaaguccguacacauauauaggacuuugggaaaugggguggguagcgaaagaauuaauuuucuuaaauuucuuuucuguuuauaauuuuccccuggguuggaucuugagugcuuuccagccuagagauacuuacuagggaugugugauagagacagucccagucaaagaggcucauccuuuuagugacuagggucugccagcaggggggaagccgaguacaguaccugcuuacacuguguacaguauccagugugcuagauucucaggcacaggauauauuccaugcuuucauuagugguaaauacuuuuacggacuugauuaaacaugcuugaccgugcagugcagcaagcccacucccccuacacacucgguuccuauaucauaaauaagcuggaacaacuggcuauugacacacuucuuggaucagauucagauuugcagggaaaguuauuuuugauaauaggaaauugugaggcuaguaaauugcucuuuaagaaauaucuuagauuauucauuggaccagcucacccaagacugucuaaccaaauuuauauguaguuuacuguaguuaaguacuugaaguauaaaauuauugcccucaccaccuuccauguuauuucuaaacuuuuauuguccuucuagccaugaaguuauuauuccaggaauauagauugaauuuguauacucaaaaauaauguuucauuauaggaauauaaaugccucuuacacauauuccgaaguaguuuuauguaagauuguaauguaugcugaaucacugguuaaucuaugcuuccagagcuguaucuugugggagggguaugaaguuuaucucccaggugcauacaaaguccuaagcguugcaggcaaugcuugauuuguuuauuauguuuuucuugucaguguuuccgaaggcuuccaguuaagucuuggaauuuauuugauuuuguuuuugaggcagggucuuuuauagccuugaaccccuggucuucuugccucaagugcccaaguucugagauuuaaaacaugcauagcccuguguuuuagaauucuguugauauuuuccccuaagcaugaagauugagaaggcauauggaaugaacuaagauaagacuaaacauucuauguucaagaagagguggggaauucuucaggugacaacaauucuagaccuaucugugucugcuuuucaaguuacaucucuagagcaucuaagaacuugacagugaguggcuugccuucuugcuaacuguaagccuccuggcuuguuuacaaguugucugcuauuaggccaauaacuuuaucugcccaaaugguuccgucuguaaggcagggcaauaauacugagacuuucuuuuuuuaagucaugguaaugaguguacaguacuuagcucaaggccuggcaaauaguuagcugccccauaaaauucguauuuaugaaucaaguauuucuguaacucagaaaugacuuagaugcuguuccucuguuuacugaugugagcagaaugcucauauguuuucuaaagugauauguaauuucauucuuccagaaaauugagacucuaucagugcaagaggcagccuaucaugucagauuuaauuuaauccagucagagcaaccugcugauuauacuuuuugagagaaccuucggugccugggaauuuccucugagauuggaggacuggggaugcaguuucagcagggacucuuucccacaacaacuuugagagaagaaaacguggggcuccugugguucugugugcaguaagcccgcuuccacugagacauacgguugaugccaaguugaggcuggaacagaaguuuuagucacuacauaccccaaaauggaacuuuuaauaaaauacaaugcccagacuugggcgguacaaauagcuccccuguagacaguacugagugggccacccuaagcauccuugggaaaaaagcaccuuuaacuuagucaaagcacccaaaccugagcacagaaaaggaugcguguguguaugugugugugugugugugugugugugugugugugugcgcgcgcgcguguauuuuucuaaauaucaccaccuuauauaauacuugcaaggacagagucugaguuuagcagugugcuguguaaaguuaacuugggaaaggaauauacucugggauuagaaauaaguaucagcgccugggaagugaaaggagagcaagagagggacaaaaagggagggaggaugguaggaggugucuuagaaauaagcaguaguuucuccuuagcuuuucugauucgaucaucuccagugagaacacacacacaaacacacacacacacacacacacacacacacacauauauuuaaucccuuuccaauuggcuuuuuuucccaacuuaacccugacuuauaaauagucuauaugacuggcuguaagcauugucccaagcuaaucaacucccaagucuuuucacucaucuacuuuuaaauaauauuuuaaucagggugggguagaaauuguuuacuugguuuacugagucccucgaaguccacgaagcuaccugaaauagcgcaaggaggagagauuccaguucuucccauccccaccugccaugcuuagaggaccaucccuaaguucucugggguacaaaguauguggucugaugcacacguucauggcugugagcagcuuuaaguaguguuucaggaauuguguuuacaguugcuaaggaguucccauccaauaauauuugaugggacugaggagacccgauaaaggggacaauauuauauauagaaaaccacagauguagggccuuucaccuccccauccugucuccuuuccaagaaugacuaggaaaauaaucucacacagagaagagguucugguacuaacuacagaagguagguaccagaaagcaaccuugcugggaugagaccagcaaagugggggugggguuaauacagccggauuauuuaucuggcuuucccauggagggggcguuugauuuauuuucgucacauacuuuugcuuuaaacauugccuuuaagcauuuaaguugcaagaauauguuucucuacccugcuugccuuagugggagucaaucuuguggccacaguuaccuguaacuuugaagaugugguaaagccaggauggaauccaaaggccccugugaacuuggcgacccuaaguaccaggucucgguuggugcuuuguccugguaaagcaggaguugugucagcuugaagauagcagauaguaugcagaagauagaauuaaugacccaauuguuugcggccguuuguaauguaaaggcauggcaacaucccucuaacuugacggacaguauuucagguuagcguauucaauauuugaucaaucagauggucuugggaguuaaacgcuuuuccuauccaaccacuucuuuuacagguaagacaaugacaggcccacugcaauuaaauuacucagcuaaggucacaagucaacagggggccccuccgagccaaaacugaaauuggagauuuuugcccucuuaaaaccucuuuuugugaggagaggguuaacugucuuacaugcccuacaugggaggcuuaggugugcagacuacuaaacucaaguuucuuucagaugcgguuacacugccccagagacacugagaaaucaaggcuacuuuagacacucaguggaaaggacuuguaaguggaaaggaacgacagguucccuaaauagugguagcaguguuuuucaaaguuugauauuugaaauuucaguuauuuguucuuuggaugugacauuucgggugcccugacagagacaguuuuacuuaaucaacaacagccucaaaggacuuuuuuaacuuucuugaaagaggggcaccaagggaaguguuguccggaaccaucuacaucccgagugacagucacgguuugcucccugggccuuugcauuagaccauugaccgagaggcucuuccucugugguuaacaccaggaagauuucugaugugucaaagcugccgaucacuuaacucuuucggaggaaguugucuaaagucaaagcucauuuccuuaaaaugaccuuuuuauuuuacuuguggaacugagaaagcuuaaaaauagaauugcuucaagcucugaagccagaacgugaaacaugauccaacaugauugcagcuccuagccugcccugggacagggguaucuguuuaucuguaauccaccagccaggaagguccccuguguguguaaaggcugacuuccugugagccaugaguagcaauugaugagagcccuguuaucagggaggcugaguuucucuggaagcacauaugauggcuagaggaggugaaugcccuuggccuucccugccagcucucgccagucugcucuggagaagccugcggaggcucuucgugcucuugagugauugcugagaagggcuccauccuguucuacucucacgagccuuguauggacucacaguuggaggaggugaacacagggucuaugcguuucacuccuuccugcacugagauguugggaaagcauagucaagaggagcgaccucgagucuugcuuacacuaccaucacgucuguccuuccgauuucagccucacuguccagagauggagucuugaguauaaaagacacacucuccuaaaagguggagugagagacagcuagguagaaaguuaagugauggaggcuggaguccucugguuuccuuuucugccuccacccgucagaugcucucuucauuucucaucuuucugggguagcgggguucucacaggugcaaggaguugaaaccagugucccacagaugucauagaggggccaggccaucucuuggcgcuguauuuugcgucuuguuuuuuuuucccacuauucuuuaguguccguuucauacuguuggcgccucugagagugauggugacugagagcgggaggcguguguccugguguggacauugccuggugcaaucauuggacccccggucuuuguuaccucuuucuaagcugcucauugacucgggaaaagaaacagaagaauaaguuuuuuauugucauggugcaaucugcagugccagugcuaugaauaaaaccuuuauuucucugauggaacauguucgugaaacggcacgaggaaugcaaauugcacuguuaacauaauuucaugucuguacaguaagccauaguuuaagacuggcucagaaauugcaugccaagcccuaucuaacuuggaggcgccuuggguauguauguuagggccaggaccaagucuugcucaccagaggccucuuaagcucccauggagccuuuuuaucccucauucucucuggguuuguuuuugagauggucucaugaagcacaggcuggccuccaggucuuaaucuagcugcagcugguuucaccucuugguccuccccagcacugagauucacccauaggagcgaugacacucuuccacaguugacauuccuuguguucucucugcuccgucugccucuugcaagucgcucagacuugcaguuggcucccuggcuuuuggguauugugaaaucuugauuugacuguucauugcugccuuguuuuuccugccucuuucucaucaguccuuccaggcccaccugaagaaaguucacacagaguauagucccagaguccccaagccuuggagcgcuuccguaaguggcuucgggcuuuuucuggugcaucauagauuuccuuauaucccuauuguuugggguuuugacuuuuuaccaaaccauccuggccagagaucgguguggccgguucuccacgugcucuuugcaaaggccucucugguuguagagugaaccacuugagaagagguguuuucgucagaugacuucaaugugcuuggcaccccgucagcucuguuggggauaggaaagaaggaugguaggaucugccugcuguugaguuuacagccuauuuggggagccaggcuuuaaauacaggucaaccugcaagcaauacuaaacaagaguuggaaagaaaacaaggcccaucucuagucccguguacgcugcagacaggaaguggcacgggagaguaugaggggcacuccacuccaccuggcuuucagaaccagaggccauggauccugcaauggcauaucucagggcuuaucagugugcaccuucaaauguuguugggugaauucuggcauagugguacauuccuuuaaucccaguauuugggaaguggagacaggaagauaaaaacuuuggcuauauauuaaguucaaggccacacaggcuacaugagacuauauuuuaaaaaaaaaaaaggguaucucugggacacuaaaaaauacauagauaccugggcccugcggagacuagcaaucgcugaggguaagacacagaucuaucuuuucuuugaugccccagaugauggugaugcgcugcccgucguaccaccggccagauggagagagaaagcuggcuucuuuaaugugccauacauuuuccauauggacuugaacccacaguagagcagcaggaagucaguuaucaugaaagccacuaguuggacugcuguuaguauuggggauaagaagacaaacgggucuguuaguagaaugggucuagaaguauuuaggagaauugcugagcucaaggccagucuggguuaaagugaggcccuguuucaaagaaauuggucuagaauagggguuuuggcuuucaugagcaggcacagugagggacaaauuggaauuaggggaaagugggacagagcuguucuuguagagaaaguggguauuaucaaaggggugccugggucccuggucuugaucuguggaugccagaggccaggguauuccuguguguugccagacauccaaucuaaccuacacgucuaccaguuuuaaaauacugguuugauugaagaggaaagugugaaggccaaaugaaauaggucucuaggcuagauuuggcuuaagggcugccacuccacaguagauggucuaugggauaauaauaggcagugcuuauagagugcccguggguaucgagggcacuagacggaaugccuuccucgccuuagcacguuagaugcguggaaaccuaugaaauggaugcuauuaccacucuuguuccacacggaaggaugcaggcugccagggguuaaggggcugguuuagggcccugauacuaagugggacaaccagacuuaaacccagggagacugcccucugagucucaacugauuuccucuuuauccucagugcccuugcaugguacauagcaggaaaccaaaguaccuguccaaaaugaaauaaguuagcauuuuuaccuggggggucaguuaaauaaccuucauucaaaguguuugggguaagaguguuuugauuugggacuuuaagacagccgcuuacugcuuaggccagcgucagccuaacuguguuugucaaggcccacccuaacuugccuccaugcacgugcugagauugaaggaaacaccauguuuggcagauguuuguuugcuaguuucuaauaaagugcuauuugcauauaaauaaugcacuguucuuaggagcaggucuaaacaccaguuaauuugugcugucaccacggauugaaggucauuuuacacguugcuuauaauaauuuuguguagggccccauucuaugauguuugagauucuuaaagucuuuccgauuuucagauuagagauauccaaccuguaguaagauuagccuuuagcauuuuauccaggcagagauuuccagcuccaucccuaaccuuaguuggaagccugacaucugauguugugaaauauguaggcagucacuaauaaaguuucuucagcaggcaagaaccucauagagaauauuugaugcuuaacccaucuuuuauuauagagaagaacagaccugaagaucuucaugccuacucugucaauacuaguuucgagauuucuaggucauugccaggaaaaccauccaaaaauauguuucacaaagcccagggugccuaguauggcagcacaugucuaaaucccagcucuggagaggcagaaagcccuggauguugaucuugggauuucacuggcuaccuagucuaguccuguucaugagcuucaggcucagugagagacccugucucaggacauaagguagagcuagauacgcauggugucacaugccuucaucccagcacucagaagggagagaugggcccaucucugaauuccaggcuaggaagagcuauacagugagauccugucugaaagaggaggaggaggaggggggggggagggggagggggaggagagaagaaauaauagguggaaaguagucuagacagaccagaugaguuccuuuggcuucugcacgcacccacucacacacauacagccacacgaauacacacauaaaacccaaagggaauaacaagaagggguuugccaagugacugaagaucuaaguuuggaaggucaaagugggaaaguuuccucuguccaggcacccacaccgacagaauucccugcuccgagugguuuagucuaucuguaggcuuucugaucuggucucugggaacagauaaccaaauggacuaagaacuggacuugaacuggaagagagcucgggcauguccuugaacucauggaugcugaagaacuggcauaagugggaagaggauggaaagcgggcggggauugcuagaucuuuugacucaagauauguaacucugggggcuggaagaagaguugaggcuuagcacagcccucauuguguggcucuccuguguggagggaauccucggggguggagagcaauauuuauuuauggucuuccuaagggucugggcugagcccuagaaguguuugaggcucuggcauagaaguuacaguagaauugcucagaaaccacaggccaaaacguagugguuucaguuuuuggagggaaaaaccacauagguguagaggcacagaaaccuucgacaauuuugcuucucuccguauaauaugaagacaugucagauucaucagauugauuggcuggggcuggggcuggggaaucaauacugucagggcucccagagacaaaccaucagauguuauuuaugccgcuuuuccaggccuggacauggcagcuaggcugcucugacagagaacuggggagcacaggaccaacagggggugcuauuuuucaggacaagucauguaauuaugucugcgaucaauguggccccuaucuuccuaauuugcugugcucuuuugauuuuuugcuaauaaggaaaaaaaaauaucaaaacuguuuuguuaugcugugucaaauugaaauuuuuagaugaugaggguguuucgggggauagagccaaguggauucuaaauaucuacaauuaaauuuuuuuaaauauguaacauguugaagccuguuuggaccacuccuugaauuaacugauuuuguuguuauauuggguagcaaaguguguaacaaucacacuaauacuguccuaagguuuccaggaauuuguguuacugcucugcuucuuagcaucucaggcgcccugaugcugggauagugaguuuccaggccuggcgagccaugacacagagguaggguauggaaggagcgugggacuuggcagucugacuccuuucccaguuaccagcgugugaccuuucaccagcuacauuggugagacacacuuaccuaaaaauagugauucugucucacuggcuggucggccagauuaaaugagaugguguuuauaggaaacaagauuuguauuuuccucuucccaagguaggacgaguccaguuuuggucuaacuuuccaggaaaucaagcugugaaaaaauaccucauugaacacuuguguguguguguguguguccuggugguacucuagggggcucacgaggugguuaauuugucuuugagguuuucuagcagugccucaguagacuggaguuguguucucuaaugaugaagaugauguacaagauagugaaauaauaccaaugguguuucuuaggcaccuagacuugggggcucaggaggacaggaaagcagccuugggaaaguuuaaaauagagcaagcccauuaaugucucguugaagaagauggucuugugcauuuaggauaccuagucugucuggccuccaugcuuguggacgccuguagcauccuggcagcugucacaaugaacauuggcuccagacauugcuaaauguccugggagcaaaagcaccauugauugagaaccacugcacuagaccuugaagaaagggguguuacagagaucaugcgugcaucucuucuauauauaccauaguauuuuuauaaguguauugaugugugugugcauguggaaggcaaaaacucagauguuccucaggugucacuucuuuuuuaaaauuuaaaggcccggauggucgcucauuggccuggaacuuacuaaauaggccgccuuggcuggcuguuaagccucacagaucuaccugugucugccucccuagagacgugcacuaccacaccuagcuuucuuaacauggguucugggacuugaacucgagcccucaaccuuauauggugagcacuuuaucaucuaaacugucuccuggcccuaaucauacauauguaucuuugugugugugagcaugcaugcaugugugcacauguagugucaauauuuuaaaucaucuaauauuuacaaauuuuaaauuugcaagcaagugguuccucauccugaguuuguacuuugaauugcccagccgcccugcagagugagcacacuauagcuuacuauuucuuggucuugguugaugguacuuuguguagcuggcugaagcucugucuguuugauaugacgagcauaauauuaguuugcugcaaggagccucucuggaacucagaccagaaagacuaaguccacacaguugggaaaaguaacuugcauugucauuguccuacccagaucaacugcuccacuugacuuuuaagcccagucuacauagcacuucacacuuggaauaguuugccuauaccgucuucuuccuauggccucuuuccuccugguuccugccucuaaggauagcagguaguugugaugagugcuggcugcagcuccucccauggcuggacacucuggaguucuugucuccaucaucuauaucauuaucacuuagucuggccuccgucucagagcagcugagcagcucggagcaacucuuucuucuuuccuucccuagguggcaaugucagccacuggcugcaggagcuaccuaacuuaagaguuacuuaacuuaaucggcaggaauguagagaaguggcccugugugucaccugauguuagggagagcgguaucggaacacagaauuccuuauccuauguggcuuuauaacuaaugaggaauagauacucacuucuguuacuguuucuggugcauuuugugcacuguggcucacgaugaggugaggggccguaaaccaguguuagcacguuggaacuucugaauguuuccccuugugggaccccaagaccuauugagucaaaaacuugagugucggagccaauagcugauuugaugaccaguuuugagagccagugcuuggggagaaaccaaggggcuuugauugggcugugguauucugugguaucaaauaaguguugcuuguguggugauucuagccucagaguuuacauacgugacuauuguuccgguaauucaagauggcagcacuuuguaggcgcguccuuguauggaccaaccaugguuuacgugggaugacugggaggguuccagcuaacagaaauucuuggucuuucauuggcuuuucaucaguaacacgaaaauauuaucuuugucuggagacuuuuuuuuuaauuuggagauaaaauugaauguagccuaggcuauccuugaacacuguggucagggauaaccuugaaaugcugcugaaucuccuaagugauagucacaggcuuguccccacuguguccuguccagucacuuguacuaugucuguuuuaucauuguuaaucuuauuuuaauuucuuagcuguuauuuuuuuuucugcucccguuaaaaaucuuuauguguguaaucaaauugccagccaagcacacaaggcugauuuggaaauggaauggugguucucccuuauguguuugguaguuugaguauuuaaagauacugugaggaguaaugaaaugguagaccaugggaaagaauccagcugggaacugggcccggcagagccgcaggagaaauguccauguaauuucuguccuguccacguucauuaggaaagccaaagcauuaaauaaacaacacaguucauuguaugaaaacuuugggguuccgcuugcauaugcauuaccaucauauaaauuagaacaggaagcauagaaucuaaagguuugauuuguuaaaacuuuuauuuuguaaauaaauaaaagggcugaagauauauagcaacagcgguagaguguuugccuagcuuguaucaggcccuaaaaccuacccccaauaccacaaaagggggggaaauaaagcuuuuugaaaaaggaauauuccuugguguguguguaugagagagagagagagaauauuuuguuuuuuaagaaauggccaaaucugcuugguagaaauacuuuacuuugaaccuuacucuguccucaaacccgaauaagauuacuauaaucuguccauucauuggucaucauucaguuuacgggcaugacuuacacauuaggagggguguuuggaacucugugcucauucuuuuugaacaaggucuuggccaugcauaggaaagacgaugagggucucaugauccaggugugucucgguucucuaaaaacagucucucugccaguggcauuuccucuuuuucuguccaccuugcgcucaaauaacuucuggcaacagcaguaguuuggagguugccauuugugguugguuuuacuacaggggccgugaaagaaaggcggaugguguucauuucuugcuuccugucuuguuggguguauaaggaucggcuucucuucuuggcuuuucagguugccuuucuguauagaaaagguagcccuuagauagccaccacccaugaccggcuaguuccauccaguccuaccacucuuccugaaggcagcccuacggccugaacuugacagucucuucucuugacuuacagaguaaaggaauaaaaauagagccauccugccuuaauaccaaugaguuucauaaauacuugucagacucuagugcuuggauuaucaacggaugaacucuugagucaguugcugugcacgugugaaggguguuggaggguaaauuggggucuugguucucaucuugugcguuugggggugagacucgggguggcgggcuucuuaucugcugagcccucucucugccuggagucuugcuuucaugucuucuguuaugugagcagucauguaaaaugccauugcguagccguccuuuuaagaaagguggucggucuucugccaucuuggagccccagagugaucccugugggaagaggcccugcucccaccuuacagacuuagaaauaaaguuuauugcucuggaagauugcuucgugucagucagaguuccaaaggcuaauaaauuuuaaaugcguacuucuuaauuuaccucaggaaauaauagucaagcagacaauuacaaauauuuuugugcuuaucagaggaagaauaaaugcguugaacagucccauuaguguuguccugcugcgauggucccuuucuggaguggaccuuggagacggaaguaucaccagcuguccaaggacuauauggaauggucacuuacuggggguuuaccucccucacucugauagggaacacugucuuuguuuauauagaaaauacuuaguucuaggauaugauuuuccuuuuucaaaucagaaaauagaaauugcaguaaaaauacccauaguccugcuucuuucccagacagagggaacugcaaugaaauguucgucugucuauuucauauccauuugcaaauaucuauuuaauauaaaaaggacaacugauuuuuaaaaaaggaauacaaaguggcuugcaaauucuacuccacacaguucgacaucucuccuuaccaacguaugcugauguguguuauucuugaugaaggccacucaugggauaugccagaagguauuugguuauucccacuugauuucuguuauuuuugauucuagcuguuacauuggcuggccacaaauagcccuucaucaacugcuaaugaggacacuaucauucaugucauacagcacaaacuaacccugcuguccccacgcccacugccgucacugcuauuguguauugugaaucucauccgucgggugaugaugccauuguugaauguuacugaguguccuuaacaaacuggagggcauaagacaacugcuagguauagccuuuuugugcagucaagagacucggucgcccugcaaguaggacuacacuuaaauuguugauaagagguauaauuauaggggaggaguaacucacccaguaaaauuaaguaugguaucacacacuuguaaucccagcucgggggaaguugagauaggaggaugccuugggcgcauuggccugccagccuggcuuuaucagugagucccugguaccagagaaagaccuugucucaaaagacaagauggaggaaccccgagguugaucucugugccugaucauaagagccuucccaccugaagaugugcauaugcauccgugagcacacacacaacgcauaacacagucuauguggaaguuagugaguaauaaauauuuucauuaucacauuguguguauccaugacuguguaccucugcuguuguaugacuggcaacaugggcuuauuuacaugagugucaauagcaucacaggaguagugcauugaguagacagacauauuaggacagccacugugucacuuuauaagaauucuucaguucuguuaacagucuuagggcaucagaguuuauaaguggucucauuaacuaaaugucaucuuauguacauaacuuuuuuuguguguguacaaaugugugucucaauaugucuugggauagcaggacgcauguauuauuaucccccccccccucuguaguuagaccuuuucucuccccguaagucccccaugaccuugguuauuaacuuaccuugcaauaucaggugcuucuuaugcuccacucaccugcucgcuuagaggggugggucugccguuuaaaagacagacucccauauccguagccucguugucuguaaauucaagcaaggauacaauauacuuuuaaaugcaucugcacuaaacaugcgcagacuuuucuucuugucucuacucucuaaacgaugcaguagagcagccguucucaacuugguucaaugacccuuucacaggggucgucuaaggccaucagaaaacaaagauuuacauuaugauuuauuacaguagcaaaaugacaguuaugaaguagcaaugaaauacuuuuaugguuggggucaccacaacaugagcuguauuaaagggucgcugugcuaggaagggugagaaccucugcaaucaaguaacagcuguguuaauacugcacggagguaaugaggauggacugaagugcaccucaaaccggaggguauaagggaggucucguagaagagagaagccaaggugauguccuuuugcuuaaacgacuuagcaucuuuggagcugggaccacagcaagguagugguucuugaacuaauccccaugggaacugaagaauaaccacaccaugaagguaauaacauccuagacgcucuggccagaggagacgucugcacaacccugggaguuuuuuaccuauucaaaaacaguguaaugugguuagagaaaugacagaucugugggaaguccagaaguacugcuuuccugaagaggaaacuuuaaaaaccaaggcaacucaacucaugugugugugugugugucugucugucugucuguguaugugugcaugucuguaugaaugugugcaugcguguagaugaggcagccuaucaucuacauagcucacacuugaacuauggaauuagguuauuuuaaaaguacccucaaagcaagugcuggaagacacccuagcaccacuacaauauggcauggagaggugggacagauuggaguggcgcuugugcuagggacagagguggaacugguaaugugaugguggugacaggcgagagaggacugaggucugcaugcuaucauugcccgguauggucagagagauguuuugcaacagccuggacacagacuccgcccccaccccucuggaccuucugccaggcuggggaauccccaacaaugauggaggccagggaugaagaaagguucacuuuguggauugaaggaccaccaugauccucgauggccucggaggccauguugauauccgugguccacgcugcugccccagaccgugaugaagccucccauucaugaugccuuggugauggcuucaggcuuugccgccucagggagccaugccaacgugaguggcaugugugagcaccugagaccauguugaggcucauggcaugggcuaagggccaugcugaugucuaauggccuguguuaacacugaagcccauguggauggaugcccgaguggguggggaggggugcucugccguccucagugcuguauguaguacagagguguuuguggucuaccccacagcucuccucagcugaugccuucuggcccagguacagccagagaaagacucaucgucccuugggggcuagcauucugaccguacuccagugaauauacaaaccacacaaauuauacuuuuaggggaggcaugggagguagacaugggaaggcugggagguaugaacuauuggggcaguuucccaaauaauugucuuagaaaaguacccucgucgggcaugguggggcacaccuuuaaucccagcacuugggagguagaggcagguggauuucugaguucgaggacagccuggucuacagcgugaguuccaggacagccagggcuacacagagaaacccugucucaaaaaccaaaaaauacccauaauggucuaaguuuauguguugggcuacauucauagcuauguggcuucaguuugggccugauggauccccccuuuucaccaaguaggguagccccuugagucuuccucucucugguguuuucugcuagcucucuuggcugaacaucaggagagugauuuucuuuggggaccuuugaggcugacucccuaacaaggcccagugaguucccaucaggcuucgaaaguaauccuauuuauuaguaguaauguauugauuguguguguagaauggacccagaggccugcaaccgugaguccauuugaauuauaauuuaagauuucugucaaaaucacugcugaaauggucgguccuaggacggaaacggggagucguugagugggauuuucggaauuuaguuggugugugugguggugauugguggggggggggggguguuuuacucagguuugcuugucuuuuuuuuuuuuuccagaaaucuccucuguguugugugugugugugugugugugugugugugugugugugugugagagagagagagagagagagagagagagagagagagaauguguaaaagagagagacagacagacagagauugauugguugguugauugauugauugauugauugacuauaggugcuugugugccaugaguaugugugaaagccaagaagacuaccucgaguauuggucuucacccugcaccguguuugagacgggucucuuaaaaaaaucucugacaguuccccugucuucgucucuaucucaauacaagggcauugcgauuauagacaaacacaguguucaaguccggcuuuaccuggggauuugaacucaguuccucacaauggccgagcuagcuagcacucuuacccaccgagccaucuccagccccacauccaaaguucuuuaaugcauguuuuuaucaacaguuaaauggaggcacuuaagucgcugucauaaagcauuuauaaaaaccugguuuugcuuuguuugcuuauuuauccauauuauaugauucugucuuagaccauagaaggguacuuggagcuaggaauguagcccagugguagcauccaugccauccccaugggcagcguccgucagaucaccaucuagccucacguuggcauuauggccauagguuggccuuuccagggcugugaccacuaugaucacuggggucugugugccuggaagccugaccuggccucugccuucuguccucccaugggcuuuccuaauacuaacaugucuucuuuaccauccucccuucccccaacacaacugcccuggcauccuggcuuuuuccauucucgacaaaugaucuguccacuguaacuguagcuaagcugugcugauaucuguugaaauuagaccuagaaucuaaauguggcuucgugaaaagaugggcaagacauuuuucucuucagagaaucuggauuauuggcauucaggccagcuccugguagcuucugaacugagauguggagggaagaaaauggaguaauaugcccggagcuugcuuagaauggcaguucuccauguggcccacacaguguuagcuuauguuguugcaaugggaugagguagagagcaguguuugcugccacugcaccugcguucucugaaccuguggacugacuucaaccugguggcaucucuuauguaacagaaauugcaaacucuccugguguccccuuuuuacagccauuccaacccccaaugaggcccaaagacuuaaugucuuaaccaauacugacugacugacuuauccaaguucuucuauguauuuggucauuucucccaacaguucgaaacaguaauuugguggaagcuaucucuacaacacaggucagugacaugccugaccccauuuguccugcaagaccauguggccauuauuuagaugaugagccaagacauugggcgaccacuuggggaagaagggucuccugggccacaggccauagugagguuugcuguguaaucagacuuggguugcagguccagauguggaccugugggcgcagagagauuuaaggcuaucuuccacucugucuguccacaaaaccacaggaaguuuugcuguuugaggcuuccuucugcaacugagcucuagaacccgccuucaagagcucacugagugcugccuccguucuuagugaugcugagaacuauuaaaaucuuauucugaaguugcaggugaggaaaggcguauggcgggucagaaggagacucgcccaauccccaaagaggaggcuagcuuuggacuucagcauugcuuggguuuaagaucacguguguucugggagcugggcaagucugucaugugggauaauugcaccuccuagacugaaagguggacuggggaaaaauaagguguguguggaucagcaaagggcuacaggaugacauagucaaguacuggcuucgagggugagcaugcgcaacugauccccacaacuuacauaaaaagaaagccaagcaugguggggcuucuuguaaucccagcucuguguacgcagaggugagggcuucagggcuugcuggguuuaagucuaaagugagcacugggccaaaccaccccggucucauaggaaauggggacuguggaacccaggugguccucuagccuuuccaagugugcgcacgaagugcauccacacacgugaugaccacacaugcuuucuuacuuuuaaaagaaggacucauaaaguugguucuugcuguggugagaaagcaagaacgugaagccagaagcagucccucaacacaacguuuugcauguaaaagguaggguacgucuuuguuuaacuuuacugugggucaaauggggcuuugugcacauacuguuuuuggaaguuaccuugcugugaucaguuuaauuguaaugaguuuuacacuuuguuucauuuuuauauggaugaaugguuuugccugcagguauguguaugugugugcaugcauguguagaggccagaggaugucugguuuccuggaauuagcaucaaggaugguugaaagcugucacaucagugcugggaacugggcccagguccuuuggaagaacagugagugcuauuuaaaaacuaagccauguguugagcccccugcaguggaauuucuuuuaaaacucugggaccucgggaacauuugauuugcuaaagcagacacuuaaugagaagcgugauaaggugccgcuucugucugggguucaucccuucauccaguguggagaugcugucugagccacacacacacacagacacacacacccauuaguuaccgaggcauccaugcaacagacugacugcuuucacaguauuugggcucaggaaaccuaaaugacuuaacaguggcguaacuguggcaacucggauucaccaacgggaagccaggaagugcuuccuuuaaguaaaaaggugaagguucucaacucagaacccaggcauggcugacauacgcaagacugucaguuagggccacagugucggaugggguucugaucgggugcaaaggacauuagauuuguggguaagagacgcaaagagaaaguguggucugacuuuguguuaggccagagaacauugugcuugaaugaggagaugagauccuuugagacaauuagaagucagguacacagauugcaaggguggcgcggggcggggcggggcagggggcguggacugauacuuguauuguuggaguauuugcgccuuguacuuguaugucaaggcuaguacuugaagguuggugucuccucaguugcucugucuuauuuuuugaggcagguccucuuccccaaacaugaaacucaccaacucagguaggcuuacugggcagcaaaucccagcagccucccguuucuaccucccuagugcugggauuacaggugaaugccgccacacccaucguaccucccacacuuaaccaucuccaaucauaacuuuaucucagauauuguacucuacaaaguguuaaauaauacaucucgaguaauuacuugccauaaggaaggaaauaauuucugaaagugauuuacaaaauguguucuauaguuacauucauuuguuucacaauguagcucaaauaaacugguguggugugacucccuggggagacuugaacaaaugucuaccuccuccaggcaagcaaagacgucaaaccaaagacgcaauaccagccaaaccugguuuggcgaaccaauuugaguugauuuaagggaauccaagugagaggugacuuucagaaacaugggagacucaggcagcugaggcacggcagagcccaucccagccuggcugaggacucaguagcggcaccccuggaguucucuuuuuaacuuugcaggcagcuccaccaaagacucucuuuuccaucaguucacagccuacacagccucagagagggaccccuccugagucauaugagcuucuaauauuucaugagccccucuucucguucauaagggaauguuucauacacggagggaauaauagcuacucaccacagggugaguaauguccuuuguaacauccagaaaccucagaaaccagaggcaaagcugggcaggagagagaauccuuugcauggucaugucagagauugccuggaaauccagcaaggcgaugagauuuaaaccccucgagugucgugucacucaugaauaguagaguuucuuuuaguguugaggaucagccaaagaaaagaaaagguggaggguggcuugagauucacuugggaacacacacacacacacacacacacacacacacacacacacacacacgaaaaaccuucaaaagacgauucacaaaugagaaugcagaguucuuccuggcucauccguguuagggcaccuguacccacguucugggagggaagcagcugucauagacugccaccugcaccuuuacaucucugugauuucaaaacaaguccauugauggcgagggacugggcagguaccucuggguaaagcauugguguguguguguguguguguguguguguguguguguaugaagaccugaguucggauccucaaaacccacaugucuauaguccucaggugcaaugaacucugucuuaaaauauaagauaaagggucuggagagauggcucaaugguuaaaggcacuggcugaucuucaaagagaggacuugagugugauucccagcauccacaugaccaggggaucugauaccuucuggccucuuugggcauacaggcaggcaaaacaacccauacacauuuuuuaaggugauucagcaggcaaauacacuuccuccaagacugaaccccugaguucgguuccugggaucuucaugguagaaggagaaaagcaacucuugggagguguccaccacaggcacaucauaguacauagaauaaaugugugugugugugcgcgcgcacaaaguuggaaagcaacugaggaagacagcugguguuggucuguggccuccauuugcauacagcacacacaaaaugaguccccuguaaugcuugcuagcuucugcgacuguaaaggugguuugggcccugugcugggucugcugaacucugguuccacagcucgucccuugacucccuccauuucccagccagcucugugcagacugaugguguugauggcucuaacauuaggugcacaugguacuuacugccuaguggucucaccaguggcuuccuagugccccugccacccacagcacccuguaagucaggacaguugaugcccgagaaacagccucucacccuggggcgauaaaugccacuggguggaugggugguacuuggaguuccauuuugaaugcuuccuagggagccgcagcagacucaggccacuguuuccuaucucuacaaccugguacuuucuggggucauuucuaguuaaaccguugaaacgugcucugguaguucuggagacccaaagcccaaggucauggucucaccagguugguguccccagagcgucacucugcugugcauaggugccugcugucacuauagccuugcuuuuucauacagaccagcggcauagugucaccaccugccccaaacaaagaccuuguuuuauaacuucaucucuuuaaaggugcugcugcaaaugcagugacauuuugagguccggggguuagggcuucagcacauggauuuauggggggggggcgucaccauuacuaacaccuaugaagaacaauuugggcuaggauaugugucuuucaauggaauuauuuggcuuugaguuuggagguuucacaaaacucuacuuuaucuaaaagugaccugcgguugaagucuuccaaugaguccgaacaaggaagaaagauggucccacuaggcagccauuuccucuuagucuauuggccugggacggccuggaagaagagcugcugucagacuggagaagugugacaccggcauaagaacacggugaacgguugagagaaccgcuuccaugcgguugagcaaaugaaggaacgguuaggauuaugggguggcugugguguggcccagaaacccucacacagaucuguguguggccugcagugcgaagggugaaugaugagaacagaauguagcaggggcagugaacaggcuccccuuggggcuucugugagggggugucagguagguguguuaggagcauggagcuuugagaaagggucuaugauagaauuguccagggaagccuugcagguguugccaacuugugcccugcccuggaccauggcacccccugcuuccucugccuggagcagccuggccucgcacagucaugucuugucauccacucugccucacuucuuguccugucauucacugucugaagucagaaucuuagcugacaucuacauaaugcuccauuauuugcuaaaugagugaaggcaaggcgcccauuacauacauacauacauacauacauacauacauacauacauacauacaaauuuaaauucacuuuuggaaacaaaacaaauguguuguccuaguuagaguuacuauugcugcagugaaacaacuucugcuucugugucauacauaguccaucaucaaaggaagccugggcaggcacucaaacagggaagguccuggagacaggaaaugaugcagaagccauggaagugugcuugcucauuauggcuugcucagcuugaauccaggaccaccagcucagagaagucacuacccacaauggcuggacccuuccccaucgaucacuaauuaaggaaaugccuuauaacuggauauuaugggggcauuuucucaguugaccuuucugaugacucuaguuugugucaaauuaacauaaaaguagcuaggacauauguagagucaagaggaacaacauaaaauaucuuacuuacugguuacugacaugacauuuuaacuauuccuuguuaaauuuuagcauuaagggggaaaaaaccuuaaauaaaauggagccagaccuucagaaggucgugaagaauuccaaaagcuagauuuuaaacagauuaucauuggacugaguucuggagaccauccauuguuuuauuuguugagauaaggucucguuagcccagccuggcuggccuggaacucacuauguggacuccaggguggccuuaggcuugcaguaguucucuguccucagcuuccugucugcugggauuguaggugcaccucacuguggugaccauguagauacucuguaacugauguuuauccuuccucaccuggacaagucccagcugccgauaauacauauauuuaucaugguuuuaagauuuuaaagcuacaggaguucuuuggaccuccuggaucuucaaaucuaacagguuuguuacuguaucauacauaccuuuuuggugcuuugaaaagcuguguuuccguacagggcauuuucuuggcauguuuuauuuuucagaguccaaaaacaguaggccuagaaagacugucauagccuuugcuagagggccggaaggaaggaggccacccccucaacucuaacuagggaacucagcugguacagauugccucgcaagaagggagcucugaguucaauccccagcacuguguaaacaagcuccccuggaguagggucggaaguucaaggccagccugggcuacuugagacccaaaucugggguggauguguguagaacaagaagcucugucuaggaagugcucagugcugugggcucaccccucccucugaagccgcucccacgucugucaguuuccgauaggguuauaauggucacugcucaguguaucaggacugccacaggauauccaggcuuugaugaaggagcagaaggaucugggacagcuggucaaaacaagcuuguccucccucgugggaggagggacagagcuuuccaguugaucuuuugguuaagaccuuaauuaaaaacagccucucgguccacuuguggcaagaauuuauuaaaggaaaacaaccaugagcaagccagugcugucuucucaaacagaggcccacaugggaaucccggcuuaaauucuggugaacuaacacaaggagccaagacaccacggacggguuacuuaacaguuugugaugcauguaauuagggggaggauugaucucugagaucuaagaaucuccguacuugaagacacugugauuuguggcuuaauuagaaacccuggugucauggugccagaaggaagagguauaguccuuaauuucccccugugccaccucagucuuaugccucgacaucucauuccauggaguccucauuauuaccggaagucucuugcuuguucuuuguaaaaaauagagagacagccacaaauuucuuccacagcgccuuagggugggcagcaaggcaucacuuuugugguguuugggagcagagggauucagguauugggcuucccugcccugacuccccguucacugcuccaugcuuuuaugguggcuuggugugagcgagcacuggggacuccacuaggacuuacagggaacuggguacauagccauagaaagaacgcuugacagauggaaccgugggaaaccuggauggugacccacugcaggccggcaucagagaagacacaggagcauggagccagagccgguugcagauagguguggccuugaacugagcaaggucccucggggguuuguuuguuccucccaacagcugcucuuugaagucuuaaaugguguauccauuuuacagaggaggagcuuaaggccuaggagaguuacaacaugcccaaauucguuacaauauccacaggcccaaaaccaugaagugggggaaaagccagcagccaacccagccuucuugcugcgagaggccugagcgugaucucuugguccuuuaguuugauggugagaucaagcuacuugggaauaauaaaaggcagagcaagagaagccuagggaccacacaaacacccccagccccgccccacgggguuuucucugagucacucacucuggcuggcucaaacugagaucagccugccucugccuccccaggcacggaccaccaugccgguuacgugagcuccccccaccccccaucuuaaaacaaguaaaccaaacccuggaugacagcaacaaaggauaauagaagaguaaaacaaaggcaguuuguucuuuuaaaggggaaagggggugggguagggugguaaggauugacuugcuggacagacaauaauugggaugacaugggagguaagaaugagcucuguuggauauauaauaauaauuuuaauaaugagugcugcuuuauuauagucuucccuggucucuuucaacauccucaaaaaaaaaagagaacuuuucaaacugagggaugcuugaccuuaacguacuugagauuaucaauuccaggcuguggcccuguuuauuagaugacuuccuuaaaagucccaggcuaggcaauagugaugccggccuuuaaucccugcagagacagauggaucucuugaguuaguggccagccaggcugcauugugagguucaggaaagaauaggaccuuaaagaccaaaggaauaucuacacugcuuaugguuuaagcuguucaacuccacugauguuguucugauaagaagagucaugcgaaaugaaagcauuaugguugggucaacuuacauagugggaaaucuuacaaaacuaaaaguuggucuguggggcuggagagauggguccguggauaagagugcuuuccugugccagugugagggucugaguuugaauccacaacacucauauaaaaagccaggcauggccagcugugucuaacucagcucgguccuguccucuacauagagcgugcaugugugugugugcgcgcgcgcgcacacacacggagggaucugucuguauucacagaugagaaaaagaaggcucaguuggcucaccaauaugguucgguaaagcaucaggcaagaacagcuccuuccauuucgacucaguuugguaguuugugacaugacaacaccggaguguucgauuuuugauguagaaagaagccguucuuauucuugggcauggaaguugaccuaagccaagguuggaaauacagugaaacaauccagucgucuacagaaaacguuaaaauuagggguuuuugaaaaguaguuuguuccuguaguguugguggauuguucucccgaacuuaaguaacagcuauguucacucagcaaaggggaaugggaaacuuuggagcaaaagccucuagcguccaguggaaaaacaguggucuguuccaaucugagugugugcgggggggggggggggggggacggggacggggacggggacgacacuaaaaccacuuuguuucauagccugguggggaagggacuggggaauuuccugucucuuuuccccuauccugguuugguaacgacuccagcagcaggggcuugcucaggaccagccugagcauugucgugugcacccacgcucugcuuggcuguaagauuuauuuaaugacaugugugacucugagacuauucaugauagugaauaccacagauuuggcuggguaacgugacaguuuuuauuugcuuuaaguuaacuuuagcuucuagugugguguguggcaaaagggcaccaaacuuggaucccagguucaaguuugauccuugacauuagccuucgccugagcaaacuugagagcucuguuuucuugauccaugaaaugggaauccuaacacuugugaacuuucucuuaggcgguggugaggggcuuugucaaauucaaagcaauggcaggcaggcaggcagcgagguaucaccccuauguucguuuuuccgauuuuuggauaaucaaguuaacauucccccgccccgccccguuuuguauuucugcuucuuguuugugauggguucucauguugccugauuaccuccuaacuccccugugcgugggaggcaagcccugagcuccgccuuccuauugccucuagguuccaagcgcuuagcuuacaggaugcuuucuuuaccuucucuccccuuuguauuuuuacccaguauuuuuuuucucuauggaagucuaaauauuguaaguuaggguauuucucuugcagccuuugucucuagugagcaaacuucaacuuuccacuccauauaauucaucauucucuugacaaauauuuuuguuuguuuuuguuuuccuucacuugguuaggucugaaacggucucucuguagccccugcugcucugggacucuguguagauacuguaacucgcucuguaggccaggcuggcugcuaaccagugaucagucuguuucucccuccccauguguugggauuaaagguguguaucgcuccuggcauauaugcgguuuuucaccaucuuaaaucagcucuuaggugugguuuuggcugcggaguagaaauugauaauugcguucugguuuucugugaguauuaccagucuggguaaacauggauaccagaguggguuuagugaaucaacagaaccacauacuuuuuccagcugucacuugcucuccgauucagaggccuggcuugauuggcuguaguuauucacacgggcaagccaguuguuuacaagcaaaaauuaauguaguauuagacugucauuuuaauugagguauucuuguaguaauuuggagauucucccccaagccaaaauaaauaaauaaauuuaguugauuugggagcuucccuuguugauguugggggguauaaaagggagguugauaguaugagguuuugggaaacacucaaaacuuaucuaaaauucugaccaaacauuuuuuucuuucuaauuuuucuaacaaaaaaauggaaacuccagcuguauaaauaaugauuuuuguuugaaacuauuucuucccuugcuuuuagaaccaucgagggaauucaauuauaaauaggacuuagcaaugaacaacugucacuguggaacagagugcaagguugcucuaguuuugacccuaugcuuuggguucagaggcuguggugaguguggcuggcggauaagccagcucuugguggagauggaaaggguucgugcacauguugcuuuuuauugucaucuuauuuguuaauuuauugcccaguugguuuugaugacuuaaaacaucuuuuucuuauuuuauguauauggguguuuugccugccugccucugugugugugugugucugugugucugugcaccacaugugugcagugcccauaagagccagaagagggcaguagauuaccgggaacuggaguugcagaguguugugagcugccauauuggggcugagaaucagccuccuggggagccaucagggcucuuaacuaucauuagcugaccucccccuccccccaccccagguauuuuaacugucuaaaauggcacuuucuguguauuugugugugugauaugagugggauuggggauggugaacaugcccuguguguacaccuggaagccagagguuaaccucaguuguuucuuuaucacuuuccaccuuacuaugggaugaggucguucagccuggaucuuagcaccuggcuggcaucuaucugucucuggccccugacucugggauuacaaucaauacagggcccuacccugcuuuuucaugggcacuggggaucaaacucgggaccucuugcuuacauagcaagcgcuuuaccccacuaaaccuucucccugccucuaaaaugagauuuuucuauaagaguuuacaagauugcuuuucagugcuacaguuuugaauguggccucaauucccauguuuucuuuagagggaugacuucuuuugauauagcccaauuaguagagugccguuuagcaugcaggaaacccuggguuccauccucagcacuucagccagguaaggugauguuugcauauaaugccagcacucagugggggcaggugcagaaguucaaggccaaccugaccuaagggagacccugucucaaaacaaaaagggauagcucgcauuuauuuauuccccagaccccauccuguuuagcacauguuguaggaaugccuaagucuauggccucugaucauuuucuuucuguagguuuguguuuuaguuauuaacaaggcuacuuauguguagucaggaugcaauagaaaacauucuugucaacaaaucacaugcuuucugauccuccuuauugcauagcaagguccccaugcuauuggacaauuaguuucaucacauuuuuuuauacauuuuuguuguuuuauuucauuuuguauuuuuugagguaggguuucugguggcccagaacuuauuaggccaggcuaaucucaaacucacagagauccaccugccucugucucuugagugccagaauuaaagacaugcaucaccauguccaacccuugucacauuuugaaaucagcuuuucuuccagggagucguuuuuauaauguucuccauuccacacauacuucagaaguguuacuuccaaagaaauuguugcaauuacuuaacacaaguuauucagaaaaaaaaaucacaagaaaaauguagucauuagucuaaagaaauagaagggagcgugacuuguguuagggggaaagccaacaaagaagagcucacugucagcccaggguguguguggucccuuaucucuggcuuguugguaggaagucauugauaccuguaugaaagaaggccgggaucuugucugcagcccacuagauguuuucuuuccaugcuggccuccagugcugauaguuaacccuuccugugggaaacuccucaggggugacuucuuucucuuggacguggaagccgccugcugaagcccacuuacucaaacucugcuuuccagauugaccuaugccuccuuuugccaggaauaaauucaguggacaucuugaaggagaagcguacagauggaugguuaugggaagggcagugaccaggguagaggaugggaaggaagguuucuacugcacugauggucagggucugccuucgugagagcaucuuagggaacuuguuucuaccuuaccaugguaacgaaggugggacaugcagauuugacuucuauauuugacuuaguauauauguguguuuauugugcauguguguacucuguacaggcauguagagguggguuuucucuagcuuuugagacagggucucucacugaaccuggaggugcccagugggcuccaggaaccuccuggcuuuuauacaugaguucuucggaucagguucuguggugccuggcauaggaagcauguuuaccaaugcaauagucucaccagccccagcauugaccaucuaacuguuauuagguguaggauccaguagaucugggugcaucuaucaugccugucuauuucaccauagacucccaguucucuccagccccucauggcgccuauucuguuuucugcucuccaugaacuugaccgcucuagauaacuuguagagauagaaccagacaucugucugagugguuuguuucaguuagcacagugucuuuaagcuugagccaugcuguggucuggaucagaaccuggcacuuucucugacagacagugauguuccuuuuuaaugugugcuaccauuuuguuuacccuucauguauugaagcgcucuguaguggugcggcugcacucucugguucccaccgauagcgcugcccggaugcuaggaugcuugcgcuuucucucuuugauccucucuggguauggggcugagaagaugguucagagaacuugcugaagaacgcuggcugcucuugcagagaggcuccggguuugguucccgguaucuguaccaacucauugggugugucuccagaaguagacuugcugucguacaguuacacagugauuaacuuuuugaagaacuguggggauuucuugcagcagcuguaccguuuuccauuccguguacagcagaaggccauggcagggggcguguuagcccuuuuggaugucaccugcagcuuucccuuaaucuaccucgucaucuucauuaaccccugccucuccccauauugugucugcucugugcuggggccuccuccccuggcccacuggcuucgguuuugcuguugaucugguuggauggaccuguccgucugugcccuccucagacugccaugagccuucucauucucuuggaagccaccccuguaauaggugcagcuucaugcgaaugaaaaauucauuccuguucugccagcccgaaggagcggcuccucacgugucaccuauuauuuuaccaauuaucucggugacucaggcgcuuuucauuccucaaagcgaaguuuagaguggugugagcuucugggauacucaguucugugaugcuuucugucguuccaguaacagcaagucuucggaggaaguugagaugaucugaaaugcuuuuacacuuucccuuggcuguguagcugugugggcccuacaucccgaugugauuccuugcacggagccauguagacaaagccuuuccugagcaguggguguuucgaauccuuguuucuuuguguggcauuaccuucaacuuaugaagccuuuaggggcagcaggugguuugugggugccaucaucuucuuaauagauaaggaagaugccaacacagacauucuuggaucuaucuccccaagaguuuucuggggugccauuugggggcacuagggaggagccaggccauccacuuuccuuucugugaccaaccuccauagacaguccccagguccggggcaaccaacccuucuugacauugguuuguugcugauuuucucauggaaucaccaccgugcuggauuuuguaugugcgcacgguaaccaugguaaaccauucaaucaagaucugaaauccucagcuggggaccguuccuaauaccauguuuaacaugauugauugugguacuuuggauggcaugugaauucugguagggcuggccuucacacgugaugugacgugugucugcugccacaugucuuccgaaaacccacggggcuuugccuuuaugucguaugaauuuccuguccauccucugauauuuauuagcuucagaauggcggcggggugcucucucagcucagucccccacugucccagacacuuuuaacagaccacauguuuacaacaugacaugcuguuguuuuagguagauauuaacauuaacaaagucauuuugguugagacagucucuucgugguuaggccuggcuuuaaacuuauguuaauccuccuauccccacuguaccugggcuaacgugugugggccaccgugcuugauuaacauguuuaucauaaaguaagcuugauucaggcccucagaauagcauuucuguguagcuacguaguugacgcuugagacugaugaaugauguguuugguucuuagcucauuccuccugaaaagaauagcuaaguacccacugauccccagugagccgucaggcauuggccgucaccucuuccgcaagccgggcugggguguguuuugcuggugugcccagaagacagugcaggaagccagccccagcuuugcaguguuuuacagccuguuuggaugcucacuggcaagcaagcgggggucccuagaaauuaagucuuagggaaaauuacaagucaauccgagggccuugggaagucccccugagucaugggugggugugguagcauugagauguugggccucuagagccacccagauccaacucuuuggucuguuuguccccaggcccggcacagcucucaacacaggagguuuagaacugaccugcacugaccuugauggccuuagggcccuuggcaagucugaguccucugggucucaucuucauuaggauggagaguugggggucagagcacagcuacuugcuccuuucagauaagacuucuuggugacucaggugucaucuuugaaaagaacaguguuugccuugucuuccuucucauguugacaaggcuuugggaacacuacccaucgauuguuaacuaggaacccccuggauacuaaaagcacgggucuuccauaaaagguaguaaguaguacacccuacccucuccuaccuuuguccacucagggucauuucuaauagcaguguagugcuguacuacaauuaauacuagguuguuugugggaauaauuaaacaagcacaugugcugcccagacagcucgacucccccuggguagccucagcccuugguugguuaacuguacaaaugccuacuuuuguccuuuuugaaaaccaaaaaaauuauuuuuaguaauuuuguggggggagaccuugugucucuuggggcuggaguuucagguggguguuagcugucugauguggguucucagcaccaagcauucucauccacugagccagcucucuggccccaucuucuccguuccugagacaugcguucuuucucauucguccauuugaauuccauccuugcuccccucagcauuugcugauaaaacaugguacaucuuguaauccuggcugcauguaaccaggaaguuugucuucacucuuggaggcagcacaguaugaucacuacuaauagugauuaaaaaggcuuggguauaaugaucacgacagagccaauauucugggguucaugucuccagccugcaucuuuuaucguccagagucguccucacugugacaccacggaaguacccuaucuugaaguuuccugaauagcagaaaaguuuugcuguguuaccuccuccuuggcggcgaggaggaggugggucuggcuuaaagcaggaggcucuuauguaucaucaaccaugcuuauuuucguggaguuauuucaacgaaggcuuuuguauggauuuacccuugaagccauugagauauguauuugauaugcaugggagguucgugaaacuccacagaugaugcucaagguugaaaucaucgcugaacaugauguaggagaccuguuuguggacuaggaauuagcaugagcuuuguaacuacucguuauaguauucuggauuauguauacaggauggacagcucaacacugaaagggagccuaagacgcucaaagcaaaaaucaaauccguguauaccaacagcagguuugugaaauguuaccauuuuguaaugggauacaaccaccuuagacccauaugugguccuucugugaauugucuuucugguuaauaucaggaugugauaaguuagauuaauguaucggcuugugucuugucaggaaauauagguaggucuucagagccuaaagaucuaggaauuuccacacuguccuguuuaaugucacaguggaggaagaguccccagccagggccuggugcuccacagcaggugauaggugugggggaaggguaaccuuucccugugaaguuucuugccuggaggacaaaaagguuaagcaaugcaguguuauuaaaggggcgugugcaugcacauggucguggauccaggcacaaccacaagagagaaaaacagguaauucuugcuauuuuuugccuucuaucagacaaguucuccuugcccugugguacaggaauggcguugugacccccaaaugacugaguuuccuaucuaggacccuggacucuaaacuugagcgagucuuggcaguucacugccguagaacacugacucuccagcaacuuucugggguuuccuuccccaguaaaggcagugaccugugcugaugaggccuccaaaaauccuuauugaauccauggugaauuagaaaauacacuuccacuaugccaucuugugcaggcguuguuauacaauuagaaauucaguaucuaagaagauagacugauguaauauugucggggguggggugggugggaagguagguuacaagcuuguucuuccauuguaaacugucaccaauagucacuucuauucuuuuuuucuaagauuuauuauuuguguguaugucucucucucucucucucucucucucucucucucucuguaugguguguggugugugugugugugugugugugugugugugugugugugugugugcgcgcacuuggagguuagaauagagcauccaaccuggagcuguaguuacagcuguauguaugcacgguacccauagaggcaagaagagagcaucaacuccccugaaacuggaguuacaggaagucgugagcaaccaugugggugccuggaaucgaaccugggucuuuggaagagcaaccggcgcacuuaacaacuugagugagccaucucuuuauuccuguauuuuauucuugauaguagauggggguuuucaggugaccagaguaagcuguaaaaauucaauggccuggaaucuaaauuuuaguuaucacaacugucuuugcugcugagccagcuuggaccagagugaacuagagccacagcgaggaccagucucgcuccauccuuugggcauuccuguuuccgcgaggccucauucuuucugcagguggauuacagaugaugaugugcaaagcugagcaauggauaguggaagcuaguacauaaugggcuccuuguggcuuugaguaucuugagugcccccagcacacagccuagaagccacuccugacaggcacagauccauccgcucuuggaggcgugcgagcuugugcgagcagccaugcugccuugggugcuaauguacacccuccugcugguuucucagggccgagcaucauuuggaggcuugcagacuucccccuguugcagggcugacagcuugggagaugcucuucuggugcuuugccauaucuccagcaaaguuaaacgcuugucuuuauuuuauacacccgugcagcagcaggccgaccagagaugcuuuuuauuuuauauuuuauaggggagcuuuuuaaaggguaugaagcagggcauaaugguccaaaccugaaauuucaguaaguggggaacuaaacaaacaaauaaaaagguuacaaagaagaaaggaauacauuuauguaaaggguuagggaggaagcucuugguggagcacuugguuucacaagcacaggacccuggguuugauucccagcauggcaacagcaggaauguagaaacuagagauagccccagccucucuccagacagucauggaggaacuuagggugcugggacuuuuauacuguauccgaaaguaucaccuucacugugaauuagcuaaauggcaaauuugagaggguggggaggaccgggucagauuuucccgccugguccagggaauuucgaguuugaagucuuuaauuagggguucuuguugauugugcguuaaaacaaagcuggaggugucuggaaguaagaaaccuaugcagacaucagaacucaccuaacagcuucagcuggaaagagauguaaguucauuguguuaauuggaagggagaauguauagaaagugaaugaucccuuaaagcuaaaagccuggcugcuuucaucucagaguucugcuuuagugcugugucucuggaaaguccgugucugcaggguggacuuugccacgggaguccugccaucucugaggucagcaauaccuuugguucaguuggugacuucguucccauuuaccaaguuuuuucguuuaacuuugggcugugcugaaaauauaccuguaagauaagauguuccuguguguacugaaauuuucucuguguaccugugaaugugugcacgugugugugggggcuggaagucagccucugguguccuuccuugggagacuucaacccuguguuuauuagacaggguuucugcauugcccuggaggucacccguuguagugaccuggaggucacuagguuggcuggcuaucgagccccagagauucauguguccaccuccccaggccgggauugcaagggaauaucugcaugcucugaugugcgcucucucucucucucucucucucucucucucucucucuguguguguguguguguguguguguguguguguguguguguguguuguuguuguuguugaugauugauuuucggauuuguuuaguuuugagaugcagucucucaccguguggcccuggcucuucuggaagucacagaaaaccucugccccccgcgguaaacacccugcacuucuggcauauucaguguggguccuggaaucagacucugcaccuaauacuugcacaguaagcauuuugucaacugagcagaauccccagcuguugucauuuugacauagucgaaugcucugcaguaauuguuagaaggaagccuccgugggaagcuacacuuggacucuugcuggccagucuguuccgguugcagcuguccuaauggcuuuuacaggcugacaauguuacuacauguucauagguucuuccacgguuuaggagacgcaaggauuuuuggauuuuuuuuuuuuuuuuuuuuuuuugacaggguuuugccguguaucgcuggcugaucuagaacuccauuugcagaucaggcuggcuucguacucggaucugucugccucugucucuggacuucuggguauaaagaugugugccaucaugcccaguucaaagauuuuuuaaaucuguuuuuuaauuuuacuuuguguacaauaugagagauugagagaaagagagaaagagagagagagagagagagagagagagagagagagagagaaugcaaggucacuguauauuauggaaaucaaagcagaauuuggagaagucaguucccugugccacagcgguccagaggauuuaccucagaugucucuacccacugaaccaucuaccgccucagcagcccucugauuugcuuguuacccugucgucuuagaacagauggcaagguagcaguugcuugcgcauugaacaacacugaguuuuccaggcccaugaauaaugagucuaccaaauaaaucgucagucugcauccuugcccagaccaacuaccacucuaccacucaaacuacaugccggugacuguacuuuugagacuaaguugccagugcuggcauuggacccacucuagcccaagggguccuuggauuugcacuccucuggccucacucucucugguagcugggauuacagacuugcucugugggcccagcuugauuuccuuuccaagaacugauguauuuugcacuaaugguagcuuaggagagcuucaccagcagagaagguuauuguacauucuggaugccugccauucucaugcagaaaaauguacaauagccauaugguuugaguuuguauagcuaaaaauugaaagagguugagcaccccgucauuugugucucucuucucucugucucucucucccucucccucucccucccucccucccucccucccucuuucucucucccucccucucucucucucucccucucucucugucugucucucucccucccccucucucucccccucucucccucccucucucucucucccucccucucucccucccccucucccucccucucucucccucccuccuucccucccucucgcucucccugucucucauauugcauucucugaugugauuugcuuuucuuccaauucguuuuuugucucuuugaucugugaggucuuuauaaagaugagggagcuugccuuuaauucuaauauguccuccagaauuucuccccacuugaucauuuccuauaugccugcuaacagauguugaguguguuugugugauacccacguccacacguccacaugcucucugagaccuuggauccaccugucugccuccccgaugcuggcuuacagauguucacugcccuguccagcguuuaccuuggguaucagaccucagagcuccaugccugaacagcaagugcuuggccagccugaacccuagaaguuacuuuuuuuuuuguuuuguguuuuuguuuuuguuuugcuuucaagacagcauuucuccguagcccaggccuuccuggagacccacccgccucugcccagugcuaggauuacagaugugugcuaccauggccuggccagaggugacuuuuuauagagcacauuucuucuuaacuuuccagcuccugaauuauggaucacggagagccucuuuuacuguccccucacacauaaaagaguugauucuuguuucauacaggaccucugugguaucacccuuucuguuuaaauauaugauccauuugcugugugucccauacucugaagaagaugccccggcccauggccuaugccucuauuauaaaauuuuuuaaauggaaaguauacacugugcccaugugaaaccauaaacuauggguuacuguuggggagcuggggguggguuuagguccuuuuguagcuuaaggccgugccaggcucucuccuucaagaguaacaauguuaagccuugaacaugaaugaguaaacccagaguccgccugugcgcucagaccuaaggggaugaugaaauuuugccuuuuggaacaagucccaagauauacccgaagacagcgucccauuuuccuugaaguguuucaguuucauucuuuauuaccgggccugaggcugaauagaaacuucucuuguuaaugugaggaugcucaaagucauaucugcauuauuuggaaguugccaggaauggcugcuccuaucuuugaccaauuaucaaaguuuuuguggcaaaugccaagguccagggauaguacuagcucaguugguagagcgcuugccuaucaugugugaagcucuggcacucccuguacuucguacaucagaugagguagugaacacugguaaucucaguccuugagggaggagcccgaguucucagucauccucacuacguagcagguucaaggucagcuagggcuacgugaggcuacugucucaaaaaaccaaaaccgccaccaccaacaacaaaaaagcccugcucccagcgaggcucagucagucagagaugugugaugugaaaaucggagaauggagauuauucggcguggccgcacuggaaaggggaacagauaaggguuacauccacguauugcuccccuccccagaccccuuggaguccguccuugagguccugacuuuaggacuuggcuuaucagggggggcaaaagauguccugggccauccagccuuggucagagcggucccugcccaccagcucagcuucacucuugcggacagacggucugauaucugauuguugaucuguuccuugcugucauuccugugguggauucauaccaacugacugauucaggugcagcguugucuucuuuuggggaugagcuuuucuggaauugaaggugacugaagagaaaagguuaagaccugugacaaaucucugugcucucagcaaacguaaagacgggggcagaauggaagcagagaagccaggcuuuccugccgucuagagauuggacaucuuguuacuguguagacccaaguguggagucagccacccaugauccugcaugcagggccccaagagccugacucuuagagccuucccggggaaucugagcaugcucccgugugaguccugugacgugcuuagaagucguauucaauuuuguaauagcagaucacggucuuggcggugcugccaucugagugggugagauuggcccuucuuggcauguagcaguguaaggacuuaggacauggugauaucuguuauuugacucuggugugcuuaggagugggaaauuucuuaaggaauuuuccggagcucacagagucacuuuggacuucguugcauccaaaauccugccgccgacugggccagugcuucccaaugucauauaauuaaaaaccagaagaacggguuuccagaauaugcuaggaaguuuuguggcccuggaaacuuguuuaccccccaacaaaagcagcauuguucuuccucgucccucuccccucugccuucaaagauaaucugacaccagaauggaauacauauuuauuuaccugcgguggccuugggccagagaaagcagggcucgcccacacagcaguaacuuccaaaccucacugugcccaucugaaacucagggcagcuuuacaggacagaauccccuagaucccuuugcaaaaucuagcauuaccccacccacgucuguguaaacaaguccaugccucaagagugagaccugggaguggguuuuccucaaguucccccagacauuuucaucguguacgcaagucugagaacugagccuuuaaagccauggaguuucuuaucacagggaccacacaggagaaagaagcaugagccagugggaaaggcccuugcuaccaagguugaagaacugaguuugacccucaggaccaacauggcagaaggagggaauugacuccuagguuguccucuagccuccauguggacaccauagcauaugcaugcaagugcgcacacacacaauagacaaacaaauacagaaauguaguacaaaggaagagcuccuuaggguaaguauaguuagaacaagaaaugggucauuuauguagcaacucacauggauggcuuucccaucugagaagaacucgggcugcagugugucuguuucuuucuggauuucuccguaauggucuuacuuguugauuuugcuggcuacaagcacagguaauaaaaugccaguggccacccgugccagggaggucagggcuggacuuuccuauuuggcuccguuuugauggcauuagcagauuaauuugaaccccuucuggagccuuugaccucuugcaggguugugcugucuuugagagcaacaguccuuucuagaucauagcaacaguugagaauccuucuuaggaaauccguggcucuucugcgaaaauuucccgguagagucuuccaaagucuuccacaaggaggggaggaggcagauuaagaaaacaacuacucaucguaguucugaaggugucccagggcucgggugcuccaguggcauuaaugggaaggcuguguggucauaaaaagaauguaaucccagcacugucgagauggagcaggggaaccuagcaacucccuacacagccaagccagucuaaggaaugugcagccaccagguacagugaggcacaacccuuuaucaaacagugagguggaaaagcaguugacaagaaaacugauguccaccucuggcucccacuccgugugcacacacacacacuauguacucacaaaagacaccaagcuugugaaccucacuagugugaggcuucagacacugaaggcauuccuaggacaucuccucuucacuuucuacagcucagacccacuggauccacagcucagcuaaggucucuugccugcugcccaggcaggguuaaauaauaauaaguucuauuuugcugacuugcaaaaucagcugucugcuagugcagcagaagucaugucuuuuuuuaacauagauauucguguuuuuuuuuuuuuauuugccucugugaacggcugcgggcagugguuuaaagaaccugcucuaaauuguggugugagucaaguaauccuugcuuugacuccuuguuguguauggaaugucagccuccaugcacaagaguaaacaaugaaaagugugaauagaagcacuuuggaagggggagguuaguguuaguccacuaauaggaaaaacagaccauagucacuacaggaccaacccaugugucuaaaacuauugggcuuuggggaauugugugcuuuggauagauaaauaauaugaacagauccauaagcuuuggcuacuuuguagaaauccugagauucuugucuacccuauguguguugcuuuuuaauuagaugguuacuuugcauuaauaaugauaacguugaaaaaagccagcucugcugacaggaaucuccacgugugucucugggguucuggggaguucacuuggggucagucaucgaggaaagcaugcuucugagaccugugaauuaacuuggucacaggugagcuuucccagcuaugcagcgggggaggggaagucgugggaggaugugacgcacauagcccuccaaggugaguaguuucucccuguucucuugaguuaaucuagaaauaauguagucuagagagacccuguucccagccuugucauguucaaacagcauggaacucccuaaaccuuuuccacauugaucauaaagaauguguuuuaagcaauucccugguauacauguaauuuuucaaguaguaaagaugaaagcaaacuugcacacuaaugagauggauaugucugccugauacuguacaauucaaagauacacuaauuugguauuuacguggaugcucucauaauacuuagggaugauagcagggaaagaauaaaaguauuuguuuuccauaauuaaacuacugcguuucuguaggcacacaagcuuugugcauacaguaaaauuguuacauuuuuaugacacagauaaucuuaaaucugagccaacauguugcaggcaaggugcacuuguguuccauggugugacgacaugcacaguacagagugugugcuguauguucaaggcuggggccaggaagauggcuuagcugguaaaggugcccgaccuuaugcccaacggccugauuucauucuccagaauucacguggugggaagagaauggacucaaaccucugacguucacaaauacacacacaauaaauuaaaaaaaaaaaacaccaaggcuuuugagcacugucaaaaaugccucaguucacuucaucuuugaauuuuaauuuuguuuugcucaagagucccuuaauagugccagauuuucaucaucccccucauuaguuacgugaccccauagagggucaugaaggagcuacuaagauggguggguagccaaaggcacccgcucccaggcugacacuuggccugauccccuaggacacacaagcuagaaggagagaacugacugcugcaaagggguguguguguguguguguguguguguguguguguguguguguguguguguguauacauguacacaacaugcaaauuuaauauauaaguguaaaaauagcagcuuugaacuguuuucuuagcucucugcuuggucuccuuucccauaaauaccuaugaaaugguaucuaaugcuuagaauuauuacaagguacauaagcuagaaguaguuagaagguaaauggcuuggaaaauagaauuuucaaaggagacagacucucagauuggucacuuagcuguacuugccacuguggcuccuagaugccuuacuuuaugcucagugugagcuaacuccggguucacguaaauagcugguugcccugugaugauggagcuagagaguaaggcgaggacucuugauaacagugggcugcuguugauuuuaucuuaguaaaaguuauccguguugcccuuuucuuguacaaugcacuaacauuuguuccaagcucguuuuaaugaagaacacguuuauuucuccguguuuagugacuucagaaucaucaggcuuguauauuuccagagcugcagcucuccucuuuuccagcccacauuucuuaccaccuuucuuccuaguguuuucccaauccuuuuaugugcaucugaaaaaugaacaugauuucauauguauucauuaggagucccugccagaggccuuucuguuugauuuuuuuuuccccucugaaccucaaagguaaugacuccuuauagaguagaaaaaagcuaacccgggccuuguucugcacuuccauggguaagugagagaauuuccaaccacagccucucaaaacauuugcccacauuaguuguaauggggaguuaaagccuugcucgggcgggcggaguccucguaagccaacugccgagggagaguggcuggagcuguguugugcuggggggauccauccaugcucccccaaccgaggugccauaugagugacacugauacucuccagcuaggcuccucugcaggcuacuguacuucccucaguguggagaaucuucugguggggcucucuagaugcgccuggaucccuugucuuugauguuguuuacagaucuuaagagauaggcaaugggugucaaagugccaguuaacuuguuucccacagguucuguuccauucuuuacacaccgagauggcucagaaguggauuguauguggauaggaugauguucuguaauccuggugcuucccuggcgauaacugggaaaccugagucuacuauucugaaggacauuucaucauaagccccucuucugaggcuuugaaaaugguuuaacgacuucaaaagccauucagccugaggugguacaugccuuuaaucccagcacuuuggauacugagucagguggaucucugugaguuucaggccagccugguuuguauagcaaggugcaggccauauaggguauauaagaaagaccuugucucaaaaaauuuaaaagaaaaauuaaauuaaauuuuaaguggccugauccuguguuuccuuauugaguguguugggcaggguuggggagggagcguaugaaguugggucucugcaagauuuuccaguuacuuggucuuuaguaauauaguaagagggcacuucagagaaaugaacaucaaguggaagguaaucacuggguuuaucugguuuuuuuuuuuuaauuauuuuaaaauuuuuguuccauguguaugaaugguggguggaugugcgcaccuguuucuggugccugaggaugucagaagaggguauuggauccccuggaacuggagcuauagaugguugcgaauuaccguaagguugcugguaaaacugaaccuggguccucuaaaagagcaacaaguacaauaaaccuuccugaggagccguuucuucagccugcaggauguaucugaagagauuaauugaugaagaaauacagcaugggaaaguuuuucugucacugggugaaaagacugcuaugaauuuguuguuaccaacauacuacgugacucugucucuuguaaacaagguagauggcuccugcggacugacacucaaaguugaccucuggcuuacaucugcacgcauacacacacaucuggcuaucauguuagaauuuucuguauguuaucuauuauuucaccuauaauacauauuugcuauauuguaaaucguucuuuuuuaaaauguauuuauuuuuaauuauauguaagcuugugugccucuauguaaguacgaacacauaagugcauuugccagagaaagccagaggugucagaccaccagaaguaagaguuagaaacuuuugugagcugcuuggugugcaugcuggaaaucaaacuugggucuccuggaagaacaacaaaugcucuuaaccccucagccaucucucuaucccugaugauugucuuucaaggagauuuaaaaucaagggugagaagucauguguguacccaucuggccacacugcugauguucuuccugucuaugcagguuuccacuugacauccucuccucggagggcuuuaauauuucugcucuggguccacugcugaagaauccuuucugcagaggaucaaccaggcacuugcucaaacucuacacuaagcuguauccccagccuucuuuuagcuuuuaggucucagaaagucuuuucucucggaacuguggaggguauuuuugcuagguaugaaagucaagcuuucaauacuuuaaaagcuguuguucuuuuuucugggugcauuguuauaaacuguucuaucauuuuuuguucuuuuucucuuuagagaauuguauuuucucuuuaucaccaguuuuaagcaauguaguuguacugugucucuuuuuuuuuaauuuuauuuauuuauugucuguguaugugcaguacaacaugcacauagauguuagaagacaaauuaaaagacuugcuucucuccuuucguuacuguauaagugcuggggucaauucaguucaucaggcuuggcagcaagcaacuuuauacacugagcauccaugucuccagcccuuacucuguguuuugauaggguuuuagauagauagauagauagauagauagauagauagauagauagauagauagguagguagguagguagguagguagguagauagauagauagauagauagauagauagauagauagauagauagauagacagacagacugacugacucuguguuuugauaggguuuuagauagauagauagauacauagauagauacauagauagauacauagauagacucuguuuugauaggguuuuagauagauagauagauagauagauagauagauagauagauagauagauagauagauagauggagucucugauaucgcaggcugaccugauucuccuuuuucucgucccgugugcugggauucuaggaguacaccaccacucccaacuaggcuccuuuaguaauuuuuuuacuggaaacuaggcguuguuggguacaagacauuuuuguauuuuuguaaauacucuugaacuuccaagcuacagccacuaguuucaucugugagcucuugugucauucggugugagcagagcaauauuuuuuguugggcugcuuuuaccccugagugaggugacaaauacugaccugaguucucuacuuuguacccaugauuuaugaggcauuuuuaggcugccucauaggaacacacacaguuuuuggccccucaggaguuuccaucacgguacaugucguuuauuucucuaagacuugggcugauuuucauccucaaguucucuuguauguucuuugggcccagcucugcuccauugaauccacaggcaggacuuuccccgaaucuccagugggguuggucgcucucacucacuuuuuccuuccccccacuacugccccuuuccuucugguacucuguccagguucuggcugcuaugacaucccucacccauccuuuaacuccauccucucagcucaggaacguuaccagagccaccuggaccucuccuuccucuucugcaaucuggagauucccagccuccagaugcagaaggcuugcguuuauauggaaugaaaguagagugagcagagcuaccugucacuagucuaaguguuggaugucuguggcacagugcaaaaccagcagagccugccuuugccugccugccuugcugucgaaacaguuucacugucgguucugaucguccucaaacucagcuccuuugcugguccuuuacccucagcugcucccugaauuauaugucagcccccaaggaaaaaacuguuuauggguuuuucaacugccuauauaaacuguguccuuaucuaugaauggcugaagacauaaaaaggcauucuuucacuguuuccuaccuguggcauuauguccugcaauucagacuagauagcuuagcaucacuuuuuaguccucagcuaaaagacuaaauaagcauggcugagaucuccccauuacccaaaaagaugauuggaugagcaauaccgaguccauuaauaaaaacacaaaugacugcuggguggggugguacacacccuuaaauucagcacucaagaggcaaaggcagguagaucucuguggguuugaaaccagccuggucuacauaaugaguagcaagccagagcuacauaguaaggcccaaugucaaaaacaaaacaauaaaagcuucacacagggaaguggcccagugggcaaagcacuuguccuacgggugugggaaccugaguucaaauugcuagaacccuuguaaugucagucagacauggccauccacucuauaaucccaguauuuauaaagcaagaugggagaaagagacagacucuccaggggcucaccggccagcuagccuggugugugcaguaggaaauaagagaccuauucaaagugaaggguaaggacuaauacccaggguugucccaugaccuucauacaugauauucaugguaguauucguccuaaaugaacacauacauuguacacacacucaaagauuuuaaaagaacauauuaaguuacaaaaagaauuuauccccguaguccuagaacugggugugguccaaaauauggccccuugccucuuuuauaaauaaaguuuuaugagaacacagcccaguccauucuuugauagccucucuggcuaugccagagccuaacgaacgcacuccucccucugcccuuugcagaacaugcuugugaacuccuguuuuauuucacuguucuugaagcaagaaauaaaaaccacaaggccaaaaguuaaagacucaagaaaaagaagaauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugaguuaaauaccuaauaaaaaauggaaaaaaaaaaagaaaaagaagaauaaacuaaacuguacuggaguagaaaauuccagaacacuugcugugagaaaucuacacagcaggauucgccuaaaccaucaccacucgccaccagauagauuuuacauauuuuuuugccaaacuuaaaaauagaaauuugggugucggaagaauauguguugccuuguacggacaguauuuauacaguuaagguuagcaguuguuuuaaggaaacaacacaucacaaaucagaggagugcauuuaaaacccucucuuacauuacuuugugcaguucuccccuguguucagaaagagcuuaucauauuuggauuuugagcagaguaccgacgcuucuguguuaguguccagcauucccauccugaccacucugccagguggaugcuggacucacagacacgggguacugauagcagcaaaguaguuacaacuuguuauaaauauugcccaucugcccuuguuuuauguaguuuacauuaggcuuaguugguuuauucauugggucuuucucuuuaccuucugcuccaguugguauagauacaggauuagcccgguuuugccuugguuuuguugucuuuaguguuuacuuauuuauuagcaugugugagaggucagaagaugguguuagguccccuggaacuggagucauaggcaguugugaccugccauguugguacugggaacugaacccugcuucucuucguaaggacucuuaacuacagggacauugcuccugguuuuuguuuuuuuguggguuuuuuguuguuguuguuguuuuuguuuuuuguuuuuuguuaaagacaaauucuugcguucaaggcuggccuugaacucaagauccuccugccucagggcugggauuaugaccucuuucuuaggguuacuauuguuguggugaaacagcaugaccaaaagcaaguuggacaggaaagaguuuauuuugcuuaagaaguuuccaagucucuguucaucaaaggaagcgagggcaggaaucuggaggugggaacuuaugcagaggccauggaaggaggcugcucauuggauuguaucucauggcuugcucauccuucuuauagaacccaggaccaccagccuagggaugaccacacccaccauggaccagcacaguccucuccccucccacacacccaccuaaaccaguaauuaggagaaugcccuacagacuugccuaccagcagaucuuauagagauauuuucccaagugagguuuuucucggauuacuuuagcuuguguugaguuaacauaaaaacuagccaggacuuuaaaguaaaguaaagaccaaaauccuggacuggggaaaagacuugaagaagauacugagcuugcaagaggaauugugugagcucaucuucuaacaagccugccuggaguacuuacugaugacucugaauuguuuguauugagguaauuuugagccuuucugaggccccaguugaccuuggacucuccuugggcacagggcuugccuugaacuuggggccaguccccugccucugccuccucuuccccuguguugggguuaugggcuugugccaccaugcccaacgagacuuaaauacagaggaucacugcugcuuugggaagacugaccuucauacagucugggcuauauauggaggucugacuccccaaauauguaaguaauaagagacagcuuugaugggaaagacaauucaacagauuucugcaaugccaggaguggauaccauugagaaccaaguagaacugaggaaggaacugaauacagagucccggaaaggcucacaaguaucaguaauaacaccaagagucaguggggcuccagggaagacgguaggcucguaacacuucauuuuauuuuauuuuauuuuauuuuagguuuuaauguuaccagagcagauaauuuauucacaaaacaaaagcaagauagaaauaaguucaugaaaucuaauagugggguugggaaaaugguuuaaugguuaaacgugcuugcugaucuuguagagaacugggugugguucccagcacccauauaggguagcucacaauuccuugaagccacugcacuuuggggggaucucaccuuuucucggguuuguugacagugcacacacacacugaaguauccuaaauggagcuagggagauggcucaguguuuaaggacacaugccacccacccugaugaccggaauuugaugccaggaaccccacaugguggaaggagaaaacuggcgccugcgggcgccaguuuucuucugaugccacaugugcgucuaugcauauccacaagcacacuuuuuuuuuuaaaaaagcaaaaauaaaaaccaaaaguguggagcuagaaagaugggucagcaguuaaaggcauuuguugcucuugcagaggaccuggguucccagaaccaacguaacagcucauagccauuuguaacuacaguucuaggggauucaguucgucuucuccccuccaaggaccagcguguggcgcgugcacaugcagacaaaacaccuguauaccuaaaaauacgccuuuuugucucuaagguuuagaauuauuaaauaauagcaaacccuaaaagaaugagacucggauuagcugucggucucuuaacacugauaguggauguggaaacaacagugauauuuauuaucaguaagugguuaguuuguauaccaggguaaaauacaugguuuuaucgcuauaagaaacacaguuuaauauuccauacacuguucggauguguuccaggaaaacaguagauuaauaaucuacaagggugcugacucgguuguaagcagaacuaguucugguuuauugaaccagaagaggaacuuauugaaaggauauuggauaacucacagggugauugggaagauaaaaccagucuuagggaagaagugggggccaggaaaccugaacaacuacaacccuagcuagcgaagucgagaaaccccauaaggggcucagcaauuugaguuccucugaggcugccuccugggucucuauaacgaucgauccgaucgucaugcugcuguggucaggcuccugcucuugguggcaccaccaggauuaugaccagcaucugguauuuccuaggguucaaguccaagcugggucugugccucgccaccaccuagaucaagggcuuaaaguuugccaacuuguagcacuuuuuugaccaagaaauguuuauaugaccccagguaagugaguauauauaauagguauacaaacuaaccacuuacugauaauaaauuauuuaagaauuauauuucaagccauuuuguguaaccugcaguuuuaccacuuauuaaggacaaaggcaaaugugcauacuaauaaaacagaugugcugcuuauuuuaaagugaacaaugaaaucuugaccugggagaauuccaccucagcgguagagcacaggccuggccugcucagguucuggguucagucccccgauauucagauuucagggcuaagaagcuuaaggaguuaaaucuugcagaucaccacagaaacuaaggcauauucaaccuuuuucacagcagacugauauuuguacuuuaugaucuucaauacugagagcaccagucacauuaauguauaaguaaccggcagaaaaugaauggggcuauuucagaaaugguuggaaauucugucuuguucucagguuuuuaaugaaauugaagucaacucaagccauaguuuuuuuguuuuuugaauucuaagucugcacuccagcaauacacuaaugugauuuuuccuaugcugaggaacaauggcaggaaaauacuaaaaagucuuuguuuuccauaauuaagccacaguguuucugucagcagaaagcuuuguguguauggugaaaacacaguaguuugugaccuacauaaucucagaucugugcuguuuccugggguguguucauugguguuuuucuggagcgacagcaugggaaaugcaagcagugucuucuauguucagaaccaaggcuguggggaaggugucugauacaauaugggugaguacuggcagauuccaugaaauucaucauuucaguguuuaauuuugggcuaacuuuugaugguugcacauucaaaaaccuuugacuacuaccaauguguguguguguguguguguguguguguguguguguguguguguguccuaaaugugauuaugcuagcuuccaugugggguaaagacccucaucuuaagaagcuagauguuaaguacaggcuggccuagguucuaaagaaacuagaauugagaaguggauccguuaacauagggucccagguuccaguaccaagcagauacauaauucuuccaaggcuucaucacugugacagugaaggaagauggcagaacaauagccauguuggggacugggaagcagcccaagggcuaggcagcagauugggagauguagacagaaugaagaguggggauucaguagacuaucuaagguggaggguauaguaaaggcaagaaggaacuggacacacagcaagaacgcacagacguuacgggagcuuuuccuggcaaguuggaaacauccauucaccucagauaaggcaacaacgggucaaagaaaugguuccacccauguccaaccugugagccacugaguuagcuuuuaacuucaagagcaugggcaauuuaucagguacaggcuaaagcaccagggggucuacaacugcaguaguuaugugaaaggaaauacaaacucugcuguacuugacuucaacaugaacaaaauuucaagaaccguggugugcauaaauggccuauuuauccaggagcauauaguguguuuguagggggaaagggaggagaggugaguauugcaccacuggaagacagcacagaauaacaaaacgggcuaaaucaagaauuggcugcauaagcauguuacauagggacaccagcagcaauggugacauugguucuccugggaaggcagccacuguaauugcucugaaacauagaccuuggggcuucuauuuaugucuaaacaacaacguagcagggcuggagagagaguugagcaaauuuguuacucuugcagggaagaccugggucuagcacccauguggagccucacagcuuucuguaacuucuaguuucaggggaucccaaccccccucuucugacuugugugggcacacugcgugcacacagugcucagacauacaugcaagcaaaacacccauaacaugguuaaaauaaaaaacaaacaaacaaaaaaaaaaacaaugugcaggcagggcagguaaugagauggccaauggguacgaaugcauaaugcucuuaaggaggaccugaguuuguuccuuggcucccauguuaggugguuuacaaccaccuauaacuccagcuucagggacaugugacaccuggccugugaggacaccugcacucagauguauauauucccacagaaacaaacacauacgcaacagcaucauuuuucaaauguuuuaaaaagaaaaaugcaacaagaaggaaggcagauguuaguuccugacuaaguggcuucugaacauugugugucagcuuggcagccacuuuuccuuuaggaacucuccuaagaggagaauuggcucccagguuaguccauacauaaaaguuaaagugaaguuucagagucaaaaagaagaaaaaugucugagcuuggguaguaauuguaauucaguaaaaaugguugaccuggggcucuugggucacuguucagggcgccucuuaccccccugccugaagggcuuugguuucucucaguuccucacucacaggcucacacaggaugccgcucugagcugagcucucagcucucacuauaggauuucuggugcauuccuuuugguuugugugcauccuguucaguagcagggaccauugugcccccuccaagauuuggccauuuaugcuggacacgucugggaagagacaaguauuugagaaacaugcuguuugauuugacacagugucucuuuaagcagcccugguggccccacaacucacuccauagaugaggcuaauccccggcucacagagcucuccugccccugccugagugcugggauuaaaagauguucgucaccaugcuucagcugcucuuucugauacacagaugccaaagaaauaccuguuggggucauacuguggaauugcuaguuugaaugucauuaaguuuaauauguggauguggccauuuuaaaaauacaauaaaauguuacaaaaauaagcaugacgucauugccucauuuccuuucauuguaguucacagaaauagccaccaugaacauuugauaaauggaucuuuccuuuaauuauagguucuuuguaugugguccaggcuaacuucauacacacugucuuccagcuuccucuaccuaacuuagcuugccauggucuuuccaagccuuucuccccugugagaaacuuuuguucaaauacauaguuguaugcuccccucugccgcauggaaucauauaucucuuucuauaacucaucuccacaguacuuuuucuguguaguauguggugcuuaaacuccagccagugcacagacagacaguuaugcacgcauacacguuaucucuuagagguugacaacacuaaagcuuugugguaaggaauuggagaaucgauuccuugucuuauuugguauaaauaaacaaauaaaucaauguaaggugggcuugucuuucgccuugcucuggggauccuaagccaaagacuagaccugggcugggcauguuguugcuacacaccuuuaaucccagcucucagaggcagaggcaugaagaucucuacaaauucaaggccaacccugaauuuacagauuacuuagugagguccaggcuauauagugagauccuaucuaaaaaaaauaaauaaauaaaacuucugggccgugauugccauguaaaaucgugcuguggcagcccacacgucgcuauggaagcaggacgcuugucucaagcaucagaaaagucaagguuagccgggcaugguggcacacaccuuuaaucccagcacucgggaggcagaggcaggcagauuucugaguucgaggccagccuggucuacaaagugaguuccaggacagccagggcuauacagagaaaaccuaucucaaaaaaaaccaaacaaacaaaaaaagucaagguugcauagaaucuguacagaucauauuugcuaauuugcucaacacagaaagagcguguuaauaccuauuccacagagucaucacuaacauuuauggagaaauuauuauauaauaguguugaaugcuuaaguaaaauguaguuuguuaauuacuauguuacacaguuaugaggaagucacuacaugcacgcaguaccagguaucacacuccaggacauguugauaaagagugcugguguugcugugauuuguaaaaagacaaagguuagaaguauugcauuaugguggugcgucucuguauauuauauauacuuagauuuacuuagguagaacaucugaagaguuguuguccagguaacuucccagugcuuacguuugagaaaggggccuggggaccgggagcaggagaaacucuugcuuuucccauuuaucuguuuguagugaguaaagugugguuugcauuuauuauggcaggaagagguucggcuuuucugaauggauaagauaguauucaaguuuauuaugaaggcaaugucaagggccuagagggguaacccaguggguaagaacucuuaguauucuugcagaggagugggguuccuagcacccacaucauguggcuuacagucgacugucacuccagguccaggggcuucacuacgcucuucaagcauccaagggcagcuacacacauuugugugcaugcaaauagaugagcgacuaaguaaggcaccggagaaguggcucugcggccgagugcuucuucccccagcagaggacuggaguucaguugccagcacccagauccgguggcucaaaacugcccgugacuccagcuccaguagauucguaucuuucuggccucuguggguaccuacacacauaauucuucaaauguuuuuauauggcaauaucccccaaacuccucaugaaggggagcuaagcccugacgaggcguaccaguucugggcuguggagaauguuuuaaacuucaguccucucacguugaauaagcggugauagcagcugccacguggagaggucauuagacgccauaguauaaugaaaugcaaaguaguuaacgcugcuguaucauaaggcugugucaggaccuuugcuuggccuuucagucuuuccauuugccuaaaguuacagggccugguccccaagccugcugcuucccaugacagucccaagccccaggucucucaccugugcuuucgacugaccuacugugaaucagcggccggccgugggcacuuuacuuauccuuacuggcugaauaugaaggccacuccagaagaaggggcuggauagugagguacagaaaaggguguggaccuuagugcaccucucaugauuaccagucuccaggauuacuuacucagaaccuuaugaacccaguguuuugaguuuuuaacggaagcuucaugauauaggcaugauugauuuaauuauuggccauugacaaccaaccuacucaaccauuaucccucuuucccugucugaagauuggaguuggggcuaaaaucccuaucauggggauucauaucuugaaugcuguugcccagcuggugggguuauuugcuguagggcuacagaaccuuuagaaggugggaccuaggucaguaagggcagacuucugaaggggacagccaucccuaguccuggccacugugcuaugaugcuggcauccuccguauguccgauggcuuacacuccacugugccuuuuccucugugaugggcugaaauuccuaaaaccuugagcucaaauaaacauuuccucccucuauauuucugucaguauucugucacaguagcccaaaaguaauaagccucaacccucuaguaacugccaacauaccaaacucuggucacuagaaaauucuuaaguuuggggaguuguguguaaggacaccgaaugaagaugcaaaacauguuucauauaacaguuucaaccaagaugcucacacugugggcaaaacaaaaccauggcagacggaagagacccaucagcauuucuuggaggcggagaucaccuacacuauuuaaucuagcuuuuuguuuuacuaaguauauaggauucaauuugccauguucagcauugacacaacaaugcccuaucacagaucaaaguuuacgauuugcccacagaguccagacacuauacgcauguucauaucagggacuuaacaggaagcauggcguucauucaagucuaaucagcccucccauucaugaaauagaagaaaggggauacaauaaaccagcagaaagaccuacuuaagaaaguggaacgccauauagugaucacuuuccauagccccuugugucuuccccaggcauggcagauguggacugacuugcuagggaugggaugauugauggagcugcuaauggccuccccaguuggaaacucuagaaaagacaucuugggcugccuuucuuucagagcuuguuuguuuguggugagagccucuaagccucaugauuaauacccuuaagagacugagacaucgcaggccugugcucucucaucuagcauuuguuguacugucugguauuuagaauugaugcuuaguaaccagagucacacauggagacuagcucugguccuugaaguuugagcucagucucuuagcaauaaaccucuggggacuuuguccuuccuuaggccuuucccgaaacacaaauuaaaauggccuagggugauaagguaaaagucacauggaccacagcugcuggccagaggauagaccuuaaggagagcaaagauuugaggccuccgagcucuuccuggauccuggacuguuuugccuuggguagaggagacgguagccugaacucuuuggguugcacuucauggacauaacggggccaaaaugugaugacuuacuaucaaguggucuagccucaaaguaagguuuuccaucuguagcagcuuuccaauugccacaagaagucacacacaaaccuuaccauucuaguuucuaccaggaccugacagcucccgguuggacccuggcccaucuugacuuuacugcugcuugcagcagacuuccaggguuucaacccccaaccuuuuuccuaaagauauuuguauuggcuaaagcaacaaaaagguguggagaagaccaaguauugcuccugaugccugaaccaagucagacucuuuuucucuccaguccuguuuucaagccuaugacuuuugccuguagucccagggaaauccuuagaguugagucaccccuuucucccccagcuuuggccuuauaccgugcaaccuggucacuguggggguggaccgggaggcagcacagcuauuuagcuauaccuagguguguguucacauacacucaagcucucacgggaaaaggcugguucuccagagagagggaacagugcccagauaucucaaaacuacacaacauacuuggauuggacaagagagcagggagcaggaaaugauuuggagaaugcaaauugcugaauugucuuuccugcgcuauuugaugagcccuuugcuuagcccagucgaauagaaaaacuaauguuuaaaacacaugcacacugcauguaauacucaaucuuuuauaaagccaaaguaucauuuuaacauaauacgaacauuuaaugagcuguugguccgguggagauggguugguagguaaaaaagcuugucauuaucuacgauauccugaguguaguagaaucucaacacuggggagcuggagacgaauggauucauggaacucacucacuggccagcuagacuagccuacuguacaaauuugggaccaauaagagucuuuaucuuaaaaaucaagauagauaguacccaaggagcaacaccugaaauuauccuguggcuuccacacacagaaaauucauaggcuguuguuuuguuuuguuuuaaacccaguguguauuugagacuuguagaguauaauguguagguuggggaaaacugauggccaacugcuacugcuauggacuggguuagccaaaaccuuuucauuagcaagccagacagccaccaucuucugauaaguuaccuguaucccauaucauaggcaguuaaucugaaguugcaaaucucacuagaagaagcuuccuaaagggagcuugguacccauuguccugcuaggugucuaguuguggaaacaccuugcgcuaaacacccauaauacucagacauuaaauacuugccaagcacuuagucuucuggcuuggauuauacaucggggaaggaagagacuccuauccuuucugcuuaccuugguuccuaacugcaguucccaguauguagaaucuguuaaagggguuuucaguggagugaaaaauaaguuuaaaacuuucaugaagguuucucacuuuccaaauauuagugcuguugguuguagcucgugaugguguauuugcaauguuuauuuuuucugaugaagggccguguguagccugucacucguuguguuccucugaaucacucaucugaugaauguauauagaaagagugauggaauaccuacagaucccggcucucugccaagcuccaggaugcaaagauaaaugggaacugucugucuuaaaggaaaugagaggcagagaaguaaccauuaaguguuaggauauaagcaaauacagucaguaucugggaaacacaaggagguguaaguauccaaccaggucagaugggggaguccccacuaacgugaacuuacguuccauagugcaugagauguucuuagcaaccagcccugugccgagcacauacauugaaacgguggauaaaugaugaagccagagccgaagaaucacuuuguucaacccuccaaguguagggacggaaucgcugcaggggcagggaauuagugcguuggguuggccuucugaguaagacugugggacaugacaagccacggagugggauagagcaggagaagagaagcacagacggggccacugacagcugucucuccuucugacuacaggcaaagcgaaggcuggaacugggcgagaguggccaucaguaccucucagauggucuaaagacccccaagggcaaaggaagagcugcacuacggagucccgauaguccaaaaaguaaggaugcuuucaucuguuucccuguucuccuuggugugggacucccaacucgcaaagcuuguggcuggaagggugccaaggugugaauaauuuuuggcauguuuucuucuuuacuucuuucugugacuauccaaaaauuaaaaauuaaaaaaaaaugcaauuucuucuggcgccuagcaaaaggcaauagucacuccaguacuugaaugcauuugcauuuugaacuagucagauuuaauuuucccuucccuuaguggacgucacuugagugcaagggcggaggcguguguggcagcgugaugccucuccuaccucacuccccagcucaccacaccguagccuagaaacugggcagagccuagcaugaggaggccugggcucaggccccagcaccacauaaacugacuguggucgcgcacauccauagucccagcauuugggaauuggauggggaaaggucagccucagcuagguggugagcucaaggccagccugggauacaugauaccuuaucucaggaaggagccaaaagagaaagugguaguugcgcuaagucccagcuaauuccuugccucggugaguacugucgucaugucauuugagaaggaaacgaauacgucauaaaaagccaaauaucucuucuguuucugcgcuuagugcaaaagcuaacuuagacuuggcucgucuguccccaugguuucuguuaugcaucuguagucuauguguaagggcuaaaucagaaccucagcgugagcgccugcagaagaauagcacaauacuaaauacugacauugccuuuaaaggacguggggaacuugaacguugggggcuauucuucaucaaaauaagacuuuuucugaaagauggauugacaagggauaacucugcagcccccacuccaaagggcuggugaggucgagucuguuugagacccugucuugaacaaagaugaccuggcucugugaguuuaugcuucuuaaaugagauucccagaggccucagcacuuuuucauccauucaacagauacuuugggacaccuagacccagagaauaggcuaagaggacauagaaacuacugacaacgaguccaagaaaaugccauugccaacauaggaaaucuuuaucaucucuuccuuuucugauaaaagccaccucauagcucucuguaacuuacccccaaacaacgaccagcuuugcuuuagauacuaaucuggcugccgugggaaagagggcuugcuuagcugcgaagaaacccuucauuucuuuaccuuucccccuaucccccacccguucgguuuuuuguuuuucuuuaagcuccaaaaucucccucagaaaaaacgcgguaugauacgucccucggucugcucaccaagaaguucauucagcuccugagccagucuccugaugggguccuggaucugaacaaggcagcagaggugcucaaggugcagaagaggaggauuuacgacaucaccaacgugcuggaaggcauccaccucauuaagaagaagucuaagaacaacguccaguggaugugaguaggagcccacucucuccccgggcaccagccagcuccucggggccuuuaugacugccucaguuuauccgaauuuuagcuuccacguucagacccauacuucuccccuccccucuuccucuuucucccaguuuucucuuucccccucaaaguuguauguagaaagucacggcugaggauugaguuuagugaguggacugcuuaccuugaagucaugaagcccaggggucaguccccagccccacauauaccaagugugguauugaucagccccgaucagaaguucaaagucaucuuccaguacauagagagauugaggccagcccaggauacaugcaaccguauaucaaaaaaguaaaaauaaaaagucuuuuagcacagggucugcauuugauuagcauaaaucaagaagaucguggaacucaguagccccucugcaguuauaaauugagaaggaagcuuugaaucaucacacuugacaucugugcaugcgugugaccugcagaugcacacgugugucucugauacuguaucuuggucaucugugggcgaauauggacaaacucaguuguguaguggauucaucccuaaauuaacacaguuucucugucaaugaaggcaagacuucaaugucuggguuuuuucugcagagaugugugcacuaaugugucuaauucugcaugauaauaucauuugugaaucauggacagagccaggcauuuuauaaguacagcacugaacuauuaaaucauguuaaaagagccaaaacuaguuaggagauguuuugaaaacaauauaauuuacgggcuggcaagguggcucaggcaguggaaggguggccucaaaauccugacaacccagaaucaaucccugaagcauacauuaagguggaaggagagggccaguuguccuuuggccucugcacucccaacauggcacgguauguccacacucagaauaagugggggaaaaaugucuaaauacaguucaagggcuaaggauguaaccuaguggcagaaaacacuugcccgguaugcacuaaagacagcccugaugcguucaguccccauuguuauuaaagaguggauuucuauuuauaauuaagcugguagcuguguguguuuggaguuguggacagcugggggacucacuuugaccugugccuuagagaaaccuguuaacuacugcucuuucuuacagaugccuagcacaccuguccguuugccccggggggugcaugcauuaggugauggggguggaggagaccagguggcugcuuuuuuuuuucccccucagaauuugagacucugaacaauuagaccuuuuaaaaaaaaagaaaaaggaaaagaaagacccugaaaauaacuuuucacucgacuucugugauaugugaaagguacaugacuguauuuaugaaaacuguauuuacaaagcuguacucuugacacucgacucacaaacaacacgaugugggugagggggguuauugacugauuucccccacucccuaccucccccuccuacucuuuagcuccuguaaagcgccauaaucuguguuuggguucuaggggcugcagucugucugaggaugggggcaugcuggcccagugucaaggccuguccaaagaagugacugagcucagucaggaagagaagaaauuagaugagcugauccaaagcuguacccuggaccucaaacuguuaaccgaggauucagagaaucaaagauauccuuugugcugcugguggugguuagagccuucuguacuguuugcagagcugacagacuaacuuguucaugauguagauagauauuacucuggcaugguacacacuaucagugugugugugugugugugugugugugugugugugugugugugugugugugugugugagauaaaguacuuuuagacuaugugguaucauuaucaguguugauagccaggugagaacaguuuuucaaagcaugguauguaugguuggaaaaucugaauacacucacaucauaagaacacacuauuaaaagaugucauaaggugucuggaucaguauugaugacagcauccagcagguuugaccuuggcuucccagaguuuuaauguggguuagcugucauuguuggaguucucgaccuuuaucuucuuucuuucuucuuuucuuuucuuuucuuuucuuuucuuuucuuuucuuucuuuccuucuuucuuucuuucuuucuuucuuucuuucuuucuuucuuucuuuuguagcauuuggaguuugcugugucuggguggacugggacugccugcaauccugucaauagggaaacugaguccugagugcacagccaaucuggcuacaaccgcagggcccuaucucaagaaaagaaaaaaagaaaaaaaaaaaaacaaaggagaaaugauacuuuucaaagucagguguguuguugcacauuugugacagcaauauuugaaagauaaagacagaauuaucagggguucaaagacagccugggcacuauaaaguuuaaaguucaucuagggugcaugagcacuugucaagcaaagcguaaaagucaagaguucagguugugugugucugccuagggaguuugaggccagaguagaaaucuuguuuuuaaagaaagaaaaagcaagauguggagguaugugccuuuaaugccaguauuugggaugcagguagaguuccagaccagcccuucuacauaaugaguuccagacuagcuacaacuucauagugaguauguccuguccaccuuaucucaaaaaauuaaaauguuaagaguaaaagagccuggugugguggugcagagacagacagaucuuuguaaauuugaggccaaccugaucuccauagcaaguuccaggccagccagggcuacaccaugagaucugucucugaauacauagaugaaucauagguggcucaguagguaaaggugcuugccuccaagccauaccugagucugguuccugaauccaggugauaguaggagagaagugacuccugcaaggcucccugaccucagaacucauacugcacgugcacugugcacacuguggcgcccauucacacacuggacagauagauagauagauagauagauagauagauagauagauagauagauagauagauagauaacuagcuuuuuuuuuuaagaaagaaaucaacaguggggcuuuuuuaguucaucguuggauuggagcucuguuuuggaaaggcugugugguuacacaugauuggcagcuguccugagcauggggcuuggggugcucucgacuuuuucugguaccuuuguuauaaaacaaaaacaaacaaacaaaaacaguuuucuugaaaccacuaaccaagaaacagaugucagagggagcacuuuuaaguuuguaacuuagaaaauguauuuaugaaauucaucucgauccuccguucagcucccagucugcugcagcuuguucacagcuguguugauucugcucccugcagcuuguugaguaauuguaggugaguucuagucuacuaagcucgugucacauagcuuuuugacagugggcucaagcucagaaaccugauggucagcuuauaaaaacaaacaagcagaacgcagaaccauccagaguuccggaaaugcucccauuggccuccuuggugggcuaagugguggcugaaagcccagaauccugagauuugaagaagagaguccaguacaggcaaacaccgaagugugccacggauuuauccauuuguucauauuuucaaagcugaccagucagaagguggcaggccgaucucugcauuugaagccagccuggucaacauagcaaguuccaggccagccaaagcuacauagagagaccccauguuucaaaaaacaaaccaaaaauaaauaacuauaagaguucugaccuccacagucaucaggcacgcacauggugcauauaccuaaaugcagucaaaguacucaaacacuugggaaaaaaaaguuuuguuuuguuuuaagcuuacuaaagggcugguaagaugacucucaguggguaaaagugcuucuugcugcacaagcuuggcuggcguccugaguuugaucuauggaacccauggugggaggagagaagcugucaguuuacugccacacuugcuuugaugaaugugcucgugugcauacacacacaaagacaggaaguaauuuuuaaaaagguggcuagaaacacauguuaugucaccuguguuccuccaugucaauuagcaagagaacaccuugagccuguugucucuagcugaguuuuugugagugcguuugucagccaguuaaguagcaugcucuuucgugacauccuuuuaggcuuagcuuccaggacaccgacaggaauuguuugguacuugaaaguaacuacggagagucgugaaauguuaauuuauucuuuuuagcuaagucauuguaucuuaaauucauucaguugcggagcaccugggagcugcucaccuccuugggaacccugaaauguucuagugauaauaauaacaaggauaauuuuucuaacggaaauaacgauacucugaucucuaggcgcuaugcagucacaccagcccaggugcacccgcguaaacaggcugucugcccgagcaagcaguaggcuccauucuuccccugguguauuugcuccuuauucauucauuugguggcugcuggcacuugcuaauagcaagcagaaguagcugccgucucagauuuugauuagcagaucuuaccucccccaccccacugcaaauuaggaccaugugucaaucaguuugauugacagggcacuucgauggaguucacggacuaccaguacucaagauuggcacgauaaaguauagguuucuuuuagucuuaagcaucaaccagaaaggacaagggccaugaagaauccguuuaccuggugauccaaaagggaaggcauaccuauucuaacucgugaaaccauggguaacugucuaugucuguuacguugugcucaugauagcuacgucuguggcaacuugauagaagauuuccuuaacgcuucuuacguuagcuuauguuacauaucaagauauucgaaaaauuaguggccuuaaagaccaaacuguuauaguugugaaagccccuccagaaacgagacuugaagugccugacucaauagagguaaggagacagugacgccggccauccauagagaacgcuccagaacgccugaacgcaagcgucacugaccccucccaagaacuugcuaauuccucuucauuuauuuccauaaccuaaaguuuaaaaggguucaaaauuucccuguuuauugaaugcccaaaacgucugguuucaauuuagagggguguucgggucacagcaggcuuuggugcccuguuuucucuucaacuuuccuuuuucacaauuuguuaucugguggcugugaucaguuugaaccacuugagaauuuuuauuuugauugccuuguguacggguguccccacuauggauuuuagaaguagcucucugaccuagcacauuuuuaggaauucuuuaaaaacauuuguagcauguuuacuuugagaaaauuaaacgggaccuugggguaaucaauagccaagaacguuguaagaaaguaggacgggcguccuuguaauugcuuucagguguacuuugaugaaaucagccucggcugcaauuauaagauaaaggagcuauagugaaaagaaaauaccuagaauauuaaaagauaauaccuaaaauauugaaaacauuaaauuuacaagguaaacuucauaccuuauacaguuacaacguuaugaccuagaugaagagggccucuaaauauucguuugcugagcaagcugaagagauggcucagugguuauagcacugacuccuauuccagaagacccgaguuccauucccagcauucauguauagcucauaaggaccuauaacuccagcuccagaagaugcagugcccucugggccucuggccaacagccacacacaggaaucuauauucacacagacguagaagcaugccuuuaaauaaugcacuggagagguggcuuagugguuaagaacacuuguugcucugcgagaggacccugguucaauucccagcagccacguggcaacgucgguaacagcuugucggguacccaggcgugcacauggguguaaagauguacgugcagggaaaacacacaaacacauaaaauaagaauaguuuuuuuaaaauaauaguaacaaaauuaagucuuggacuggagagaugcuuagugauuaagagcauuggcugccccuccagaggaccugggugauucccagcacccacacagcagcucacagccaucuauaauuccauucucagagggaccaccaaaaggcauacuugcugaugcauaaggaugcguucaggcaaagcacaaguacacaugaaacuaaaugaauaauucuuuuuuuuaaauccacuuauaauccaauuauuuaaaaaugaaaaaaaauauuuuuuuaaaaaugugcugggcaguggugacacacgccuuugauccuagcacuugggagggagggacaggugaaucucugaguucaaauccaaccuugucuacaaagugaguucgaggaaagccaauaugcuuuauuuauucucuuacucacuaaagcuccuggcacuuuaaaauacuagguauaaguugguuauuagaguuuauaaauuggguauuagaaaaucuuacuaugagaaguuaauagaaaaaaguuguuuggaacauuuaacagaccuuuaaauaauuuguaggaaaauaauacagcuaaagaagacguggacacccaccccucaaauuauuucucuagcaagagucaacaaacuucuuaaagauccagguuguaguugucuuugguuuugcaagcaacauaauuucuguuuagauuauucaaguaauaaacucuacuacauguuacuauguaagaugaaaacagccagagggcaauaugaaaauaggcagcaugagaauggccacagacucucugucccaauaaaacuuuauuuacaaagcuggaugcuggcuuggauuuggccuucagacuauaguuguuugcuggccccugcucugggagaaggucaguacugacagacaaaggguaggggagcaaaaugaacaaugaucaucgccccuccacuucaguuucaggugagaugugcuuugguuuucauuucuaagugaacuugaucucuuucuugguucuagagccuacaaauccauuuggcaaguacccaagggcccauugagguuuacuuguguccagaagagacggaaacacacagacccaugaaaacaaauaaccaagaccacaaugggaauauccccaagcccacuuccaaagguaaacagauuucacucugagacacgguguuuaaaaaggaaggcauggagaaggguuuuccuucaggaccucauggcugugucuuaaccaaaugcuuggguccacuagaccgaugccauuauugcuaagagucacguguaacccaugaaacuuuccagaguaaccaaagugcugggcagagccugcaagugggccuggaauuuaugggugacacuagcugcuccaucauccaccauguuaaaggccuggugugagggugacaugcuuguccuguaggagucaggaaggugacuccaaguccauucugaacuugccgcuggguccuggguaugcaucaguugaccaugaccugcaccuuuuaaagccuuugucuuguauggaggggacggggagagacguuucauguuguuggaagaguuuucugaggcauucugaucaauuuuagacuaaaauaaugaucuugguccaaacggucccucacccccgaugaagaugcugcaggcucuugaaagcagaaaacuguuuccuuggcguacuggacgauggcuguagacagucuugggucucagccaugcuucagcagacaucuuggaugaugcuccugcagucauuagggauggaauugagaagucaagccuuggucagagucuugaccucaucuuccucuccagagcaguaaggagaggaucuaugcgaucagaaagcagcagggacauagcccacuucuccuuuccuccagcugaagaaaagcucuugggaacuucagcuuggauuuaaagacacagaaaaccuuucuuuaaaaaaaaaauaaaaaaagguucaacugugacuagacuagaacaaaacaaagugaugucauucuuugugccuguuagccuaauggugaucuguguccucccguagccccagugagcugaggggcagcagaauauacuuucuucccgaaaacaaguaggguguuuguuuguuuguuuauuuguuuguuuguuuucuccuaacuuugacucuccuccccacccccuuacagacuuggcuucuaacaacucaggacauagugacugcucgguuucuacagcaaaccucucuccucuggccuccccagccaaccuuuuacagcagacugaggaccaaaucccguccaaccuugaaggaccuuuugugaacuuacugccuccccugcuccaagaggacuaccugcugagccugggggaggaagagggcaucagugaccucuucgaugccuaugauuuggaaaagcugccucugguggaggacuucauguguaguugauugggcuuuguacaaacuguccuuauaaaccaauauuuuuuuaucacggaaucagaaacguguaucgcaguguugucccuuccuaccuucuuccuccaagaguaucaugaaguaaacuucagaacaaagcugacauuuugaugaauuaauuuuuuuuuucuaagcgcacaguugcaggcucccuugggaaagcccugccuggucccaggcucccaaaucuuccugaugagucagcaagugagaagaugugcaaucaggugucucucaccuguccuucccuccccuccuuccucuccuuuccuugcggacuggcuugcugugccuaacggaugggcuguugacuggguccggccgccuggcccguuggaaacagcgcccucccuuaacagcaguucaagccgugccuucucuugcagaaugcaugucuuugugagucugcuaccacggaauggaauucugccacaaaugcaagcuugaagucaugcaaaggaaugacacggauuucuccagcucuuaggaauauuuaaauuacucucauaauucaguguaagcuaugggccgcuagugucccacuaggaggcggcaagagccuccacagccuuuuuggaugaagaacuuguuugcaaguacucguugcagauacagagacugguagaguucugcugcucgaagcuguuguggauuucccugucuccauaccccacuuccacugcccccauccugcguauuugugaguuuucccgguugauuacuugugacuuaggaguuccuuguggguuguuuuagaaguuuuuauuuuucuagcugccauugaagcauuccuguggcgcccaucacuauuucaauugaauuguuuaccuuaaagcgaguuuugcaaauucuuauuccuuuagcagagggagagcaccucuacugauaaaaagcaucuaaccccgugugaccuaagguccaccaaccagccucugcgagaagcauccucugucuugccuccuuucccaggaggggagcuuggagcgagaacagcuccggggcuugcugacucgagugguccacagugaggaccucgggccagauacagcugucccguggagcagcaggcauggauccccuccauccuugggcuucccgggccccugcgaccggggaaagggcucuaaugccacacucagggagaccacuucucaggaugcggucagguggagaggcccuagggagaaagacaucccauggugugaguggcauucuaucagggacacuucccuaaguaggagcgaggagcucccacugugucuggggguuggacuaguucuagccagaacccauucuccgaauccacugugagugggugaguuuggacuaagggaggucaggagacgggaaaugcacugauagaaugccagggcgacucccuuguuacuccucaggaauggugucccaaacuggaggcuuugugucagcaaggacccuuccaguuaacuuccaagaauagcguucccacuggcagguggcaagggccaucuuguccugguguugaauauggcauaguaccucaaauccauuccuuggaugcuaagggcugcggaaaugaguuagucacgaaaacuaaccuccagcugagcaguuugaaacacuacgugccuggccuucccgggaggcacguaguaggcacucaacucauacacguuugaucgaguugaaaauaucccuugggaaaaccuuuuacugaaaccacaagaacccuggccaguuuacucuagauagauuuccacaauaugcaaagugguggugguggggggaggguggagacagaagacaccggcacuuuaaacucuguguguggguaugcgugguguauguuugggaagaaaaaacaaaggugcagacuaucuuccucucucuucagccuccagccccggccuccuccccucacacacucuggacuugguaccgaauaaucccgugugguccuagcugaagcacugggguggaggagggagggggagcuucguguuaagugccuacuggaaaugcacugugggguuuuuuccuguaugggaaaccguuuaugccaagcuuucccccaaugcccuauauuuaucucaucugguuagcugccucugcuucuggcuuuguguaauucucuuugccagcugcaucgagcuggguuucuguccccaaagucuaaugacuaaacucaccuggcucuagguuguuguguguuugguugacuuuucuuguugaaacuauucguauugugaugccguauuuauuguuuuaagaaacgaaaaggaauacuaauaagucuucaagcguucucucaaugcauaauaagacuuucuccaguuaaggggcuuaacuggcguacacagugugagacauccaugcucuauucuguuugcauuuuaggcauuuucuuugcucguaguaucuggcacacaaaguagaugaguacuacaguauuuuuguuacuuuaaguccugagaugcagguucccugguaccauugaguugcugcuacuaaaagcucacaugcggaauggcugaaaguuacacaugugcgaaugaagacggcgugagccucagaacuaaaacuguauaaagggcaacacaugagcugucaaacaguguuaggcguguguuuguguacauagccguuuuauuuaagucgauacaguccgcucacauugccauuauuuaccagguuuguacagagauagcaauucauuuguaaacacugccagaauauuuucuagcugguuuguaauuuuuuuaagaccgucgccuuggguuuuuguguuuuguuucuguuguuuucgccugugacucucguuugccuuuuuuuuuuucugucguacauguagcucugucuguaaauagaaucgcaguauuuaaagcuuuagcuuucaggaaaaacgaaguaagaauccaagcgugugcaugacagguugugugugugagaagggaucugaggaagaugccuugcggaggaggcugggugacaguuggcagggugugggaaugucuuuccuacggggugcaggcuuuuguaaaaaaggaaguguuucucccaacacugggaguaggcaaacuacuaaucaguuuagcuuuguguuguaugcuaguuugaaauaaauaaauaaauaaauaaauaauguaauauaauguaaaaauagacaaacaaacaaacaaaagcuuuuaugauggauuuuguaaauagauuuguuacagggugaccuguuccagcugugaucuuaccacuucaaauggauguaauuugaauaaauuuuguaugguaaagggucaauaaaaugauuuuuuuuaagaguucag

SEQ ID NO: 6974 - RNA, 5389 nt, Mus musculus
cuuuccggcgucgcgcugacgucacaaacccugcgccucccgcuccucuucgggccgucguucgaacgaaaggucgucccugugaccgacgaggugguuugagcagcugucgccauguugucggucgccgcccgcucgggcccguucgcgcccguccuaucggccacuucccgcgggguggcgggcgcgcugcguccucugcugcaaggcgcggugcccgccgccucggagccaccuguucuggaugugaagcgacccuuccugugccgcgagucccugaguggccaggccgcagcccggccuuugguggccacggugggccugaacggugagccggcuucggaguaccccgaucucguucccugcggcggcggagggcggugugcugggauguggugggccggccgcggcuaccuuggcaggccgagcgcuccccggagcaggcgggcucacggugacgggaugcucccguagcugcaucccccaggagucaggagccggucugcacgucagucuggguucccuccucaggcuucacuugacuuucuugauuaagaucggccucccuguaucauggcuaagauacuguuaguuacaggaauuugaccuugggcaaguuuccucgauguuaccacaacuuuguagggguguugugagucuuacacuagagaauucuauguaaagccauugguacgguuuagacgauaaguguucaaaauagaaauugaaacaaccauguaggaaguugucaguguacugguacagucgcuuuucagcaucuuaacucccuagcagccccaucccuauagacacaaaaccagcccugucaguuccacuguaggggaucagcagugguuucagauaccaggcucuacggcuuucauaaucuuacuuagucgugaaggcgaggcagucagaaaugauacuuuuuuuuuuuuuuaauacagaaaacagaggugaagugacccacacagugggaaucuaugcagugcggucucuuccuaguuuaucuaagucugcuucacauucccuugugacuuaaaaaucuagaaagcuuucuggugucuccugaaaugugggaagcugcacugggcucguuugguuucugcuccgauaguugacugacucuucacuuuuucaaguagauuaaaccuugauuucaaguucacagggaccauugaguuuagaaauaucauucacuuuaaaagaaugaagaucgcauccauauagcuuucuccucuauaccaagcaaaguaacauacuaugauuguucaguguauuaccuacuuggcacugcuugggguugaguuuaugaccuuucuacaugucaaccaaauugccuucuuagacagcuuuucacucugcauucauucuaauccugccucucugucugucuguccugccucucuuugaggcagggucucacuauguauccuaggcuguccucagacucaaggucuuccugacugucuucccagagccaccaugguuagcuuuuccugcagauuuuuaaugauccccacuggguuugcuguuuaucucuauuuuagccauuaaccuuaaugucaggucagauuacaaaguuuacuuuugcugauaucuugaugucauuauagcauguugacacucuccucucuauuguugagacuucuggccuugguuuaaagcgguagaauaauagcuccuuaguuuuugucucccauuaucagguuuuguauacauuugagucaagaucuuuuuucaggguaaaugugaaggggcacuauugggucuuugaaaaacuuuucaggacagaaguguaauaacuuaccuuguucugagucuguuuggguuaggggaucaguagguaagaagugaggaagagaaaauugcagaggugaaagcguuacuucaguuugucagauagccgaaagguuucugauaaaaauugguggugugccugcuucaugaaagcauuuuccaaaccagacaauguagaaacaaagccaaaaccuuuccugaaaucauacuuuacaucguagcuuaauugcccguuaaaauccaucugggugacuauggaaagauagguagugacagaauggguggauucagauugagaguguguggaggaaaaugucugcauaugggaaaaucucuuucaugcagauuucuagguaccuuggcuuuacaacuacgaaaaguuuaccugccuuagauuuccucuauuuugaggugauauuucaauaacugaucauguaucauguuggaauuaaauuaagcaccuaugcuuaauacaacuugugcaaauuauauaggaaaugacuuuugaaacaauuuccuaaaggucccuugauugauaauggugauguguaacuugcuguacagagaacaguugauaacuggauuuuuuugucaccaaaacucuugcaaaugagucauucuguguaguguuuuuaguuaccuuguauuguuaggagguggugguuguggcugcuguugaguguaaaacucugaacuuggcuccuuucuguuuuagguaugcaacauuuuuuuuuuuuuuuuuuaagagugauuccaggcauuguccuggaggaguaauucuuacuugauuccaaaugccaguuaacaccaucacauugauauuagguaggguaauacauaguucaugugaugugaguccgaaaaguccaaauugugacucuuagguugucacuacacaucuugguuccucccccaaaaugauaggguuaucagaaauguaauuuugauaguuuucauucuuguuugaauuugugacuuccauaaaguuacucacuuugaacucauguaaaaaguaggugaaauauuaauauuuggguauugaggucucuuaggaugagaccuuuaaagaccaagauaguaaugccacguucaguggcauuguauguuaugaguagaucuuuguuuugaaaacuuuuuuccugaaaauaaaaguuuuuucuuuuuuuccuuuuuucuuucuuucuuucuuucuuuuuuuuuuuuuuuuuuuuuuugagacaggguuucucuguguagcccuggcuguccuggaacucacuuuguagaccaggcuggccucgaacucagaaauuggccugccucugccucccgagugcugggauuaaaggugugcgccaccacgcacaccuuuaacaguuuuuaacauccuucuuuuuuacccuaaaaaaguaaauguggugguaguuccuaaaacauacauuuugcaaggguucauauuuucauacauauaacuguuauaucuauuauuuuaugaggaaauacuuucuaaacauaguuagaaucaugccaguaguccauucuuuugucagauauuuacaaauggcauaagagagaggacaugucacuucugcuuucaaaguuuaugcaaacaguaaauguuuuuucauuugucacaaaacauuuggcccauuuuauuaccuccaggaaaagugccccacucagaguccacaguaugaaaaagauauuuuuaauagguguuguuacucuaccaaagggggagauauaugaaagucaccucuuuuuauucuuauuaaauuuaauaauuacuuugcagauuuuauugagugcugcuaccuguucuaauaguuguuauucucugacacuagaggcuuuuuugaagauaaaguaauaucaauuuaugcccuggaauuuaaaauuaucaauccuuaaguuuucuauaaaguauaccaaaaaacacacgaggcuuauugucuuguaauuaguauguuacaaacuuuuagcuaguaguuuuuacagaaagcacauagcagagauacaaggcuaggcugagugaaauggucacacagcaauuuguaagguggacuaaguuuauuuaguguaguuggauagucuaccuaagcaauugguuuuuuuuaaacuuaaauaucuguuuauuguguuauuugccauuauaacucaaaagucuuugcuaauguguacccuuuucaagacauccuuuuaauuauguugguuuuuuuuuuuuuucuuuuugucuugcaguuccugcuucuguccguuuuucccauacagaugucaaggugcccgacuucucugacuaucgucgugcugaaguucuugauagcacaaaaucuucuaaagaaagcagugaggcuagaaaaggcuucucuuaccugguaacugcaacuacuacuguggguguugcuuaugcggccaaaaauguggucucccaguuuguuuccagcaugagugcuucugcugacguacuggccaugucgaagaucgagaucaaguugucugauaucccugaagggaagaacauggcuuuuaaauggagaggcaaaccucuguuugugcgccauagaaccaagaaggagauugaccaggaagcugcagucgaagugucccaguuaagggacccacagcaugauuuagaucgaguaaagaaaccugaauggguuauucugauaggugucuguacucaucuugguuguguacccauugcaaacgcaggagauuuugguggcuauuauugccccugccaugggucacacuaugacgccucuggcaggaucaggaagggcccugcaccucucaaccuggaagugccugccuacgaguucaccagugaugauguaguuguuguggguuagacacguggacucagggccuagguuucugucggucuucagguccccucagaagaguggagaguaagccuuguguacgucuagguugguugauuuaaaauauuuaagaauuguuaauaauguauuggcaaacauuaaugugaaguaauugaauucacuguuaaauauuaucaagcauuagcauaauaaaaccacuguugaacaucauuagauucagucauagacuugaaaggugcaaugucuuugauagcuaauucuaauaaaacauuacagauuguuguauugguguucucaucuaaauuucuuuucguaucuugaacuugagaaaagguggggacauuauuuuucaucucaaaguggaugggaaaaucauuuugauaucuaauauuuuucuguuuugauauuaaaccuuucacaguuauggaaguauguauuauuuuguugaaauauuuucacuuuaaagacugaauuuuacucucuagccaaacuggccucaaacuuguaaucuuccugugcuugcugggucucggaugagaggcaugugccaucacaucuaguucuuaaguuugucuccaaaucagaacuaacaagacugccuugaaaggcuggaaaagacaaggaagaaaaacacaaauucaagauauuauucuacucaaagauaaacauucccaguauuuauuugcauguuucacuauacaacauuuuuauagagaugcguucaugagucguucuugaugagaauuauauucccugugcaaaac

SEQ ID NO: 6975 - RNA, 2087 nt, Mus musculus
aggaggaccagacuauggagaagggaaguuagaggauaucgacggcauggaaguggacagagagggaagaaagggaaaguggggagggaggaggagagaaggguggagagguggaaaggagaagaggaauugaugggaaagggagaaaagaaggagggaagcagaaaggaggagagggagaaaguggaaggguggaauucggggaggaaaaagaggggagggguaaagaggauacagucgguuagagucacaguagauguugcccaagaguccacagcggucagggaucagcaccaggucaagaggcaaaccucagucaaaggacugcaucuagccaggagugcccgccuuauuaagauuucucacaggucagagcuuuggggucccaagggucugaguggcaaauugauuugcaaacucacaagacccccauauuauagaaacgacugcuaucuacagcccauaagcccuaagguuugaagguacccuccuguggacucuggagauggccagcugaacugaagcagacauaucccuguggcuuccucuguagcaggaacgaaggacagugaucuucagcagaggauaauggcagaagcauagggucuaccugugguuguguugccaugacuguggagagaaguagcuacggggugcccauuaucuaagaccaauaacagccuaaccuuucuaaugcugagacccuuuaauacaguuccccauaucguggugacccccaaccauaaaauuauuauguugcuacuucauagcuguaauuuuacuacuguuaugaaggcaauguaaauaucuguuuuccgauggucuuaaacaaccccugcgugaagaucauucccccagggggguuaagagccacuggccuaagcuauuuuuuuuucagauaucuuucugugaagcauaccuuaugcuucauucaguacauacacugaagagggugucguacaggcacuaugaauuaagagauauuguauggcuucauuuuucucuccuauuugugagaagauacgucaaaguguuuccagaccauccauuuugaagaucaagggaacacucuuuauucgugagcaagagacuuggcagcagagguccuaaggaaauacuguaagaaaucucuggcagucacggagccuuucacugugaaacaaaacccuucaggucucagugacaugccauuugucagguaaggcugccuaucaucaaagccagaaugguggcucuggaaaacucacagaguuuucccuggaucaaaaaaaaauaauaauaauaaauauacuaugcuagugaaacagaaacacucagaagaggaaagagacucuuuuguuaacauaaagaacacugguacaauuuucuuuauuuuuccccucccucaaguuucugcuccuaacccugaaacuaacuagcaaacacuggugcagaaguugccagaaaauaaaacuguuaaaacuaaaauugcuacgguagccacugaggcuacaaaucauuguauagguuuauguucucaacacuuucagauuucauuagaacuaaaaagaaggauuuugacacaguacuuccaaucuaucuaaaacagucuucggaaacaccaggagacaccacuaggcucccuggauaauuuauguaucuguuuugccuuacaucaauaccuuaaguacucaguacugcauggcaugucagcuugaaaggggccauacauaguuagugugcaaccuaacccucaacacaacuguaaagaugccaucucuuaaggcgccuucuuaggagaagcuaacgauuaguuaguuguccuugcuggggcauuccugccauauucauucucauaguauguaccacagagacccacugugacaaugauucaguccaccaggcuggccauccauuagaccugucagcagaguaccagucucuucauuuacucucuuguccuacucuugaacuuccugagagaagggauugugugugcuucacaaaaugguuguaggaugaaaagcugagauucaaguguucaccaaagcuguggggagagaucuauuucuagccaucuacuucaaaaucugcuaaacagccaagca

SEQ ID NO: 6976 - RNA, 12241 nt, Mus musculus
uacuuguuauacacauuuuauugaaaaaaaaaaaaccuuacaucaaaauaucuuggcaaacugucaaaguauacauaagugcaaauauacccuccuuuuacaauacaagcgaagugugaguauacgaagaucauaaaaauacuuuaaaaauacggugguagaaaaacaaccuuguaaaaauguacugucacaauacugagagccacuuucuuaaacuagacuaucgguucuucauuucuucacaauguucuuuggcaccuguauccgaagaagggaguguugggggacugggaguggguggaagaaauguccuacugagccagggaacuagagaaggcuuucuugaaauugugugcuuuuagcacugcaauuuugaaaagcacacacacacacacacacacacacacacacacacaccucccuuuucagacccugauuagugaaugcaauggccaccccagaacugaaaaguuuuauguccuccacacaguaacauaugucuuacauguagucaccuccucugucugucgcucuucugggauauuagcuuucgaaagguuuccucuuccaggggccgggcaaauaucggugagcagaacucccuuggguauuugucuaagugaugggugugcuacuuacugcuauucgcuauccagcgugcacagugugaguccguugcaguuccuggcugccccucucggaggggagaggagaagaaggcagaagagggagagcagaguggccuucaaggccucuguccauucacauaacacagggcuuaauaucuuggcacacgcucuggugaugauggugauaauaagagccacuagcggaaggguggaaagaagaaaugccauugaaauugaggacgaaaucuuuccugucgcacacuggaguggaguggugcugguaacggggcaguccgacugaaagaagaaagaaaaaaaaucuuuucagugaaagucacccagcugauggugggguguauuaguucgaaauuucccauuaauuuguguuauuuuugacugaggguguaaaggcagcugguggccuuaggguguauggcuauaaaaccaauaggacgcaucucggagcgccuuggagacccaaaggccugcccugcuuugguuuuaaauacccuuucuugagaggcaagugggaauucaagaacgccuugagagguaaucuguucguggauucccacaucccucucuugugcugggagaccucucugccaggccuggauccaggcugagcucggcacacgcacgcugacacuuugcgccaucgccucuguuuuuguaccuaauuuuucugucucaagaagucgggauggggugggggugugcuacccccuucauccacacaggaugacaaagaaaauaccuuagagaagaaggggucugagaagggggagagaagagggcagcccccucccaaccacaggcagcaggcaucuucuagauuucgaacccuggccuuggauaggccaagaggugcucuuuagucaugguaucuagccgcacacggaguacccgagggaacugguggcucccggggaaagcuugugucuagcgguuguccacgaccugagccgguccuucucagcgucaaccugcgaaccacuuuugcuuuugcuuucuccgcuccaaggaggagcaaucggcucaugcgaucagcgcgcaucucugccacagggacaggcuuuaccaagacuuccucuacgcacccgguuggcgugacccgcaccagacgcacgccugugucgcccccagugagguugacuguaaccugaaggaaagcuuaugugcgaccggcgacguauaagcccuacggcggucacccaucgagcuacuaggccgcucaccagcgggugugacuccgccucuguggcaaagugggaccgcucggggaguuucggcucuggagaagcgacccaggugaacgcgcgggacaaucgaucagauccuucacugccaacgaugucaccagcgaauaucagagcuugcgccucccuggucccaggcaguugccugcucccuauugagccgcgagggagcacagacagcugaagcccacagggcuucgugaugagcgccgacuacuccugccucuaccggguugcgucgucgccgcugccgcccugcggucgccaccuccguuauccuguuaaaaaguggggggcccggcgcgugcgaguguguggcgggaggagggucgugcugugugcguggcgauguguguucugggagcuuuguucagcugucccugggccacggcuucagccaugccaggguuccaagggaccuuccaguuucagugggccucagucgugugggcagcacucgcaaccaggcccugcaggguccccguguacaacgcagugcucuuuguaagccccuugacaaggucuuuacuggaggugacaaaaccggaauaauauucuaggaagggaggauuauauggcaccgugaccaaguuggacuaagcuauugcuuguggggaaggcucuuccugaugggcaggagaacaugagaucggaggccugccuucuuggcugucauagccgcggaguuugggggguuucauguauggccuagagugugugggauggaacacgaaccuaauaaaaaggucagaaacgucuuugcuccuugcuguuugcuuguuuguuucuccuagaauauaauuuccuggcaguuggaaagccugggcucaagguauccaaagggaaagacagaggacagggccagagcgguaggccuagagaaggagggggaaggcauaggaugcaguucaguguguaggagggagacugacagcuagccuguagggcaggaggugggggugggguggagaauaagagagagggucaucuguauugguuacuuguugaaauucccauaaaauugaaggagacucuguucucuguggguuaagucagccuaaaauccucucccgugugguccugccuagacugucuuuguuugguuaaccucugagacccccaguuaaaaggcuuauuugggaaauuucuccaagaucuuuugcuguuucuuggcuucccuauccccccaccccagcuccuguggcacacacacacacacacacacacacacacacacacacacacgaagguaugcaucagccugugcauuuucuguugguaaggacgugggagagggcaccuuugggcuuugcccuugacggacaggcucccaaauuucaaucugcaucccuaagggacccuggggcagggagggaggagauuaaucaggguuuaucucuauucuguagauaaagccauacaaacacaaaauucucuccugcacuccccuccucucccuacaccagccaaccacuuuucacaagucaauaaauuuucauaaucugcaacccacacaauauaaaccaaccacacugcaaguggccucugggcacauuuccucgggggaagggaucacaccagggugccuacgcccugaugcccaggacaaacuugagucaauuacuuagaucuacaguacguguguguguguguguguguguguguguguguguguguguccaagauuccucaacacuuuggugccuccuaucgcuagcgaagcccuugggauucugcucugcuuuucucucucuccuucccuaccaucuccuaucauuaccugcucagguaagaacucuuccucccuugcucugcuucauacagaaccgcucccuuucugucaucuccuuuaggaacuaaagccgagcaaaauggacuuugaaaagaguaggaagaaacgaaaugauccagacucaauuccucgaccaaggucuccaaaggucacaggccuucuuucagagcugagucugaccuaauugggagaaaguccacaguguccuaaugaaggccaagagacuuaggacuuggcaccacccuucuccaauuugggaauucuggggcccaccaacaggcccagagcauuagagaaggguacaagaucaaauccccuucucucacuuaggaauagggaaccgaauccccaccccacccccagcauucuaguucugaagaccccagcguugaggaccaagggugcaguagcccuggcccucagaggcucucagaggcuccgcuugcagccagccuuggcgcucuuuauuaccugagagauccucgcgggcguucuggugcaaguagcucugcuccaacgaguaggaagacaugcuggggugcagaccagcagaggccgcgggauuacugcuuggcgucagggcaggcggcugcuugagguaaggugaagcgccaggcgagcuccaaugugccgcagggcuaguguagggcgagugacacucaauggcgcuugccauagccggggaugagggcacagggcugcugcugcuguccggcccauaguccccgccgccaccgccgccacccgcugccgcaccgacgcccgcaggaccugcgggcaccgggcagcuggccauauagguggagcccggguugggcgacaugugggggacgugguggugguggaggugguguggaugcgcguggcccggagcacccgccccuguaucauagcccgcgggcaucaugucgaggccaccauaaccgccuugaccguggcaacccagaggcgccgacgggggcgcuuggaagucgaagcccuggggcagcagcgaggccccgaagcccaagccgcucaccacgcgaugguacauggguuugagagccuggcacuuccgccugaagccgcgcggccggcggcggaacgaacccuccucaaacaugaauucgcuggccgggucgaugguccaguaguggcccuuaccaggucucccgaggcccuugggcagcuugaugaagcacucguugagcgagagguuguggcgcacggaguucuuccagcccugguaggcgccacggaaaaaggggaagcgcgccuguaggaacugguagaucucacugagcgucaggcgcuugcugggcgagcucuggauggccaugacgaugagcgcgauguacgaguaaggaggcuucuccggccgccgcagccccgagguugccuucuuggugccuccacucccggcgcccgcgccgccgcugcuagccgcacucuugcaagcaccggccgaggcgcugacggaguuagaagaggacgaggcacaggaggcagaggaugaugaugacgacgacgaaguggacuccaggguggcggcggguggcgggcucaucaaggcggccuggagcgcgccgggcgccgggcugcacgcgcggcggaguggggcaggcggcgggcgcggcggggguggcggaggcccgcccucggugcucaucugggaaucgggaacgaggccgggccuggggggcggaccccggaccgggaucggcggcgccggagccgggucgguccacaaaucgggcgagugcccuacugcgccggccgcgcugcagcccgggccacugcgggccagcgcuucggcgucgccucccucagcuccucuggggcuucgggcggcggcggcggcggcgggucggaggcaacgccccgcgcaucccucuuccgagccuccggccggcuccuugcgcaaccgucuccuaagccacugaggcgacgcugcccagagcuggacagcugcgcccucgagccaagaccucagcccggaccccggggacuagcccgucgucuucuuucaggagugcucuucucucugucucuuggacuuccucccuggcgcgcccuccccgcggcagcuucgcucccucccucccucgcucccucccuccaccccaccccgcccugcccccuccuugcuccgcgccgcccgccacggggagggcgcacagggcucgcgucacuccucccccucuggaccuggcggcgggcuccugcucuuaucgccucccggacucuccgggguccugcuggcacuacuaauuccucucggggcucuuucccuuucccagucuguccucuucaaagccgcagauacacccgcauucagcagggagaacucccaaccuuggccagacucgauuacuccuaacuucagcaauucauucucuguuccuuccagcagcccguauccuaucccagaagugcccccaaccuagcgauccgugcccggacacacccugccccuccuccacccccgccggacccugugggggcugagucuuggggagacugugcccuggaagagcuuccuuagccacgguccccagugcccgaacugacaccaucugucaacuucauuuaggcagugcugcccucagccacacgccagggugccagacgucccaagguaacgugccaacuccgggucucucucucucucucucucucucucucucucucucucucucucucucuggcuggacaugcaggcuucugagaggucacagcagagggcaaacacuggacgcccuugagcugugcccggggcaguuaugaacagauugucagcugagcaagggguuuggguggagaaaccuggggccaccucuuagacacucuuuugagucgaauggauucgguuuuuuauuugcuuccauuuuccacugacuugucauuuccacuucaugcugagagagagcaagagagacccugaguaaggagauaguuguauuuauuaucaacaaggaaggucugcacagcugccaguggguuuacagcgucugucuuccggugcaccccccccccacucccuauguuccguggcccagcucccuccauucgagaacacuccuccaguuguggcuuauuccucuaaguaagagucggcucagagagagauggcccucgggagaaaucauuccaaugagacccgacaguuaguuauuggauuacacgugcggggaaauguagucugaccccggacaggggcugcaaagcgaguugcaagcugaaggaggccugaccacaccagggcugguggccuggcccagagggaaggagaugcccaucagaguagcaaaugguaggcacagcacugcgccagcccugagaggacuggguuuguguuguguacgcagaaagccugggaagaugggagacaaggcagagaggagagugcagggcccaguaaagaugcuacaaagagccugguugagcaaguggggucuggccuccugggggugggggagccugcaccagcucugugcccuagugcauggggacugccccugauggagacuguuggugggucugaggaacagaggaaagggcgggugcagggggggggggagggggcuggccccagacagugaccuggaguugaguggaagcaggcuuuuuccaucaaacccugccuggauaccacacacagagcccgagugucaguuuacugcccugagcccggcuccuuuucccuaagcuccacaguaauuagacaaagaaaaccuaaauuagcugaacaggcgucgacagcuuccuccagagcaccccugguaccuacaugggaauguguccgaaaauggcccgauuguagcccagagucagcuaagaaaacaccgcugagcagaacugaguggaccucucauuuucaagagaggaaaagaaaaaagaaaaaaaaaaagaaagaaacaagucgcucuuuuccggaagggauguuuugcuuggguuggggggggggggguugauguuucgacuuucuaagaauuucuuuuugacugacuagugaacauuugggggacaaguccccauuuauuucaugcugauccccgccuucccuuugucaucuugccuggucuaauuuuuuuuuaugagacuuaauauggaagcaaauaugugcucaauaaaccaaaguucuacgugucugaaaagaauugcuuagaugagguggaacuugggugaggauaggaaauggcccaaaggagcuuugugggcagacuucgguguugguaaaaguguuuucaagugaguguguauggaaguggggaaaacauugguucuggaagaagaguggggaggaggggaggcaugcuguuuuguaggcaggcuacacguuugagaaacuuguaugaagucaguauuguggucagccagcucuccaccuguucuguuuccugcacccggggacucuacgacucucacucccgcaugguacuugcuuuuaaauacuggccuuaaaaguuuuaggucugaagagaaugaaggcacuaagccuuuuacaaccaaggcaagguuugauaaccuuccacaucauuagcucucaguuugggagccacugaguucuuuucuaagggguaccugagauuuuuacaagguuuuucuuuuuuuuuuaauuucuacguauuuuuaaucucuguuauaaaagguuuuaaacgaguccuuuuaucauccagguauugaucacauguuacuaagauucucugaauuuguaagaaaugacucuuguagucugcaguagacaaggcaaaguaugcaaacuugaagccuuuguucuaguauaccgguccccaccaccuccacccccaacccccacaccugccccaacuccagaaagacagggagcuucguggugagcucuugggcaggaagagaucuccaaaacuuguucuuguucuuggggaucccauguucaaugguucuuugaggcugcccaggggcaagugaucuagcuggcuuaggaaugggaguggggcuaggacuccaaauucaauguucuuuucuuuuuauugcagcucaaccuuuguguuuuagucauagauguguccaaaucugucuggaaagaacacagcugauugagaauuaggucaaauucuuacucccggcaagaguauccguuucuggugggcaggcuuuugcuuauuuguuuacuuguguugcgaugcagauugagacaaacaagggaggcucucuaccugagucccagcccccucccagccaugguuaaaauggaagucuccuugcugauuuguuuagauuggucccacucucuaggaggucccuucuucuggugugagcccucuccuacugauuuuagucccuauaaacaacaacaacaacaaaaaaccuugauuuuuuuuuaaaugaagaaguacagguaugguucauuaaaugauucuagaucagcuuacgggcuuguuuaacaauaacaaaaaaagacaaagaaaaaguaaagaaggaaaaagaaaaaagaaaaaagaaaaagaagagaaaagccacacagcucagaacuguucucaucccaucgauauuggguuggucaacuguuuccaucugggcugugggcacccuuccuccuccaaacccauagaguaccacccuuaccccuuagcaagggaauguaaacuagcaaaaauuggauugcucugauuuuguucugcaguccauacuuuauucuaggaaaucgcuccauuguugugguuuaaaucuuuucuuagcaugcuuccuuuguuucguggguuuuacaugaacuggcuuagacuaaaccaguaaggauggcagagacccaucuacacuaggcguauuuaaggguauucaggacgggucuugggugagcuggcaugcucuguaccuuucucuuccuuuagccugagccugggucggaagaacucaucauuuuaaccacguguuuagauccgugcuuagguuuuugagcgcccacgaugccuuucaauaauugcuuguggcacaggguuuggguuuccuuggguagucuuugccugcugcuaccacaggccagaccuuucagaauuggucaguggcaacguugagcuuuguggccguaggugauugcuccaccagcagggauuggagagaggaacuuaaucuggaaggcauagcuaauaauuuuaaaccucguuuuacagucugcucucuuuccuuggccaagaacuucuauacuccuucuauacuucuauauaugccuagugagagaggcaagagccagauuuuauuugcauucauccaucagcacuccaagugcauguguucagggcaggacucuuaaagccacccuccucaaagaucagugccacagcucaggaggucuggcuauaggcaagacucugugugacccaguuggccaggucauagaggugcuuggagugggaggacaaagggcuaaucuaccagaccuccccuccuuucaaaacaaaacaacacaacaacaacaaaaacuccuaggccucuuucuauccauuucuagauggccauaaugagaguuccacgaggaaccuguccccacaguacccacucucaccccaccccugcaggaaggaacaagugccauuuagguuucuacagccugcuauguuuagggauggcggugccaagggcacaggccagggucccccucaaaggaagaugaagaaguugggagaccugcacuucguaucugggaagagagugugagugcagaugcccccuaggcacguugauucugagaggccucuuguacagcugggggaaaauaucugcuggcuuuggggcuuugagauuaucuagaaaccugugggagucugguggccucauggccuugacacuauagcagacagcacaguacacucaggaguggccaccuugccugucccugguuaucuuuucucuugggaauucgcaugcacaccccucccuucccaccuaccucucucccuacccucucucucccucuuugaguuuucucaacccccuccuuucuuccaccuuggagguggcuaggguggcuugccacucgggcucacacggggaagcucugcagagcccgaagaggucacuccaggagggcacugggcaugcacacagggaugcuacagaaaacacccaccaacacccagaggcugcaaggcuggccccagaccuccccgauggagcgggaaagucggcuggcugcgggcaggcuuucacggaagcgcccuggaggucccaacccaguggccggguuuucuucucuaguuuggcagggucuccucgcccucugccuucccuucccccccaaauaaauaaauaaauaucuaggagggcagcgaucucggcggggcgcugggccccgcgacuccgcgcagaugaacuuccuggcgcaucaagacucgcugcaguccucccgccgagcgcaggauauggggcgcgcucgccucucuucagaaaaggaaacguagcucuuccaaaaauauaaaucaguucugacguccaaauauuucuuuuguccuccagcauccucuguagggauaaauaaaacgugcuaggcgcccagaggccgacuagggaccucggggcgcccagacgccgccucugaagugcugcuucuugcggagucucccuccccauuugccacucuuacccggccuuggaccccuucagcuugccccuuggucccuggagucuuagagggcgauuggcuuacggggcuggcccagggggugcuggggaaaaaaaagaagucccggagagcagggccugagcagccccuuucaccacccagcuagcccccaauuuuccaguccacacagggugugcaccuaacccuuccaggagggggcuccuggugccucauggccucggguuucaguaguuccaggaggacuccggaagaccccacaucaggccgagaauacuccuugggcauuccuaaggcugcugcugcucacccagagucagcgaggagacugugcagcugauaacagggcuaucagccugccaaacucacguguuggcauggguuuagucaaccuugugcagcugauaacugggcuaucagccugccaaacucacguguuggcauggguuuagucaaccuuaagccuguucgccucguaggaacacuuucuaguucuguuaggguuuccacugggauuagaaaacagcucaacaguaaggcaaaccacagccagcaaaaguggcagagaaaccagcaagacccgaaagaagguggguugaggguguguuccacaacuccauaccccuucucuucucucuccugaagcugggguguugggagucuccucuccccaccaaguccuccccccuccacgugcaccuaugaggugagccugaaagagugggguucauggauacaggacagagguucccaucuguccugggcauucccccucccgacagucucagccuaacuccaauauucuugugugggucuggcucgagauugggcugcgugugggcgcucuucgcuuaccccuuuccuccaggggaucuucauggcugagcugccucaaaaaucucccgugcagaauaucuuagaaggguuuagacaaucugucacccaccacuucaagaaugcuuccucc

SEQ ID NO: 6977 - RNA, 4000 nt, Mus musculus
agaggaaggauguaagucugcggucagaguagaggauauggccugcaugggccucggucuccgggaauccucauaucgccccaugaugccaggaggaaugacgagcugaccuucucgguaggaaagagcucugaaauccaaaucuagguauccaaggcuggagucaucgaccuuauuaaauuucuagaaaucugcuucauugucuuugugagcaggucaguuuuaacauuucucgaaggcacuagaguuucaaggcuacucuaaccugugaaucuucugugaacauuagcaguuugcuaauguuuggacuaguuuggggguucccgguaauuccguucaaggaacaguauuuacuucgagggcuggaaguuucuggccccgcccccauccugcauaaggaaacaauugacaaaaauccacaggucaguaaaaccuguacaaauuucaugaggugggguuguugcagugucuuuugaacuuguuucuauuuagugcaugcacacugacagauucacugacugagaaaggcugacaaaggacucagacauagggacaaggguguagggaagaaacacacacacauacacacguacacacauacuguccagcuuaucucuccaauaaacauccucaaaccgucuuucccuuugcaaacugagcuacuaggacagggcccaauagaaccugcuagauaugauacaaaccuguaguuccaaaaccagagugcccaaacuccucggaaacauuccaaacuuuauacauaggcuugucugguuuaauauuuuuaccuuuccucuagcgcauucuauauggaaaaugagaccuagaaguuggggaaauauauuccuuaaggcaagaaaugucuaaaaucuagaugaucuuuaacuauugauuuaguuuuauguaaauauguuguaauguaaggauaaauagaaaaaaaugaauacuuaggagagauaugucccauuuguucuguaggucugacaccuucuaucauacuaaugaauacuaggaauuuaucugucuaguaaaaaauuuaacagaaaaaaaucauaaaaaucaaauauguauuggaugugcugagcuauggcuuggugguaaagcacuugccuaaugggauugaugcccaauaguacaaaaguaaacaaauaaaaccaauauuuuuuagggccuggaaaugcaaaaauaguaaagaagauauugcaaacugucagaaauaaaaaacugugucccuuaaacauccaaccgguauuuccuuuauuaccauccuagaaucuggauauucaagaucgggguugacuuccucugaggccugucuccuggcuuguagaugucaccuugcaucuggucaugacacacuuccucuccaugugcuugcguuccaauuuccuauuguaaggacagugacucccuuucauuaggaaccacccuaaugaccccacauuaccuuaauuuccauuuaaagaccauagcucccagccagccagauggccugguagguaaaggcgcuugccauccugaaucuaauaccuauacccacauacugggaggagagaaugaaguccuacaagcucuccucggccacacauuuaaaagaaaaaaauaguaaacaaaguaauuaaaaauaaaagguauccaauuaccaauuacuuuuuguuuuaauuauuuuuauaaaguuuuuuguuuugugauuuugguuauuuauuuauuuauuuauuuaugguuuccuuuguuuuauuuuuagacagggucucauguagcccagggcugcuggccugcaauucauuauauagccaagaaugacuuuaaguuucuuucccccugccccuaccucuugcuuacucaaauuauaugcauggaccacuacaccaugcuuaugugguuccagggaucaaaccaaggauauuguauauacuaaacaaauacuguaccaacuaaacuauagcccccccccauugccuuuuuuuaaagacucagucuugaggugaugaagucuuacacuucaauauaugaaauaauagagagacacaauacaucuccuuacagacaaaggggaaagacuuuucuuguugguuugguuuggaagcauggaagacaguugguagugggcaucauuguaauuccccaguaaccuuaggggaaugugugcagucagcauagggacuggacaacaugagauuucuauuagccagagggagagugcuaguguagcauaguaauucauaacuguaggagacuucguaaccuagaagacauuugacacuuuuuacuguaacacuauugauauuuaaugauuaaagagugaaugggucuguugcugaacauccuaugauuaccagcccagcugacucaucguaucaauacagucuguucucuauauccuuuuaacuugcauccaaucaaccaaauuugcauuguuuaccaugaaguuagcacuacagcgcuugugguggucagucuuauuuuaauuacauauuuuuauuuuuguguagggugggagugccuggaacacagggugcuccuguagaggucagaggacaaggucagcucuuuucuucucccauguaagguccagggauugaacucagguugucaggcuuggcagugaaugucuuccuuaaaccaacuggccggucgauccugugaugauugaucuugucaccucgauuagaucuggaaucacucuaaaagauuugcuucuaggcaggucuaugagggcauuuccaggaaaggucaguugaauagagaagacccucccccauaguguguggcaccuuucagccaccauccagauguaaagaacuccacagaaaaagcagugcuacuuugccugacaccuuaggugggaauuacugaggcauccagcuucauggacugaacaguuagcagguucucaccccauccagcaugcagaugaccauuguaagacugccuagccccuaucgcguaugccuaucuaauaaaauuauuucuaucuuauacauccauucuguuccucuagaaauugcugacuaaugaaaugcuugugucuguaaagaacauauauggguaauucuccuuucauuauccccuaaauaacacauugugccaacuacuuacacaguguuuauguuguuuuaggcauuauaacucaucuaaaaaugauggaaaugauacaggaggaggugcauagguucuaagcagacacugcacuacuuuauacaaaagaguuggacaucugugaauuuugacauucagcgggaacuaauagggauguaaggguauucuggaaccagucucccucugaugcuaagaacccaguuuugcaugugugcagugggauaugagauacuaaacaguuccaucccccagucaaugccuucugcuaaacuuucaugaccacagcucuuccucccaccccuaucucuaacucuuaagcuacucaccugcucuccauuucuaaaaauuuauuauuagcagaguauuuauuauaaaugaaucuuagggguuggcuuuuucacucaggguucccuguuguuauguuuauuaguaguuuuuguggaacuuuguccucugucagcaagagacccugacaagauuguccacuaauauucccuaauaaagaggagggaaaacucacauguccaagcacaagggacuaaugaggcagcacacuagacacuuaagucuccaaccuuccucaaaauauuuaagccauuaauuacugugggaguggggugguagcuuuucuucaguaauguagcugccuauaaguuguccuuguuccuauaaguaaccuuuuacccgugcuccuguaaguaacuucaaauaaauucauacuuggauggaauaauauuuuggucuguuguuauguuuugucugaaaugaauaaauauuuauucacaucuucgcaggaaaagucaaugcaacaauagcucauuuguucguauuguagaguagcauucuaucauauggacacaccacagugugucuaacuacucaucuacugaauuaaucucuc

SEQ ID NO: 6978 - RNA, 2461 nt, Mus musculus
uagcuauugccaguuuacuucauagcauaagauaacuaaaccuucagugggaaaacaguaaauaaaaaguuucuacuguaacuugcuguauacuguugggugguaaaguaaauacacacucaaauuuugacaagauucauaagucuuugcuuucccuuaacacauuuaauuucugauuaucagcaauaaucaauuauaauaaaauuuugauguuuuugguagcccccagguacagguugagaauuccagccuuagcaacuuaacaagucacacuccucucaaucuaccuauauguauuuaaauauuuuaaaagauguauuacauuuauauuuacauguuuugccugcauguaugacugugcauuaccuagguguagugcccccagaggccagaauaaggagccagauccucugaccuggugcugcaaacugaaagaggaaccuacaauagcagcaagugcucuuaacuacugagccaccucuccagcuccuuuugcaucuuuccaaggaguaacuuacagaaaagcauaauaaaaucauaagcaguaauacauggauguagacuaccacacuaacuuuuuaaauuugcuuuucaaaaguaaaaauacaauuuuguauuauguagcccuggcugacuuggaacucaaaauguagaccacgcuggccucaaacucugagauccaccugucagugccuccugaguacuaguauuaaagguacacagcacuacacccagagaauauacauuuauaaaugccuauuguacucauuuccugcuccugucugcuggaaauaccuuuaaggacugccugccaucauuuuguuauugggauacaacggugauuuucaguuuacgacuauuauaucagcuagagauaacuauuaagcaaguacuuugggcgacagguccuaaaguaaaauuaaggggcacaggggagggaaucccuuuuauugcauuuccuugagcagccuucggaauugaacuuugucuaccuguguagcucuuguguguuuaugucgaagcccuuucuccagcuuccuaggcacuucugggguauuuccacuucguuuuaguuuuauuacaaauauucucccugaugacagcauuucuaguuccgcacccagaaggccaaaauccuggaaagccagguucccaaguucccuccgcuuggguuuuacucgaaggcgguuguuuccgguacugagcaggcaugcgcacgcgcaccacgccuauccaagcagcgccacagaaaggcucuucccagggaccgaagaagacgagagggccuguugugacggagaacuacauuucccaaaguucaaugcgagaaauugccggcggcgauugggggcaucggguugcggagucuucugcccgcuuuggacuacacuucccgacacgacucgcgaggcguugccagcugcgggccgagggcgaguugacgcgggagcucaggacgugaggcaugagcggcgcccucccucggcccgugcguguccugcucccuacccgcgcgagggucgcgcggcaccgggccuagcggcgggcaucggcguucucaggggcaggugcagccgcacgggcgccagggagggcagcugccaccauggaggugagcgggccggaagacgaccccuuccugucgcaguugcaccaggugcagugcccagugugccagcagaugaugcccgccgcgcacaucaauucgcaccuggaccgcugccugcugcugcacccugcggggcacgcggagccagcggccggcucucaccgcgcuggggagcgggccaaggggcccucgccacccggcgccaagaggcgucgacugucggagagcucggcgcugaagcagcccgccaccccgacggcggccgaaagcagcgaaggcgagggcgaggagggcgaugacggcggcgagaccgagagccgugagagcuacgacgcaccgcccacgcccagcggugcgcgccuuaucccggacuucccgguggcccgcuccagcagccccgccagaaaggguauggggaagagaccagcggcugcagccgccgcaggcagcgcauccccgcgcagcugggaugaggcggaggcgcaggaggaggaggaggcggggguggacggcgauggcgacgcggacguggacggugaggacgaucccgggcacugggaugcggacgccgccgacgccucguucggagucagcgcgggccgcgcgcauccccgggcgcuggcggcggaggagauccgacagaugcuggagggcaagccgcuggcugacaagaugcguccagacacgcugcaggacuacaucgggcagaguagggccguagggcaggagacucugcuccgcucgcuacuggaggccaaugagaucccuucgcucaucuuguggggcccgccagguugcgguaaggugagugcugcucuugcuguuuuugccaagggccgcggagguauucug

SEQ ID NO: 6979 - RNA, 2461 nt, Mus musculus
cagaauaccuccgcggcccuuggcaaaaacagcaagagcagcacucaccuuaccgcaaccuggcgggccccacaagaugagcgaagggaucucauuggccuccaguagcgagcggagcagagucuccugcccuacggcccuacucugcccgauguaguccugcagcgugucuggacgcaucuugucagccagcggcuugcccuccagcaucugucggaucuccuccgccgccagcgcccggggaugcgcgcggcccgcgcugacuccgaacgaggcgucggcggcguccgcaucccagugcccgggaucguccucaccguccacguccgcgucgccaucgccguccacccccgccuccuccuccuccugcgccuccgccucaucccagcugcgcggggaugcgcugccugcggcggcugcagccgcuggucucuuccccauacccuuucuggcggggcugcuggagcgggccaccgggaaguccgggauaaggcgcgcaccgcugggcgugggcggugcgucguagcucucacggcucucggucucgccgccgucaucgcccuccucgcccucgccuucgcugcuuucggccgccgucgggguggcgggcugcuucagcgccgagcucuccgacagucgacgccucuuggcgccggguggcgagggccccuuggcccgcuccccagcgcggugagagccggccgcuggcuccgcgugccccgcagggugcagcagcaggcagcgguccaggugcgaauugaugugcgcggcgggcaucaucugcuggcacacugggcacugcaccuggugcaacugcgacaggaaggggucgucuuccggcccgcucaccuccaugguggcagcugcccucccuggcgcccgugcggcugcaccugccccugagaacgccgaugcccgccgcuaggcccggugccgcgcgacccucgcgcggguagggagcaggacacgcacgggccgagggagggcgccgcucaugccucacguccugagcucccgcgucaacucgcccucggcccgcagcuggcaacgccucgcgagucgugucgggaaguguaguccaaagcgggcagaagacuccgcaacccgaugcccccaaucgccgccggcaauuucucgcauugaacuuugggaaauguaguucuccgucacaacaggcccucucgucuucuucggucccugggaagagccuuucuguggcgcugcuuggauaggcguggugcgcgugcgcaugccugcucaguaccggaaacaaccgccuucgaguaaaacccaagcggagggaacuugggaaccuggcuuuccaggauuuuggccuucugggugcggaacuagaaaugcugucaucagggagaauauuuguaauaaaacuaaaacgaaguggaaauaccccagaagugccuaggaagcuggagaaagggcuucgacauaaacacacaagagcuacacagguagacaaaguucaauuccgaaggcugcucaaggaaaugcaauaaaagggauucccuccccugugccccuuaauuuuacuuuaggaccugucgcccaaaguacuugcuuaauaguuaucucuagcugauauaauagucguaaacugaaaaucaccguuguaucccaauaacaaaaugauggcaggcaguccuuaaagguauuuccagcagacaggagcaggaaaugaguacaauaggcauuuauaaauguauauucucuggguguagugcuguguaccuuuaauacuaguacucaggaggcacugacagguggaucucagaguuugaggccagcguggucuacauuuugaguuccaagucagccagggcuacauaauacaaaauuguauuuuuacuuuugaaaagcaaauuuaaaaaguuagugugguagucuacauccauguauuacugcuuaugauuuuauuaugcuuuucuguaaguuacuccuuggaaagaugcaaaaggagcuggagagguggcucaguaguuaagagcacuugcugcuauuguagguuccucuuucaguuugcagcaccaggucagaggaucuggcuccuuauucuggccucugggggcacuacaccuagguaaugcacagucauacaugcaggcaaaacauguaaauauaaauguaauacaucuuuuaaaauauuuaaauacauauagguagauugagaggagugugacuuguuaaguugcuaaggcuggaauucucaaccuguaccugggggcuaccaaaaacaucaaaauuuuauuauaauugauuauugcugauaaucagaaauuaaauguguuaagggaaagcaaagacuuaugaaucuugucaaaauuugaguguguauuuacuuuaccacccaacaguauacagcaaguuacaguagaaacuuuuuauuuacuguuuucccacugaagguuuaguuaucuuaugcuaugaaguaaacuggcaauagcua

SEQ ID NO: 6980 - RNA, 20650 nt, Mus musculus
gccggcggcgauugggggcaucggguugcggagucuucugcccgcuuuggacuacacuucccgacacgacucgcgaggcguugccagcugcgggccgagggcgaguugacgcgggagcucaggacgugaggcaugagcggcgcccucccucggcccgugcguguccugcucccuacccgcgcgagggucgcgcggcaccgggccuagcggcgggcaucggcguucucaggggcaggugcagccgcacgggcgccagggagggcagcugccaccauggaggugagcgggccggaagacgaccccuuccugucgcaguugcaccaggugcagugcccagugugccagcagaugaugcccgccgcgcacaucaauucgcaccuggaccgcugccugcugcugcacccugcggggcacgcggagccagcggccggcucucaccgcgcuggggagcgggccaaggggcccucgccacccggcgccaagaggcgucgacugucggagagcucggcgcugaagcagcccgccaccccgacggcggccgaaagcagcgaaggcgagggcgaggagggcgaugacggcggcgagaccgagagccgugagagcuacgacgcaccgcccacgcccagcggugcgcgccuuaucccggacuucccgguggcccgcuccagcagccccgccagaaaggguauggggaagagaccagcggcugcagccgccgcaggcagcgcauccccgcgcagcugggaugaggcggaggcgcaggaggaggaggaggcggggguggacggcgauggcgacgcggacguggacggugaggacgaucccgggcacugggaugcggacgccgccgacgccucguucggagucagcgcgggccgcgcgcauccccgggcgcuggcggcggaggagauccgacagaugcuggagggcaagccgcuggcugacaagaugcguccagacacgcugcaggacuacaucgggcagaguagggccguagggcaggagacucugcuccgcucgcuacuggaggccaaugagaucccuucgcucaucuuguggggcccgccagguugcgguaaggugagugcugcucuugcuguuuuugccaagggccgcggagguauucugagccgggugcgguccuuagauuccggaccccuccucuggagagggaggccugggggcgcgguccugaugcgugagcggaguuuguaauacgcaagcaagcaugccauuuccccagauuccccagaccccuuguugggcguuuuucacaagaaaaugcccaauuuucuugguuuaugcagagauguggacagagauuugagcuaucuuuguggucauauccaugauuuuuagugacccaauuccaggcaggggacaugcugcaaacauuggggaagaaacauuuuguaugcuccauuuguuguggaaaacuaauuaaauuuuuucuauuauacuugacccccucucccacuaauuggcuuauucuaacugguuuuuggaacuaauagaagucucucuucugugauucguuuucaacaggcauuuccauaacuuucccauaccaacugcugcuugagaaaagcaucaauguucuguuuuagccacagccagaggagacugguuagaauaccguggguuuagagaacaggucacuggaagaauacuugagaaaauguggugaagugacaguccugcucauaggauacccggaccguccuguggacagucaggaaagggcccaggauuauaaagagcucuucucaauuuacgguucagacugcuucauucacaagcacauuccugaugcuuauccuguuuuccuuugcagcuccucucagccacaccucuuuauuugcuggaauacaucauuccuuuugugucugcuuguacucauguucucucuggccaagcauaaaucacauguacccagauaacauuuuuuuuuuaagcccaggcccuugcacucuacuccaccauugagcuacacuuccagcucucaaaauaacaugcugauugcuuagggugcugacuguuagcaucuugcccacuccuccaagauuuaaugguaguuacuccauuuagggguucggucaguagcauugguagcaauucugacaucuguguuacgacauggaaauagucagcuauugaugcuuguaagcuuugaaaaggucugcagggaaaugacuggugagucauggagaauugaguacaagagauuuacuaggccaaggcuucucagugaggcauguggugauaguuacaagccuauaugaugggggagccuaauuccaaaaggcacagguaagcugggauuuauuaccaggccgccagugucuaguaacacucaacuguacaauuuccagaaaauaaaguacuaccuuucuauucagggauaauuugucauucggcaagcaaccuucucucucucucuuauuuuuuucuucccauuuuaaauauugaauugcuaacaguaguauuaguagugucaaauacacauuuauugagcggugccagauauugaauuaagaguuuucuugagggccugaaagguagcucaguaguuaagagcacagacuacucugccagaggacccagguucaauuccuagcacccacauggugcuaagcaccuguaacugcaguuccaggggauccagugccgccuuccaggagagcugacagccucucuucugaccuuccagggcaagagacacacacauaguguagacauucaugcuggcaaaacacucuuauugcauaaaacaaauuauuauuauuuuuuaaaaagguuuucuugagucuuuccuuuguuuucuaaguacuaauaagaucaaauugcuccuuuuaauuuccuuguagaguggaugugcacaaguggcauguagcugucucauaugcuagcugcuuauuucccucagaagcuguucauuuugcuuuucucagcuaaucugcuggcuucccauuugagcuugguucugggaucagcucuuauccuggggccuuuagcauuauacucuuggccaaaggagaaagaauuuucucuuuggugagaggucacagcugucacccuggcuuugcuaaaucaagacuucuauucuuuauugggauucauaagagcuuaaagaguccaccaauaaagaaucaaaaggaguuaaggauggaggauggucagaauuggccuaagauuuaacuaucuccugauuuucauuguaaugcuuauguaucguccuucuaugcuucagcacucuuccagguucaguguacuuggcuaaguagauaugauacuuaugguacuuauacuuuuugguaccuaugcauacugcccagucugacuagguuuuuaaacuuugcauaucuuuuucuagaccaccuuggcucacaucauagccaacaacagcaagaagcacagcauaagguuugugacauuaucugcaacaaaugccaagacaaaugaugugcgagaugucauaaagcaggcucagaaugagaagagcuuuuucaaaaggaaaaccauccuuuuuauugaugagauucaucgcuucaauaaaucucagcagguauauuaacuuuuugcuauuuuuagauauuauguauguaagauaagauacauagaauguaagaucagguuguaaaguauaaaacaauauaaaccugcaacaaauguuaacuuuccucaagacacauaggcuugccauccauccucaacccccccuuacucucucuucuuucuuucuuuaaaguauuuuuagaugacaagagaaugcuuucucucucugauaaaugaaauaauugccauaucucugagcugucuguagaagaaaagguucuuuugauccauuuuccaacuuuuagagccuuuuaaucuaaaaagacauugugacuaguugaacucaauauaaagaucauuauuuaaggcuaggguauaaaguacuuaucuaguuuaugaaaacccuggauucuaguucugcccugcccuccaaaguucaugguuuuaucuuuccccacuauuuuuauguucaaaauuauuuucuguuuucugugccaagguaaaaauuguaagauaaugcucuguuuauuuucaacccuuuagaaagaaaaugauaguuuguuuuuauauguaaaacuucuuuuuugaguuaccuaaauagaaaaaauauuuucaggcauacucuuuucuuugauuuacauuguuacagcuuuuuacguauagguagaaauauuuccccaaacuaauaaaccguuuuucuccagaucugaaucucuuugcguauaccaacaccuuagcguucugccugauuugggcuuaaauaugcgaccagugaguugacauuuccccuuuagacaaugucugcuggcugcaucuucaccaguuccuuaagaacaguuaggugaugauugaaguauguaggagaaaaacauuuuagaaauacuaacaaugaucuucuguagaaagcugguguugcauauguucacacuguguacuagcucaucaguggguagaagguacuugucuaaccaagaacuaguuuauguuggagcuguuagaauuguaccugagaaguaccguguucuuccagcaagagaccagaguuagacacuggcacccagaaguugcacuuuacauaugcuaacuaagacagagacucuugaaauggaugugucuaaacugaugaauauccugaaaagguaaaauuagacaaugaaggaauagauaggcaacuuacguaggaugcugcacguggcucuugaguggaaucacuuucuucucuuuuccucccaugguuaggacacuuuccuuccucacguggagugcgggacaaucacgcugauuggugcgaccacugagaacccuuccuuccaagucaacgccgcccuucugagccgcugucggguaauuguucuugagaagcuuccaguagaggcaauggugacgauuuuaaugagagcaaucaacucacugggaauccauguccuagacuccagccguccuacugacccucugagccacagcagcaacugcagcucugagugaguagauugugugcagccccugggugcccacaccucccugggaaucucuuggcggagggccagagagggcugggccuuaggcaggggaagggugaggccaaguggagccauuggucugccuguaaggaagcuaaaggaggaggagaguguuugcuucugccuugcaggaccugccuaaggcucccuuuccuuaaggugcaucuugugucuacugagaggugugucugcaucucugagcguuagcauugcuuuguuauuauuguggugaccagggcauuugcuuuuaugcuucaugcuuuuuccucucucacuuacuuuaaagguuuagaaagacuauaggaagccuuauuuaaaggcuuaaagccacucauuaaauagaagaaauagauauauacuguagaauuaauuuacacauguuugaagauuuguguuagauucagauuucuuuuugccacacaguguaauuuucaaaguauugaggaaaagcuaauguaauucuacccauacaauuacuuaaaacauuuuguauauuccaaagcucauuuccauaaaaguaaagaaguguuacugaaagugacauggucugaaagugacaggcugaagagacugucucauuccuuuuguugacuaacucugcaucgugaccacccguagccuuucuugugguuaauccguuugauuucaugggucagagguuuuucuuuauuguuagaaauguuguucagaagucauuuguucaugugcugacugaaauaauacaguagaacaucauguggucugaggagaaaccauugcccaccuccacaugcuguagaccagacagcugcuugugcuugcuccaaggccaaguucuggggccacuuuucagugaggauuaaaguacaaggcauaguuguacccucagguuuuagguuucaacaguuucucccugugugucugcauucucucauuugcuucugucuuauauuugggaagaacacuaccaccaugccucauuaaaaaaaaaaacuuugaaguauuuggaucuuugggcagaaugaaguugcuucauuguagaguacaguuauggaauggccauuagaaguuggccagaaaaaaaguuugggaccugcuguuaucugaccauuguugucguaucaggggcccuugugggcugggucucaggucauuguaucuacuauagucuuuucucugucuuagaggguuaguucaaggaccccucacgaguaaauguguagguacuuauguacucucuauaaaaagaugcagugcuugcauuacaucuauacacauucuccccguauacuucaaauucugauuagauuguuuuuuaguuuuuaacuuuuuuuuuugcugucaacucaauaccuuguucacgacaaauguuuuauuacugaacugugcuuccacccucccuaaaguacaaugccuaauaugauacaaaugcuauacagauaacuguuacucucuguuguuuagggaauaggggcaaggagaaaagaucugcacauguuuaguaaaacacauuuuaaaaagcuuuuuuuuuuuuuuuuguuucugucaaagacugauagaauuuuaggcuguagagaauccaugggucagguguagacucaugucagcaugugguaaaggcaaauugaaaagagaaaagcaagccaggcagugguggcgcacgccuuuaaucccagcacucgggaggcagaggcaggcggauuucugaguucgaggccagccuggucuacaaagugaguuccaggacagccagggcuacacagguuuuuggucuuaaaaaaccaaaaaccaauaggaaacuacuuuuauccuauauguuaguuguaaugugucuauaaguuuaugucccgcauauuuagggucauuuuuauuuccugggucugaguuauccaugugcuuccaggcuucuuguucacugcucugucaugauugaacugaggucaguagaacuguggggcucaucuucaugcacaggguuuccgugcuuuaagagauccccagaugaucugcaggcacauaaagucugaggagauucaguagaagaauuaagaccucauauagauacagaccugcuaaaauggcguugccgucagugcaaaccucccauauccaacauggcuuacuguugucaguuguuuagagcugauccuaguuauggcuucuuuucauucuugcuugcuucuucuguccuccuccuuccuggguaugcuaagaaaaugggaaguuguccuuguuuauauacccaucacccaucagucuuaucuuaccugcuuggugauugguuagagccugaauaaaucguagcuuucaaugugaaaaccaugguuuaauucuucaggacuauccuucagaggagguaaucgcccagguaugagaaccuuuuuucuuugguaaaguaucccuuuuucacaguaaaguaaguauuaaccuuagcacaauugaugacugaauggcuagcauuacugacaagaaguuaggagauguuguagaucacagaaaaacaaacacuuucuaggugacuuccugaaagaaguagcugccaccucaauugccaagaauaauuuuugacuuucaguuuuuguggauaaaguauuacuuucaagucacuauuuacuagugucaacucuauguucauucuuacacacauuaaucagguugguuacacugaucuagguagaagaaaagacucagcucccagucauugacuccucucugggaauacugugcauccauuugaugugauauauuuugaugcucuagguagaaacuagaacaugcacagagaauucuagacuguugaaggacgugugugagguggcagguguggcaucuaagaguaauccaggugaugcuuacgccacuagauuguauuugcaaauccgaguucucucucucucucucucucucucucucucucucucacacacacacacacacacacacacagugucuccauugcagcagcacagaaauauucaguuucuugcuuguuuuggugcugggguucauauccaggucuuuucaguugcucagccacuaagcuccaccuaucuccaccccagccugcgugcuuuuaaaaagaaaauuccuuaggccuuuaaucucugcauuccugaggcauuaaaaguccuagaugugcuagguauuggcugcuggguauugugcauguugaaaaguacauuucugggcuggugagauggcucaguggguuagagcacccgacugcucuuccgaagguccagaguucaaaucccagcaaccacaugguggcucacaaccauccguaacgagaucugacucccucuucugguguaucuaaagacagcuacaguguacuuacauauaauaaauaaauaaaucuuuaaaaaaaaaaaaaaaaaaaaaagagaagaucuuuguccaggaaaacuacaauggagauuuuaaaaaaaaaaaaaaaaaaaaaaaaaaaaaaaaagaaaaguacauuucugugcuuguagagaacauguagugugauaagagccagacaagcaaagagcucguaguauuccgcucuggucgucuguacaagagagcuccuuaaacuugguauacuagagagccuuuucuucaagaacucguaugaccccaaguauauaagagagguauagaagucagacuuugaugggugaugauucauaaagugaugaugauggugaugcuuauguuuugguuuuucaagacaagguuucucugugcagcucuggcuguccuggaacucacucuguagaccaggcuggucuugaauuucaagauccaccugccccugccucccaaguccugggauuaaagguauucacuaccccugccuggcuaaaauuauuuuaaaauaguuauuuaguguacauguaaguuuuuucacuaaagaugaaacuuauuugcuuaauaaugaggugaauguaguuguuuguuuaaaacaauacaaaggauacacacugauuagaacuuauauacugaugaaugacaauagaaaaauauuaaaagucuuuauuguuuugggacuggggauguaucucaguugguagagugcuuuucuagcaugccugaaguccuggguuugauucccagcacugaaaaaacugggcauggucauauaugccuauauuccagcacucaggaguagaggaaagaugauguaaaguuuaaggucauucugggguuuauaguucaaaccaggugucuugaguccagguagacagcauaagugacaugugucacuuaagugcaucuuuacaaagacuucaucucagcucuugcuucuuuuuauucagugagccaggcuggcuucuuugguucucccaugaaauuacaaauaauuuuacuuuccaguaucaugugcugaauaauacccaaaaacuaaugugugaaagaguucaggccucuagaagagaccauggaguuuccugugaucugcuuaggucaaagcuuuuucuccaguuggagaagcuaggucccaagucuuuuaccucuguaucuuguuaaccagaaauacauuuucacaugcauuugcuuuggccaauuuuuccuuauuacagaagcuuuuauaucuuuguuguuguuacuuguuguugcuauuuuuguuuguuuuuuguuuuuuuaaagaaagaucucacuguguuaccccgcuguccugguaacuugcuuuguaggccaagcuggccuggaacucaggacuacuugccucuuccuccuggguuuaaauucaugggcuaccacaccuggucauguuacuucuuuauuuuguuuuucauuuauuuugcauguggauuuuggugcauguaugccauguaacacauguggaggucagaguacagcuuacguauuaauugguucacuccuuuuaccacgugaguucugggaaucgaauucaggcuuagcagcaagugcauuuaccuacuaagucauccugccaguucccguuugugaccucaucacaguguaguuugcuauuuguuauuuuauugcaggauacuaugaaauuuuggucagucuaguuccaaaguagauuuuacucucaauuaauuuucuuuaacuuuugaaguuucuuucuaaauuggagcacuccccccucugugcaugugcauauacgugcauauacgugcaugugcauauaugugcaugugcauauacguaugcauguggguaggaaugacaggcuucugagagucaguucucuccuucucuacggguucuaaggauugaacucagauugguuuagcagcaagcacaugugcucacugagccaucucacuggcuccuauuuuaucauaguaugaauuauuuccuccccucauucaauuauaagacauuuuaguuuuaaauuuuaguauuuuuaaaguuuuauuauuauuauuaauaauaauaauaauaguaucagugugucacuuugugugcuugugcagugcguggguaugugagugcuggaagaggucaguuagaaccaguuagaacuaggagucaaagaugguugugagcugcaccacguugguucuaggaacugaacuugggucuucugcaagaguauuacaugcucuuacucacugagucuucuuucuaacccuaauuuuuuauuaguguguguguguguguguguguguuaugaugugugugaaugaguacauuuguaucaugcagcauaugggaggucagacaacaguuuugugaaguuaguucuuucuuuauguagguucucagaauugauaucaggucuccaggcuugcacacuguccacuuuuaccugcugagcuaucuucacugcucccagaguauuuuaaugcaccucauguaauuacucgucacagcuuuuaaaagcaggaguucgggacguaacagagugguggguagaaccuuggaaauuccugccugguguucuuaaguggggauugucauccaugcuuugcuuaugcccacugagugccaucagcacagccccucuuacuauuuggacagaguugcugacagauuuauucuguuuuuaaaauacucugacaaggguaaaguugcaaguaugaaucauauaaaggaaagaaggagugguggcucugugacugcaaacugcauuagaaccuguaaugacagcuagcuggauuagcucuauagccaaacucugggugcaauauagacagcaauugaggaagauacugggcaucaaccucauaccuccucauguaucaguguacacacacacacacacacacacacacacacacacacacacacuacacaccgugguuuaauguuuaagggagcagcuaauuuucucaagaggauaaccccaugucuacucuugaggcucuagucacagugugcuauuuauaaaucuuugaagcacacacuuauggaagggacauauacuacagugcuaauuuuaaagaccagcauugugugcuucuauuuuuugauuuuuuuuuuguagguucaauauaacauguauuugcuuuagaaaugaggucugagcagcuauuuauuugaagagcauaaaacuauacaguaugaucccaguaguguuuuaaaaauuagcuacacucuucaugguugguugacucauaaaggaaaauuaacaaaugacaauguagguguuauuucugguugauagaaauaggaauuuuguuuucuaaugcuuuauuuuuuuaagaaaagagugucucgccuugagaugauaagaaagccaaauuagcccacucauuauacaaauuuugaaugccuguugucuaccaggcauuggaacuaccacagaaggauagaccucccaccucugccuuugugcuaucuuuguaggauaauaaaaacaauuucaaaaugacauucucaaguacugcacucagugcuuauuggggucucuaagaagagaacagugguuaacagcacacuucaugguuuagggcucacacuuucuguguugagaagaggcuuuccucagagacaaaagaugucguuuucauuaguuccaaggcaaacuggaauuauucaggcaguuuccaucgucuuccucccuggcaugcccuucucgcucaggugacccuuugguucugguccuuucucugcacauuuuguucaguaugugucuuuugauuuucuuuuaauucaucuucaagaaaaucccaucucuaguugauaauuguuuccuaggcucuacagaaugcuaaugguguagucuagauguguggugaaucuucuggugaagugucugcugguuggagcugccauuagaaaggaaaaaggccauucaccagagcugugaggcucaggugguccucaggagucugugaagaaagcaguguuagaaaguuacaugaugagaacuguaguguccuugcauuuuugucaaccuacacacuggagucauuugggaagagagaacuucauaaugccugcauccacauugccucuaggcaagucuguauuuucucaguuauugauagauguaggagggcccaguccgugggaggcaaugguacaccugggcaguuggugcucaguuguauaagaaagcagacugaggaaaccauggagaacaagccaguaagcagccuuccuccauggcugcuguuucaguuccugccuugaguugcugcccugacuuccugcagugauggacuguuacuuauaacuguaagaugaaauaaacccuuuccuacugcuuuuggucauaguguuuaaucaaagcaauaagaacccuaagacacagaaugaaugacuagaaaucuaggacaacuuaaguaaagaaaaaaugucauguuuaagaauuauuaccauacaaaguauuaaauuucaucauggcuuuuuuuuuuucaaauaaauuuugguguguuauuguuguuucuaguucucccaucucccuccuccgaggcugcuuuugaaacauuagccauuacuuuuguggguggguagguaguaacaaacacuaugccaacuccagcagacagcuggauccucuccccuucaagaugcuuucuagcccagccuaguucacuguuucccagguagcugguuuggacaucugugaccaggacucauuguuaccauaaauaguuuuaacugaagacuggaaaugacgugaaugagcuaugaauuuaaaaaaauauauuuuuccuacaaaaaaauacaacuagucacucaaucaaaaauaucccaaauaacauguguuagcugguugacgagguuggggagaaaaauuuuaucaaaucaggcuuuaaagauaguuauaguuugaccuucuuuauaaaggucuaaacuuagaagugauugugucuagauaguauaacagaaaucccuaaguccacugcugggaaucagguaggaagauugcuaaguuaagggugcauucauuggucuucuaagagagacuaugccucaaaaccaaccaaccaaccaaacaaacaaaccaaaaaccagaaaaauauguaaaugaauagauguuauugugaaaaucaguccuaaaacguuaggugacuuacucaaguucugagagagcccucuaaucaguuucuaggauagugugaaguaccacaugcucuuuauuacacugggaagauuuuauaugauuaauacccacagaaaguggcaugcugccacccaagaaugccauggcccaaauuccaaagaccuguuguuccuuggucugcugugccagaguaauugagauccuuguuuguuugcaagaugagggauuugggcuuucugauuaaagacaugugaugcugucuuuaccccauguggaaggugauccgaauauuccugugucaucagauguggauuacccuugacauacauaggcuuucuauacacuaugcugacaugcuagcaugucuaguaguuuucaugauuuauaggcuagaagcagacagcccacuuaucaacagugacuuuucauaacauuugcugucuugcuuuguacaagucuguauagauuaacuuguacagugagguucucugugguucauagauagacugugacagccucagcuugugagauagagugagauacccuauagaucaugucugguaaaguguagugacauacccuuaggacuuaggaaacuuggucaguucuuagucuaaauaaugcuuaauuaucuauguuaacaauaugaauucagaauaaauauuagaaccuuugaaccagaauguuuuacugaaguuaaauuacgaugugcugcaaaugagaaguugagccuugaguguguugguaaugaacacugguuucuauugcaggcccucugucuucauagaagauaaagcaguggacacucuggcuuaccucagugauggugaugcccggacgggcuugaauggacugcaacuggcagugcuggccagguuaagcucuaggaagguguucuguaagaagagcggucaaaccuauucuccuagucgaguucugaucacugagaaugaugugaaagaaggccuacagcggucccacauuuuauaugaccgugcaggugaggaguugaacgaugggaaaaguagaggugcagggacaaaugugcccacagcucuuuccacccucugaccuucagccagguccaaagcgugcuccagaugcucaauuugaucugcauauuauaauggaaguaagccuccuacacaggacugaagacaggcauaaaacaagcugucuugauaagaaucaagacgagcuugggaguuugaaauaggacgcuuccccuucaucuuguacggugguuagauguagauuuccccuuguugucugauagcaccuaggagaacacggcaguuugaaaggccaugaauucaguugacagugauucuugugaucacuuacaaagucagugaggcagaaaagauugguuuauuugagaguugaaaaauccuccauuuuuaauauuaaagaugaguuuacaaggauuuugauaguuugguuuuauaguagcuuugaaauuuugaauuuugcaguaugugcuagguguuugcacagaaacauguuuauagauggcagauaucccagcucuuauuaaaucugugaucugguaauauuaaauaucauaagcacagcauauuuguaacuucucauuaaagguagagaugaagauggcuuauugaagauuaagcugaacucuauucuagaacauuugugugacucugaauaguaucacauugcgaaacuauggaguggaaucuccaugccuuuaaaaguccugccaggagaagaagcugauaauugaaucuucccggucucacagugacugugccuccauucugguauuucuuaaugaugagaguucuccuuacaggagagaauuggaggguggggcuguagaauggcccugguccuagucacugcuuuucaugagugaacuggcuggccauacauccugagugacugaagcaucccuagcugauaauacugugugguguaacuagugcugacacauuggucaccccugucccaucuauguugugcugagcgugggcuccagccagcggccuuuuugcaugcucucucuugaauaucuuguccuugaaaagccugggaaguaaaauaucuaggcauaguacccuacuuugcuuuaagccaaauacuaacacgcgauaaaagcaaacugcacauuuuucagcagugagcaacuucucacccaccuguuucuuuuuccggaggcccaguagcaguggucuuuaccuccccggugagcagcccagaagacccuuuccuuugacuguuucauauuuaucaggucacuagucacaauccauaggacauuuaugagugaucuuuugaguuuuuuuucuuuagauuucccaaacaaccauauaagguagcuuauuaauauuaucccuacuuuauauaaaacucaucucaguucacaaagcaugugcuaaaacugauucuaaaauucaccuuuaucggggucuguuaagauggcucagcgguuaagagcacugacugcucuucuggaagucaugaguucaaaucccagugaccacaugguggcucacaaccauccguaaugagaaacaaauaaaaaaccuugggcgggauugagcagggcccggagcaagagggagaagggaagggggaaaaaguucaccuuugucuacuuccugagaagaugugcugucucacugccugcauauaccccaugccuaccuccuagagucacuaagucacucuaccuagaccauguuacugagaagagacacuuggagauguucagcccuagggagcuauaugaggggcaccuucuuacuagcccuuugcuauuccaggaggagcugaaggcaguggaaguuccuuggcuugguagcacagccgggaggacccauaugucauaccccuauguuaaugugcuugcacugcccauccauaccagcaugucugugccacaggggaucaucagacacacauaaauauaacucacauucucaagaaauauacuuuuacagacugcuccagaaacaagaauuguagaacuguugcccuauaaauguguuagcuuagacucuuggaguuuuuuuauaacccugauuugacaaaaacaaacaaaaaacuaccauuagaggcuuuguuauuauuaaucucguuuaauuucacaaacuacacaguugcccccuaguaggauccaguaaggugguucagauguuuauacacuagagugaagauauuucugaaugagaacaaauggucugcccugcauugaucucaugcuuuuagguuaauaauaugaacucuccaauucucaagcugcauguaauaaaagcaaaaguaaaugcauuguuucugugggcuaguaauuaacauuaaagguuuaguuguucuguacuguucucucuguacaaggcccguguguuuaaaacaacauuuuaccuagugggaaucucaaggcauggagaacuugcuaaagucugcauugcuagugaguuugagguucagguccaaacugccucaggcuagagccuaugguacaguucacuguaagucaguaaagaugagugaccuguguuagagaguauaggguuaacaggcaugaaggacuagagguggcugccuaucccuucccaaccguaugcucugcucuguugagagaucaggguucagagugcccaaaccaaagaggccaaacaggggcuaacgccauguagaaaacucaggacacuucagccagggaccauggcucacuuuacuagagaagccccagucagaggacacugcuuauucauaaaauuuaguaauuagauucaugccuuugaccuggccugaaauuccuuaggaauugaaguuuaaagggccugcaaacuuagauacuuacccuuugguagaccagauucuugucacucuauuugaagagcaaaugucaucuuagcagcugcuaggauuuguuccuggagccagagugcccugcccaccagaacacugucacauuguugauguagcucaugaugucuacagagcaggugcuucucuggaaggacuuaggaccagaggacuuugccucucagcugucauguucuuaaacuuccacgagagaauggucaaaagacauggacauguguaaagagcgcugcuuauuuuugauaacuguucaucuauuauuccguucuuaagugucuuuucuaaaguacauuuugcuaaccuguuugcuugugaaucuaggauuaaagaugaacuaaggccaaauggugaggauggggccacagugcuuugaggcuaagagccauuauuucauuuaucaauacccuaagauccugcuucacaaauguccccacagucuaugguguaaugaccaugggcuucagauaccaagaugucaacuggcaaugccacugaggaacaaaugagcucuaucagcuguccuucccacuuucucucaacccugaugaccaugaccaggccagucaguuucacucagauagauucuaugugggcagaagauggaaccaggacaugguccucuccauuuccuuugccagccucuaagucuaaguguccucaguguguauaaccgucaggaguuucuccucugaauaggccugcugugaaacaggccuggagcccugagugagcucuguggcuuauccagguuuuaccccacugaguguggcuggagggcagcugucaugccugccuuccccagcacaacuggggccuguuuuaguaugcugcuuuguaugucguguaggcauacaaggcagacacgugacuguuguucugguguauaggagaagagcacuacaacugcaucucugcccuacacaaggcuaugcguggcucugaccagaaugcuucccuguauuggcuggcccggaugcuugagggaggagaggacccacucuauguggccaggaggcugguaagguuugccagcgaggacaucggugaguggaggagaguuuguguggggguggggguucugagagggggugugcuuacucuaguguggagucaugcagaguagguaggaaaagaaagacuuguucugagcucaguggucgguugcuccaugugcaugugucugacuauuuacagagucacuguuucugcuucuuuggagaugaucucaaggucauucaaaaugccgauguguaggagagaguuuagguuugcuuuguagccaauguuaagguuuuuauucguuaguucucagguagaaaugggagguucuggacaccauucaagacaaagaauagaaaaguuuuccuuuucuuacuauagauacugugcuuucauccauccauucuuaugaaugccuucauggcuuugaacuuugugucugucauguuuaucagucucuuguuuuuccuacuggaauauauuuuuccacaagaggccauuuugacaccaacaguaacucaauaaacaguaacaacuacuauaaauguaaugugauuggagcucagagauaaauugauauaguugugcuggguauuuuaucccuaagucugcaugcaguagugguugcuguuuacaacagcacacugacagguuggaacaagaguauccugugacuuaaacuucgauuugucucuuguuguaugauaggccuggcagauccaucagcauuagcacaagcaguugcugccuaccaaggcugucacuuuauaggcaugcccgagugugagguaagauaccagcucaguucuuugcaaaucuucuuuauucugugcccugucuuuuguggguuugaauauaagucuugccuucaucacagguguguuagguccacugaacaagcugcucagcuuugaacuuuguuauguagaaucuuagccuccuaagagaugagagcuucccugucucaucugguugugguuugguuuugguuuuauaauauuggggcuugagcccagagcucauaugugcuaguuaaguccuccuccacaguacuauccacagcccuguuuuaacuuuuuaaacagucuuauggguuguucaaaauaguccuuaacccauucuuuagcccccaggcaggccuugaaguuagaacuuccugccucagccuccugaguuacugaaguuauaggauugucagaucaagcaugcuuucacaccauccuuaacuuucugggaacaggaagcaguggguucaccuccaugccggacagucauggcaucugcuuuaugaaccagggcucaagaaauauuugacuuagugagaaguucauaccuuaaaugagaacuacugauuuaguuccgcucucaccauguaacacuuucuccauuguuacuaauuguccagacuaagugaaaagugggcuauaaaaauuaacuuaaaaaacaagcaagcaugggaaucauguaagaguuaacuaggaggaaucauaaagugcucugccaaacagaaacugugccaucuuccuggugacaugugcccuucuguguccuaggugcuucuggcccaguguguggucuauuuugccagagccccaaaguccauugagguguacagugccuauaacaauguaaaagccugucugcggagucaccaggggccccugccuccuguaccccugcaccugaggaacgcgcccaccaggcugaugaaggauuugggcuauggcaaaggguacaaguacaaccccauguacagugagccuguggaccaggacuaccugccugaggagcugagaggaguugacuucuucaagcagaggcgguguugacucucgggccaugaguaggaugcuuguaucuugaggaaggccaaaagucacuggaucuuggaguugguugccuggggaacauuaaaaauagaccaacauuuugugccagaaauuaaggguuccauagauggaggugguuacuucagcuaaauguguaccauugaaauuguguucauuugcacccugugcaaugauuaugcuuaugaaaauaccuggcagcuuugugcaauuaaguaauguuauaaggaauuaucuauuuugucauaguauuuaagucauaaugucauuucaaaauucuguucuguaggcuuuuuuucuuuuaaaaaauguauauucuggguaguuacaauugguacaagaaaauguaauugugauuuaauacugcauagugauuuggguauuuuuuuuauaugcaaaggucuuaugagccaauaaaacuauuucaaaguacucuu

SEQ ID NO: 6981 - RNA, 1009 nt, Mus musculus
agauuuuccaaauuggugguguucaaguucucaaaauacauccuuaugauucucuggguuuccuugguggcccuuagaucccucuuuucuuccaauucuguuaaauuggaucuucucucuccauguuuaauuugguuaagaguuugucaaucuuguggauuuccuuaaagaaccacuccuuuucucauucauuuuuguuuguuuguauguuuugggugguuuugguuuuugagauuuuuugguuuuguuuuuuguuuguuuauuugucuccauuuuacuuauuuccaccaugaguuuguuucuugacaucuacuuccaaaauggugugaucucuuccuuuucuucaauaguuuccaaguuugacauuaagcuauuaguuggagaauugcccaauuauuuuuuaauguagugcuaugaacuugacucuuagaacucccuucauugugucccaaaaguuugggucugagucuuuucauuuucauuaauucugaaaaguucuugauuucuucccuaauuucugucuugacccaauuuucauucacuacugaauaguuguucaguuucacuaaguucauaagcuuucugcuaucucuguuguuguugauauccagcuuucguccaugguggucgcauaggaugcauguuauuauuauaccuuucuuguaucagcugagacuuguuuuguguccaagucuguggacgauuuuggagaaaguguccugugauguuuuaauagccacuuuacaugugguauguguacacaauggugggcguuuuuuagcuauucagaagaaugaaauuaugucuuggcaggacacugaacagagcuagagaucaucaugcuaagugaaguaaucuaggcucagaaaggcaaauuguagggacacucaacuggagucagcucaagacaccccaagaccaaguucucagcacaaaagcagauuuauuugccauaaggagagaggggggagguggagggauagagggcggcaacuaguuagcauaaaac

SEQ ID NO: 6982 - RNA, 15808 nt, Mus musculus
guauuuugcaaccauuaauuuuauuagggcuuuaugaauugucaguuuuauguccugguuuuuuuuuucuuacucuaauucuaaauuggaaaacaauugaaugggaaaagccauacauuuucaugccuaucaggagccuauuacaauugcacagguuaccucacagucaugaaucuauacaucuauuuaauucuuuagcuuuuagacgugauucuguugacaguggaaauuagauuuuucaggggaaaaacaauauauacauacccaugccaauggauauaaaaagccaacauacaaaagaaacauacaaaacauacacacauacaaaagaaagaaugauuguguuuuguauagagguuuuauugacaaggacuaauggaauaaucaucauuaaucucagggaaugaaaugcuaagcucugccuucuaucucuaaagucuccuucuucuauggggaacaaacccugccaaagaagaucauauuagcugugggguugugccgaauaaagaaaaggaaugggugauccacagugaauacuuccuguggaguaggcaucuucucgcagagcaccugaauaaugccuccuguggcagcagcugccucuguucccugcucauuaacauccacaaaugacuuguggacaauuuuugauacgaaaagaucucuggauccugacaugccagagagaucagccuugccacuacuaaagagauccugcacucccaggcagcacagguuagaguugaguauguagcucucuuccaucuugaaccugggcaauuugacauggacaucaauguuucucaaguucucauguuugguccauucaugaaguuuucccaaaguuaauugcuccucaaucuggaaugaauuuaaggcagaaagaaguuaauuuacuagugaaauaaaguacuauucaaaugaacaauccauaauugccaaaacaaauagguuuccuucauguuuucaucacaaacagauucuaccugaauuucauuuuuugucuaucaauugguagaauauaacagaacuauuucaggucuuugaggguccaaguacaaaaacauuuaauuauaggucugucauccauucaucugugcauuaauuuaucagucuauccaucauucauuuacccauccaucaugcauucaucuauuaauacauccacccaucauccacucuucauccaucuauccauccuucaugcauccuucuaucaauuuuucucugccacacucacuuacuccuucaauucuagucuucuuucaguccacccaucuacccauccuaucaugaacucaggauuucuaaaccuccaucacacugaaugacugaugagcuguaagaggucucauuucccugguuguuugaaugguacaagcaaaauuuuagaagaauuuucuguuuauucugaaacauucuuauguuauagugaccuguaaacuccauuagagcugaaacaaucucuaauaacuccuggguaaaaauaaaaaauggacaaaauguaugagacuuaguucauuuaaaacaaggacaagcaucugacaugggggcauauacccugcaaucacagcauucagguacaacugaaagagggaugaaagcuuuggcuauacagaaagaccuuauccuuggaguggaguagaauggaccagaguagggcagaguagaguggacuagaguaaaaaauaaaauacaauaggcaugcuaaugacaccaacuuuguagcauuguugugaccauugaauaaauugauauuuguaaagggcuuggcacauaguaaggaccguauaaacaucaaguauuauuguuccuuuuuaggaccaaaagagaaccacuuaucuuauagauagugacaauuugguuuuugagauuagaaccuuauuuaauuaccagucagaaaacacaauugacaaauggaccuuguuugugccgguacauacucaguacauucaaaugacagcaggcuccuuccugauugcaaguguaggcugggaaggaacaagagcuaaggcauagugcagccgaggauugcugggggaacucuguaaucuucacaguuaucucuacuucuaauccugucaggagacauacaaucccuaaggauguaagucaauucucauuacaauuccuuucaagauacuucaagagacauucugugacaggccacuuaucauuguuacauuuucuuuaaaucucuagacauuccccaucgcaaugcuucacugaaggcagcaauuauucuaaccauuuaaauuuuaggccacugggcugggagcuuggcucacagacagaacacuugccuaacccaagguacauggucaauucgauuaauaaaugaugaugaugaugaugacaaugacaacaaggacaacuguaaaacauaaggccucagagcaguaacuccugguggacaauauugaccaaacugugagaaaacuaguaagggaguuugaguaaagucuguggaagaacaaguguuuauggugcaguguacaaaugugaaauauaagaacaguacagugaaaagaaacaggaaucaugacuuugagagccaguuaccuucuuaagacccguggacucauccucaaugucuucaggcagcagaaugaccaugcuaaguucuccacccugguaaggcaucuccagcaccuugcacuucagguccgaaauguaaccgaauggaaauuuuuucuuuugauacaucaucuucacuguuuuugugucuuucugaacaauuacaaaaaagaucacucaaaccauuuccucugcucuuuuaguacaaagaggaauuuggggucuugggguagaggacacaaugcuaaaggcuuggcuuacaauaggagaggcccugugcuacaaucccagcacucccacacacauacaaugaagaacaacccaggaugauggugucuccugaccuuauucagucugaauggagcauugauuguuucucuugucaugaauugcuccucccauauuccuuugaaguaaauggcauucacuagcacaaguuuggucaugcugucuaccacacccuuagccagcaguucugggauuuuaccugaaaagacaaagggaacuuuuuaaaagauccauauugcaauucugauuuuaaacucuuaacuuauuaacucaaacauauuuuguuuuaacucaauguuaagguggaaagacccaauuguuucauuuuuauuuacaauaaaccaacuguaaaccagaaaagcuugugccuguuaugcuguaaauguauguauguauguauguauauauauauauauauauauauauauauauauauauauauacacacacacauauauauauauauacacacauauauauauauauauauauagucauuauaguaugucagauaucuucaaaggauuauuuuauaaauggcuggucuucaaaaauccauaauggauauauuuuuggucacugguaaauaauaucuucaaaucugcuaaguaggagccugcuccuuugaaaaggguuuucaagaaauauccaagagauaagaagacuuaugcaaauguaagucuauugaaacagaaaccauuuccacacagccugaugcacugcugggaacuaaucaaauuccagacaagaucccugggugcugacucacacaaugacaagacugaggcgagauccaucccaaagcuaaauugagcccagagggugagucacucccuacccacuaguucugaguuauugaacaagaugguggccaaaaaaauaucauggcuguaacaguuucuaaaugcugacuucauaguuccaugaaguuucagguaucauuucuuuccacauucacucuaaacacuuuuguauuggcauuuuuauuaaucuuauucugcauuuuaauguugauuuuaacauuaaauagagcuuuuggugauccuaaagguauucaacugcuucuauuaaaucaugucuguauuucuccacuguugaauuucugacauuugaaguuguuccuuauucuagggaauagcaucugaaugucacugcacauaagccaggauuugggaaguugaggaagggagaaaggagaugcaagugagagaguguggggagugagaaucucaccuaucaauggcucugcugugguucagaggggucccccaaaggccccugccuuaaagauuuggucucuguuccauccuucauuggaaggcagaagaacuuuuaaagugcagguccuaggugaaaaucuauauagaucauuguggagucugucuuuuuuauuuguuuuuauuuugagacaggucuugacauaugugcucaaagcaaccuuccugccucagccucccaagaacuaugauuguaggucuucauugucaaaccuacauugaagguggggcacugcuauugaaaacguuugugaaacacugguuuauccuuucucuuuauucaucagugaggugaacaggccuccucugaaauguugucuuaacacaaagugcagugucaccaugaguccaaaagaaugaguccaauaguuuauaaaccuagccuccagcacugugagucaaaaucagccuuuaguucacaagcugauuucguaaggugugaguuccagaagggaaacagacuaacagauccagcacugcucagccucucaccuucuguuugaccuuugacccauugguuuaucuccuuccuugcauccucagaggcaugcugaaaauccacagcggccaagucagcacuguacauuuucuggguggaagccaagaacuccuauuuuuaaaaaaggaagugucaagaaaacuucgacucccuacagaacuuuucuaaaaucccaaagagaaaaagucauaaaaauggaaaaguuucauuaauaauucaccuauauuuuuucuauuguguugauauuuacaguccuaacaauuuuuuaagguuacagugcagaaauggcaaguauagcccuuuauuuaacauuucuugugcaaacacaaagcuuauuaauucauuuuucaucuuacauacacauuuucauaaaucaguaaauguugaaugcucaagugacuuuuaaggacuccgugugugauugugugugugugugugugugugugugugugugugugugguuguguguugguaugucagggugugagugugugugugugguugugugugguuguguguuggugugucaggguguguguguguguguguguaugugugugugugugugugugugugguugugugugguugugugcuggugugucaggguauguguguguaugugugugugugugguugugugugguugugugugugugugucaggguguguguguguaugugugugugugguuguguguuggugugucagggugugugugugugugugugugugguuguauguuggugugucagggugugugugugguugugugugguuguguguuggugugucaggguguguguguguguaugugugugugugugguuguguguuggugugucaugguguguguguguguaugugugugugugguuguguguguaugugugugugugugugugguugugugugguuguaugugugugucaggguguguguguaugugugugugguuguguguuggugugucacagugugugucagggugugugguugugugugguuguguguuggugugucagugugugugugugugugugugugguuguguguuggugugucaguguguguguguguguaugugugugugugguuguguguguaugugugugugugugugugugugguugugugugguuguaugugugugucaggguguguguguauguguguaugugugugugguugugugugguuguguguuggugugucaguguguguuugugugugugugguuguauguuggugugucaggguguguguauguguaugguuguguguuggugugucaggguguguguguguguauguauguguguguuugguugugugugugugucaggguguguguguguaugugugugugugguuguguguugguguuucaggguguuuguguguaugugugugugugugguugugcgugguuguguguuggugugucagggugugugugugugguugugugugguuguguguuggugugucaggguauguguguguaugugugugugugugguugugugugguugugugugugugugucaggguguguguguguauguguuugugugguuguguguuggugugucagggugugugugugugugguuguguguuggugugucaggguguuuguguguauguguguguguguguacauguguguguauuucuguaagugguguuuauguguauacauauguguauauggguguacauaccuauucaaucauggaguccagagaagaugcaagugucuuauuucacucucugccuuguucccuuaagacaaauucucccaaugaaucuggcuaggcugguggucuacaagcccaagggguccucauagcuccauuccacacagggcugggguuucaagagaguauaaagccaugccuggcauuuuucauggguucugggguccaaacucagcuucucaagcuuguacaagaagcacucuuccccacaaaggcaucccuucugucuugcuugugcuuuaauaagacaugcaggagggauccuuucauuagagugacugagaugaaagucccacaugcauuuuguguuuuguuuguuuguuuguuuguuuguuuguuuguuugaaugucuugcaacauguccaugccaggaauagucugugucacuucaggaaguuucagaaugugaagaguuagguacuuacaggaaggaaauuguagguuuucucuccauacagucuguuagcaaguuucagagugugagaugcucccagcuugcucacuucagcagucaggcuuugaaagcaugaauggauguccucaacagagucaaaaugaagagucuaaaggaaggaaaacaugcuuuauacaauugucuguuucaaaguucugaaguaaccccuuggugucugguuccaccaaauauuuuuuuuccuaauaucaaguaucuacagccuaauauuuuguuaacaugacauuggcagaacaauccaaguacaaccagaaauguaugacucagugagacauuauaauuagacaugguuucucaauauuuuuaauaguuccccaaaugugaaugguuaaaacacuaaauauuuauaucugauuuuuuucauaaaugauuuaagugguaugcucauguuuauauucugugucauauacaaaguugcuaaaacaaaaauuaaaagucucagaacuguacuguguaaauaagacucaauccaucugugagaaugaaaauguaggacugacugaggccuucuucuuugguuaucuuacugagguccacaccucauucccuagagaaauaacuuccauaaguuuauccuggugagagcuuauuuccucuuccgucuguuguaugucaagaggccucugaugguugugugaggucugggcugguuacucacuucuagaacacaaaauacaaaaaagcauacaagguccacagucugugcuaaucucugagguauaugcuuguuagaaugcacuugcacugaaauggggaggaaaggacauuaacauuauuguuuccugaaguugucagcaguaaaaccuuaacauugaagcaaacauaaccuaugagaagcaauaagcagcagguacaaaguagccaggcagaucaauaaggaaacacuuugcccacuccugccuagacuuccaaagguggcaagaauuguccucucagaauuaaggaacaccgagagcaccccacacccauuaaggaagaauggggaggggggcaaaggugaccuguugucucccagggguggggugagaggauguagguucuguugaccaggccacuuuuacuuucccauugcuaauccugcagacccacagccagucaaaucaggcuggagaaaggcacaggguuaagccuggaaacacagacaaauggcuaucuuuuaccuugucccuacaauggguaccaccaccaagcugccuccuguagcuuguucccauaucuauaugccugaaguuagcauuguuauguuuuauaaaagaguggcagcaaucccugucaauauguuccccaguagguauuagccaugugacaauccuaauaaaaaagggaguguaggggggaagggagccagggagcagaugggagauuuggaaagagguagaggcagagaaaaagagggacagagaaggacagaaagagagagaugagagaaagaaaggggaagagacacuguaaagagagacagagagguggggagagggagagggaaagagagggagagggagagggagagggagagggagagggagagggagagggagagggagagggagagggagagggagagggagagggagagggagagggcacaagagccaagagcccaacagauuuacacuggagccaggcuccaaaucuggcuguugcuaggcaacuguugggcagagccuagaggaauugcuaacagacacugaauuacaggcauguuucauaaacagugaugauccauucaaaaaggaaaacaggaaacccauagcucugaggaagugcagggcuuacacaauuuacucauggaaguaggaggcacucaaagcccacaggucuuguccuuguuuuucuucacucuguuuccccaagugaacagagacacuacccuauguucacucgaagcugccggugaaugaauaacugaagguuuuugggggguugggguggugcgggcagugauggaaggagcagagggauuaggaggaggggagggcuuuugugaaagucugacugcaccaugucagcagagauauggcagggagagcuggccaguuuggccucugcuaaccuuagagagcugggcugcagugcugccuuuggcucccagaaagaccauggccaaggaagaagaaauacuaaauggagagaagaagauguuuccuguggggcugcuuuccuucaguguguggaacagcuccaaggugaagaggguguucgcugaacucagcugcuccauggugaaggcugcaacagacaggagaucagcuuugccagcuacaacacuaccaacaccuaucacagcuuugccacccaccccuagcaccugcaguagguuaauccggcucccuccaauuuuuccaaagaggcaagaauacuccucuaggcacacaaagcuggggccagauaugagcagugacauggcccagggccaagguugucuuauggcucuaacuuucuagacaggugugucuuaggagaaauuaugcuggugguccuggcacagugcccacacuacacagccuucugucuggagcucacacaucucucucccugugggaugucagguucgaauucaucugugcaaugaauccagaaaaccauauggaccuacucugcauacaggagaauucucguaagauaacaauguuaucauauuaguucucagugguuacaguccuccaugccugaggucaaggcuuuagucucagcuggaaugaaauaugcaaauuuggguuugccacucacucucccuagucaggcuaugggugacagggaagagagacacucuccugugucuauuuggaaggaagcuggucccugaaguggguaagcaaguccugcuugggacucacuccuaauccaucuggauccuaaacucagaacuccaguuuguccaaguacaggccauucacagcuguguaucuguggauguuuagcuaccagggcuacauccaguuaucauuuuugaggaucuaggaucucaccagcuuccuucccaaccuccaucccugcagccaggauugaagcuauggagcagcagggcacuguccucucagauagagguucaaaaagcaagcugaggggaaaaacaaaagcaaaaccaugacugggacagccuuccuuccucuggccaaaggcuuggcuuuggauguggcuggggaaccacaucgccuuucuuggucuggugucacaacuagggugagggugaggcauggggagagcaugcaggucccaggaggacgugcagagaggucucccacccucuugccaaccaccuuccugggaugcugcccauggcccuuaccuccucuguagcagcucuggcuccacuugcuagagaccuaggaagaagcucccaaggccagcugcagccuugacucugaaaggagagugucuuacuggcaagcacaagcugggaagagagcuuuuucuccccuggugaguacuuaaaacugugcuugcaugacugacaaaaugaaagcagaagauugcaagcgcccacagggauccauguuccuccauuccaggcuaugcucuacuucuccaagcagaguacuugauaaauuacuccuuccugagcugugaaaagccgagaggaaaaacauucucauuaccaaucaaaugauuccuuuuugaauuccacugaaagacugcaaaaaugcuagagauccuuuuuuguaaggugugugcauggggguguagaggcaccuuuguggccccuugaauaaggucacagugcuccaguuucuagcuacaccuauguaugagagagagagagagagagagagagagagagagagaaggaagaggaggaggaggaagaggaagaggaagaggaggaggaggaggaggaggaggaaaaaaaguccuuuauguuggguuccaaagaagcaacuggcuaacugugguaccuauuagcacaccaaaauucauucuggcuucuaucuuccaucaguaccuguagcucuucucaguuuuucucaccucuccccugaacuaaacaucuccucccuggggcccuggcuacucuucugcaagcuucucuuuccuauguaacccugccauuuuuggccauuugcucucuuggcuaucuugauucucuucgcucuuggucccuucuccugguccccuccccucucacaucuuuuucucuccuuucccccaucaccuggugcagucuacuaaccauguuuaucccacauggaacaugaccucaucucauucacuuuacugaccacugcagcccaguaaggguaaucacauucuguacaaaccugacaguucugguagugucucccauuaccaugaaugaucagguggcccugcuaguacugaguggacugagcaucuggaaucccuguuucuuuuagccaccauugguauuccuuaaaggaaggcgucagaggaggcuucuucaccaaggcagggucagagcucccauuugggccacuggaagaacagagcuacaagcaaccccaagaugugugcucuaaagagcagagguggaagaauggcuggcacaccaaagcaugguagucaggaagcuguccuguccagcucuacagccaagcuuauugucccucagcacugcugcagggcacuuccuucugcugcaagugcaggguuugaugugcaugcgcccuagucaaauagugucaucccacuagcaggucauuugauguaccaucuucaguuccuguuggagccauguucucuccuucaauaaagccauugaugagagaguacauaguaugcagacuuaacauguugcaugggagugaguucagugucauggaaggaaaauuacuguucccagcgaaggaaguccccuaagaucuuaaaagaacaacauuguucuuuuaaggcuggucaugaauucccaaucuccacucaaauaaccaguauauguccccauuagacaucaaguuguuuccauugaguccuuguucccacccaaggaucuuuagacaguccauucauucagcugccacacugaccagguguccaggcuauuggcagugauaccauagucaguaaaaauauagcuggauguggcggcagagguggcaaguaugacgcucaugauguaguggguauauuauauccaaucuaugucagaagacguucauaaauuguccagaaugucaggauccaucuuaggacaagcaaauaacuagcaggugaucuuccugagaggaccaccuuagacugaccucuacaucagaauuccaauaggcaaggugcaggagaaaauaauuuuaggaaagauuccuguuauuaauaugcuuuuccuguuauuauuaaacauauauaacaaucgcuagguauuagccuaccuauuuugagcagaucacuguagaucuacaaaaauguacuaucuuguaaugaugcuauauagacaaauggaugacuucuuaauucauaaugaugauccuauaagaauuuauaucaguauuuauuaaggucuuuuauaguagggcugcuauuagguguuuuucugauagucaaaacugcaaugagaacucugucagucucccaugcauccccagugaauugcuucuagauaguaaccagacuuucuacuacucagagcacauuccaaaagguugcaaagcaauuaaccaaaagucauaaaaagggaacuaaugauuuauuuuaggugcuagaacagaagauaaaauauugacuguguuuaucuauacaaaauuucacuaauaacuuaguuaugauuuuucauuuucagugaaccuguggagcugugacaggugaucaauguuaagccagauaauuacuccuaauggauaugcauguaaacauucacugcuguaaacuucuuauucgauuuaugaugugaauuuaugcaaagugguagugaacuuuuuaacaugugaucauggauucugaaagauguuuaagugcuuaggacaaagaaaagagucagaacugagcugaggauuacuuucuagacacaacauguuuuagucagaucugagcagaagcugcagagagagcaggaggggcaggcaggcuucuccuaaccaugggacagaacagaucuuuucuuaauaacaaggcaagcugagucuuauuaaagaaacaaagcuuucuucuuaaaaacuuggguuuaauucacuuagcauuaaaaggguagaagcuuuuacuuccucuaugcaauaaagauuggaguucauuuuucauccagaaugcgugacuucuuucugcacuggugcuuggucuuuugcuccaaaugcauauguaaguauggauuguguauauguauggaauugugagaauguaugcaagcugacugguuugaauggaaauguauaaauaugcaugugugaaucuguauauggauguaucugaguuuauggauauuugcuuauguaaaaguucuuccuucugugaacauuauucucuucuccuaaaucaauagaaguuuauugcuccaaagagaagagugagaaaaauuuuccccugcccacuuaggaccuuucugcuuuuccccuuuuuccuagagagcuuuuauagguaauuuuuuacaacuuagaaauaaaugcuauaaucacuuuucaaaauguaccuuuuucuucgcacuacuucuaccagcaggcugaaaguaagagccgcgcauuuccugcugagauagaacaaaggccacauuacuuaauccccugcugcuagacuucuggugucaauaccuagccagcagcuucuuacccucagaaggagcaagaaaaauuuuaggaccuuuuaguauaguauagaaucagcauuucaguauaguuagagagcuagaccguccagagacccucagucuuuaaagccacaccagaguccuacucugugucucugucucuacccucuccaggccgggaggcuccuggcaccauauuggcagcgcuguucaaugcacccuccugauugcaguuuacagagccaucaguggccacaccucugaauccuggacccuuagccacagguuaaggcuggagcauccacuagaggucacucuggugacuugcugguaagcuagacauuaaccuguagagucugcuagucccuugguaugucaccugggcccaacuuuuaauguaucauuucauucugcaacugaauucuguugugcuugucuacuuaagccaauuguguugaauaucaauguaccaagucuggaaggauuuuaaacagcaaaaauuugucucaaggcucugcacgcugggaaguucaaguucaaguugccagcagguuugcugucugcuuucaguauaguauccugugaagacagugagaugguucagggggucaagguacuggccacuaagccugaacacccggauuugaagccuggaaucuacacacaguagaaaaaagaacugacuccugaaaguuguccucugaccucugugcaagugccacagcaagcacacucauggcuguguacacacacaaauuuaaaaacaaaacaaaacaaaaacuuguuaugguguccucaaagauggaaaguggaaucaaauaaggucuaacuacaccuuuuauaaggucccaaucaaacucacaaugucuauuuuaauacuguuagaggauuaacuuccaauaugaaauuuacaaacaacacauucaaaaugcaguaucccgcccaccagcccugcucuccuugaacucaugucugcuauagucaggauaugguuugagcuugucuccugagcacucccguguuggauauaaugcccgcugugaaguaucagaagauagaaacuucguguguggugcuugggaggugggggcuuugaaaagugauuaagauuacacaagauucucaggguggggagcccugacugaauaagagaauaucauccucauuaccacuagguggcacucauuugucuguccuguaguaguuguagucgucaucguuguccuccaagucccgaccccaccccaccccucugaaaucugggagaaaucccugccuucagcucugcgaaauacuguccuggugggaacucagcagaggcacaaaaucuggcuccaaggggcauagcuuuuugguggcuucuuaucugcuuacauuuuuuaagacagagagaaaccagaagagaugcacaugcucucccaguuuuucuguuugguugauugguuguuugguuuuguuuucuucugugaugccuuacacuuccuaggaaggcuauuucagaugcccagccaugaccgugaagaauucauaguuauccagccacaguguuuuauuauaauaauauaaauggacauauuucuuuucacauacaguauauauucaucccaugccacucaacuuucuuucuaguauuaccaaaaucagauauaaauuucaaaauauuauucuuagaguaccugugaaaccaaacaaucuaguuucuuccaaaauaaaacagguccaguuuaagacagaauuuucuuuguaaaauucagcgacaggcaaggaaaaaguggugggcccuacaaacuuccaaaucucaauauuacaagcacugugacggcuugaggcuugagaauacccacaucacaccucccuaguccacaucuuggacacacacucaggaagggcaagguaguugauuguccauggcuuugauggaccucauccccaggugcauaaacgcagcagcucuuacaaacugaguccaguguuugugacuuuccuagguuguagcuauauuuaauaaucacacacacacacacacacacacacacacugccccucccuggcucaguuuucuugccuuuauuucugugaaacaccuuccugguggaaacuucacaaugacaaucccuggcuccauuagugaucauucugugguagguccacuugaaauccaggagaaugugccacacagauccccccucacaaucagcugaccugagacaucuugaaacaacuucaaggacuucaagaaggacagcagaaa

SEQ ID NO: 6983 - RNA, 25902 nt, Mus musculus
ccacccagccaguagcccugggcacagccaguaccuuucagaucucugcucaucuugcuaucuccaggugaaccuagugucgggguaggcuaggcugaugcaggcuuuggcacagggcgcuggggacgaggguggcaggagcggguguggcguuggccuagagaccugcgaucagggguagggguuucaucuugaauuaugcaguugcugcagugguucuuugacacugucuggagaguaagucuccuuguguucugggccagcugguggccacgccuucggcucugaugcaaggggcguuggucaguucagcacccacugaggaguugauuuguucacgauggggucggugucccagauccggauccacaugugacugcuugcccagacuuggagauccaggacucaugacacgagagacagucuuuggaaucucagagggcggggaccagggguggggaggugggaggagguggggaugaagaggccugggagugagugucaaggguuuuggaccugcuuuuauagacguuauggucuuugugaaguuaggcucaaacgacaagucuuuggaggcccucaguguaagaagaaggauacugguaaggagcugaccugaucacuuugauaugcuuucuacuaaacucuugucaggcgaaguguuaaggauccagugucugccuagacacgcagaaaguuuuaaucugauuucuguuccagauuagauugaguuaucuuuucucucccuuucucuuuguuuuguuggcagacucacagccuugcugugcugagcuugcucugccccuuaguaacagaccugaaaugucccuuucucuuaaaauuguuuugagaauuaaaaguacagaaaaauagcauucuugugguuucaauauuacuggaaauuuuagguagcccuauuuggaggaccacuugucucuaggaaaauugaguuucucuaauaguucuuagauuccuuauuuauuuacuuauuuauuuauuuagaauagacacagaaggaaacuagaacacgguuuuauuagaguuugaaagaaaugccagagaacagcuucugaggguuuugagacggaguagaggaggagacaaggccuugcuaauugagugagggugaagguucagcaagcagccaaauggcaaaaagggacagcgaauacagagcuaggaagacaucuuuaagcuguggccaggaaucagaaaguaagagacaaaagggagaaaaaagagaaaaaccaaggcuuuuccaggucuugacucagaaagauggccagagcaaacagagccucacagcagcuugggagggacauaacagauucgggcuuuugggaagggaaagugcauuaucuucucaagggauaauuauuacccucauauauuuaucuuggcaccagcuggaucuccuuccgagguguggucucuuaggcaguugauuaguacugauuguuuuugaguagccuggaauguuagacauacccagcccauagcuagaguucauucucuugaucugaaacagcuuuucuuuaaugggccucaucagagagcuguguagaaggcuaaggcuacuguaacauucuucucucugaagagguaucauuaaaccaguuacaagggguaaaguuggaaauagauguaacccccccuuuugguuuugguuuuguugccuccccaggguuucucuguauaacagcccuggcuguccuggaacucacauuguagaccaggcugggcuugaaaucagagauccaccugcuucuaccuccugagugcugggauuauaagcaauauaacucauuuuaaccaugaaaaucuagggaucuaguucuauagcuauucacuagaaggauuuacucucuggacuggaguuugguucugcccucacagguaucaagggcaauuagacucuugagcucccuucuggaguccuggucaggugaucaggggcauuacaggaacugauacuuuuggggucucugauccccaagugccuagucaguuuuuauguucuuuucuuaucauaggaacacaugaggagaauugugagggaaugcugggugaaguuuaguaguuugugugugugugugugugugugugugugugugugugugcauguggaagggaauugcuucgugacuugacuauuccuaaggauguuugcuccucuuggguguggcuuaggacuaggugugguaugugauggcugacuaaccuuugaguuaagaucaugugaucaugaauuuuagugcugggauuugagguuccagggauugcggauguuaucaguuuagacugggagugucuugcuuuucuggucuauccugaggaguugcagucacuauggcuuguaucaucaaauagagaaaggaauguuugguucacauuuggguccauaaacuaaggccaccuggcuuccuauaucugcaugucuguuuacauggauugcacauguauaaucagcagacagaaauaguacacugaaaaaauugggagagaagccaggugugaugguauacaccuguaauccuaguaaucaggagacugaggcagagggaugauaguuugaggacagccuggguuguauagcaagacccuaacucagauggacagaauucccccccccccccaccggcccaacacacacaccuuuuucuucuccaaacagugugguguacaggcuccauuuaucuggaaguuauauuguuuugaguauuauagguuaucugcagaugauuucaagaagugaguugagcacuggaguauuauggcauuucagacaccaacugaauauuuagauauacaggaaugacuguauuuaaaaucaaaccaggucaauuccagucuaaaucauuuugacagguuucuuuguguagcccuagcugucccagaacuuguucuguagacuaggcuggcgucagauuuagagaucugccugacucugccucccuccuauaaggaucaaaggaaugcuccuccaugaguggcccaaagcaucucucaaaguuaacuauagcuaacuaacucagacccauaagaauacaaggaauuaggacagagucagauucccuacccuuuaccccagaucuggcagaaacggcagacagauguuguaggaucucaugggagacccacacuucuguuucuaagcuuucuggaccuggguuaggucagggagucagacucuguauaccugcuagcuguguacugagccauuguucugacaagaggagaaaagaugggugaagagacugauucuccacagcuuagcaaauacugucugucagcccuuaacacccacuaagaagccuuuucccaaagugccacacaaaugucguucuccuugugcuuggacauugagaagguuggugugguaguguugacugucagauugacagaauacagauuuaccuagcaaauguugaucuaggcaaacuaugaguuuuguuuuguuuuguuuuguuuuaauuccuucugggcgaguuacuauuuuaauuagguuaguggaugugggaagauccgucccaaagugggcagcaccaucccgagcuugggccucauuauggaugcagugugaggggcugccucccuagcuucuuugccaugaggaaccaggagccaaagcaaauucuuuuccacuggaguugcuuuugucaguguauuuuaucacagcaacaggggacagagcuaagacugaaggcaagucccagaugagcucagucuaagaguuuuuccaucugacaaauaggugaugcagggccgggguggggguggggcaaagaagggagggagagaaagggagaacagugucugucuguaaaaaaaaaaaaaaaaaaaaaaaaccagcaauacuugcaaaauugucaccagagagaaaaggacauacucuugaauugcuagauugaaagguccuccggugcccuuucaaaugggugagcugugagcagagggcuaguuaaugaccauaugagucucuaagcuuucagaaaguugggugaaggagggaccuugauggagcuggcaucagaaugucaucagacuuuugaacagaaaacuugguugcuggaaaacagugaagaaguaucucagaugucauucacacacccuucauagacuuuguuuaaagaauagugguauggaagaaucauuguauuuucagacaugcuagauauuaaauuagugacaaucuguauuaggaagugaugggacaaugcacucgauuaaugggagaacaacucaacacuaaguaagaugucagggcccagaacagaugauauugguaaaggggugugagcuguguaucauaccccuaagcaugagcaugggcagccaauucaaaguagauucacaucaguaaauuggcugauagacagcaguugauaugacacauacauacaauaaaaacaaagagucgugagugugcugcuuccaggugaaugccuccaagugccagagugucuuaaaagacuuaaguaagugcaugagaacuuuaauggcaaucuaguuuacagcauggcccaugaagacuuuggaaaaaaacaucucuuccagcuuguccuugguguauccaacagcagcagcuggaguguuuuccuuuuaucuauugaguagauucaugguguauuugugugugugugugugugugugugugugugucuauaugcaagcaccuguuuuccuccaggcauauauggaggucaguggccaacaacaucuguuggucccugccugucacuuucuuugagauagggucucuuuguucacagcugccuuugccagacucugggccuauccaugagcuuccagagacucuccugccuccaccucucuggcccaugauugggauagcaacuaugugccaccuugucaauccuuacauguguauguguauggcagucacucugcucuguccauugagcugcuucccaagcccaacagcuuuuuuuuuuuuuuugacuuuuugagacaagguuuuugugguauacagccuggggcuugcuuuguggucuagccucaaacuuagaaauaugccuaccucuaccucauguaccaccaugccaaacccaagagcugaauuuucaaucagcaacaauacucuguguaggacugggaaaggcagccugguuccugguugagcuaaggcuagaaacccugaugauccuaaagggauggaagguguuuuacccugcucucugggaaccaggcuccuggcaugaggcuggagcccucuauauauuuguggccaucagucauguaugggauaugccccaaggccuuccacagguagaggcuacgaggucacuuauccucaagacagauccccauuuuaauuagguaccuaaaggccuggaggacuuagcuaauaaacucuccuuuucagacacuccucccugcaaauuguauuuaaucucaggccuacccugagaaguagggguacuguucuacucauccacuuuccaccaugacaauaaaugccuugaaaccaugcaucuguuuaucagauccucccuggugaacaauggaaaagguugucaccuaaagagcagccacagccaccaccaagccaucaauaccaagcccaagccugcugccuucaagccaaggacucaucccagagggaccagcuggaucuccccgucccccuuucccccucagcccugggcuauauccagccuguggcccccacucuguucucagcucuuuugaggcauccagccacggcugggugucugagagccugagaaccagguggcccuggccuccuugcaggaccugcuucagcugucccacaccucagucugugcuccccaaccccuggagccaugucccacugauucccuacagcccaacaccugccaggaagcaugcucaaaacucuuguguucuuccugaggggccaagcccuguggcagagcagacacaggaaccacuaacccuacaacucuguucuccagggaaucagacuuuguaccucauaaauuucucccaaugaaaccaggagauguuaggcauuaugccuuuggauuagaaaaauugagcaugcauguaagauccuauuuuauuaguuucuuuugagauggaguaucaguauguaucuuugucuagcuuggacuugcuacauagaucaggauggacacuuucugcaugugaccuuuacuuucuauguuguuugugugugccuuguucacugagucagaguaucacaguguaggugagagugaagauucggcccauacaucagccugugucgugugauguuuauuccaggcucaccaugauggauccucugcuggaagcaaaugcuacuuuugccuuaaaccuuuuaaaaauauugggugaagacagauccaaaaauguauuuuuaucacccauaagcaucucuucagcgcuggucauggucuuauugggggcaaaaggaaccacugcgauccagauaacucagguaaccaacacuauauauaauacagcagauaaaugcuguggacugucaguugagcuggugcaccacauuccaaauugcucuuacagaugauguaggggugugacuggagacaugaugggcaggaugugauacccugcugggaugcuagcucuagcauucugauccacugguggugacaguguauguaaggguuaauugagggcagaaauucuuaaggcauagcaccacagccccaugaccuccauugucuguggucuggcccuaauggaucuaaaccuuccuacagaugaggucuccuccuaggaucuugaaguuuauucucaaauggggucauucuaggcuagaagaccaggaauagaaccuuugaggaucuuguuaaguacagugcuuuaucuguagacauuaugaaccucauacugccccaagguggggauaaguacagugcuugcucccugaaguaucaguuggcuagggcaguguuacagacaacacagauuggcugguuuaaguaacacagaguauuuuuuuuuuauaguucuagaggcugaaggcuaaaaauuucgaaguuggaaaugugauugucuauggcauauaaauggcaucuuuggcuucccuggaugucuaggugauaaccagcuuuucucaaugggacacagcuuggguuccacucauucuagugccuucaguuuaacuucaaugucccuuauaugagcuuaacuccaaauacagucauauucugaagaacugugugucagaugacaaaauaccaguuugaggggauacauucagugcaugggagaaaggacacagugcagccucugaacuguagcaguucugguccacaaccaaguguuuguguccagucuacuguuucucaugauuagggauaucuugauucacaccuacuuguguuuagaguuagucuuccuaauccaugaccaccuuaggccacaacuuugcauucuggguuagcucuugguagcauucuuuuguuuuauacgacaagcguuuguuuuuuccucaggcuauccucucacuggaggauuagagcuagaggcuugccuucaauuugaacucucucucucuuuuucaguuucaagguauuauuacagauccugggaggcaguuuauuuguuuauuaugggaacagccaaagucauuuguguagcuuuucagcagguuucagauaucuaagaucguguauaaaaggccuggcagccaaguguucacucuuugcugguguuuugcuucuuuuuaaugcagccuuauuuguuggcaauuacuccaugugaccccugcgggauuggcuuggauuuccuuccaccaauggucgcuaggaacaagagcacaaaagugguagcuuccaggccuuuuaaagcccagaccuggaacaggguugcucuccucaauucugguggucagacagugcuggagccagcccagacccaagagcagggaagagacaguaugucuugaagucagaaggcaggugcacuggaaugauagcaggugugguugguagccaugcuugaagccagagcaucauuagugaauaugaaguguugggguugugaaaggcuauuucuucucagauuagggaugacaggacccuagacauggaaccuucaaaguacuuucaucuuugacuagguggguuuugaguggcugcagggaucugcaaaauucugagaaugagcuuaggguugacucauuuccuauaucuggaccugaugaugcuguucuuuuaaauccauuuugauuucaggcacugucuuuggguaaaugcagcagcagugaagauggagacguccaccagggcuuccaguuacuucucagcgaagugaacaagacuggcacacaguacucgcucaaagcagccaacaggcucuucggggaaaagacuuuugauauccuagcaguaagugucauguagcacuuagagauguuuagcugguuaucuucuaacaaucacauaggcuuauacauacguacaugcacaccuugaacacauagguacagacccacaugaacgguacuucugccuuauacauaaagacacaaauaaaaaauaaaaacaguucugucaaguaggaauuaaauaugcagucauggauuauuugguagaaauacugagaaauuauuccauauacacugucaacauaaugggagcuucaacucauuuauguuguuuguguuuucugguguaauaugguagaaugugagucguuaucaaugucacugucauuucauacacuauauaagaaaguagauuuuucuuuuguuugccucgugcucaugauuaguucccuuuaaggcccugugaaugugaggccuguccuucacuacugcaaugagccacuggaccacacgccaccauggguugugcuuuugcaaacugcucacugccugaaacugagcuuccugacaugguggccguagacauauaacuacucaaauuucauaucaggaaguacaauaaaauaaaauggauauucaaucucauagcuuccauagccacaucucuggugucugucucuauaggugacacuauucugaauggugcaaauuugcauuucuuuuggcauagcaaacuguaguaaaagguccagccugugcacaaugcagaggugucauagccagugagguggccucuuagagugacagcagugugauacugcaucugaggguacucccgauuaccucccugagcuucagcuacugccucagagauccaguuguucauggugcacuuuagugguucucaucuuuuuuuuuucuccuauuuauuuuauuauuggauauuuucuucauuuacauuucaaaugcuauuccaaaauuccccuauaccgucccccugccucuuccccaaccuacccacucccacuuccuggcccuggccuuccccuauacugggggauauaauugcaagacuaagggccuuuccucccaaugauggcugacuaggccaucuucugcuacauaugcagcuagagacacaagcucugggguuacugguuaguucauauuguuguuccaccuauaggguugcagacccuuucaguuccuuagauacuuucucuggcuccuccauugggggcccuguguuucacccaauggauggcugugagcauccacuucuguauuugccaggcacuggcauaaccucacaagagacagauauaucaggguccugucagcaaaaucuuucuggcauaugcaauagugucuggguuugguggcuguuuaugggauggauccccggguggggcagucucuggauggcccuuccuucuaucucagcuccaaacuuuucucuguaauucccuccauggguauuuuguuccccauucuaagggggaaugaaguauccacacuuuggucuuccuucuucuugaauuucauguguuuugcaaauuguaucuuggguauucuaaguuucggggcuaauguccacuuaucagugagugcauaucauguguguucuuuugugauuggguuaccucacucaggaugauauccuccagaugcauccauuugccuaagacuuucgugaauucauuguuuuuaauagcugaguaguacuccauuguguaaauguaccacauuuucuguauccauuuuucuauugagggacaucugcguucuuuccagcuucuggcuauuauaaaccaaucagcaucuuaugucauucauaaacuaagcauaaugcuagacagcuggaaacaggaaggauggauuuuauacucuuucuguauguuuguuuacaagucauaucauacaggauuaaauuuugauuaucugcuuuugggcauuggcaaagaggcugcuggugcuaaucacuugcauggcuguauaauuuuguuguucugucucagucuuuuaaagauuccugccacaaguucuaugaagcagagauggaagagcuggacuuuaagggugcuacagagcagucccgacagcacaucaacaccuggguagccaaaaagacagaaggugaacaaaguuucucuguuuuguuuguguucagugcuaggauuugacugcaugcccugggaauccugagcaggaucuccucugccacugagcuauauuuaccccauccaugucaaucaguuggcuuauauugaaaaagugguacauuuaugugggcuuguuuguuuauuuguuuguugugugucuauguuugucugugcacaccugcaguuaaaaucacucacagauuugguuuuuucuuucugccaguguuguccugggauucuacucaguucuuuagguuugguagcaagcaccuucaccugccagguuaucugucuguuucuaauauuuuuauuuuuguuuuuggagacagguccucacucuauagcucuuacuguguuauaacucacuauuuagaccaagguggacuagaaaucagagauccaccuuccccugccauucaagugcuaggauuaaagauaugugccaucauuccuggcuuuguagucuauugcuaauaaucauauuauuaguaccuuugcaagagcuucaaacaauaaugacuuuucuucauuaaaucaggaguucuuuugacaugccugguguugaaccuaaggacuugaauaugcuaggcaaagcaaaguauucuaaaguuggucugcauugcuagcucuaaaucaggaaucagaaagcuuuugaaaaaauuuuugagacaggguuucucuguguagugcugggauguucuggaauucagucuguagaucaggcugcccuuugaucugacaucuuagauguuggugucaggguuguugcuuuuagggauaugugguccuuuuauaucaagagaaaucuccuauguaagguucugaccagagcagcagguggcgccauuugccugucagcccuuugcacauaucagccacuuuuguuagguaauuggguuagcuuuguuacuguucuauugcuaugaagagacacccugaccaaggcaacucuuaugaaagaaugcgucaaacugggggcuugccuacaguuuuaggaggguuauuucaugaucaucaugguaggaagcagauagacauggugguggagcaguggcuggaaguuuuacauccugaucuacacaggcagcaggcaguuagagagacugggccugcugucgguuuuugaaaucuuaaagacuaccuccacaacacaccuccuccaccaaggcuguuccuacuaauucuucccaaauaguucaauugaggacugaacaugcaaauauaugauccaauggggguccauucucauccaaaccacaagucuuuaauuaauuuuaaaaaucuucccucuuucagauaaaaucaaagaguugcuaucuccagguacaauacauucaaacacuccacugauccucgugaaugcugucuacuucaaaggaaagugggagaagcaguuuaacaaagaggacaccagggagaugccauucaaagucagcaagguaaccacagugcaguaacuaaggagacuccugggcaagguccucuguucacacugguuucuaaaacauaaggagguuccucauguagccugugcuucuagugucucugggcagcccuucaggcaggacccucucucagcugugaggagguucucuucccuucuccuuuugcauguugccaaugauggcugcaggguauaugguuucaguccuggcccugcuucugucaagggcuauccugucacuggcagauguugaggccaaaccugauggcagagcucugcagugguguuucauagaaguuugaacauaagaaaaucuaaacuccagaugugguuuaugagucuccuucuggcccagaaugcagcccauuccuugugcacaguccggucguuucagugugucuucucagaagugcugucuuguguuuccugccuccuucaagaggaccacaccucguguugguuccuacaaagagggaaaauaaccuuucuuauccuguuggaaaaacagcugagggcagagagcugucuaaugagugccugacuuaugguuggugcucaauaaacacugaagcacugagugaaauuuacuucugguuugaugggauaaacacaaucugggacauguuacuggaauauguuuuuguaaccauauuacuuuucccccucaucucugucucuuccucccuccuccccccaucaccuggugccuaugcuccuaggaugacaagagaaauuaauuacaucacauucuggaucauuaaccagaccucagaucuuuaggcuaacuuuaauugaaccuacaguuuauuaggaaaugaauuucauuucaugcuuuauuuuaaauaaauucuucaguuuuuccugaucaaguauuucuuuucuuucuuucuuuuuuuuuuccauuuuuuauuagguauuuagcucauuuacauuuccaaugcuauaccaaaagucccccauagccacccacccccacuccccuacccacccacuccccuuuuuuggcccuggcguuccccuguacuggggcauauaaaguuugcguguccaaugggccucucuuuccagugauggccgccuaggccaucuuuugauacauaugcagcuagagucaagagcuccgggguacugguuaguucauaauguuguuccaccuauaggguugcagaucccuuuagcuucuuggguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuuccgucuucauucuucuugaguuucauguguuuagcaaauuguaucuuauaucuuggguauccuagguuugggacuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucugguuauuauaaauaaggcugcuaugaagauaguggagcauguguccuucuuaccaguuggggcaucuucuggauauaugcccaggagagguauugcuggauccuccgguaguacuauauccaguuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuugccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuuccccaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucgcauucuucuacaugauaacaaccaguugugccagcaccaauuguugaaaaugcugucuuucuuccacuggaugguuuuagcucccuugucgaagaucaagugaccauaggugaccuucuaaacagucccauauccccuaaagaaauagaagcaguuauuaauagucucccagccaaaaaaagcccaggaccacacggguuuagugcagaguucuaucagaccuucaaagaagaucuaaucccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacauaauaaaagcaaucuacagcaaaccaguagccaacaucaaaguaaauggagagaagcuggaagcaaucccacuaaaaucagggacuagacaaggcugcccacuuucucccuaccuuuucuuucuuuuuuuuuuuuuaaucuucuaugaauggcuuuauuuuagaaagguacacuuucucuuguaaacucugcucauggaaaaaaaaacuuguuugaagaagaaggccucaagucaguuaugggaauguuuaggcucucuguauacugcugcuggggagggggagggaguguagaaccugucugaaugcccaugagauggugucauucaucuuuccuuuaaguucugauuggcauugacauuugucccuguucuuuauuuuuuccaguagcaugcacuccaaaggggcaaguuucucauuucuucauaucuuaagucacuccacagauguuuugcagaugaauauguccuuuuuugugucauacacacacagcgauuuuuuuuagggcuguaagauucucucucuuuuuuuuuuccuuuaaucuuuuuuauuagauauuuuccucauuuacauuucccaugcuaucccaaaagucccccauaccauccucccccuacccccccccccccauucccacuuuuuggcccuggcguucccuuguacuggggcauauaaaguuugcaaguccaaugggccucucuuuccagugauggccgacuaggccaucuuuugauacauaugcagcuaaagacaagagcucccggguacugguuaguucauaauguuguuccaccuauagcguugcaguucccuuuagcuccuuggauauuuuuucuagcuccuccauugggggcccugugauccauccaauagcugacugugagcauucacuuauguguuugcuaggccccggcguagucucguuagagacagcuauaucaggguccuaucagcaaaaucuugcuaguauaugcaauggugucagcguuuggaggcugauuaugggauggaucucuggauauggcaaucacuagaugguccauccuuuugucucagcuccaaacuuugucucuuaacuccuuccauggguguuuuguucccaauucuaagaaggggcaaagaguccacacuugggucuuccuucuugaguuucauguguuuugcaaauuguaacuuauuucuuggguauucuggguuucugggcuaauauccacauaucagugaguacauaucauuugaguucuuuugugauuggguuaccucacucaggauaaugccccccagauccaaccauuugacuaggaauuucauaaauucauucuucuuaacagcugaguaguacuccauuguguaaauguaccacauuuucuguauccauuccucuguugagggacaucuggguucuuuccagcuucuggcuauuauaaauaaggcugcuaugaacauaguggagcauguuucuuuauuacuaguuggaacaucuucuggauauaugcccaggagagguauugcgggauccuucgguaguaccauguccaauuuuuggagaaaccgccagacugauuuccagagugguuguacaagcuugcaaucccaccaacaguggaggaguguuccucuuucuccacauccucgacagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuauucagcucugagcccccuuuuuuuaauaugguuauuugauuuucuggaguccaccuucuugaguucuuuauauauauuggauauuagcccucuaucugauuuaggauagguaaagauccuuucccaaucuguugguggucuuuuugucuuauugacggugucuuuugccuugcagaagcuuugcaguuucaugaggucccauuugucaauucucgaucuuacagcacaagccauugcuguucuauucaggaauuuuuccccugugccaauaucuucgaggcuuucccccacuuucuccucuguaaguuucauugucucugguuuuauguggagcuccuugauccacuuagauuugaccuuaguacaaggagauaggaauggaucaauuagcauucuucuacaugauaacugccaguuguuccagcaccauuuguugaaaaugcugucuuuuuuccacuggaugguuuuagcucacuugucaaagaucaagugaccauugguguguggguucauuucugggucuucaauucuauuccauugguauacuugucuguuguuauaccaguaccaugccuuuuuuuaucacaauugcucuguaguaaagcuuuaggucagacaugaugauuccaccagagguucuuuuauccuugugaagaguuugugcuauccuagguuuucuguuauuccagaugaauuugcagauugcucuuucuaauuuguugaagaauugaguuggaauuuugaugggaauugcauugaaucuguagauugcuuuugacaagauagccauuuucacaauguugauccuaccaauccaugagcaugggagaucuuuccaucuucugagaucuucuuuaauuucuuucuucagagacaugacguucuuaucauacagaucuuucacuuccuuaguuagagucacaccgagauaauuuauauuauuugugacuauugagaagggucuuguuucccuaauuucuuucucaaccuguuuauucuuuguguagagaaaggccauugacuuguuugaguuaauuuuauauccagcuacuucaccaaagcuguuuaucagguuuaggaguucucugguggaauuuuuagggucacuuauauauacuaucauaucaucugccaaaagugauauuuugacuucuucuuuuccaauuuguuuccccuugaucuccuuuuguugucgaauugcucuggcuaggacuucaaguacaauguugaauagguagggagaaaguggacauccuugucuagucacugauuuuagugggauugcuuccagcuucucaccauuuauuuugauguuggcuacugguuugcucuagauugcuuuuaucaugguuagguaugggccuugaauuccugaucuuuccaagacuuuuaucaugaauggguguuggauuuugucaaaugcuuucuccgaaucuaacgagaugaucaugugguuuuugucuuugaguuuguuuauauaauggauuacguugauggauuuccauauauuaaaccaucccugcaucccuggaauaaaaccuacuuggucaggguggaugauuguuuugauguguucuuggauucgguuagcaagaacuuuauugaguauuuuugcaucgauauucauaaggguaauuggucugaaguucuauaucuuuguuggaucuuucuguguuuagguaucaguauaauuguggcuucauagaaugaguuggguagaguaccuucuacuucuauuuuguggaauaguuugugcagaacugggauuagaucuucuuugaaggucugauagaacucugcacuaaauccaucugguccuggguuuuuuuuuugguugggagaccauuaaugucugcuucuauuucuuuaggggauaugggacuguuuagaucauuaacuugauccugguuuaacuuugguaccuguuaucggucuagaaauuugucuauuucauccagguuuuccaguuuuguugaguauagccuuuuguaggaggaucugaugguguuuuggauuucuucaggauuuguuguuaugucucccuuuucauuucugauuuuguuaauuaggaugcugucccugugcccucuagugugucuggcuaaggguuuaucuaucuuguugauuuucucaaagaacuaacuccucguuugguuaauucuuugaauaguucuucuuguuuccacuugguugauuuugccacugaguuugauuauuuccugccgucuacuccucuugggugaauuugcuuccuuuuuuucuagagcuuuuagguguguugucaagcugcuagugugugcucucucuaguuucuuuuuggaggcacucagagcuaugagcuucccuguuagaaauguuuucauagagucccauaaguuugguuauguuguggcuucauuuucauuaaagucuaaaaagucuuuaauuucuuucuuuauucuuuccuugaccaaguuaucauugagaagaguauuguucauuuuccacaugaauguuggcuuuccauuauuuauguuguuauugaagaucagccuuagugcgugguggucugauaggaugaaugggacaauuuuaauauuucuguuuccacaaucuguccauugaugaaagugguguguugaagucucccacuauuauugugugaggugcaaugugugcuuugagcuuuacuaaaguuucuuuuuuuuauuagguauuuagcucauuuacauuuccaaugcuauaccaaaagucccccauagccaccuacccccacuccccuacccacccacucccccuuuuugccccugguguuccccuguacuggggcauauaaaguuugcguguccaaugggccucucuuuccagugauggccgacuaggccaucuuuugauacauaugcagcuagagucaagagcuccgggguacugguuaguucauaauguuguuucaccuauaggguugcagaucccuuuagcuccuuggguacuuucucuagcuccuccauugggagcccugugauccauccaauagcugacugugagcauccacuucuguguuugcuaggccccggcauagucucacaagagacagcuacaucuggguccuuucgauaaaaucuugcuaguguaugcaauggugucagcuuuuggaugcugauuaugggguggaucccuggauaugggugggauugcaggcuuuuacaaccacucuggaaaucagucuggugguuccucagaaaauuggacauaguacuaccggaggauccagcaauaccucuccuggguauauauccagaagaugccccaacugguaagaaggacacaugcuccacuaucuucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuugcuaaacacaugaaacucaaguaaaaugaagacugaaguguugacacuaugccccuccuuagaagugggaacaaaacacccuuggaaggaguuacagagacaaaguuuggagcugagaugaaaggauggaccauguagagacugccauauccaggauccaccccauaaucagcauccaaacguuuacuaaaguuucuuuaaugaauguggcugcccugcauuuggagcauagauauucagaauugauaauuccuuuagguggauuuuaccugugaugaguaugaagugaccuuccuugucuuuuuugauaacuuuggguuggaagucgauuuuauucgauauuagaauggcuacuccagcuuguuucuucagaccauuugucuggaaaauuguuuuccagccuuucacucugagguagugucuguuuuuuccucucagauggguuuccuguaagcagcagaauguuugguccuguuuguguagccagucuguuagucuaugucuuuuuauuggggaauugaguccacugauauuaagagauauuaaggaaaaguaauuguugcuuccuuuuauuuuuguuguuaguguuggcauucuguucuuguggcugucuucuuuuugguuuguugagggauuacuuucuugcuuuuucuagggugugauuuccauccuuguauuguuuuuuuuuuuucuguuauuauccuuugaagggcuggauucauggaaagauaaugugugaauuugguuuuguuguggaaaacuuugguuucuucaucaaugguaauugagaguuuggcuggguauaguagccugggcuggcauuuguguucucuuaaggucuguauaacgucugucuaggaucuucuggcuuucauagucucuggugaaaagucugguguaauucugauaggccugccuuuauauguuacuugaccuuuuucccuuacugcuuuuaauagucucucuuuauuuagugcauuuguuguucugauuauuaugugucgggaggaauuucuuuucugguccagucuauuuggaguucuguaggcuucuuguauguucaugggcaugucauucuuuagguuugggaaguuuucuucuauaauuuuguugaagauauuugcuggcccuuuaaguugaaaaucuucauucucaucaacuccuauuauccauagguuuggucuucucauuguguccuggauuuccuggauguuuugaguuaggaucuuuuugcauuuuguauuuucuuugauuguugugccgauguucucuauggaaucuucugcaccugagauucccucuuccaucccuuguauucuguugcaucuauaguuccagauuucuuucaaagguuuucuaucuccagcguugccucacuuuuuguuuucuuuauagugucuacuucccuuuuuaggucuuggaugguuuuauuaaauuccaucaccuguuuggucguguuuuuuugcaauacuuuaagggaauuuugugcuuccucuuuaaggucuucuaccuguuuagcuguguucuccuguauuucuuuaagugaguuauuauaguccuucuugauguccucuaccaucaucaugagauaugcuuuuaaauccgggucuaguuuuuuggguguguugaggugcccaggacuggguugggugggaguguugugcucugaugauggugaguggucuugguuucuguuaguaagauucuuacguuugccuuucgccaucugguaaucucuggagguaguuguuguaguugucugucguuagaaccuguuccucagauguuuauguuagccucuaucagcagaccugggagacuagcucucuccugaguuucauugcucagaguacucucugcagguagguucuacuauugcagggaaggugcccacauaucuaguguucgaaccugcuuccuggcagaaguugcgauccagucacagaggucuuaagaucccgaggaggguccuguguacaccuuauagguguccgcagacuccacgcccaagguaccccggugcuggccagaccggaagggacuugugccccugcucuggcuggguuuucugcuucccuaacuaaugcagucucagguuccacgcgauuggauuggauuggauuggagcuguguuccacucaccaaaggucuuaugauccugugguggguguuguggguagcuggcgugugucagcagacccugcgcccuagcuacccccaaguauuucugucuuugaacaaagucacugguugacaagauguaccucaacaaguuguuucuguuacuuacuucaacugcaaguagcagaaacccuagaugauuauaguugacuucuuacaaguucauccaacaaggaggccaggaaauggguggagccuggggcugccugcauggggugauacuuaugggaacugacucuccuuuccuggucugccaaccuuagcuuggccucuuuuuccucaugcucacagcaggauuuugacccugacucugugguugacagggaaugauauaggacugagagcaagaagccuuuuuugagaucuuuuccauauaguacauaaguggaccuacuuccugcagcuccugcuaagugcagagauagugcuuuguuaucuuguaccuacccuagacauagacucaucuguggcuacagcagcugaugcucauaauccauauauguggcccugccuccaaaggcacaagauuuucuguucuauggauuuguauugaaauuaugagcaauguuccuguacauuagcuugccguuauauucuucagaugucacgagauccuacuguguacacugaaauacauggcugaaugugccagcccucauaaagcucuguuuuccuggagaagagaaauuugagauaagaauagguaagaacacagugguugcaggaggcuccagagacacaaagggaugguggcaagaugcugugauuggguguagaucuagugagagcuacugcugaaaucuucacuguaagauggcaggauagcagacaccagaacauacaaagcauguuucagauucugcagaccaacaugaugggagaaaucuaguuaacuacaauacuacaaacagcucuauggccaaagaauagagagugaaguauaauaggaaaugggcuggacucuuauuuuuuaccccaggguguuuuaagggcuuuaaguaaauuuuguuucugcuaggacacucccacaaaaugucauccagccaaagcaguguggucugacuugcccugugcuaugaccuauggcugcugcacugaaaucagugacaagaagguuaucacagcgucccagggcugugcuuauggcaguggagguuaaaaagcaaagucaugcuuuggauauaguucagagauacagacaauauaauuuuguaacgagucaaaucaggguaagagagaaagacaggacucaaagacaugaaaugguuuuggugacuggaaggaagacaucccucuccauuagaacaagacuuguagguagagcagcuaaacaaagaaauaucaaagugcagcaaucaaauugaguguaaaguacauauuuuccagaguucagggagaaaugaguauaggacagugaauauuagaaauuauguuuauagucauaagaauaaaucauaucucucaauagaaaagaauuguuggcuuauaacaugacaggaauuuggauauuggguaguuugcucccuguuccuaccacuaauauagagauaaccaaguuuuccaguugauuaucccuuuccaggguacuucucaaugacccaaacaucuuucucuaggccucaccucuguuuuuuuucuuuucugucucuuuuaaaauuuuuuuauuagacauuuucuuuguuuacaucucaaagguuauccccuuuccuccuuuccgcucuaagacuccccucucccauccccacccugccuacucgcugcucaccaacccacccacuccugcuucccugucuuggcauuccccuacacuggggcauugagccuucacaggaucaagguccucuccucccauuuaugucugacaaucccauccucugcuauguacguggcuggagccauaggucccuccauguguacacuuuguuugguggcuuaaucccugggagcucuggggguacugguugguucauauuguuguuccuucuauggggcugcaacccccuucauagggucuaccucuuaucauccauuucauuuccaauuuccacucuaaggaccaagucuuaaaaaaugagccuacaggggcauggaaagucuaaacuguuucagacauuuagaggcuuauaaaauauucuaaaagucucaucaagaaaauucucccaggggacagugacucucuuccccugugguaguugcaauuugcccuauuucaacuuaguauuuauccaugauuuacagaaugaggagaaaccugugcaaaugauguuucagaagucuaccuuuaagaugaccuauguggaagagauauccaccaagauuuuguugcuucccuauguuggcaaugagcugaacaugaucaucaugcuuccagaugaacacguugaacugaguacgguaaggagcauggggccuugauggagcuuucagagagagaaagaauggcaguggguuucugcuggggcagcucuccuaggcucccaugaucaugacuuuaucuuauauuuauuugugggacugggauggaacucagggccuggagcaugauuuauaagcucugcauccuagccccuuccugcuccuauaauaagauauagccacaguucccugggcaguguagaaccuucccauugucucaagggcccugugugacaucacuguccuaaugucuucaccucucuucuagguggaaaaggaaauaacucaugagaaauuuauagaguggacgaggcuggacaggaugaaaggagaaaagguggagguuuuccucccaugguuuaagcuggaggagaacuaugacaugaaggauguccucugcaagcugggcaugacugaugccuuugaggagggcagagcagacuuuucuggaauaucuuccaagcaaggcuuguuucuguccaaugucauacauaaaucuguuguggaggugaaugaggaaggcucagaggcuacagcugccacuacaauuguucugaaggggucaucacgguccaccccuuguuucuguguuaaccgccccuucauuuucuucauucagcacauuaagaccaaugagauucuguuccuuggccggcucuccucucccugaggaaagguuguucuugucaguauuucauccuuucucugugguuugccugaaacccaagugaccuuauccauaagugcaaugacagcuaugaaauaaagggcuuaauggcaccccaccuucaga

SEQ ID NO: 6984 - RNA, 1568 nt, Mus musculus
uacaacaggaguucagaaagaucucaaguguuacauugauguuaucgguauuacaaaaagagaaaaaaagugacaggcaacagugaagagcaccagagacccagcacaaaccuaagaccauucuccuuccuucaacugccaagguauuuucacagauuaagcccccccacccccuccuuucaucucagcuuucccuaaccugcuuggccuggggaacucaagccucauccucgcccucuuccuccucgaacucgcccugcucaucagccguggcauccugguacugcugguacucagacaccaggucauucauguugcucuccgccucggugaacuccaucucguccaugcccucacccguguaccagugcaggaaagccuugcgccggaacauagcagugaacugcuccgagaugcgcuugaacagcuccuggauggcagugcuguugccaaugaagguggcugacaucuugaggccacgaggagggaugucacacacggccgucuugacguuguuggggauccacuccacgaaguagcugcuguucuuguucugcacguugagcaucugcucauccaccuccuucauggacaugcggccacggaaaauggcggccacggucagguagcggccauggcgagggucgcaggcagccaucauguucuuggagucgaacaucugcugggucagcucgggcaccgucagggcucgguacugcuggcugccccggcuggucagaggugcaaagccuggcaugaagaagugcaggcgugggaauggcaccauguucacggccagcuugcgcaggucugcguucagcuggccugggaagcgcaggcagguggucacuccacucaugguggcugacaccaggugguugagaucgccauagguggguguggucagcuucagggugcggaaacagaugucauacagagccucauuaucgaugcaguagguuucaucuguguucucuaccagcuggugcacugagaggguggcauuauagggcuccaccacagugucagagaccuugggugagggcaugacgcugaagguguucaugaugcggucuggguacuccucucugaucuugcugaugagcaggguccccaugccugagccagugccuccccccagugagugggucagcuggaagcccugaagacagucacagcuuucugacuccuuccucaccacguccaggacagaguccaccagcucggcccccucuguguaguggcccuuugcccaguuauuuccugcaccacucuggccugaaagagcaaaggaggauuaagucagccaugauugggaaaauuccuucuuuaaaaaaaaaaaaaaaaagaaucaccucucagauaaggcuauuucaaauuauuaucaaauggccaauaaauaauaaagcaauaaacuauuugguuaucaauacaauuauaaaugaguuaacagagcacaccugccuuugaaaaagcuaagaugcaauugccucaaagccugauaaggcuuaggcgccacugcuauguaugcucccugucuaucacacuccuccacccuuugugcuagu

SEQ ID NO: 6985 - RNA, 1568 nt, Mus musculus
acuagcacaaaggguggaggagugugauagacagggagcauacauagcaguggcgccuaagccuuaucaggcuuugaggcaauugcaucuuagcuuuuucaaaggcaggugugcucuguuaacucauuuauaauuguauugauaaccaaauaguuuauugcuuuauuauuuauuggccauuugauaauaauuugaaauagccuuaucugagaggugauucuuuuuuuuuuuuuuuuuaaagaaggaauuuucccaaucauggcugacuuaauccuccuuugcucuuucaggccagaguggugcaggaaauaacugggcaaagggccacuacacagagggggccgagcugguggacucuguccuggacguggugaggaaggagucagaaagcugugacugucuucagggcuuccagcugacccacucacuggggggaggcacuggcucaggcauggggacccugcucaucagcaagaucagagaggaguacccagaccgcaucaugaacaccuucagcgucaugcccucacccaaggucucugacacugugguggagcccuauaaugccacccucucagugcaccagcugguagagaacacagaugaaaccuacugcaucgauaaugaggcucuguaugacaucuguuuccgcacccugaagcugaccacacccaccuauggcgaucucaaccaccuggugucagccaccaugaguggagugaccaccugccugcgcuucccaggccagcugaacgcagaccugcgcaagcuggccgugaacauggugccauucccacgccugcacuucuucaugccaggcuuugcaccucugaccagccggggcagccagcaguaccgagcccugacggugcccgagcugacccagcagauguucgacuccaagaacaugauggcugccugcgacccucgccauggccgcuaccugaccguggccgccauuuuccguggccgcauguccaugaaggagguggaugagcagaugcucaacgugcagaacaagaacagcagcuacuucguggaguggauccccaacaacgucaagacggccgugugugacaucccuccucguggccucaagaugucagccaccuucauuggcaacagcacugccauccaggagcuguucaagcgcaucucggagcaguucacugcuauguuccggcgcaaggcuuuccugcacugguacacgggugagggcauggacgagauggaguucaccgaggcggagagcaacaugaaugaccuggugucugaguaccagcaguaccaggaugccacggcugaugagcagggcgaguucgaggaggaagagggcgaggaugaggcuugaguuccccaggccaagcagguuagggaaagcugagaugaaaggagggggugggggggcuuaaucugugaaaauaccuuggcaguugaaggaaggagaauggucuuagguuugugcugggucucuggugcucuucacuguugccugucacuuuuuuucucuuuuuguaauaccgauaacaucaauguaacacuugagaucuuucugaacuccuguugua

SEQ ID NO: 6986 - RNA, 835 nt, Mus musculus
uauggucccaaaaaaacacuugaaguguguagcugcuccaaaacauuggauaaguuggcugacguguuugcuccucauccauccacugguccucacaggcugagggaaugccugccucucaucauuuuccuaaggaacagaguauguaugcccugacuggagaugaaguaaaaaaagauuugcaugcagcuauucauuaagauugauuggaaagucaggaccgauauaaccuacccugcugguuuuauggaugucaucagcauugacaagaccagagagaacuuccgucugaucuaugacaccaagggccgcuuugcuguucaucauauuacacccaaggaggccaaguacaaguugugcaaagugagaaagaucuuugugggcacaaaaggaaucucaaacuggugacccaugaugcucguacuauucgguacccugauccccucaucaaggugaacgacaccauucagauugauuuggagacaggcaaaguaacugacuucaucaaguucgacacggggaaccuguguauggugacuggaggugcuaaauugggaagaauugguguaaucaccaacaaagagagacaucccagcucuuuuugugguucaugugaaagaugccaauggcaacagcuuugccacuuguccuuccaacauuuuuguuauuggcaagggcaacaaaccauggaucucccuucccugaggaaaaggaauccgccucaccauuguugaagagagaggcaagaggcuagcggccaaacagagcagugaguaaaauggucucuaggagacaugcuggaaaaguguuuacacaagccuuucuaggcaacaug

SEQ ID NO: 6987 - RNA, 30765 nt, Mus musculus
augguagcaagaggcacacuuuauuaagcuuccuauuaaguaguuugggaucauuugcugcuacaacguaaguuacaacucaaaugguaucaagaacaauuagaauacacaacauuuucuuaggucagcuuccguaucuugaucacuaaauggaauggcucuucagaagaacagucccuuacccuauacacagaagaagaaaaaguaaggaugcuacaaugguauggcaaggaagccccaaaacaaacaaaaaacaaaaaaucccaaaucuuagucaacuguauucaacacugacauggaaaaauuacaaaugauuugcagugaacauuuauauuaggacauugcauguagaauaaauucauguugaauguauaagagccacaaaauauuaccuauagggcccaaaugcuaccauaaggagauauugucacaucucacuauacaaucuuauccaaaaaauacacacucauuuccuaaauaauuuaaauuuuaacacauguaauuccuuuguuucauuuccgagucuauuucucccuaugaugccagaguagacuagaagaaaugcaaaucuggggccaaaaugagaacauuacauuucacuaacucugcuacauaccauaaaauauguauuuuguaucccaaaaguguccugagaaauuuaaucuuguuacggggggaaaaaaaagaugguaauugcaaugguaaaauaaaaaucacauugucuuuuaaaaauaaaauagcugaggaaguagccacugggaaugaagaaacagaacguuguuaaucaggacuugagcguaaauacaaacaccggaagguccucguuucuaacagaaugcugcuccucuucagaacugcccaagucccucauaucugaagguccuggagaacaagucugccaagaggccuaucaugacgaacgcuuccuggcugccugcuccuccuuugaccccagaaaaaaugcuuaagaguuucugaacccuccucaaggugagugcauggacugcccagaauaauguuagaaggucuuuggacuaauugcccauguauauagugauuacgugaauauccacauaucuugguauucuuuauuuccuaagaagaacauaaauuugccuuuaaaaauuuccuaaacacaaaaaaguuuuauggcccucaggcuuggugaucucuugucauuucugcuauaaaguaugaaagcguaaacuuccugucagcuuccccugaagacuuuucagcuaaucagaaacaugaacgcaggucuguccaauaggaucauucacaacugaccucaaccuaagagaggucuuacacaacugcaaacucuaccucagugacauuaccacaucaaacagaaggacguuucucuagugcagcuccccgguuccuuaaaggucgggaagaugaugguauaguaccgccuuucucaccuccacaacaccugccauuacuauuuuaugucucugacacuaaaaaguuggucacaacgaacuaaaacaaagcacagcuauuaaaggcguugaccagcuuguuaaaccuaggcuacuuuuaugauuuaggcaccugcuuaaagccaaagcauuaaaaaaaaagagcucugauaggccaggcagaccuugaaccccacauccuucugccuccacuccaagcgugcugagguuacagguguggcuagcacaugcaacuugcagguuauuuucaaauguacacuaaccuggcagcuauuuuuuuuucuuagugaucuucaggaccuaauucugacagcuaugaaaugugggcuuuuuaggacuaaacuugcuuuuuacuuucgaggaaggcuguagcugcaggaacuaugauauacaaggagcacuuuacagaugggcacaacagcacuguucuuauaccacagcaaugaaacccaaacuguaacgcugaaacuacaagucagacacacacuaaaugagaacugaaaagaucuuuuaugggacagaaaccuuggcucaugucuucuggcugccgucaucuuccagugaucugcaccuaaaacacaaagaacaaguaacaagcaacuuuguguuuuuaaagagcaagcaaaagcuuugaaggcauaagaugaacuguuucuaguggaaaucaacuuauuaaauaacuacaaaaugaagccaggaaaaucaucagaagaaagcaguuacuauuuugagugaaaacaacuauaaaagaccugaauaugcagcauauuagcaccaaaguaaaguaagcauggugggaaaaucccuacccauaucguuaagguggacgcugcgcccgugaugccuuguuuaaaaggccucacucuaccuguagcuggaaacugccguguguuuauuuuaguaagucuaaccaugaggagacggguguagguucagaggugguuuauuaucucaucuaucaccuuccuggcuguguaguucauuucaugucuuuaaauggagcauaacccaccaggagaaugcugcuauucugauauuccauucuugaaugcaccaaaaugugcaugcuuguuguaauuaggugccugggugaauaaaaaaaucccauuuacaauguaaaauuacuauuuaaacccccagauguuacuguccucccuaauccucagggagacaaacagugaguugacccacucccaaacaguaaagauuacacaggauuuaaaaauccucucuaccaucuuaaacauacacaauccuuugugucgcaaaaccaagccgauuuacaugauuuuguuuuaaauugcugcuaaauguuuaucuacacaugcugucagaaauaaccuuguuaagaaggugaagcuggugucucagcaaaucagaccccuuggagaaggcgucgaauggccugugccccguuuuccuuuuucucuuuccgcaccaucaaaaggaaaagugagaaaauagcagaaacauuaguuaaauccugaguuagaccccauaaccuacuacacugaggaauaaccucacuacacugaaagcugacaaaauuugaagaacuuuuucuggaugaaauaauuaagaccuuaauuauuaaaaacaauuuagaaauaaggcuauacugaguuacaucuuuagcagguaauccuuucaggagaaaaacaaagacugcuuuaacuauuuacaguuuaccugacuuaccagcacugaagacaaaaucuuuuaaaaauggcuacaaaugccuuguucacaaaagacuuuauuaucuagugaugcauacugagaacauacagagaucugcacggcccacuucccaugcagaacaaucuucucauuacaguaagugagugucaacuguuuaugcaauagacaacacuuuaaagucacauuuuaaaagaaaagcuucauuuacaaaagaaauaaaagguaaagaagcaauuaccgcuuuuaaaaagcagcugcuuuguucaagaguggaagguuuaugccuguauugaaagacaacaugaucacaaauaaugcaaacaaugaacaaaugaaaaacacuuuuaccauaaagcaguacacuuucaaaaugacauacaaauaguuaaaaaucucauuauguugucuaucuuuuaaauaugaggacuuucagaaguaggccucaacauuuuaauuaguaaaugaaaacuaugcagucucuaugucacuaagaacuguauuuaacaaaauguauaaagucuauagcaaguugauuuaaaaaaaaguaaaguugauaagaaacaguacacugaaggcgcucuauccaucaagcgcauaugcuuccaauuuuaaaugugaugacagaacagaaacuguaacuaugccacaguugcgaugcgaaaaaauaaaacaagaucaguuaucacacaugcagggaauucugccacaaagcuaucccucauuuucaguuauuccaauaaaauaacaucuaaaacacuggugauguugaugguuuagcuuaccuucaguguacugaauguuguacacaaccugcuuuaaaagaggagacaucccugcaggcaggcucaagaaggaacagacucccuucggcacugacuacaccaagggcaugcugcuguggccugcacacacacaccuaggaaaacgugaauauaaacagcauuuaugcuggccauuguaucugaagagcaaacugaagccaagucugcuaaaaacaaaucaaccacccagcacugccacucauaacagacgcuuuugucuuuuaugugaacugcaaccauauacauuagcacuguaauucugugcagucuuggcaauuaaaacauuucuacagugaaauuucacauaagacacaaaacagauuaacuaacauuucuaaaagaaauaucacccucgguguuaauucaaauauaucaugcuuccucaaauuugcugcagaaauauuuauaaguuuauauacauuaauaauaaacugcugugaaauuucuucagucuuuguauuuaauuacucaaacccuuggaguuucuucaucucauuuaaauuuuuuccuggaugaaugcaugcugcagggccugguugaugcuaauucgcuuagcuggguccaacauuaggaucugguccaacaaguccuuuagcugguguacuuuuuuacguugaucuucaggaagucgcuggcacccaaucaagucagccaacagguccuuaguuggauuaauggugcucaugacaguaacuuucuccuaaaaauaauuuuuacaaugcauagcucuaaauaaguuacauguauguaaaucagacuuuuuucuaccaaaauauuaauacagaaacaagaauacuuaugaugaucaaaucaguuuugaaacuguucugugguuuuaaccuccacaucuuuucaaagagaaucaagaacuuaaauggaaaagaucugcaaaugaaccaugaacacgcagugagcaccugcagccuuaacugugcuuucuggcuuuauucuuuaguggcaaaugaaccaggucaauccaagacuuguuacucugugcuuugauaaaacaagggcucaggguuacagaugaaaaauuagcaauuuuugcuuguagguuuuagaaagacuaguacauguaugauaguguguaugucagcaaugcuggauaaaagugucuaggagaggcggucacucaggacaugacucagcucaugagagucugugagcaaaggcaccgaggccugcuugaaccagggugccucuuaccaagaguggacucacagggaaaacaaaaaugcugaagaaggcagaguucauaugacggagagcuugacuuauaacugcaaaucucaccaacggcaauuuagaagauauuugggaagccagaccaaggcaaucuaaggaaaggguggcaaggaccuaaauaugaaccgacuaucacuuuagagaaaugucuuaaaucccuucauuguucucauagccugauggguuuuauucacaaauugguagcaaagggaucuaucugccuguucuguugucacuuuagaagcagccacagcuccacaaaccacacagaacucccucccucugcucuaauagagcauagagcgcagagguagggcacugagcuaacuaguaagugugaauccccgucucaguccccacacugaaaagccaagcaacacacguaagccagacuuacccucucugucacuuuaucaaccucuauguacaugaaguucagauuuuggucaaaauguugaucuuugaauacaccuuuccggaucaucuaaaaacagaaacaaauggcuuauaaacuacuacaaaucuugccuggcacacuaccaacucucuguaauaauaauucacacaugcauuauuuaagacuuucuugcuguacugagaagcaagagcucuuagcaagucugcagugcuuagccaccuucucuagcgcacucagugacacgcuaacucuaaugugcagcucuguccauccugucuacacagcugcauucuuucucacugcccuugacuggugagaacugaaacaccggcaacaagaaaggagcuccaguguccgcacagccgccacgcacacugagagcuuuacuucuucaucgcuacagucuaggugacaaagucucagucuacaggaaggaaguuagccuaccuuauuuggcauuuuuccuuuaagguccauggcgagcuucaacauaugguuauuaguuuugccagggaauaagauuuuuccaguguagaguucauauaagguacaaccuacagaccacauaucgauaccguagucauagcuuuuaccuauaacuaaaaacaaaauggagguuuuaauacaugaggauaagaaugagcgacuccuuagauuuuauuuccaguaauggggcuaccuuagcuugaacuauagucaaauccauaauaucguagcuuaguuucauguuuuuuuccccaccaauucuaaagagauacuuuaaaaaacaaaaaacaaaaacaaaaacaaaaaaagcaaaaaaacaaagaacugccaacagguuuaaaaacagggaaaggagaggaacuggagggacaagaacagacgcuucuuucuccugugaccuuugcuggaggugcuagucaaucucaacccaggcaccaggaagagaaaaaccagaggucccauacaauccauaaaggugauaaucagaccuugaacaaccaagagcagucuucuaaagucgaggguuuccacaacuguuugcuacucuugcucgacaugaccaagacuccugucacaacuaccuucaugccaccugaggaggaggaugagcucgcuaacucgugcagcugcugaagugugauggaaaacagugcuuagacagggcacacgcugcuuccaccagaggauggcccacguacgacaacacucuaagacacuuacugaucuccggagcacgauaaaaucuacugacaagauaaggcguaaugucauuaucugcaacaugugaggccgauccaaaaucacaaaguuuuaaaauuguuuuggauucauuaaccugcaaaacauuuuuuaagaaaauucaauucaugucaggaauaaacaaauuaaaauugucuuuaugaauuuaaacuaaucccuaugcuaagaacaaaaaaucacuucaaaauuccuuuucuauuauauuauacaaguuucuaauuauaaaaguguuuguucaauacuuuauuacaacuacaguaagacuuuuuucccugugaggaaacacagggaaugccaggugcaauacauuuuacuuaacuguauuuaaaaucucauuuuaugaggcaaagcauuucuaaacuccccuuuaaugcuuaaagucaaguuacuuucuacaagagcacgagaacauuuuuuaauagaaaaaccucugacuaaaucgaauuccaguugccaggagauuccaauggcaaucaaaggagagcggccggugacuaagcacuagugaucccucgucagucaccuggauuacaucacccgaaacugucaccacuuuaagucugaaaaauacuaaaucccuucaguaggaaguguuagcaagacaacauuaacccuaccuaacaaaacugauaaacaugaccucuguacuagucaucugcucuccucuccuugguaaauacucccacauacacagugacagugacaucugcugagaaaggcuggagcugcuccaugacugcugccacucaugaccagaagcauguucaggauuaacaagugaagagaauucauauuccagagucccuuccccccuucaaaagagacacauacaaauucucaguggggacuugaacuuggccuacuguacccauccccaugacaaugaauaguuuaaccagcucuaguacucucugggggaggaagcauuauccucacaaaguagaaucaguguaaacagacuagacuaucagugggacccacagaacuaaguuccuagcccccgcccaagacagucucucuauguagcuaacuuuggcaggccuagaacucauauauauaaaccaagcuggccuugaacucacaaaguccaccugucucugccuccaagugcugagauuaaaggcaagagccacuaaggccagccaaacacaaauuauuuuaaacuacaacacgacaucaagaccaauuuucuuacuuuggagaccaguagaaaguugucuuaaaaugguaaauaauuuucuaauaaaaagaaaacuaaaaagcaaacaauccaugaagcuaccgaaaaaguuguaauaccugcugugccacacccaaccaacacccaccccacccugcauauaugcacaugcacaggcacacacacuuuuauuugcaaugcagcuucuauucuccaugaagaaugcugcacauuaugugguuaaauccaggcuaaaaacauuggacugucagaagugaaaucaguuccagguguccugaauuuuguuuuucccccaaagaaggaauauuuaguuuccaaaccucaugugcaaaucuaaacuaacacugauuaaaagaagaaagaagguguuaagaacaaaagcuucucugggcgugguggugcacgccuuuaaucccaacacuugggaggcagaggcaggcggaucucugaguucaaggccagccuggucuacagagugaguuccaggauagccagggcuacacagagaaacccugucucagaaaaacaaaacaaacaaacaaacaaagaaaagaacaagagcuucuagggcaccgucaaacaucaaagcgcacagcacuacacaagugugugcuguguaacugucuaaccugcagguguuuauuguauauguguacuguuuuucacaacuuuuuucaagaauucuagaacugauuuaaaauaaagcaugcauuaaacaaacaaaaacaaacaaacccagaggugugagggcuagaaaaauauuucaguuguuaaaaggcuucugaucccagaggaaacugguaugagggugguauuugguuccuaaaacucacauggcagcucacaacugucuacaauuccagucccaaggaaucuguggacauucuacuuaccguguguguguguguguguguguguguguguguguguguguguguguguguguauacauacauacacacaggcaagacacccacacacuugaagucaaaauaaagagaaaaaaggaaaaagaacacuggaaagaaaauacauguuguagaacacauagcuggcagacgaucaagcaacugacuaaguugugacuacgcuucagaaugcgaauaccacagaaaggugaggggccaaagaagguggagguaugcaugcuucugcauucaugcuaucaccaggaugaccuaucucugaaugucaaaaauaucagacagugugaaaucugauugcacuacaugagaaauuacuaacaagagaugucacaacuucaaaggaaggccuuuuaacaacacguagcaggagcugaaccuuacugcuuggguccccagaaaccaccuucaaaggaaaaaaaaaaaaaaccagcaaaacaaaaccaaaauaaaacaaaacaaaaguaucuguaaucucagcaugagauuugggcaacuggggcaagaaaacagugaguuugaggccacuaaaaaacagacuggauuucgaaauaccuagugaaccaaaaaagcaccuuuuaaacuccaaauagcugcucggcagaaagcaguuccuguguccacaagacacaacacagagcaccgagcauccuccuccugcugcucaaggagaccaucaccaucauucuugggucacuccacacuauaaaucccuccaccaacauuuaaaaagggauaacaauucauuuccucuuuccucauaguuuucuaugaaauucacugcucaauuucaaacaaagauaaaauuuggcaaguauaauagagucauuaaacacgaaauuauauuaaauguuaucuuauaguaugacaauaauccuauuauuaguuaguaggaagagauauggauauacacacaagguggcgugguugcuugacuuaccagaauauuauccgguuugauaucugcauguaagauauuacaucuuuuaaggaguuucaaugccaggaacaacugcugacuguacgaucguacagccuuaauauggagaccgacauccuuaccauauuuuuuuaauaccucucgcaaauucauacuuuaaggagagaaaagacaagagaaaauggggucaaaaaacaaacacaaaaggcaaaaauacuuucaagcacaaaguaaaaucaagugcaaaauacaacuuauauaauuguuugggacccuuauucagaaugccugauaaauuauuuggcacugagaugggagaauaacacuaugcccauaauacagcuucccaauaaacuuucaaaauaaacaaaggaagaacuauauuacucgagaaagucuucaccugaaaauacaacucagaagccauauugcugaaggucaaacugguaucugucccuaccacuccagcugaccugcaggguaccugagguuucuuacugucugccacccaguacagaacucuaugcucuacaugcugaugauuuucaagauaauacaaugaauaagaagaaccaacaggaaaauuagcaguuccucgagagcauuuacccagcaugagguugcuagacaaacuacaggagcaauugacuguucugguccuuaccugagagguucaaagacgagacagaggugcuguuugugguaaaagugucugaagaggcgcaggcaauggaacuugucaucaggaucagcaucauuaaguuuuuucaagaauucuagcucuuuuaaaccagucuuuugccuucaaugaaaaaagauuaggacacaagaauuuaggaguagcaucuguuagacacggccuauacacuaacuaccuaaguguuauuuaauucaaauuuuuuaaaucucauuauaucuugauauaaucauuauucugguucuucuaagaauguaauuauugggcaugucucccuaaauauaacuuuacuauugaaaaucugauuauaagcggucauaaacugcaucuaaaaagugaguguuuacaguacagaagguuagacuuuccagccaaauauaucuuucuaaaccuaggacagucaaacacuugaagaaaaaucuguaauacuucuaacauuugaaggccagugaaaagcuuuaaauauaugggaauggcaauuauuuaugcuuacgaaagaaaaaagccaauaaugacagacacaaauaauuccugucaguagcucacgaaucauuuugauuugcugguugcuaugugcucaguaacaauucauauccuuucacaucuccuuucuagauuaaggcugucagagcagaagauggcauuaggcauuaggcauaaggagaggguagggggucuaaggacauacugguacaggguagguacugaaaugacuuugacauaauagaacuucccauguaacccauggcucuaaauuuaaaauccuagagucaaaauuauuuucuaagaguguuaguaaacuaagacuguuguuguugauuguguuccguucugagcuuacaugaguucauuguuccugaugaucuuuacagccacuuccugguuggcucucgcauuaucccuggcacgcacaacauugcugaacacacccugcccaguguagccauacacauuauaacguuuaucuaggacuuccccgauguucacaccuaaaaccaaauuuaaaaauuaaagauaugauuaugaaaauaaaaucuagaagucauuuacacauuggaguuauuuaaaauuggaucaaaucuccacuguuucuaauacaugauggaauccaggcaccgccuccaauggucaucucagaaugugacaggagccgcauuccuaguucagaaacucucagcgguccuugguccuauccauugcugacaauuuuauaaacauuucacugagcugucuuccacuguaguacugcaugacaaagacuuccaugaccaguaccugaguuccuuuguacgcuacuucucucgacuuauaauaaaaagauguucaagugguagaccuucuucucuagagaauuuacucaugccugaaaacaucuacauacaaauuuaggcuuccuuuaauuaauauguagugcuucugggaugcugacuggaauauaacaaaaacucacaugcugugacuagcucuaccauaccuuucuauaaagaguucaacaaugugugauuaucugagcaguguacuuuuauggacuugcacaaugaauuuuaaaguugaugagaaaugcaaacuuacgguaauagccuucugcaucuguccaauuaucucugagguugggauuuucuuugaaaucuuucccaaugccagcagcucggagacgagcacucugaaauuagggaggagaccagaugauugcacacuuaaaguaacuccuuaauaacaaaaauuaguaauacuagcauuuuauuauauuauuugacuguuacuauugcuuguauacaaauucaagguagccaagguaaaauuaccaaaaugucuuacaucuuaaauaacaggaaaaauauuuuaaaaagauuuccaaaagcuuuugggcuugauuaggcacuaaaaauuaaaauaaaaguucaaaaucagauccaauuuccuuuagcugacgggccagacgagagaaacuccuacagaccggaacucauuuaaccaacgacaguguccgacauuaccuaccgauuugcaucauuuccuucucugccucccuguccauggagacauuuguacccuuaccacacaggcaugaaauguaguaacauucacuggcuguacuagguugagccuguguggaaaauuaaaaauaacaacaucuaucuaguauuugugaauaacccuauuccauauuauucuccaugcuacccagaagguccugcaauaaugcuguaauuuauuaaaugcccccaacccacacucccaagucuuugugagauaaaagcuuugguuccuaggguggcacugcugagaggcagugaaaucuuuuaaagagcuuacaacuauaagaucgaaggagcuuauaagaccccaaauccucuuugucucccccuucuugccuauuaaugagcaaauucacugccaccugcuccugccaugaugaacucaugaacccaaaacagcaaggccaacugauuauggacuagaacccaagcaaaucuucuuucuuuauaaauuaauuguccagguauuucauuagaguaagagaaagggaaccaagcaucaccuaggcaaauggugagugcugaugugucaaugggggcaguauucaauacuucaucuucucuuaaccccuucucuuccaguguuccugcugugcgccaugggaugcauuacagacuucucaggccaaacacaaugucucacacagugauuauucuaccucauuuugauuguucccauaacaucuacccucucucuuucuucuaagaccuucuauuuaugacucuuuaaauauaaacuaaaaaggcuucagacuuucagguuuaucuguaguaaagacuuucaauaaaaagguacugauaaaacauuacagcaaaaagaacaaaauaaaaauaaaaacagaaaaucacuacugacaaagaccaccuaaccaaccgcaucaugguaucuaacuaccacacuucuauuacuguucaugugcugagcuaccauuuguacauacaugugcaaguacuacacauuuaggcuuuuggguagaugugcaacuuugguaaaguucuccaauuuuuuucuuguuuauauuuuaaacccucugauagaguuuuggccucagagaggagcaaagcuggcacacuucaguucugagauggauagggcuuauacagccuauccagaugucagcacuuccaacguugguaaugcaaaccucauugcucuguaacugcccacaagcauuagauacacagaccuuuuuccuaugucacugauuuaaaauuacucacaucaaaauaagcagcaaacaugucaucagauucuguaaacaugucaggugccaaaaucuucuucugagaugagccuuaaaugaaauaaauacgcagcaggacuugagacaugcaagcagagaucaaaauccaagucaauagaauauucagaaguauuaaucagacuucuccuccuuacacauuggcuuuuaacuaauaauucaauugagaaacauguuucacacuugauauguaauaucuacugcaaauacaaagcaggaaacuaacgucaacuuuugcuauggcuaauuuugauauauagcucuaugagaaucuuggauuaaaaugaaaagauaucccuaaaaccuucuuaauuuaagccaguguggcaguauacucauuuaaucccagcacccaggaggcagaggccagucuggucuacagaaaaauuuccaggacagccagggccacacagagaaagccugacuugaaaaacaaacaaacaaagucucauauuaaauaccucaaaggguaaauuuccccuuuagucagcuauagaucagccuccaguuuaauauuuucccauaaaauagcuaaucucauauagaaaacuggacaaggaaaaagaaauaccaugguuuccaacaaguaaccacccagaucacaguaagagaaauacagacucgcgcuaccacuagguuacaggcacuuaucgaggacagcgacuacacuucuaagacaacaguaccauaugaauaagacuuuuuggguaaauaaguacagguguggugagucugacaauuuauagcaagaacauacacaaauagucugacacugaucuaggaagcccauuucuuacauuaauacuggagaaaugaaaacagaaacuaaaaccaaagucaagaaaaaagucaguaguguuacuuaaacuucuuuuccuucuuguacauuggcuuucuaggcaacuuccaaaacugccgcucaguacugaaaacgaccugaugugcauucuuauuaaauuagaaugcaauggguggccgcaauccagucagaugccugaacaaauauccuugacaauaagaaaugagaaucaguagagaccuuaucuuaucaaaacccguguuaaacaaguagggcaucagagcaauagacacuugugaucccagcacuggggaaacaaagacaguggcucccuaaccagccagccgagccuauucagcaaguugcaaaccagugagggacccugucucaaaaaaagacgggugggaacugagaaauaaaaucugagguuuccccuuggccugcaugugcacuccuaccauacagacacauauauacacaaaauaacuuaaaaaucacauuaauacagggcauuacuugagcauaauauuccuacuucuuuuucacuucccucaacucuguuauaaggcuauacagcuaagccugcagagaaaagcuccauuagacacucuaacucaccauuauucuguucaacugucauuagauuaugcuuggcuuuuacugaggccucaaaggugucaacauucucccgcucauauucuuuuacaucagcagcaacucgcuccaagaugucgucuggcgaaggagaucgugaucuugugcugcucugggggcugcuuggcucagauggcacagauauauugcuaucuucagcaagauauuuauauuucuauaacaacaacagauacaucagcuucauaaaaccagauauuaucuaaauauauuacuuacaaacaggugcugcauuaggacauugggagcacugaaaccguaaaacaacaaaggcauccacuccuggcuuacaucaggugcacaauaccuacaaaauccccuauuaugcaaacucugaaaaguaguuguguuugcuguacauucaucaggugaaauuaccugaccugaccauaucaaauucuauccucuggcaugacuuuugucucaggacagccaaggagaugugguuugucuuucaaagcagcaaauuuuauugcuccaugacugaugugcauaacacauugagauguguauaacaaucuuucucacucagcuuuaauuuaaaccgcaauuguggacuagcaauauggcuuagugguaaaugugacugccauuaagcuggcaauccaaguucaaucuccagaacccaccaacuccuaccaaaugauccucauuuucaugcucaggcugagauacacucaagcacgcacacacgcacgaacacacacccacacgcacaagucugaagcaaaauugaaauuguaaaguuugccauuauccuuuuagagaaaauaguuuauuguaugguaccaaauaacugauuuugcuaaaagaacuuccaauuuacccuacacuguaauaauuuucauguuuguuaaaaaauauauauuucaaauucucauguuuuacacaagaaguuuauauuaauauaguuagauauaaaacaaaacaaagaggaacaagucaguuuuaauaacuaaauaagucucaugaauguguguaagcucuucuagugacugguuacugucacuacuacuuucuugcccugauuacccagcacuagaaggaccaucacccaccugcacaauugcuugccucuguauucuucucuguucuauuagagccucuucaucuuccuccuccacaucaaaaucuucaaggcuuaaaaaaaguuuucaaacauuuuugcagauuccuaaacuguuaacuuguacauuuuuaaaguuugagcuauggucuaagccaucacugauccaaagcucaaaguugucuaaugggagccuagcaaauuuuacccucaccuuguucacugcaccaaaacaggaaacaaaaaagaucucugcauucaaaauacccaccagugacucugugacugcucugaucuacguucucuucucuaaagcaaaggcacaacaguaagcugacuuuccccugggucccagaaagcucauggaagcuucuggucuauuuccuaucaaaaaugcaagcaggcuguggugccuccuacaaaccaagcaaaaaccaacauaauaaacaaaaaaggauuuaaaaaggauacaaaaacuugacucuuuucagauggacauggcucaauguccaauucuaccuggaucgcccgcccacauguucuucaaggaccuccccaaucuuuaugaaucaccacugaguacuaugugugcacacugaguagucucugaguacuguaugugcacacugaguagcuuaacacauugugcacugugacuauaccaagcucuacacagaacccuuccuccugcccagcuuccucaaucauggaaccaacaguggcuccuuaguucaagcacugcugauuuuagggguggguuguuuugugaggggaauuggccugugaguuacagauucuaguauuccuggucuucuaccaccagcugacaacaugccuucagauaugaauaaaaugucuccagggaggcaagaagugcuacugagaaacacucuuagcuuugcuucugagauagugcuuuuagaagcgugcauuuuaaaacaguuucuaaugcuuuagaaaacuuaagucauuugaacuguuucucuaucucagugaaacagauauacugcccaccaacuaguccaaaggaaaagcaggcaacaucugaccuaaacugaaaagucuaaacuggucugcucuuucuaauaaaaacaaaagguaaaaugauggcccaauagucaacucaaaucuagaaaaagcagagcccuuaaguucugaaaaacauaccuaauaagcacagaagguucgcuuuuaaauucaggaugaaaucagguauucacuaaugacaguuaggcagaaacugaagcccuccaguacaccaauuuuccuaaccuagaaucaugaaauggcaacaguccguucuuacuuaucaucagaugaagacucuugcucaacuuucauuccuucugagagacuuccuuuaaauuuaucuuccuuuacuuugcuucugcuccuucuccuaugaccaccccgugaucgagaccuucuccucaagcgugaccugcuccuucggcuccuaucucuauuugaaagaaaaaaggggacauauaaauauuuguaaaaguuucaaauaaagugagcaaacaccagcauguguggggaagaauaaaaggugacuuugaacucaaugcucaauuuuucugugaaccuuaugucuucuguauugucugguuuugugugucuacuugacacaagcuaaagucaucagaggaaggcucuccauuuuaggaaaugcuucgaugagauccagcuauaaggcauuuucucaauuagugaucaaugggggaggagggcccagcccacugaggcugguaccaucgcugggcuggugguccuagguucgcuaagaaggcagccugagcaagccaugggaagccagccaauaagcaacaucccuccauggcuucugcaucagcuccugcauccagauuccugcccugcuuaggguuuuuguccugacauccuucaaugacagacuauagauucagaaguauaagcugcauaaauccuuuccuccccaauuuucuuuuugggucacuguguuucauuguaguaaaagaaacuuaaaccaagacaccuucaaaaucuauucuauuaaagaaagguguccagacauggugauacaacauauaaucccagcacuccgagggaggcuaugaggacugggaauagcaaaacccaaauucuuuaauaauuuguuuuaaagguuuuguuugggagggccuaaaugaaugcauguauguguacaacugguaucugcagagcugcguaucuccuagagcuggaguuacaugugguuguggucacaugacauaaacguugggacccaaauuugggucuucugaaagagcagcugagccaucucccuagaccuuuaacugaauucuuaaagaccaauaguuuguauaaauuucaaaggaaacuaugcuaaagaaaaagaaaacuguguugggcuggagaaauggcucagcaguuaagagcacuggcugcucuuccagaggaccuggguucaauucccaguacccucauaucuguaacuccaguuucaggggaccugacacccuaugcaaauauacacacaagcaaaacacuaaugcauguaaaaauaaaaauuaagaagaagaaaacugugugcaguaucccaugcuggcagaggaagcuaugggaucacaauuaaaauguuucagagaaaaauggucggugggaaaaugguuaggugcaauuugcagcuaacuuaaguuuccaaaugagccaaaggcuaaggaauggaggagacagcauucauugguccuucauauuuaccuucuccgaggagaccugcuucuucuucuaggagaccugcugcgucucaauggggaacgggaccuccuucuaauuggagaccuacuucuucuucggguuggagaccaccuauugauggggcuggcaucuuuugaccguucacaucuaccaaggauaucaucucgaggucuuguucuuaagggaacaaaugcaaguucagagaaaaaacaccaaacuaaaaaaaucuguuugacauuuaaaaggaguaagauucacaaacuuaagucgaguaacugacuaaauuacucugaaucacuauuuaaagucagaugaccccauuagcauuaugguguuagagaaggcauacaauaaguuuauuucccauaacuucaaaauuuaagaauuuaaaaacuauuuacauguuaaaaagaaacuuuaaucuuauguacaauucaaaggaaacauuccuaaacgggucauaauagccuauguccucauucugaauugucuacauauugacauugcuaugcuuaagauucuuauuuugcccgggcaugguggcgcacaccuuuaauuccagcacucgggaggcagaggcaggcggauuucugaguucgaggccagccuggucuacaaagugagcuccaggacagacagagcuaauaaagagaaacccugucucgaauaaaaaaaaaaaagauucuuauuuugauugcuuauauauguggacaggugcgugucuuaguacacauguggaagucagaguuaacuugaacuuucuaagauacuacuguacauauaaggagacugaacaaauccacuucuaugauuuauucuacaaagaagccucaaauauaaccaacagauaucuaucucuguaugcaauugugaaaaauaaacccauguaauguuuaucagcaaauauggaacuucuacacuguaacagauacauacauuuauguaugugcguauauguuuauacacacacauauaucuuauacuguuaccaaagcaugcuuuccaaaaagaaaaaaaaguauaccaucuauauuuugagauaaauuggagacuccauuuauaagaaaaugugcacauaaagugggcuagcaggauauaaauguauugugaggggcuguaagagggcuggggaguccaagaacuuacuaguuucuacauuaucuggcuuuuucuuuaaucugaacuucuucuacaauuaaaaaaaaaaaaaggcaggggcauuuggaauaaauacuuaagguuggccuuuaauaaaacuuucaaacuggaauaccaaggcugacuaagaaacacuugagauaaaaaacgaucagcaaaccuaacagccucaaagcagaaacuaaaggaaagagacagauuuaguguaacacuauuccuaagugagggguaaacagccuccugagauggcacuuugaaaacucucuucaaaguucucagaaugugaugauggagacuucaagaucaacuuagauuuacacugaacauauuaauauuaauaggaaugaguaaacaauucaugccaucuuugcaagcccacaucuuuuguaaaacuugacuaauuugauuaauuucaaaaugcacaauuccuauacauaauaagcaaguuucuaaaaugccucuccuauuucccucaaauuuaguucuaugauccuagucaaucguuugauuguacacuauacaaaaauuagggccagcauggugggacacaccuucaaucccagcuuuuaggaggcugaagagacaguauuaaauuugaggccaguaacagcucuuucauuagaccaugucucaaaacccuccccaccaaaaaggaaaaagaaaguuuaugaagggcucccucucacugggcuaaaauaaucccauuuagauucuagaaaacugcuuagauuuaaaugguugauugaguaaguuagaggcuaaauuaagucaggaacuugaaaaaaauagucauuaaacuauucuuaaagcauaaauuaugauuaaaaaacuuuaguguuaauaaaauuaaugcacuacauuauauugaguuaugaaacccaucacuaucucacuuaaaaauuaucuuuauauucacuuuuuuccuuuaaaauauaaauugcugccgggcagugguggcgcucaccuuuaaucccagcucuugggaggcagagggagguggauuucugaguuccuggccagccuggucuacagagugaguuccaggacugccagggcuacacagagaaacacugucucagaaaaccaaaaaaaccaaaaaaacuauauagauagauagauagauagauagauagauagauagagauauauagauagauagauagauagacagauagguagauagauagauauauauagauaaauagauagauggauagauagauaguuaguaaaaagcaugagcguuucgugaacagguuaccucggagaagaaagucgucuccucucugguucucuccguuuucuuucuaaggaucggcucuuggcccuucugccuggagacagaguucgagaaggcgauuugcucugcuuagaucuucugucauugagaagcggagaccuacuucuucuugacuugucucgcaguuuuggagacaaacuucuucuuuuaggacuacggccaggucuucuacugggugaccuauuuuccuucccagaagaagcauccuuugaaggugauuuaauuggcuucuuuucuuugucaauuucagaucguuuugacuuccgcucuuuggaccuugaccuucugucuuuggauuuaucucuuaagucaacuggggacuuggauuuuuuagaucuaucucgacuccuuucauuuacaauuggugauuuuuuccuauccuuuauuuugccuuucucuucacucuucaucuucuccucagcaggagaucuggccuuccccacuuucucuugggaccgccgucugaguggaggggacuuugacuuucuagcuuggucuugagacuugcuucuuuuggaugggcuuuuggauuuucuccucuccuuggacuugcuccuguuugcuuucucucucagcauuuccccagcccccuugcuuuuccuuuuguccgaucugugccugguccguucuuuggaucugcucuuacuucguuucuuugcacuauuuuuguuguccguaauuucaaguuuuccccgaguacuggaagaccugguacuggaccuguucccauuucuugccuuuucgugaaucucuccuucuucuucggagccagacucauagccuugcaaaaugagccccauuccagacuggaccuuccccuccauuaacucauuaucaagcucagcuuuaaucaaggcucucugcuuuuccaagucuuccagcaaagcuaaaucaucaagcuuaguucuuuuugcaggggacaggccuucuuugucggaagccucgauaacuucuuuccguuugugcuucuuaugcuuaugcuuauguuuguguuuuuuaucccuaucuucuucugaggaauguuuauguuucuuauguuuacuucuguguuuaugcuucuuuuuuuugugacgacuguguuuauuuugagauuggucuucugauaccucuccauuuucuucauuuacacucuuuucagaauuaucagcaucauccauccuauaaauguacaaagcacauuuuacaaucacaguauuuacccagcauucaguuauaacaacaguaaugauaaaaugaaucucaguguaacacaaccgagccacuaaaauguuguaaguuucagguauuuuauuuaaaggaggcaaaugaccagagcugaggugguggagacacaacaaccuguuuuaauaccugaauuaaaaucuaaaaguauuacaugaaauauguuauggaauauggcuuugaaaaacauuauuuaacugaaaucaaaccagcaacaaaauccaauuaauuuuaguuacacagaaacuccaguaauuugauuuuaaacuagcauuucucacaaauacaaaaggcucacauucucuuuucauaaggcauagauacuaacauacugagaaguuaaucuuuccacuugaugcucagaaaacuugguugucaacaauaaucuaccuguuuacuuacugugaacaaucucaccuaaacaccccuucuugaaaaaaaaacucaauagcuaauauuggguaaauccaaaguaguuagugugcccccagaagcuucagaagagcacaguaguaacaacacaaacaaaaaauucccauggucuaagacuucgaaaaacuagcuggaaugagaacuguggugguuugaauaugccugguccacaguaagaggcccacuguuagguguggccuuguuggaggaaguacguugcugugcaggaggacuuugaggucuccuagcucugccuagggcagaugagagucuccuccuggcugacugcagagucuccugcuugccuuuggauugugauguagaauucuccguuccuucuccagcaccauaucugccugcaugcugccagucauaaaacugacugaaccucugaaacuguaagccagucccaauuaaauguuugccuuuauaagaauugccuugggugccaggcaugguggcgcacgucuuuaauugcagcaccugggaggcagaggcaggcggauuucugaguuugaggccagccuggucuacaaagugaguuccaggacagccagggcuauacagagaaacccugccucggaggaaaaaauauagucaguuuagaccagaacacuauucuggaggaagauacaguucaucugacuucaaaggauauauggauauauuccugguacuuuuguguaaguugguuguuuucuugcaaaagaaggaauggugaaucuauucaccagucucugaacauuuuuaaaugaccuacuacuacauucagguauucagcaaggugacuggaaaauaaaaauguugaagggcauagucacuuacaguacagugggaaggaacaccacacagaaccaccauguaccauggagaaguaccaaugacaaaagccccaaaugaggggauauuggaacacagaagggccaucuaaacccauauuugaaaagagucaguaaggguguuuuguagaucccagggcagggggguguuagaggugugggggguggggggguggguacaacccauuuguuaacuggguacauugaagaaaagauguuaacugagaaggaaugugugcuaaaaagaauagguggauuaacaguauccaagagugggcaaaaauuuggagagaaacaguacuucaaauagagauaucaaaagucacggcacguagagaaaaccacacuccaaucaugaugguuagggcacgaaaccuguaaagacucugaucuaaagagguuuaucucucaagugaaacaacgcaaaaggauaaaauauaugugguuacaugagugagugagacagaacugaaaguccacugggaacccaagggcacaggaacugcaggguuagagggggggcuggauuaucuacaggagcacugccaguucuggaacuauagcaggagguggggucuacagucuuguccucuaggucucagcuuucaauaacuugguagaggagaaggauacagaguauuucugagaaguuaucaggacaucaaugaaggagugaaacacauagccacuacauggcaucaaacaaauggaacccucaaauuuacccacuucgauuuuggcuaugcuggaguuuucuugcuaguagaguaugaggugucuguaaccucagguaucugugcuguaagaugggaaaaacaacuguaccuacauaaaaagauauuaaaugcuucuuuguaacagcguuuagcaugaacuaauugcccgccaaguaagauguuauuguauacauauuagacaacuacaccuguucaaaccuaccuuuggagaugcaggguaguuacuaaguuauuguaaggaauacuaucaaaagcagcagaugauuaugaaucaaacgacuugacucaaaaugcugccccacauaacacagcaccuugggcaaagugcuccucuaaugccauuuucuucagccauaagaacuggauaaucaguaacacagacaaaucauagguuugcaugacaauuagacuaaauucacauaaaauguggucacgguaauuacauaagaaccaugauuuuugcuuccuuagcaccuaagugcuucccagauuucuaugugcacauacuacuccuugguacuuaauaugcaauaccuuaaguaauuauagcuuagcaaaggacuuaauuuuaggcaugaaauaaguuucauuaaggacugugauauauucuagcuuuuuaaaagaaaucuacaauuuuacaaauaauuuuuugaugaaaacuuuuaccuuaggacgacccaguauaggaguuccaaaauaauucuauacacuccugcagcaaacuucuaucuuuuucaguugaccuuuuaaaauaaacuucaggaaacaagaauuauguuuuaugguuccaagggcaccucaguggcuuagugcuuagauacuuggcacaugucaagccuugguuuuacuaccaauaccauaugaaauggguauauaaauuaagugacagagaaagagcucauuaucaacaucauucucuuaaagcuuaauaaaaagcugcugguuaagacaaaugagggcuuuuuggauaguuuacauggacaacauaaauuguauaaauccuauacauauauaucuuuucuuuauauuugcauuuuacaauguaacaaauggauguguauacuugccugucuacaauaaauaugucacaaaauaaguauuuaucaacaaccuacuagccuacguugguuaacauucauuuacauccaggacuaaugauggaucuaaaguacauacaacacaggaggcuucaggcuucaacaguuugcucauuuguuaaguuuuaugcuguaagcuacugagaucuugggaggagcuggcaaaauacaggacacggaacacuuucaaaauaguauuaucaaaauaaagucaucaauuaccaugcacuaguaucguuuuaacuuucuuuuccacaaaugucggcuauagaauagugaggggcaggguaaggugagguaacccuauguggcuuaggacuuucacuccuccgucagcuuuccaagugcuggggucacaagcaugcaccaucauaagcagcucaaagacuuguauggccucaccuucagcucuagcugucgugaaacugagaaaucugcaucccaagagcuggaauuaaagguguaugguguacaacaucaugccugguuaucaacagauaaucccacugucuuagucaggguuucuauuccuggacuuuuguccaucaugaccaagaagcaaguuggggagauagccaagauuguaccuucucuguggcuggacauggaauguguaagagucacccaggugguacugguuuuaaaggcaugaaggggucaugaagagcacugagagaggccauggaaggccauuggugaaggugcagccucaguugcaauugaugucccaggacugaaggggucaugcaaaggaguugaggcuuagcaccaugaggagagccuguaagaggcuauuggugaagccuagucacagcggaagacagcaguguuuggagaugccagucccaugagaugaccaccaagagcagcagcagcagugcagcacaggcagcuggagccuagaggacaagcugugugcuacaaagggcagggcuggagaagugacccaagccccuggaggagcccagaagauugugaguuggaucccagauauugggcaguuagaguuuaauuuucccuuuugauugugacugugcccugauauuucccccucuugaaggaaguuuuuuagugaagcccacaguuaagagacuuugaauuuuaaaguacuuuggauuuuaaaagauacuggauauuuugaaaggauugaacuuuuaauauguaaagacugggacuuuuaaaguuguuuagaucuuggggaugaauaaaaacuaaggguugaggcuuaauacugauguguuugugugucaaguugacaaggggucaacuguacuggcuaguuuugugucaauuugacacaggcuggaguuaucacagagaaaggagcuucaguuggggaaaugccuccaugagauccaacuguaaggcauuuucucaauuagugaucaagaagggagguucccuuguggguggugccauuccuggacagguagucuugguuauaagagcaggcugagcaagccaggggaaggaagccaguaaguaacaucccuccauggccucugcaucagcuccugcuuccugaccugcuugaguuccaguccugacuucccuggugauaaacagcaguauggaaguguagaugaauaaacccuuuccuccccaacuugcuucuuggucaugauguuugugcaggaacagaaacccugacuaagacacccacccuugcuuuucaagacaggaauucuguguggcccuggcuguccucaaacuagcccaccucuaccugggccucuggaaugcugggauuaaagguuugcaccaccacuguccagcuaggauagucuuuauaaauugauuugggaagcauuccauuuaugccuuauaggcaagcaagcuacacaauuuuuuuaaaaaaaagacaauucuuuaaaaauaugucaauauugagcaaaguccaauguaaaggaaguaacuaaaugacuuuucucuuccaaacugaaaugcuuuuacaacagaauugauggagccaggaguuagaauggaucccaaagaccaacuggucuuaaaccuaguuucugcuuuuccuuuuccaaaucauguuucaggaauuaaauuuuaauguauuauaaacaccacaucaaaaacacaucuuuggcugggcaugguagggaugcuuguaaaugcaaccuuugggaggccagccugaaaagacacagccagcucaggggaguaagguacaucuccacgguaggacuuaggcuagugcauguuaggcucuggguuuacuccuagugucagcccugcucaaugaucucaggcugacaauguggcucagggguaaaguacuugcuuauuaacaugugcaaaaggguucuuaguuugauccuuaauucccccucacucccuacaaccaucuuucugggacacuagcaaaaaacauuauuuuaaaucuuagaggcaagugaagaagccacaguacagcagucgggagcuggccuuuagagccacauuuacaaaguuaaauguggcuaucacagugcgaccuugagcaaacuacuucaugucucuguguuaguuucaucacccacaaaauaccagcaacaacaggacccagcgccacaggauuguuacaagaauuaaugagcuacuauuugaaugauuugaauaguaccuggucccuggugacuucgaauacauuuauuuuuuuuuuaaagcugaaguaaagaggcugacaaauguacaggccaguaaaacaaaagccauuugagccuuuaaggaaaauguaaacuauguaauaugugugcccuuaauuuuucuauuuugaauagcuuccuguaacuacaagcuauucagaguaacuugaagccauuuaggucagcaacacacauagugccugcuuucauaucaaacuguuauuuacuccauuaauuauuuucaaauuagcaaaaauaggacacauugagaagaauuccauuuacacaauuucuaugggggaagggaggauaaauuaaaaacuaccaucaguguuauguaguugccagagccuaaacaaacccacgcuuauaaagauaggauuaaauacgcaaauaauagggcugacucugacucaaaauaaaugugaauggauccuccccucaaauuaagugaauggacauaauaccaagaacuuuucagauugccagaacuacuuagcugaacagccgaagacacccaucaagcuaaacuaacauccuguaacugccacaccaugaacuuggacaauaagcuaucuuaaaauccuaucuguucucugcuaagcccaauugucacaaccacaaugcaacuuucaagcauacuuaauaaaaacaaauucucugucaagcugaguaaaguaaaugacaggggaaccccaaacuagauucucagcaaagaaaccaagcuaucugucacaaguugcuggaaacgguaucaaacacuuuccuaaacaggcugaaaacauagauaaugcagauguaacugggggguggggggugggggggguugcuguugccacccagucuucagugguauucucuuuaaaguuaagcuuuccucgcauaaacgugggaaacaaaacacugcucuucuuuaagcaacagcuaguccuuuugcuuauucaaggauguguucucuuggcuucaaauacuucuauagucgcuuaauuaaaaacacagauuagaaugauuuagaaguagcaacgauuccuaauacuucucccaugucccuuccuaaaggcaaaaacaaacuagggcaaaaaacugccaggccucaaaacccagguagucuaccuuacuuugccucaaguuugaaaguuagaaauaagcuaccaauggacagagaaauaccggguugugguuggaaggaagaguaaagggcaaaggacuucgcuagcacaauuuccgggacagucaaaagugugacccuagcacccccgucucugcuuuuaccaucagcaggaucgcaaggauagcauaugcguuaggaaagcggggcuuagccugccggccgccacuauuccucgggucucuuuagggaaggagaucaccgaggguugagaucggagagcuccacggucccccagggaggugcaggaaggcgcgaccucagggcagcagcagccaccacgcuaacuggaccuguagaggccgcucgugccgccgccucccggggcaacgacggacagcaggccgcgcugccggcaccucaacagccgcggccccaccggcagcaaagcccaggccgcucccacgccucccgccgcaccacccacggcgcgcggcaaggcaaaguuuggcugucgccguuaggccugaacuuucccgcccgucgcgcaggucgccgccgccgccgucccccgcauugccggccuggaggcccagcuccgacacacccgcgcggugcacuuacucagcuugcucccgcagggacgggggcuccguggcggccaucuugaacuucccgacuccuccgcgaugcuggcggcggcucggcgaaccguggacgccaguggaagcggaggaagaagggacaggcagccgcgcaugugcggagcacguagagaaaagcggcacucgggaguccgcgcuaagaauccggauagaaaaacucggcguccgggggcggggcgcggaacguaacuuccggggcuagggggcgggccguggggagaagaaggccugauucacuuagagcgcugguuauguguguaagugugaguguguaaguguguaaguguagggaccugcuggagacagcagcaaagaaaggggucgggugcauugcugagagcugauucuccaug

SEQ ID NO: 6988 - RNA, 3326 nt, Mus musculus
ugacuuuagaaggcauuuuauucaacuguggguguauuuauuguucuaggaaggaugucugauuuaccauguuggagaaagugaaaacuuuagaaaguuguuucucccaucuccaccccaugacuuacuucucucaagguucgguuacucccucuacuguuuuaaacauuggauuuugaagugcuguugugcucuguguauauccuuaagcuugcuaccugcuucucaggacaccagugccaagccaucuguuuugcuagaauugggcuccuaggucacguguguguagccgguagccuguagguggagaaaaggugcagcaccuuucaguucugagaucacagaagaaaggcccucugcagccacccugcuucccagccgcccuccagcucugcccagcagagggugcugggacgcagagaaagagugggauggccagacaggaccgaacacaagaacuaaccucgcccacccuugugaggcagcuguuaaucacccccuuuaaggcugaagacauuccagagcacauucaucuccacgugucccacccucugugacauuggugacuguccuguccucucuugucccaagugcuauaaacaauaaaguaaccuuaccuggguuucuagacaagacaguuuuuuaaacuugacuauucuacaaacugaugaugauagugugugagugugugugugugugugugugugugugugugugugugugugucuccauguguccauauccauuccuguauagucuaccccauggcuggugauaaaugcccaaagcuauuugagaaaauguccuucaaugguagauaaucugucugaggaguaguuaaacguguguaagcgcaugccuuaaaugaaaacacauuggcccacuuaacacaggugucugucccaugucuaugugucuaucuguguguccaagguuauauuuguuucaaauauggaaaaauauagaaccaguaguuaacaaugaauuuugcuacauaaagauuugagucaaaauucaaaucccuuccccaaaagagagaacuagauauuauaucugaagaauaauaauauauuugaacugcuauggucuuaugcacauuaaaaaugugcuaaccaguaauuaguuuuuuuccucuucuaaauguaaaaaaaugcuuuuauuuuuagaaacuuuuaaagacaaacguaacuaauguuaaucuuuuuaauaugacuuuauuacauuauacuuuauccugugugcauguguauacugaggcaggaggaucacauauaaggucaauuuaggcuacauggcagaaggagacaggcugagagccaugugcuaucuagagcaguaguugucagcauguggguuugacccuuggugggggauugaacggcccuuucauaggggucaccugagaccauaaggaaacacagauauuuacauaaugauucauagccgcaaaauuacaguuacagagaaggaacaauaucauuucauggcuggggguuaccacaaggugaggcguuguauaaagggucacaguguuaggaagguugagaacccugccguagaggcagggccuaugugaggggggacagccugaaggaagaccgcccucccacagaguccacugccuuaaaugaagaucaucugcagagcucugggaagcccaucccugcugcuccagccugcauccuuugucaugcaucccuagcaaacccuguggaaggccgguuccuucuaaaaauauaguggacccaaaguuagggacagucuacaaaauaaguggaaaacuuuucuaaacuacaggcagaggucaugauaaaaaagacaggaauugccccagauagagagcaaaaagaaauggaaggaacgcagggcagaucccagaacagaaaggcacaucaaaggggccauggugaagugagugaaauuuacauaaaguacuccaacaaagauugaaauaaaauuaguuaaguauuaaaaaauuuaaaaguaaauugacuuuuaaaagcuuguauuuuaauuuugucuauaaguguuugcacuguauguauguauguauguauguauguauauauaccacaugagugccggguaugcacaaaggccagaagaggguguuugaacuaaauuacagacaguuaugagccgccuaguaugggacuggagcugaguccacguccucuccaagaaaaaaaacuauucugaaccuccuuccagcccaugagaagugggguuuguuuguuugccugcuuugguuuuuguuuuuuaaauguugagauucauuaaaguauuuugauuggaaaagcagaaaccauuuuuucuuuguguguguguguguguguguguguguguguguguguguguguguuuucccauuuguugcacccaaauguguuggcuuuuucucuauuccauaguuuuccccaaucccaugacauguccacuuugacuguuccuuacacaugcauguagacaucuugauuggguccuucccauaaguacuccacagccuagcccaacaguguucauucuaacuuugccuaacuugguuggaugucuuccugucagugagacuccgggcucuuguuagccauacugcguuuucucauucgccgcccaguucuuguucgaguuugucagcucacauucuuauaugaggaacaaccuuauuaacuagaucaaguuuuaaugaaugauagcccauggaccaaauccacucugcuuccuaguguuguagacaguuuuuuggaauagagcccgcccaucuguuuguguuugucugcgguugcuuuuaguacauugaucaaguucuuucagagaguggauggucuguaaggcugaaaauacuugcucucucacagagugagcuugcuaacuguugaauucuucugagaauagauuuuuuuauaugaaauuuugucuuuagcuuuacugagugaggauaauguuuuccaguuuauuccucuucugcucccuucaguguggugauuguacucauuuguacaauugggcacacucccuauuccuuguauuuaaauuguagggcuucccacaguugacuggaaugaaauauuuugacuaagugguggaaccauauaaaaaggcauaccaaauucagugcccccugcucccacccuuuccuccugucauucugacaaggucugcacuuuguccacccauugcucauccccugcgggugaccagccuucuuguaugucuuguacagaugaguaaguauguguauauguuguguauguaucugcuuggauugccguagugagcagcggaucauagauuguauccuuucgaaaguucuugucugccuuaagcca

SEQ ID NO: 6989 - RNA, 11552 nt, Mus musculus
cuuguuuggggagauuucagaugcucacaccaggcccaguguuacucuucuugcccccugcugaucuggauguagaaauuucagcugccucaccaguaugucugccugcaugcugccaugcuuucugccaugaugauaauuggauuaaacuucugaauuguaagucagccccaauugaguguuuuccuuuugcuguguuugcuguguuugcuguguuuugcugaguuugugaguuugcugcuuucucuuccuagcaaaagaaacucuagcuaagacaccuaccugugugaaguuauauucuguucaguucuuaggggaguuagggagaaauuguagaugaugggauacaugugaaacgaaagcagagacuggagcuaucugggauaaggaaaagagccuauuagaaggggcagggaaugcagggaaagguuuaauucaaguaagauuuaacugguacacacagcaucaaaauagaucucacagcaguugguagcaauuuguguugagaaaaacguaaucacuacaauaauagaaaguaaaguuauuaaauagcaauauacauugaguauuaauauaauaugaggggacuuacaucuugugagaacuaacuuguugauacuuggcuaugggaagauuccagugaccauuuaacguucacuugguucaaaucuugcaagaauacauugcacuuacaauagugcugagugugggacgggaaacauaugcuuagaggaggcugggcauuuuacuucagacagcgaggccagugcccacacucagauuuauuuuaggcuuggguucaccuauucugagugagggauuggggcaccugcuugggcugggugcuuucuuuacaguacuguggucuuugcccucucacaccacagggggucaaaguagaaacucuggucuguuuuggacuuugaugaaaacauaguccccagagagcugagaaagguaaacacgaugaaagguucucacagcagcaaaaguguagaaacaucugggacaggaaggaggcagcccugggaccauaaacaguacgagugccacuguuuacugucccaacuucagagugcgcgacuauugaucacagacaagugcaaacuuuggaguacagaagugugaucagcuacggaaaacacacgucaaaauaccuguuuauguuucugauccagaugucccaugacuucuacgcucuguuuugucgcacugcguucuugucuuggugccuuguuuccauucugagguguucagagccuguggcuguuauuuaaccacaguggaaagaggagugugauacagagggucagagaggggagggggagggggagggggaggggaacuacucgaucaacccugacugagugagcaccuacucugugcaaaguuuuauguaucuuaucagcuacccauuuuuauauuugcuuauauauuguuucuaucucauucccagacuccaggauguuagcucaccaaggaaagggaucuaggccuauuuuauugacggcucagucccaaucucuacagugucccuagcuggguuuguaaucuagcaaucuggaggauuacugcaaauucaaguccaaguccugauaagaagaggaggggaucaaggaggaagaggaggaggaggagaaggaugugguuucucugugauuguugacuauacauaauugucaugcaauguguuaacgaaugcauuaugcuaaaauguaauaucaacaagcaguugcagcaacacacacuguacucugugagaagcaacgagcacauguuuuucuguuuuccuguuuacagcaucaugagcagacacuggcaggggaccacagcucagggagcauuuguaacucacaaacauggcugcacuggguauaaacucagaucuucuguuucucaguuuuaguucagacaaaacuuccuauauuacacugugggugggcuacaaagaccagugcaauagugaugcuggugacaguggugauggugacaguggggaugauggugacaguggagaugauggugguaguggggauagugacaguggggauggugacaguaaugauugccagaagccaucaaggaaaagcuaaaaucuagcaggugaucuuccugagaugguucugucauggacuguuaaaguucuugacagauuugcuucucuaggcaaggucaagaagauuacacuuuaggaaauauuccugcuauuaauaugcuuuuucuguuuuaugaaauguauauaauaaucacgauguauuaacccacccuuuugagcagauuucugcagaacaaagaagaugugcugucuuguagugaugcuauauagacaaacagaugauuuuuuaauuauuaaugaagaucauauaagaauuccuaaaauuauauuagugauuauuuagcucuuuuauaauaggacugcuauuguccucucugguaaucaaaacugcagugagaacaaccauauuguuauuguuagagcaggaggagagaacaagauuaagaauagaagagggcaggggcagagauaacuuuuuuuuuuuuuuuuuuuuuuuagugucaugaguuaauugcuucugagauagcaagcuggcaucugcaacuuagagcacauuccaagaggaagagguuguaaaacaauuaaccaaaggucauacaaaggggaacuaaggauuuacuauagguaaauaaaggacagaagauaaaauauugacuggguuuaucuaugugaaauuucacuaauaacuuaggcacaaaaauuauaauuuuuaacuuucaaugaaccuguugagcuagugacagguaaugguuagccagauaauuacucuuaaugaauaugcauguaaacauucucuauuguaaacuucuuauucgacuuaugauuugaauuuauguguaaacuuguaaugaacuuauuaccauaugauuauauacucugaaggauguauaagugaugaagagaaagagagagagagaaaaaagagagagagaacuuuuacaaaagagaauuuaauaagaaccuuuuggagagaagaacuuuuuagagaagaacuuucauagagaacuuuuagagagaacuaaguaaaggcauugggaguaaggaauuuggagcaacugcauuguuauuguuacaucaaagcaggaggagagaacaagauuaagaguagaggagggcaggguuagagauaacuuuuuauuuuuuuauuuauuuuuggagagaacuuucugauacugaaaaacuuaaaaaauggaaauauuuuuuaaaaagaaauaugccaggccuuuaaucccagcacuuugggcagauaucuaucauuugaggccagcauggucuacauagugcauuauaggacagucagggcuaucuagagagacccugucucaaaaacaaaaaaacaaagcaagacaaaaaaaaauuaaccaaccaacaaacaaaaauaaacaaaaauacaacuuucugggcaugauggcacacaccuuuaaccucagcacuugaggaggcagaggcugguggauuucugugaguucaaggacauccagugcuauuagagagaucuugacucaaaaauuaagcaaacaaacaaacaaaaacaaagcaaaaggaaacaaaaauacuuuggcauaugauggcuagaguaagacgggaaagguuuuacaagcgacagauuaaugaacagagaggcauuuauuuuauguaugggcauucugccugcauguaugucugugcaccacauauguaccuuggggcccaaauauagaagaagggaacauuggaugccugagacugggauuccaagcuauugugagcugccauguggaugcugggcucgagucuggaacuucugcagggggaucuuauuuaauaugaauauguucaugugugcacaaaggccugcaugucuaagaaauggaggccucaugaaguaggugggucugggggcuuaugugccuucuguguauguguguaguguaugcauguucagagguguauggaugcuuguguguauacuuguguguggagguccaaaguugacauugggcaucuuccucaguugcucaccagcaaauagagauuucccucuuuuuucuuccuuccuuccuuccuuccuuccuuccuuccuuccuuuuuuuuuuuuuuuugacaggguuucucuguguagcccuggcuguccuggaacucacacuguagaccaggcuggcaucgaacucagaaaucccccugccucugccucccgagugcugggauuaaaggcgugcaccaccacgccuggcccgagauuuuuuuuuuuuuuuugagacaagguuuacugugcaagucuggcuggccuuauagucacuaauguagauaaggcuugccucaagcuuacagcgaucuucugccucugccuucugagugcugggguuaaaggugugggccaccacaccugaacuuucaccuuauaaauuggaccaaggccucucucugaacccaagguucacagauuucagcuauacugaguagccagcuugcuuuggggauccccugucucugcugggauuauaacagcagccauaucugccaggcuuuuacaugugcucuggggaccugaacgccagucuuuaaaguuuccuagcaaguucuuuauccacugggccagaccccucauguaccacuuuaacaaagaacacuagugugucagccaccaccuccuuguguagacuauuuagguugagcuuuuuuuuuuuuuuuuuuuuuuuuaccuuaucauauacauuaaaaggacuaauauugcuuaaggacguaguuggagugaccagguuggagucgcuuuaaggcagcugcuguuaucacauuggccucugaguuccuuuguccucuaugcacccucucaguuuggaagagcagaacagguugugaaaugucugacauaauaggccugcagucugacuuuggcagcuguagggcucaguaugacauuugaccaagucaggcuagaguuggguuuacucacucagaacuuuuguugugaggcagcggaaucaggugagaagcugaacugucccagguuccacaaguguggccugugaccugacuaaaacauuuggugguuugguuugguuuaguuugacgaugccagccauggguucagcaacagugugguguuguaacuuucuuuugucauuuuuguuuuuaaugugaaggcggguuuucuuuuucuacuugcaucaucugagacuuucuaggccucagcagaugaccucagcuccagccuuuuagguagaggcacaaguuuaagguaagccuggacuacguaguaagcacucuccagccccuacaaaacaacaacaacaacaaugauuuaaaaauagaauaaaacaacaacaacaacaacaaaaaaacaaaacuaggaaucugaaagccugggaguaaauacuuuagcagcugagacauguggccacgugauguuugugguugaucuaagcacauacccguagacuagauagauggcuuaguuuuucacaaagcuacuuugcagguuguaucaccauuuagcugcagcugcuccccaguuuacaguggaguuuggucccaauacauccacccuaugcugaaaauauccuaagugggaaaauacauugaauacagcucagcagacgcccacuuuggugcagcaguguggccuauaccugguaccuguuguuuucccuaacacucuuuggaaauauugaaaaucaaaauuggaacuacaguuucuacugaagguguaacuuucacaucaucaugaacuaaaaaaacaaacaaacaaacaaacaaaaaaaaaaaccccaaaaacaccaagaguugaaccaucucugugucagagacaauguguuuaaagucugggcuaccugucccugucccugucccagagagacaacugacagaaauguccugugucccaccagcucugccagaggacagaugugcaguucaagucagagacugacugugccuuccagaguauccccaaguccucuugauggcugagugaggugcucccguccucugcuccuaaggucuguccuugguuucuggggaacagaccagaaaccucccauagacccugcuuaucuccauuugcuccacaggucccuccugcuucugcuucucagaguugcucaaagcucaguccagacuuccugagcuguagaccugcaguaguaugagaaagcacccgaaguuccagacucacuuacuucacaaagcacaaaauuuggaggccagguaucuaagcaacauacuagucucccaccagcuuugcuguagauaacaccccugaugugugggucgugaugaugaugaugguugccuaggcuauuuuugggggggauagaaggccacuuuuguugaaaccacugacuuuuuaacaggggauuauuugauggaccauuucuagauaucacaggaccaaagucuccauucuuggaucaggcugauauuuccugaacauguguguguccugugaggaucagaugcguauugugucaccuccaggagccuucccccaaaucuuuaaucacucugguauauccauuuccacgccccacccuguccuuugggauguggaucugagaccuggccaaacucugaauacacucuauuuugcaaaacuucauuuuaguaaccagcauccugcaccagggcaaaggguccugguuauguagcagguacauuucugucccuaguugcugauauggaccuccuaggacucagcucuaagugaaggggaauuauguguuuguuauuuuguuacaaucaaauauauuauaauauauauaauauaucaaaauuauguaauauauuauauaacauauuaaauuuuauacacacacacacacacacacacacauauauauauauuaucugagugacuaaugaggcuacuuaaacugggaguccuagugucuuaguuaggguuguacugcugugaagagacaccaugaccaaggcaacccuaauaaggacaacauuuaguuggggcugguguacagguucagagggucauuucauuaucaucaaaauaggagcauggcagcauccaggcaggcauggugcaggaggagaugagaguucuauaucuuuaucugaaggcugcuagaagauuggcccccacaugguuaggaggagggucucaauacccaccccacagugacacacuuccuccaacauggccacaccuccuaagagagccacucccugggccaagcuuauucaaaccaccacaccuuggcagccagauuagcugguuaccagaaagaaccagugaauggacaccaaccuccauucacaggggaggcuggagccugaguuccaaaacuuuugcaaggauugucgcacauuuucacuuuaugcaugaacucugccuugugccucuucuguuuggcucuuccuaguuguaucuuacacaauaagccauguguuauuaaggguuucuucgauucuguaagccacucuagugaguuaccaacugccacaccucagcagaacaucuguauuuuccaguugaccaaauaguguggaaaccugagcaccuuauuugcauauuugcaucugguuuauggugaguuuuucagccuuuaacuuguggcucugacaccaucuucagguagaacagugucagaauggaacuguuggauacucaccugggaaucaaaacauuggcaguagacaagguacugucugggugugagaaucuguccaagugagggagacaauucacuccaaccucaaaaucucuuugaaguuccuaguucauuuuuaaacuagucugaggcugggcagggguggugugcgccuuuaaucucaggcagaggcaggcagaucucugugaguuugaggccagcauggacuacagagugaauuccaagauagccagcccuauacacagaaaaacccugucucaaaaaaucaaagaaacaaacuaguuugugaacauuauacuuauuaucacaauauaucaaugucuaucuacacguuaaaaaaaaaguguccugugcuguagauuuuguagaugcuggaggugggggcacucuagguagaucuggauugggagucccauacugucagauucaguauguagauauggacacuguacuggacacuuaaugacuagaaagucccagccaagggacugaggggccuguuccuaaaaauuccucucuagcucagggucuuuggccauaaaaauaauuuuccaacuuccuggggucaaaccugaccuuagcucagcucugggaccugaacagauguucccauccuuugugugcuacauugaguuggagugaugaaguuuugugcacauaagaucacaugggaggggcccucagccuuggggagggaugagcagccugugaguccucaauagauacuaaaaucaguaacuauugaugacuccuuaaauucugcuauaccgugcccaguuuaaaagccugggaaaauuagcuuugcuuuuuguuccuugauuuguggaccaauauuucuaaaaccccaauuuuuuuguguaaguaaguauacacacagccauggugaggcaguuagucacuccuaaacggugguccccagagccuguccucagcaucucccuguuagaaauucucucagaacugccugggacacccugaaucagauaugagggguggggugggggaaugggaggugggcaugacauuuggugaugaaguuaucaguugaagcuugaucaaggcaaaguuagcuggaaggcaaaggcacaauacaacacuuaaggaaguauccagugccaggauauagugagauguucuuccauuagucuucuggcaauuggguuuugaccggcaacccccagaaggccugacugagccuuagagggucugggauccuugcggaggagagguggcaguugcaggccaggcgcaggcuaagcgagaggggggaaugaaugccuucaagucugaaggaaggcgcuuagccauggagggaggugccagcccucuucuuugaggacagggggguggggguggggcgggaggaccuugacgugcucuagugcuaggcgccaauggccaccgggugcucuugucugccugccuagugagcucccgguggguuccugcucuguccccugcucaagcgcagcagcaaggucaccagguaaguagguggaagcuguagcuucggccuuccagcuuuuagaaccacugaggggcacaacuacacagaugcgaccugggacucgagcgguuucggggauacaggaugaaagggaagggaugcacuucgcucgauugcuugccuuaaugacauucuuguaucgcggauucccuaggccagugacagccaggacgucuccuccggaagaauaacuucacaggcuggaaaacuuugucuaguucugaaaguugagagcuaccccagaggauacagacgcgcauagcagccgcgggguggaucaaagcuaucggcuagccuacgaccuucagaaauccuagucuccacuacggacguagcucucagguguucuggcugucgcgccucccugucuuggcccuccccuugggagcuagccgcaggccagcauccuccucccucuuggucccgggcagcagcagcuaaaagcuggagguuccaggccgaauccgcuuucugccaggguaggcaagcccagccgacacuaugcgcuccuucugcugcgggaguagauaaaaguuuccagaggacucuccgcgguucccgcaggacgaaacccggggccggaucggacacugucauggaucccucgggagaacagcuacacagauccgaggcguccagcucuacgucuuccggagacccucaauccgcggaggaacugucgguccccgagguccuuugcguggagaguggcaccucugagaccccgaucccugaugcucagcuccaggaccggccccugucgccgcagaaaggggcagcucucccggaacaggaggagcuacaggaauaucgccgcucucgugcgcgcuccuucucuuugcccgcagaccccauccugcaggcggccaagcuccugcagcagaggcagcaggcgggacagcccagcucagaggguggcgcgccggcuggggacugcugcuccaaguguaagaagcgcgugcaguucgccgacucccugggacugagccuggccagcgugaagcacuucagcgaggccgaggagccucaggugcccccggccguacuuucccgucuccacagcuucccgcugcgcgccgaggaccugcagcagcucggggggcugcuggcaguggcaacgaugccugauccucucuugguacccugcgcccggcuccgaccccacuuccagcucccggagcugcgcgcugcggaggagcgucugcggcgacagcgagugugccuggagcgugugcagugcucccagccgccccgcgccgaggugaccggcucuggccgagugaucaguugccccggacccagggcaguggcggugcgcuacacuuucacggaguggcguaccuuucuggacgugccugcugagcuggacccggagucaguggagccccugccuccauugcagucaggggacucuggaucaaaggcugaggauagugaggaggggcccggcaccgagcguuuccacuucucgcugugccugcccccgggucugcagcccaaagaaggggaggaugcuggcgcguggggagucgcuauucauuuugccgucugcuaccgcugcgaacagggagaauacugggacaacaacgagggggccaacuacaccuugcgcuaugugugcuccacagacccgcucugaguccgggaacuucggaacuuggaaagagguugaccagcuagcaagggcuccccggggauccuuagcugagcaacgcauugacagagcguggagcgauaggaguaaaauguuaaaccauacacucucagcgcagauucacggcaagcucuggcaguguucucaguguuuuucucaucacuuccacugaccuuucuacucgccucuuagaauucucagccugcauccaaauaaggaacauccucguuucccagggagaggcucucuccaagaaaagggcucugggacccugaaccuuggggauuuguuucuaacuugagacuugguccuuacaccuugaugaaaaccugcaggagaaagacauggcagcccaccuccacgugggagaagaaggccuucacacguggaagcuucacagccaggcuugauuuucagaaggcuaggagggcgucagcuuguccuuuuaacugggcucuggaaacaccuccccagauucgauguauuuucuuccgugauuggauacaaaugucuuuuaagaaaguaaaggccgcgugaacauguguccucucuguguuucauguuuuaccuuccgagguuuuggggaguccguggcagucagaggaugcucggcugaugacacggcagugugacaauuaugaaacaacaguauuaacacauuuucucaugacguggaauaguccaaguuccccacacugggaauaaaaaucuucaaaauguuuuguaaaaagu

SEQ ID NO: 6990 - RNA, 1325 nt, Mus musculus
uuugagcacaaacauuuuaauggucuaaaaugagauuuuuuuuuuaagagauuaucuacaguucaaagcucaccuuuuaaugugucccacccaugacccuuuuaggagacauaaaauuaugaaggauaucaccagaagcuauguaaacauuucaucuaaggaccaagagaaguucaagguguuuucacaaggaaaccaaagagacaacugauaugaaagagcugaccgcagucagagaaaucuugggaggagaacuagagugaaggacaaggcgaugagcaggugggagagaaaaagcaaacagcucaaacagauccugugaggcgggcgacccaggacgaaggcuggcuuuggcauuaucuagguaaccccgguuuguuguuuuguuuuauuuuguuuucuuuccauaggcgacuuuaauaaucuuguugcaaaaccaguccaaauccuacugcauuaaaguccucauugacuuguuggguauagguggugcccaugugcucucauaacaaaaguaucaguucuggcaagaaagcucagcugugccuugaugguacuguuaguagaauggccuugggcuaggccaggcaugucccagcgauguucugcuggcuccaggggacagaagacugagccucauuacucuaucaauuucuuggccuugaagaagcgacgcagguagaagaccugccagguggcuaguccaaugaggcagaacauggaaaagaugcugaaguacaggacccggguguucguggacucauuagugucccucaucuccucuucccgcuucuucauguaggcaaagucauuaacaauggacucggaaagguccucgagccgucguaacuccaccuccagugguuugaguuucucgacuuuugcaaucucuucauaauuuuucgccucuacuccaugcuucaugucuagaaucacgaguuggucagguaucugcccuguucccuugcucucaaaacacacuucaaacaugucauagucuuccgugguaaaggcaaacuuccccuugguugcauccucuuuggcauacagaauauggccagcagaaucugugaucuugaggugggggcgcaggccgccagcgcccccagacuggucggugaucucguaggcgcccgucaccagcagguccuuguggaucuccucucggagacacuugcgagaguucacgggcagauggaaggagaugccgaggaccgagcuggggccgagcagcaacagaaagagccaggcggacgggagagggccgggccgggagagugggccaaacaaaccagacauggugccggagccucguucaccacccg

SEQ ID NO: 6991 - RNA, 1325 nt, Mus musculus
cggguggugaacgaggcuccggcaccaugucugguuuguuuggcccacucucccggcccggcccucucccguccgccuggcucuuucuguugcugcucggccccagcucgguccucggcaucuccuuccaucugcccgugaacucucgcaagugucuccgagaggagauccacaaggaccugcuggugacgggcgccuacgagaucaccgaccagucugggggcgcuggcggccugcgcccccaccucaagaucacagauucugcuggccauauucuguaugccaaagaggaugcaaccaaggggaaguuugccuuuaccacggaagacuaugacauguuugaaguguguuuugagagcaagggaacagggcagauaccugaccaacucgugauucuagacaugaagcauggaguagaggcgaaaaauuaugaagagauugcaaaagucgagaaacucaaaccacuggagguggaguuacgacggcucgaggaccuuuccgaguccauuguuaaugacuuugccuacaugaagaagcgggaagaggagaugagggacacuaaugaguccacgaacacccggguccuguacuucagcaucuuuuccauguucugccucauuggacuagccaccuggcaggucuucuaccugcgucgcuucuucaaggccaagaaauugauagaguaaugaggcucagucuucuguccccuggagccagcagaacaucgcugggacaugccuggccuagcccaaggccauucuacuaacaguaccaucaaggcacagcugagcuuucuugccagaacugauacuuuuguuaugagagcacaugggcaccaccuauacccaacaagucaaugaggacuuuaaugcaguaggauuuggacugguuuugcaacaagauuauuaaagucgccuauggaaagaaaacaaaauaaaacaaaacaacaaaccgggguuaccuagauaaugccaaagccagccuucguccugggucgcccgccucacaggaucuguuugagcuguuugcuuuuucucucccaccugcucaucgccuuguccuucacucuaguucuccucccaagauuucucugacugcggucagcucuuucauaucaguugucucuuugguuuccuugugaaaacaccuugaacuucucuugguccuuagaugaaauguuuacauagcuucuggugauauccuucauaauuuuaugucuccuaaaagggucaugggugggacacauuaaaaggugagcuuugaacuguagauaaucucuuaaaaaaaaaaucucauuuuagaccauuaaaauguuugugcucaaa

SEQ ID NO: 6992 - RNA, 1823 nt, Mus musculus
gcuaacuuccucuuaacugcagacaacugucuaacuggagcucauauuuguucaugacugauucacucacauacauuuauauacaguaaaacgcacaaggaguaggucuaucacccaucucuuucuggcaguguuuauaccuguguaauucaaacccaucaagguguuaaaauuaucaucaaugcuaagaagugccucuuuagcacuaaacaaacaaacaaacaaacaucaaaacaacaccaacaauuaaacaaaaauccccacagcagguuguacauaaucagacaagacauuuagugucaagcugcagaaguuuccugaugauucuugucaaugagccuaaaagugugucuacucuccaagagacgggaggacagcagaugagcccuccagcugcuuguaauugucauggaugauucugguugcauuggugguuuccugacuguagugacauugucuguccaccugacuuugcuccagaguuuccuucagguagaaggaagaaugggcaauguugcugauucuccuaacgaagaccucagggauucuggugguccuugaacacccugucucuguagagugucaggagguuguugacgcgcagcacauaccuacaggcuuaaugcucuucagauuuaguuuugugguacacagcuaacuuugaggaggagagacauuugaaaagcccccauaauuaucuaagccgagggucugaggacaugcugauguagaaggaauucucucuucugggcuggagccucacaggaaaaauggggguuugaguggaucucagucccuggcuaagcucucagcuuucugaucucaccugcaaauagguggcuccugugguauuuauagcaagauguggcucuugagagaucucaugacguugucacaggagcaacggacagacuccguuacuuuucuuccaggccuaugcugugcacuuugugguaugcuauagugcauauuguauagucugaauuuuaugaauaaacuguuguuuuccuaugagguuaaaaaaaaacuguccucuggucccuuuacagucagccucucauuaccaguauuuuccagaggaauguuucauucuaauuuuucccuccacaaaaaaugaguuuucugucuuauguuacauaaagaaaacaggauaguuugucuggucugugacuuucauguguuuguacaaaauagccacaggucuuuaacgaucaaccauuguccauaggaaaagcuuauaguuccuaauaguacaguguuuugauauauuucuguuuucaugagaccuaaauuuguaacuggcguuagcaucuguggaagguuuuuaaaguaaugguugccuacccucucagugccuggugagacugacuagagcuacugcuuugcuucugcucucuggaacacacauaaaacuguuguuccagacagucauuuuacgugcuguacaaaauauuacauuuaaauuccuggaguagcauagcuguuguguaaagcuaucuuucugauguggcccuuugaaagcgguuucuuaauguaucauauucucuguggccucuccuuuuggugggaacugagaacuuaagguguguguauauuuuuucuuuuaagucauuuauuuuuuggucauuuccucacuggagaguuugcuuaaguugcuuuuguguaggaagaauaaugauucuuucaauuuuuuuguuucauuuuccuuuuucuuccuuuuuacuauuuaaacccaaagcuaaauuuuauuuuuuauagauuuuaaaaauguguuuaauacugcuuucuuauccauguacauaucaucauaaacuucauucaug

SEQ ID NO: 6993 - RNA, 8858 nt, Mus musculus
cccauuucaaacaauaacuuuuauuuuauacuucucuauacuuuguagcaaauuuuugcugaauuuaauuuauaauaaacuuuuuaaauuacaucucucucuuuuuuuaaaaucaaggcucuuuuaugucaaaaucuuuuuuuuuaaauucuauuuuagauuuaacauugauuacccccuugugaucuauaccguuggauauucagguauuacuguauguguaacagcuaaaacaagagaggaaggaaaauaaaggcaguggaccugaacgaggggcaucgacaauagcaggugaaaccggccccucaugaccauagcagcaucucuuaugacaaccuaucccacuauacccaaccucuuucucucucucugucuuauccuuaaaaaaaugcuaagcccacacucuuguguuuucgcuuuucuggaggagaaaugugcaguggaaaugaucaaaacaagguacuguggaagaaagacgugagcaugauuauucaccggcugauucccacguggacaccacucuugaagucauuccccuggccuucuccuuuucccucucgcuuucccauuaggaggagcccaucauucuucauguuaucaacaugauuaauauaguagguggcccagggccauuccugagauucuuuugccaaaauaaaauaaaauaaaauaaaaauuuaaaaaugggggugaguuugccguuuucuuauuuuucugugaagacggacuaaaaggugagguccgauuuuggcugugcucgcucgcucacugaucgguaacauuuggcaaauaaaacacaaggaaucaaacacaauuaaaaagaagaaaaaaaaaagaagaagaaaaagagagaaacaggauuucccacaaucccauaugaguguuuucaacaucacagagaaucacaacguccucagagaacgaauggcuauuccucucgauuuccgggagcauggugugagugugggugagugagcggagggggagggggggacccggucccgcgcucagaaggaaaaccaggucgcuaaagcugccgagagagacaccaggagcacggaaagcgccgggagcagggaccccgccgccccguugcugcugccgcagaguucgaauaagcugccuuggauguugagguuuuucgauucuuuucucaguuuaucccacauaucuuucgccccuuccuggcaauccguaagagcugugaccgugcagcuguggaaauccucccaguaucuggggaggaacagaacaaaacagaaggaguagcaucacuuugggugcgggaggacccuaggucugcgccccgggugacugcguccuuucuaaccuuccgagcaucuucucccuacucuccccccugggucccagagaccuguucugaacuaaguaauguccugucugaucuuugguucaucccagaaaccuggucccagggugugugagccucucuuucuccccucagauuuuccuagcccggugccaagagaggaccugacagccaggagcggggucgcacccgcugcguggcgcuggcacuguggccugcgccaacagauugcucacccuccuccgggaaagcuaagaaaacagcacuaagccuugcaagcugcggcccauuaaugccucuuagcuagcaagaugggcgacuugcucugagccaggcccucccccucccuggcuucucacauucuccucccccucgccccuucuguuucccuccucuccgcgccgcgguccucucgccuucgcuuugcuucucucccuccacccagcccccacaccuuccuuuuguuuccaguuucucuucacccuccccacuuuucuuuuccccuacccuccguuucccccucuuccuuuccucguuucccccacuugcuucgggucgucccaggccaccccgccuuucaaccguccuagcgcuccaaaggcgucgggagcccccgccuccucgccucuccucucgguucccuggucggucggugaguguuaagugccuggucaccuaagcgggcucuugagccuccuccagcucuugcaaacacccaugcuccuggucugcgagcugggugcucccuguaacuuccucucuagccuucuacauagguuugaaacucaggagcuucucuccuaccuccuccagguuguagcacccauuucucuagagugggcaaguuggccaccuaugcaggucccccuggcgcagggcuugcgaucccccuaccucuggucaguucccgaaccaucucaaguaacucagcaccccccaaccucaacccccgacccccuucccgacuacacacacacacacacacacacacacacacacacacacaccuccgcucagauucagccccgcccccacaaccuucauccaaccuucucucucucucucucucucucucucucucucucucucucucucucucucucucucucucucucucucucucucuuauugucccaccuuucuucuggaaaccuaaaauagauucccgaaacuaaauauaaucccacggcgugaucgauuccuaaggcgcugucuccuuucggagcugggucgaucagcgcgucugguaacucaggucugguucccacuucgcccggacccugagauuagggucagcagccacucuuagcaguguggaugguuuuaugguuugcuuguuuuuguuuuguuuuguuugcuugcuuuuuucucagcucuuuccuuuuuuguucaccgcgggacuguaagcuuguugaaggcaagcuuagccuuugcuuccacuucuaacuuggcuucugucccauugcggaguuguaaacgcuaguuggaguuccuggaacccgggcugucuucuaguugacuuuccccauucucugaguuauuagggcucugggaccugggcacagggacuuuccguuuccauaauuuauaacaaauaccaacauauacagucccuucaaggcccgaggacaacuccuccgcagaacuccaaaguauaucgcaccugggaagccaaugacacaaaaacugcuccuuucuuuagguaucccagauaggaacagagcacuucugaagugggggucugaaaguugaaaauccacccugggcuuggaaagguggacuucacccacuugcugagcacuuuuaacuuagaggggucugcaucccacugccugcaaccucagggacccuaccuuaccuucucuuucuuaugcuuuccaggacccuagucuugcuaaaauauauauauauuaaaaacagcgaggaauauaccacuguuuuauuauagcacuguaccagccacuuacuucuuggaguuucuaguagguacugagguguuuaggaaaguuuauagcaagauguacaccccccccaucugaucauaacuuaaaugaauaucccucuuucuuauuuaggaagagaggagccgcauaugcacaaaacaugacauggaaaaugggcacuucaaccucugggaacaaagacuccuuccugcuuuggcuuuacugcaagggcauuuuaugggaaugguugaauauagcuguuuuuuuguuuguuuguuuguuuguuuguuuuuuguuuuuccccaaaaggaaaacaaaauguauguugcaggagaugggaacauuucuaagaccugcagcagcuaggaugcggagguccauuugggggcuuuccuugucaccucaccuacugccagcugugggccuucuagucuacuacugagaaaacacuacccagucuggcacugaaggccucuucucucugggaucuguaguuuccccugucuguugagauaguagauaugggaaggggaggggggcgggagcaaggagguuggcuacucaaaaccugagaauggacuagcaaagccuugccaaugccguccaagcccccaaaucacugacacacaauaugguuucagacuuucucuaagaaacagggagacccucccucccuuccugaacguggccucuauuuuggucuguuuuggaggggcuuugccuuuaacuaaauguagcaucaccccaauucuccuuaaaccagaaucaacuguucaagaguccuaggcaggcugcccacucacaagaagaaagauuggagauuaucucaaaggaaagauuuuuguggagcaagaaacugcuaaacugccacuuuuccuggguccaagccuguccuggugcaggccuguaaggguggaaagcuuaugguaguggaagauucucuuucuuagccuuccucaggccaccgaauccccuuagauagugcagacuuuaaaccagggaacugagccugagggcagccuuggccagcaggcagaaaggcacagaugccaaccagcagaauauugagcaaauggggcugggggucgagaggggaggaggugggggugggaggagaacgaggacagaagaugaggguggggagugaguggcauguacucugaccucagcagagccagcagaagggaaacccagggucagagaggacacuuacgugcacacggucuugauguucgucuugucguccaggcccugcggguaguuggccaugcugucgcccagcuugagcaaacagucugaaaagcccuuaaagacugcaucacacuugcccgcugcucucacggccugcaccagguaagcuguggggaggagggacaccaguaagcaucaccgccacucugccccacuacugacccuaaggcuccuuggcguggucucuuuucugauccagcacuguggcccaggaugaccuauuugcauucgguccaccucuggugcagauggagggauccgagggagcgugggugggugaagagggauagcagggaggugaguccauuuauuuuucuccagcccgcucccaacugcucucuauuucuuuuucuguuuuccucgcccccucuucucaccucccucaucuccuuuauuacccuuuuuuuccucacucccuccuugucucucaacacuuccuccagcaaaaacccugucacgucucgcggugcaaucuuccauuuuugugguggcagaggaggucugagaaacagugugcuggggacgaaaacgggccugggaaagguggggaggcugggguuacgcagcugaacuaagcgccacacccccagaauagccaucggguacccggaucuuugccaggagcucaacaaauaauugcugaaugaaugaaugaaugaaugaauggucuuuggaagaccacaacggccaagggaacaggauauuauuauuauuauuauuauuauuauuauuauuauuauuauuauuauuauuacuguuauuuuuauucugauugcccagcucggagucucuucuuugugaaacucuuaggugaauacuuccucugcaccucuaaagaagggcaauaaaugucaagagaccuaguugggaugaggauuggucucaguagcuguguguguguguguguguguguguguguguguguguguguguguucccgcgcgugugcgcgcgcgcccuguuuucucuuugcuucucugcaucucucaccuuugcacaccccuuuuauaucucuggaaacagcuaggucagaccuuucuucucaaggcugcagccaggcugcuaggggcccagcaagcugcggccuagaacuuuggcucggacagggauggggugggggcuggagauggcacaaucuguggcagagguggugggggagagaagaaaaaauuucaggccacacugaggucuuagcuuccauacucaaaccaaccaaacucggaggcggugaauuuaagagcugcuagguuccgggaaggccagcgcaacuuaaacuccauuucuucccaucuaguggcuaacaaaaaucccaggguacccgaagggcuagagagaggcgcaaaucaccgcuguaagggcggggaaggggagacggugaauuccaaaauggaagugggccaugggcucuagggggucugagcucuggccucuucugcguccaucccggggugaaaacucccagaaggauagaucaccuagcacccucagucucagucuaccugucucugaacaucaagcuacugcagacucgcgggaaggugacccagucagcugcagacagccgagagcugcgcuuggcagauugcagcaggaagagcuaggcgggacuagugcuuucuaauccggaacgggaagcucugcggaagggagcgagguuaacuuccaccuuagcuggggcaaacacacaaccuuccauagaccuauaccgauuucacgccgauuuuaaaaagaagaaaaaaacccuuggcacuauaauaaaagcaaaauuuaaacaccgacaccgugucuuaugaauacauaaaucguuguucuacuguagcucggccacgaugaaagaaaucgcauuaagcuuccucuauaauguauguuacaaacaugccuuugcgagaagaaaacaaaaugcaaccuagccucucuggccgcaggcccuuccucacucauugcuccucccccuucccccaaaaucagcguuggauuuuaaaagagggcuuggggcuuucuggaggcgggaagcuuuccugucacuuuauuuuuuuuccaggcguugcuggagcagaccccgcagggcgcaugugugugagcguguguaaaauacgaauucgggaacaguucugugucuagaaauuguggcuucuagagcucuugcacuggaaagccggaagcagugcgcgggacagagggugcaggcaccacacaucggucgaguucccaguccuuucugaacccgguuucuguaaccccgagacaggcagccggccugucuccucugcauccccauccagugcgguuuccauguucucauucauuucuuggaccucucucauucaucccaaacuuccucauucguucuccauccucuacuuccccgccccuccccaacccccacgcuucuugccaaaugucaguaauuugggacagcuucuauccaugaauuaauaaagacugaggcuccaauggggggcgggggagaaagguagauauuuaggaacauacauuuuaauuccacuaugaaaauuuuggucaucuucaggcugagguucaucaaaugcaucucuccugaaauuacuguuucauuauuucuauucucaucuacuaggaaaacagaguccccaaacauccuccaggugaagucccuaucuuaaaacauuagcuguuucuuaaucuaugaacauuagucgucuaacugcaaaaugccacacucacuuauuucuaacacuuacagcauuugcugcccuugggaucuauguccuaggaugguugcagcucuuugaacuaaugucaaaggcacaaaaccaccagaugcaaagcauuaagucaucuccuaaaauuaaaggaaaaggcaacaucccggugcaugcuccuugcuuugcaaaaaucccaguuucugcaaaacaauaaacaaauaaacaaccaaaaaaaucccccaaacaaauucucaagaauauggcaaaugcauauggaccccauagaaagaaucaguuuuaaugcuccgaaagccccaauuucucuauauuucuuaugaagaaaaaauguuaaguauuucuucucuugucccacacaaauucccugacgcaccccugaaaugcugcaaggauuugucuguaaagaacgcuccagccuggcacgaacaguuuucuccaucugcagaauaaccacugggagacuuucuauuuuuuuccuuuuguccauucuauuaauaagcugcuuuaauuucccuuuucaguuacauuaauuaauguuuccauccaguaucacauaagcggauucacuaguacuuaaaacauuugcauuuuggauggaaaaauauaaacuuuaaaaaagccucccaacaguguagcugagacucacauuccuuaacaugaaaugggggggggggcuaaauaaauccauccaauaaaccgccacaaacaaaaauuacaaacccacgaaaagacaaaaugcgaacacguuaaaccacuuuccuguauaaaaauaauagagaugcuaaucugccaaaaaucacagacacacaugacccugaaaaaguauaucagugaauauuugguugauuuauccuucucggaguagucugcggugcccggagcaaacgcugcagcuaagaucuagggggaggggcggaggaaggacaaaguucuaaaugcugcaguuugagggcagccuuagaauaucuuugcuuucugcauauaaacuuuucagcccuagcuaccuaggcaucuuauuccucccuuuaccuuuugaccccucaagauaguaucuugcaguauaacaggggacaaaugcuacgagcgcucagauccuguuuuaaccccaaagagggaggaaaaaaauggaugugcgcuuuggagaaaagggagaaccccccuuggaaaacagccggucacacacacacacuucccugcaaaagaaaucacuuucuuuaggaaaaccaaaccagaacuccuuccagaguccccaagagcuaaugccccgacucagggagucugcaggguuuucugcaaccagcggcagacccuggccagcaaguccccuuaggcgccucugggguaggcaaucuccggucgccuaccaagccguaccgggcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagcugaaaaauaggcauugccaacaaguuccgggagcgacagagacuuuaugcacugggaaggcagagggaggagagaaagagagggagcgaggaagagacagaaagagagugagagagug

SEQ ID NO: 6994 - RNA, 8858 nt, Mus musculus
cacucucucacucucuuucugucucuuccucgcucccucucuuucucuccucccucugccuucccagugcauaaagucucugucgcucccggaacuuguuggcaaugccuauuuuucagcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcccgguacggcuugguaggcgaccggagauugccuaccccagaggcgccuaaggggacuugcuggccagggucugccgcugguugcagaaaacccugcagacucccugagucggggcauuagcucuuggggacucuggaaggaguucugguuugguuuuccuaaagaaagugauuucuuuugcagggaagugugugugugugaccggcuguuuuccaagggggguucucccuuuucuccaaagcgcacauccauuuuuuuccucccucuuugggguuaaaacaggaucugagcgcucguagcauuuguccccuguuauacugcaagauacuaucuugaggggucaaaagguaaagggaggaauaagaugccuagguagcuagggcugaaaaguuuauaugcagaaagcaaagauauucuaaggcugcccucaaacugcagcauuuagaacuuuguccuuccuccgccccucccccuagaucuuagcugcagcguuugcuccgggcaccgcagacuacuccgagaaggauaaaucaaccaaauauucacugauauacuuuuucagggucaugugugucugugauuuuuggcagauuagcaucucuauuauuuuuauacaggaaagugguuuaacguguucgcauuuugucuuuucguggguuuguaauuuuuguuuguggcgguuuauuggauggauuuauuuagcccccccccccauuucauguuaaggaaugugagucucagcuacacuguugggaggcuuuuuuaaaguuuauauuuuuccauccaaaaugcaaauguuuuaaguacuagugaauccgcuuaugugauacuggauggaaacauuaauuaauguaacugaaaagggaaauuaaagcagcuuauuaauagaauggacaaaaggaaaaaaauagaaagucucccagugguuauucugcagauggagaaaacuguucgugccaggcuggagcguucuuuacagacaaauccuugcagcauuucaggggugcgucagggaauuugugugggacaagagaagaaauacuuaacauuuuuucuucauaagaaauauagagaaauuggggcuuucggagcauuaaaacugauucuuucuaugggguccauaugcauuugccauauucuugagaauuuguuugggggauuuuuuugguuguuuauuuguuuauuguuuugcagaaacugggauuuuugcaaagcaaggagcaugcaccgggauguugccuuuuccuuuaauuuuaggagaugacuuaaugcuuugcaucuggugguuuugugccuuugacauuaguucaaagagcugcaaccauccuaggacauagaucccaagggcagcaaaugcuguaaguguuagaaauaagugaguguggcauuuugcaguuagacgacuaauguucauagauuaagaaacagcuaauguuuuaagauagggacuucaccuggaggauguuuggggacucuguuuuccuaguagaugagaauagaaauaaugaaacaguaauuucaggagagaugcauuugaugaaccucagccugaagaugaccaaaauuuucauaguggaauuaaaauguauguuccuaaauaucuaccuuucucccccgccccccauuggagccucagucuuuauuaauucauggauagaagcugucccaaauuacugacauuuggcaagaagcguggggguuggggaggggcggggaaguagaggauggagaacgaaugaggaaguuugggaugaaugagagagguccaagaaaugaaugagaacauggaaaccgcacuggauggggaugcagaggagacaggccggcugccugucucgggguuacagaaaccggguucagaaaggacugggaacucgaccgauguguggugccugcacccucugucccgcgcacugcuuccggcuuuccagugcaagagcucuagaagccacaauuucuagacacagaacuguucccgaauucguauuuuacacacgcucacacacaugcgcccugcggggucugcuccagcaacgccuggaaaaaaaauaaagugacaggaaagcuucccgccuccagaaagccccaagcccucuuuuaaaauccaacgcugauuuugggggaagggggaggagcaaugagugaggaagggccugcggccagagaggcuagguugcauuuuguuuucuucucgcaaaggcauguuuguaacauacauuauagaggaagcuuaaugcgauuucuuucaucguggccgagcuacaguagaacaacgauuuauguauucauaagacacggugucgguguuuaaauuuugcuuuuauuauagugccaaggguuuuuuucuucuuuuuaaaaucggcgugaaaucgguauaggucuauggaagguuguguguuugccccagcuaagguggaaguuaaccucgcucccuuccgcagagcuucccguuccggauuagaaagcacuagucccgccuagcucuuccugcugcaaucugccaagcgcagcucucggcugucugcagcugacugggucaccuucccgcgagucugcaguagcuugauguucagagacagguagacugagacugagggugcuaggugaucuauccuucugggaguuuucaccccgggauggacgcagaagaggccagagcucagacccccuagagcccauggcccacuuccauuuuggaauucaccgucuccccuuccccgcccuuacagcggugauuugcgccucucucuagcccuucggguacccugggauuuuuguuagccacuagaugggaagaaauggaguuuaaguugcgcuggccuucccggaaccuagcagcucuuaaauucaccgccuccgaguuugguugguuugaguauggaagcuaagaccucaguguggccugaaauuuuuucuucucucccccaccaccucugccacagauugugccaucuccagcccccaccccaucccuguccgagccaaaguucuaggccgcagcuugcugggccccuagcagccuggcugcagccuugagaagaaaggucugaccuagcuguuuccagagauauaaaaggggugugcaaaggugagagaugcagagaagcaaagagaaaacagggcgcgcgcgcacacgcgcgggaacacacacacacacacacacacacacacacacacacacacacacagcuacugagaccaauccucaucccaacuaggucucuugacauuuauugcccuucuuuagaggugcagaggaaguauucaccuaagaguuucacaaagaagagacuccgagcugggcaaucagaauaaaaauaacaguaauaauaauaauaauaauaauaauaauaauaauaauaauaauaauaauaauauccuguucccuuggccguuguggucuuccaaagaccauucauucauucauucauucauucagcaauuauuuguugagcuccuggcaaagauccggguacccgauggcuauucuggggguguggcgcuuaguucagcugcguaaccccagccuccccaccuuucccaggcccguuuucguccccagcacacuguuucucagaccuccucugccaccacaaaaauggaagauugcaccgcgagacgugacaggguuuuugcuggaggaaguguugagagacaaggagggagugaggaaaaaaaggguaauaaaggagaugagggaggugagaagagggggcgaggaaaacagaaaaagaaauagagagcaguugggagcgggcuggagaaaaauaaauggacucaccucccugcuaucccucuucacccacccacgcucccucggaucccuccaucugcaccagagguggaccgaaugcaaauaggucauccugggccacagugcuggaucagaaaagagaccacgccaaggagccuuagggucaguaguggggcagaguggcggugaugcuuacuggugucccuccuccccacagcuuaccuggugcaggccgugagagcagcgggcaagugugaugcagucuuuaagggcuuuucagacuguuugcucaagcugggcgacagcauggccaacuacccgcagggccuggacgacaagacgaacaucaagaccgugugcacguaaguguccucucugacccuggguuucccuucugcuggcucugcugaggucagaguacaugccacucacuccccacccucaucuucuguccucguucuccucccacccccaccuccuccccucucgacccccagccccauuugcucaauauucugcugguuggcaucugugccuuucugccugcuggccaaggcugcccucaggcucaguucccugguuuaaagucugcacuaucuaaggggauucgguggccugaggaaggcuaagaaagagaaucuuccacuaccauaagcuuuccacccuuacaggccugcaccaggacaggcuuggacccaggaaaaguggcaguuuagcaguuucuugcuccacaaaaaucuuuccuuugagauaaucuccaaucuuucuucuugugagugggcagccugccuaggacucuugaacaguugauucugguuuaaggagaauuggggugaugcuacauuuaguuaaaggcaaagccccuccaaaacagaccaaaauagaggccacguucaggaagggagggagggucucccuguuucuuagagaaagucugaaaccauauugugugucagugauuugggggcuuggacggcauuggcaaggcuuugcuaguccauucucagguuuugaguagccaaccuccuugcucccgccccccuccccuucccauaucuacuaucucaacagacaggggaaacuacagaucccagagagaagaggccuucagugccagacuggguaguguuuucucaguaguagacuagaaggcccacagcuggcaguaggugaggugacaaggaaagcccccaaauggaccuccgcauccuagcugcugcaggucuuagaaauguucccaucuccugcaacauacauuuuguuuuccuuuuggggaaaaacaaaaaacaaacaaacaaacaaacaaacaaaaaaacagcuauauucaaccauucccauaaaaugcccuugcaguaaagccaaagcaggaaggagucuuuguucccagagguugaagugcccauuuuccaugucauguuuugugcauaugcggcuccucucuuccuaaauaagaaagagggauauucauuuaaguuaugaucagaugggggggguguacaucuugcuauaaacuuuccuaaacaccucaguaccuacuagaaacuccaagaaguaaguggcugguacagugcuauaauaaaacagugguauauuccucgcuguuuuuaauauauauauauuuuagcaagacuaggguccuggaaagcauaagaaagagaagguaagguagggucccugagguugcaggcagugggaugcagaccccucuaaguuaaaagugcucagcaagugggugaaguccaccuuuccaagcccaggguggauuuucaacuuucagacccccacuucagaagugcucuguuccuaucugggauaccuaaagaaaggagcaguuuuugugucauuggcuucccaggugcgauauacuuuggaguucugcggaggaguuguccucgggccuugaagggacuguauauguugguauuuguuauaaauuauggaaacggaaagucccugugcccaggucccagagcccuaauaacucagagaauggggaaagucaacuagaagacagcccggguuccaggaacuccaacuagcguuuacaacuccgcaaugggacagaagccaaguuagaaguggaagcaaaggcuaagcuugccuucaacaagcuuacagucccgcggugaacaaaaaaggaaagagcugagaaaaaagcaagcaaacaaaacaaaacaaaaacaagcaaaccauaaaaccauccacacugcuaagaguggcugcugacccuaaucucaggguccgggcgaagugggaaccagaccugaguuaccagacgcgcugaucgacccagcuccgaaaggagacagcgccuuaggaaucgaucacgccgugggauuauauuuaguuucgggaaucuauuuuagguuuccagaagaaaggugggacaauaagagagagagagagagagagagagagagagagagagagagagagagagagagagagagagagagagagagagagaagguuggaugaagguugugggggcggggcugaaucugagcggagguguguguguguguguguguguguguguguguguguguguagucgggaagggggucggggguugagguuggggggugcugaguuacuugagaugguucgggaacugaccagagguagggggaucgcaagcccugcgccagggggaccugcauagguggccaacuugcccacucuagagaaaugggugcuacaaccuggaggagguaggagagaagcuccugaguuucaaaccuauguagaaggcuagagaggaaguuacagggagcacccagcucgcagaccaggagcauggguguuugcaagagcuggaggaggcucaagagcccgcuuaggugaccaggcacuuaacacucaccgaccgaccagggaaccgagaggagaggcgaggaggcgggggcucccgacgccuuuggagcgcuaggacgguugaaaggcgggguggccugggacgacccgaagcaagugggggaaacgaggaaaggaagagggggaaacggaggguaggggaaaagaaaaguggggagggugaagagaaacuggaaacaaaaggaaggugugggggcuggguggagggagagaagcaaagcgaaggcgagaggaccgcggcgcggagaggagggaaacagaaggggcgagggggaggagaaugugagaagccagggagggggagggccuggcucagagcaagucgcccaucuugcuagcuaagaggcauuaaugggccgcagcuugcaaggcuuagugcuguuuucuuagcuuucccggaggagggugagcaaucuguuggcgcaggccacagugccagcgccacgcagcgggugcgaccccgcuccuggcugucagguccucucuuggcaccgggcuaggaaaaucugaggggagaaagagaggcucacacacccugggaccagguuucugggaugaaccaaagaucagacaggacauuacuuaguucagaacaggucucugggacccaggggggagaguagggagaagaugcucggaagguuagaaaggacgcagucacccggggcgcagaccuaggguccucccgcacccaaagugaugcuacuccuucuguuuuguucuguuccuccccagauacugggaggauuuccacagcugcacggucacagcucuuacggauugccaggaaggggcgaaagauaugugggauaaacugagaaaagaaucgaaaaaccucaacauccaaggcagcuuauucgaacucugcggcagcagcaacggggcggcggggucccugcucccggcgcuuuccgugcuccuggugucucucucggcagcuuuagcgaccugguuuuccuucugagcgcgggaccgggucccccccucccccuccgcucacucacccacacucacaccaugcucccggaaaucgagaggaauagccauucguucucugaggacguugugauucucugugauguugaaaacacucauaugggauugugggaaauccuguuucucucuuuuucuucuucuuuuuuuuuucuucuuuuuaauuguguuugauuccuuguguuuuauuugccaaauguuaccgaucagugagcgagcgagcacagccaaaaucggaccucaccuuuuaguccgucuucacagaaaaauaagaaaacggcaaacucacccccauuuuuaaauuuuuauuuuauuuuauuuuauuuuggcaaaagaaucucaggaauggcccugggccaccuacuauauuaaucauguugauaacaugaagaaugaugggcuccuccuaaugggaaagcgagagggaaaaggagaaggccaggggaaugacuucaagagugguguccacgugggaaucagccggugaauaaucaugcucacgucuuucuuccacaguaccuuguuuugaucauuuccacugcacauuucuccuccagaaaagcgaaaacacaagagugugggcuuagcauuuuuuuaaggauaagacagagagagagaaagagguuggguauagugggauagguugucauaagagaugcugcuauggucaugaggggccgguuucaccugcuauugucgaugccccucguucagguccacugccuuuauuuuccuuccucucuuguuuuagcuguuacacauacaguaauaccugaauauccaacgguauagaucacaaggggguaaucaauguuaaaucuaaaauagaauuuaaaaaaaaagauuuugacauaaaagagccuugauuuuaaaaaaagagagagauguaauuuaaaaaguuuauuauaaauuaaauucagcaaaaauuugcuacaaaguauagagaaguauaaaauaaaaguuauuguuugaaauggg

SEQ ID NO: 6995 - RNA, 999 nt, Mus musculus
ucguuuucuuaaacgggccucaucauagaaagacaugaaucuugggaaacagcuucagaaaaaucuuugcgagcuuuugaugcugccugguggugguggugacuuuuuucuccauuucuuacaaaucaguagaauguguuuauugccauauaaaucuaauuucccccuacacuaaauuucuaccuuagcaagaugcaauugaucuaagcagugugcucauggggguaugcccucccucgcuugauggggacuaccugccuaucccaucccccaaguccgagauuccaucuccuccccacuucuccaucucuccuggcuccucugucuugacuuugcccauagccuagcagaacucucuugccuuuggucucugcuaugggugguccaaggucaagcauggugaaugcaacauuccagacuuccaaacacaacacucuggagagaccguucucuuucauagaccugucuguccuccuuugguucaguuccaucuuccuggcuagacaccaucccucacuggacucccucgccgcccgugcuagagaccauguuuucugccuucugacucaguuccaccccccuggccaggccacacccuauuugcuaggcucugcugccuuagcuagaucacucccuuccggauauaccucgccuuccagggcagaccugguuagacuccucccuccuggauagauacacaggcacacaguuaacccccaccucugguuuucuucccuacagcuuccugguggaggaguuuggcggaggcagggauucaaagcgaucccucagggucgcgcuucccaguuguuuaugggucuccugagagcaacgguucucacacuggccaguuucucuaaagaggcaaguguucuccgagcccaaccugaugacauagauuucgggccaccccaguucugcagaaugcacgucucgagggagaagucuggaaaucugcacugccacacuguucgccacuccguuuacaggcaggcuuga

SEQ ID NO: 6996 - RNA, 7178 nt, Mus musculus
uauuuuaaaaauuauuuuauaaagauuuauuguuuguaauuacaugcaaagauaaaaaagauguaagccuucccaucaauacgugcaccugcauguaggagagcccuugaagggcagaggcaucagauacccuggagcuggaguuacggacuaugaccacuuggugugggugcuggaagcuggacuuggguccucggggacugaacuuggaugcucuugaauguugagucauucugaaagccccauuuuuaaauguuuguuguuuuuuguuuuuuuguuuuuuuguuuuuggcuggguggguaccugucuuucuguuucuguaggcuuguugggaaguuaauaauccuauagaucuaagccucuuuuccugggugaaguugggaacggucucugacagugcagacaaugcagaucucaguaugucagucucaaagaagucaguacacuuuguuuuccuuucuucucuucucccuucuaucuguuaguaccugcggagauggaaccggaguucucaugugugcucagcaggugcccgucucagagccacaccccccacacccaauuauuauuauuauuguuguaaauaaaggcuggauucaaaggaucgaaugggccgagauguaaacuggcuucagcgagagcucuuggcuacacugaagucugugcucaggcaagagagaaagaauuugggaucaaagcaggagaagcuuuguaagagagucaggagugagaaaggagaucucggucucuuuguagagaaagcagcucagaucacacacagcccaagagugugugaaagggugggucgcaguggcaguggguaaggagcagggaugccaacucuguguggggcaucuggcugagaauccacgcccacagaacccaggcacaagguggggaaaccugcagagaggcauuuuggcagugaguggaaaggggggggggcugcaggggccccaaacugggaaccaguccaaggccaucagucugccaaggagagagagaacuuggaauaacagcggguaaacucccgauuaaugaauaagcugggggcugguucaggugagggcgcaccugugauuuaccuaaucccuacaaagcugcaccccgagaccccucacacucaaaacugcaggaagaaagccuggauugugcugaauagccuugaggggaagggacucuggaagggguaggcuuaaaaaagaaaaucuggcucggaggugggguggggcuugcaggagggagggaggagagcugcucucgguggguggggcuagcgggagggagcgagggaggggcgcugcucucgguggguagggcuugcgggagggaggaagggagggggugcugcucuugcucaggagcagaagugcccauggagacaagaaucagagcugcucucaaacuuugggcaccgaguauaggcagaagugaacugacuguugucuguacuuauagaugagucuauccuccagccucguggacugccuugucuaccuuuguuccccuuagguugauaacacuuucucaggcuuuuaaagugugauaugcguucagaaaaaaugcaggaauccuauccacagaguuugcuaaagguuugcaaaagcucacugcaaacagcgcgagguuauucucaucaggagccuaccucacaccuauccuuacgcccucaccacagcccagugccucuggccugagauccagcuaacacauauuaggcaaaugcccuaccacuaaguuaacaccaccagcuuggggguggggguggggguggggguggggauucaauccagcuaccuaaccuuuuuugucuucuuacuuccagaagaggcucuguacccacaaacuccaucucccgaucucagcuccaggcagccaccauucuauuuccugucuccaugagugugccuacuccaggggccccacuuuacugcagucagaggauggaacucaggccaccaggcuuggugacaagcaucucuguccccugaaucauuuucaccuuuggagaccccaccuucggcuucccagcaucugucuuuccuuguucuucagaguugugggaccguucaguucauacccuaguguuugccuuucugacuucagcaacaacuuccacuucaaacugaguuugugaaauucgguuuuucuugguguauggguguagcauccuccucucucucucucucucucucucucucugugugugugugugugugugugugugugugugugugugugugugugugugugauaaugcuagagauaauucccagggccuuguacaagcugggcaaguacuccuugugguggggccuagucagacagcaagcacccuucucaguuugaaaaucagcucaguaccuuaauaauagaguacuuugaucuguucaguuauccagcugauaagcaccuggacugauaagauaaugcauuuccacaccucugaacucacuucugggaacccuccauucacaacaauccaccaagaccguaaaaauacaaucggaaucccccuuaccacaaccccugaguccccuguggguuacauugaauccuuuuuuaaaaaaaaaaauuauaauuucagauuccggagaaagaaaaauaacauacaaaccaggugaucuuguuuaguucaguccuagcuuucauucucaacagaucuuuuugaaauguuccagugaguuccagcuacugcucggacagccuguccuaauguggucuggggcggaaaccgacugcaggauggccagccagccagcacuuccucagaggaaagagauuaugaacagaggagcagcugguggucucccuggcccucccuagggccacuagcccaugccgaucaggcagggcaacuguccuuccugcucucuggaauguugggauuaaacgugugcaacgggagaaugaccggcacauagugugugcccgaggaacccgaguucucgguuugaauuuuuauucucagucugguaccucagagccuugguuucuccacugguggaaauaacuuacuuggaaucuacagaaaaacaguuuaaaaauggucaauguaguuuccaaggggguuggagauucugauugcuucaaaguucuuuuuuuagcagaugguuguggauguuguauucauuagagaaucgagugcaagagauguggaaauguguuaucuuaaacagcagucaggucuauggcgaaggcuugaaaccacagcugcuccggaggcugaggugggcugaaugagugucugccugggcugcagaguuuuaaguuguucuacucucugggucuuuucugcacaaauccaaacucuguggguuuuguucugaacacuuuaagucauuuagaagaugaugagcuuuggcucaaggaugguacaugccccuauguguguguguguguguguguguguguuugugcaugugugcauguaugugugcguguaugugaguguuuaaagagaggcaauugguguuagugcuucuguuuuaguggagggaacaaacugcccaacagaggccaguagaagugcuugccuguggcugggugagaguagguugguguuaacccagcuucgaaucacugggacaaauaccugagauaaauccuucuaaguagaggagaguucuuuggggcucuaaaccgcuuccagagguuucaguucagaugcugccccauugcuuugggucuauaaugagguaguauuuccuggcagggagcaagguggaguaauugacucagcugauggaguccauggcagagagagguugagaagggaagaugaaggaaacgaaggaagugagacaggguaccaguaucuuccccaggagugugugcccaugaccauaauccauucaccugaccccaccuccuaacagccuaccaccucccaguaugucuacaaguugacaaaucagccuucagugcaugguucugggagauaccuacucacauuauagcagaugggacauccagagggggaguggggugugugugugugugucugugugucugugugucugugugugugucuguguguggaucugagucccaugcuguaacuuccaaguagucaggacauggaagguagugucugcugagagcuucgugugagaaauacagacuucucccauacagcugcaguccaagaccaugacacaucagaugauaagcccuuggauaagcccuuggauaagugcuuccuuugcuuugugcuauugggaccuuccgaucaacuuuggaucuggggagaaucaagacaguagcaaagcaggcagagaaggaauaccuuuucuugucauugcugucaacuauagucuaggcuggacuugaacuagcaguaauccuccagccucagccuccugaauacuggguuucccagcuugagccaccaugucuggauaagacuguauuugauuuguuuugguucucuaucucucucuguccugucucucugucucucugucucucucugucucucugucuccgucucucucucuuucuuucucucuuucucuuucucucuuucucaggcagggucuauacauguagcccuggcuggccuggaauuuguuaugaagaccaggcuggccuugaacucacagagauccauccaucuaucucugugcucgagugcaggauuacagacauguaucaugguuuggcuuguuuuguuuugaaacgacucauguugccgggcaguggugacacacgccuuuagucccagcacuugggaggcagaggcagguggauuuuugaguucaaggccagccuggucuacagagugaguuccaggacagacagggcuacacagagaaacccugucuaaaacaacaaaacaaaacaaaacaaaacaacccccaaaacaaaaaaacaauccagaaaugacucauguaacccaggccagccucaaacuuguuaugcaaccaaggugggccuuaaacuccugucuuucugucucuauguagcucuugagugcugugccaccauacguggcuccugaaguugaguuucuaacugcucuuguaguauuugaauggagauagcuucuauagaccuaacuuccaggggcagggaagggggcugcaaauuuccacgugucucuuuauuagaagaagaagaagaagaagaagaagaagaagaagaagaagaagaggaggaggaggaggaggaggaggaggaggaggaggaggaggaggaggaggaagaggaggaagaggaagaggaggaagaggaggaagaggaggaggaggaggaagaggaggaagaggaggaagaggaggaagaggaggaagaggaggaggaaggagaaggagaagaagaaagaagaagaagaaagaagaagaagaagaagaagaagaagaagaagaagaagaagaagaagaagaagaagaagaagaagaagaagaagaagaagaagaagauugccuggugcagggcuccugcgggugugguagggaaggugagugaggaacaugaguagcauuuagcaagccuuaagacuccaugcaguccugcuggguugggugcacuguuuccaggagaauagaaacuuuacauggcugcccagagucaggcuuugcaggcugcugccuaagugcugggucucuggcaucuacaggcaggauacugacaguggagcugcuuccucugggaugggcaggauguugacucugggugcugaggcugcugcguucacucaguuuuuaugggagagaagagacuuagacacuucuggggugagugucagcuguuuacuagcaggcuucuguuucugcuauacucuggcuggaugcagagagugcuggaagguuuuauuugccuguaguagucaguuacagggggguggggguggaaccugcugagcagagagggacucuagcuugagucccaccccaugcugagcuggggaaauuaaagguggcuuaguaugaacaauguguucuacuucaaauuucucaguagcuacguuauaagaagaagaaagaaaaagaaguugaaaugaauuauaguauuuuaauuucccuaaugaauuaaaaaucauugcacuauaaacaaacaccaaauauagacauacugaaauauguuagucuaauucauaauaauuuacaugguuuguuuuucauuuaaauauuugaauuuauaaugaugagauaucucaauuugaacuagcuguguucaaaaugaccacaugugguaucuagcuuagccauugcaguuuacacuaagguuucaacuaaagauaaucucccacauccaugggauguguggcaacaucaaaagucauuuuuguuacaacuggagaggguucuacuggcagcuaguggguagaggccaggaacaucgccaaaugucauguaguacagaggacaaucuccacaacauggagugcugugucccgcgauacugacagcucccaguuugaaaaacauggcuuuagaccaagcucuuccuuugccuagugcuguggcuacgguaagucuuaccaaaaucucuuguguuaaagauuuggucugcagcguaucgugggagguguuagaaucuuuaagagauagaacuagugaugaacuuaggggacccccuagauugccuuacaaagaagccagaucaaugguugguucaugaaaauggccauuagaguaccugcuacagguggugacuacugggaacgauguacaggaaguggacagacagcucaaggcgggggcuccaaaaguggcagcugcagaaaagggcuugguccacucagucucccagccaagaaaccacugaccaguaugaagccaugcuaaaaagguaggaggaauaguuaucccuguaaggagcuaacgagcuucccuucucagaaggaaacaaaccuucucucugcccucugugcagucccucacagcugcaggaaagcauagcucuuccuccccaccccccaccccugcaccccguuccuaccucuucucugggugcauuuuccucaacacauuggguugcacucuuucaccuucucucugcccucugugcagucccucacagcugcaggaaagcauagcucuuccuccccaucccccacccuugcaccccguuccuaccucuuuucugggugcauuuuccucaacacauuggguugcacucuuucuuuaaagcucuccuccccuccguaugucugcuuguccaccacguggcu

SEQ ID NO: 6997 - RNA, 28748 nt, Mus musculus
ccuuucugcugacagcagcucagcuugguccuaaacucucgggucucuuggugucugauuaguuaucaacagaagcugccacuguuccauagcuuggcagcuuggccucuucgucccuagcagggaaaggcugaugaggagcuugggaaggagaaugagcucagcgggauggaagggaaccggacugagauagcgcuggaggugcugcacaaggaccccaggaccuaagcgaccucuuccugguggcuuucagcagaagacagcaaguugcuaggugagccggcgggacagggggcguggcucugcgagcgggggcgugauugaggcguggcucugcggucgugggaggagccggggcgggagcggcgccgcggaggggacccgcggcacgagcgagagcucgccagccccgccacgaugcccccgcgcccaggacgccuccuccagccgcuggccgggcugccggcccuggccacgcuccugcugcugcucggggcgcgcaaaggcgcccgggcccaggagguggaagcggacagcggggucgagcaggacccgcacgccaagcaccuguauacggccgacauguucacgcacgggauccagagcgccgcgcacuucgucauguucuucgcgcccugguaacugcagcuccagcaggccggcggagcccgaucugggaccggggaccagggaccuggagccggggaccggggagagggcgcgaggccgcgcaggcugcgccgggggcgugggccgcgcucgggccucgccgcugacguggcgcuagccgccggccugcgagcuaggaagggcgggccccgaggggagacccggaaaagccucuccaccccgccacacugcuggaguccaggcaucccccgcuucuguccccugcccagcuccccaaacuuccugugcuggccggacgcggcgggagcccggcguccacgugcccuauccugaaggguucuuccugcuggcccaucaauauuggguuggauuggaaaucuaaggcccccucaagaugugauugcccacuuugugugucgaggguaggaaaagauagccuaggucgggaacugagacuuccccggccccuggaguccagcgaggugccaguuuuggagucuccgcugcacgcuggaguggaugugagcuguauucucaaggccuuuaacucuuucaccuccuguucucauuuggggcccggucauuuggaaagugugaggucgaacuguucuuccuaaaagucauaacuucaggcuuccauucuucgguuggggcuuccuggugcaccucacuaccccaagaauuagucuagacauagcagugcuuugcuacuggggccuagaugcucagagaaagaaguucuccgguccacagcagaaagcgguauuuagagcacaggcucuugagaugugggauguucuggcuguguuuauugcugagcaaaguacucuuccucuagcucaguagggacucauuaaggacaggggguuaagcaguuaagaaaaaugugccuguggaauccaauguagucagugauuguauuuuucuaaagugggagaaacuuugcccauaacccuagagcgggcuauuacugcauuucaauucguuuaguguuaaauuaacuuugugggggaggggaucauuuuggcucacagccauuaucaguuaagaaugcaggaaugggauacacuguuuuacauucccaagaacagccacuugagucuguagaacuaccauugaaagaaaaagacugggagucugccacagucagucgcguuaauaguuacucugugcacaagucgucucaaaguagugauuccaguuaaguacaccacaggacuuaauuggaguugauuucgguggaauaaaucuaaggguuuuuaguuuuaugagaaaaguugacaugcaggcaggguuagguucucuggagugcugauggaguuuuaaguuuagaauauaugcaaugaauaaccagcuagucuuggccaguugggguauacaccacagauucuuuuuuuuuuuuuuaacucuauggcuuacagacguuuaggucgaggcugcucucuaggauaagccuucaauuguuugcuucuugcuauucugauaaaaauauuagagagauguaggagcccacccauggccuuugaaggcuggguuuuugauguuuuaaggggaaguugaggcaggaucucucuguguagccaagcugaccuugaacucaugacuuuguuggucucagccuacagagugcuaagauuucaaaauuuuaagaacaacaugguacucaagguagacuacgcuggguccucuccccacuucuuucucaccgugagugccuggaauguucacuguccaugugugaugcuggggcaaggacacuguguagugauggcacugaccugucucuguauuuguucuaagcuuugugggugcaggauuguccuccugcuguugaucuggugccagcaucuggucacacugaaccuagggacaguuaggucaaagguaagguuaggugccuuugcucugucacuuggcuccaggccacaucugaauacagccggcagucucuguagugcuguauccacaagggcuccaaaccagaaaugccaguuagagagaagcaguggacucuuuaguccuccuggguggggagaggcuugccuguguggugaugaccccaaguggucagguuaacuuggguuagagggaacuaaaucuuuaucuucuuuuuaaaucuuguauuguuuucauaagaacccuuucaaggguauagaggaugucuaucuacaacucuaaacugagcauaucugaucaaauuccgcuaacaucaggacaacccuuaggagcugaagggguuugcaaccccauaggaagaacaauaucaaccagccagagcucccagggucuaaaccaccaaccaaggaguacacauagagggacccauggcuccagccguauauguagcagaggauggccuugucgggcaucaaugggagaagagguccuugguccuggaaaggcucaaugccccuguguaggggaaugcguggguggggaguugggagugggugggugggagugcacccucauagaagcaagaggaggggggaugggaugggggcuccugggggggggaaucaagaaaggggauaacauuugaaauauaaauaaaauaucuaguuuuuaaaaaaggagaaagaaagaaaaagaaaaagaaaauccauuagggcagccacucaucuaucuuccagcaacaucuuauagcuggguuccuuaccagcauuagaaccaaucugcuuucuuugauuaggcaccagaugucaugaggagcaaacaggaacaugggccaacuggggagcauaaaguccacaggccccauuguguacacacuuacggagccguugggccuccauucuuccuugcuauccgcucuuucccuacccaugaccuugcugaacuaacucauuuugcugaguucacagaaguuaaauccucaaauacaguuucccugugugguaccccaucccucugcuucaagugccaaagugcuuagcaugcucaaguguuugcaccggacagugcuuccauucuuggcacuugcauggaauguauaacugacaagccuucagaaaaagggggugaugcuauauuugggcuuuuauguguuuacauaguuuauuuuuauguaugcacauguguacaucucuguggguuugggugccauguguguugaggaggucagaagauggugucauauuccauagaaccagagcuacaggcauggggaccugccugaugugggugcuggguucucugaaagaguaacacaugcccuuaauuacugagccuucucuauccuguuuuauuuaggccuuuauaaagcagggauuugucuuaguugcccaggaaagccccgccaggaagagacauuagcuuuaugcugacuuuccaaugccgccuucagaugcaugcauuggaagucagguaaaaaaagaagcuuaaagauuuuauugagaauguauuugagagcaagcucacaauugccagugccuuucacucuuguaagugagcuuuuuuuuuuucccccaaaaaaggauucuuuuaaaaggcauuggagcaauuaguuauguaauaaacacaaacaauuuguuuguuagguaaagaaagaaaggaaaaucaguucugugccauaaugcugugugguaugcacucauucaaaacgccaaugugcuauagcauacaugugauauacaugcaagaugguggccagcccuguccuuuagaucccgugacaagagauaugcuguagugaagugugaagagaggcaagaggccacagucuugcuagcauuguuuuaaaugaucaauuauauacaaaugauagucauagacaaacacuuuaaaguguuuguauauaacuaaacucacauagucaacacgagacauuugauccuaccaacugcagauguccagcuuaccaccaacucuucuguaaugauagauaguuuggagcacuggggauguagcucccaugguacaguguuuaccgagcaugcauaaagcccugguuugaucuccagcauucugcauacuuaaaaucccagcacuuagaaggugaagguaagaaagucagaaguccgagguuauccucagcuacauagauagcucaaagccagccuuggauaaccaagaccugucuaaauaaauacaaaauuuaaauguacauauuuuaaggcuuuugaugggacaaggugcagagcugauaauucuugaaauugcuuuguauuugcacucauuugguuacauaguggaggaggccuuuccuuauaaauaaacaguuacaacagagcguaaagcugguugggcgagcagggaagaccaccagaaaaggaggaggaaaugagaauggauuccaagucuccugagagagacaaggaagucuucuuggaggaagugaugccaaacuagaucugaaggaaacuuagaaaucagccugauagacuuuagagcaggucucaguagggugacggcauaccuugagcuccaggggcacaacaagcuauacguuccaggaaacagaaauaucacacguuuacucggaggucaauuaaaagucuaggaggcagggucuggcauagaggucaaaaaagaauacuagggccaguggccuccugauuuagauuaauguagagaacagugucguugugagguaucugucugcugcagagagaagaaagaguggggauuugcuugcucaguggggaagacugaaguaguacauuuggacacccugggaaccgaggcucagugugcccuucuccuggcuucccuguagguguggacacugccagcggcugcagccaacuuggaaugaccugggagacaaguacaacagcauggaggaugccaaggucuacguggccaaaguggacugcacggcugauuccgacgugugcucugcccagggagugcgaggauaccccacgugaguaaggaagggcugggcuuucuccaugugugggucuauggccaaggcacguucaagcucagcuucugguaacuuccuuccuagaucccaggcgcugaauguaagcaggugugcccugcuauuaaaacaagacuguauugaacacuguugguuguagacaucuuuugaacuuugcauggggaaagccuuaacuaauucugguuggcuuuuccuguugcugagaaagagagcauuugcagugcaguaguggggucuggcugcccgagguccagcuacaggugaugcgucacacagccggcucagacuuuguuagcacuuuugguuugacuuucugcuuugaacgguuaucacugcugaaguuuuucuuuuguucaauuaacauaaagucuguugggaaggagggugacaaacuagagugcagcaggcauguacauggcuuuaugacacaaauuaugacugucugcuucagucuagaugaguccccccaaaacccagcggugcugcgaaccuucuauaagcagagcuuauacaaccuuuaggaggugggaccaaguggguggcaauucacugaaacuauguccuugaaggagauauugugaucucgguccugguugguugguuugugucaggucuacugugaggagaggggccuguuagguucuauccugcuguguagaccaaaggcaacaaauucaaguaucucauggccccaguugcccaaaacagggagucacaauacacuguuucuuuuucuaagcugaugaucucagauccuuuaacaacagaaagcugacaaacuggcuucuuaagaggauaucucaggccuguucuguugcuguauuugcauugcagacuggauaauuuacacagggcuaaagcugaaaaccacagaaagugauuucccuaccguucuggacgcugaaggugcugugaaggccaaguuccuuccgaaacugguuuuggaaaucuuuuugugcuucuuucuggcuucuccugcuuugcuggugucuugguuuucuguuacuguugcaaaauacucaagauauuuagaggaaaguuacauaguaaguuccuggccaaccugaaccagagugaaacuuugugucaaucuccucccucucaaaagaggaaaggcuuauuugauugacaguuugaaggggucaggccauggucaguugucaaaguugcuuuugggcuugcagcaggguggcuuuggccauggugugauagagcacuuauuguuagucgagcagcagagagagaagggaggggaggggagcccgggucucaguaucgucuuuaagaguacacccccaccaugacuugagaucucuuaggcucacuucuuaaaaguucuaucaccuuccaggggcccugcaguagugaauaagccuuugccgagugggcccugagagacuucagauccaaacuguaucagccauauuaccucauuacauccuuggaccauguguauguuucuguguguucaaaugucccuuucuugugaggacaugagucacauugaccucugugaaggccucaucugcagcuuggguuaggcuuucaauugcuguguuuuggaggucacaaucaaaccucuaacacaucaguuaugguacacuuugucacaggcugugcagacuaacacccaaguggggauuuuuuuccucucucuguagcuuucccaggaagagacacaugugucuguggaaaguuuguaauagagaaauugggggcugaacuugaggcugguagccuucacucugccuguuaacuccuuuaccucugucaauugagaaagaaauuggaggcugcaggcuaaugggagggucguuacugcucgccagcucgcccugggcccucuuagcuuucuuaggaagaaucucacacuuaagcagcuuagaaagacuuguuauccaacaagagauuuguguacuaaauugggguaaggggagugggaaagacaagcccuacaacagacagacagacaaaccggcaagaucuuacauuuuaacuuuagcaaagaacacaacaaccaaaaaucgagucuaagcacugguuccuucugguauuuugagacucaaucuguguccugcacuuugcuguggggaggcacuucaaaggagaggaaggcagaggaauauaauacgcugcuucuaugucgcugugaccccaacuuuccuugccagagcugccagagggagggaggcccagugccguguguguguguguguguguguguguguguguguguaugugugugcaaaaccuuuuaauuaugacagcauauuuuagcuugcuuagacuuuguuagugguauuuuuuuuucaaacagguucucacuauguugucccgauucccagaaacucuaaucuuagguuuucuguuuaagguucaccugccucagcccccaaagggcugagauuaugagugugugccuccaugccuagcuuuucuguguuccucauuggagcgcaguguagugccuaauucuaaagcuguuaacccugccuugucuagauggucccagaguuaaugauagauuggcuugagauccuucaccuuccugacagggcagaagcagcccuauacagccauucugcucgccgcgcgcugugcaguaagguacaggaggcauuggacacuguugugucagguaguuuuacacgcccgaggccgacucuguguccugagcaagguuuaggcuggguaggauguuugauaaaugauuguuuucgccucacagugguuguaacuuaggguggugugugaggauauaacccugcugucaguugagagucaucgagcucccgaggaagcugggcaugcucacauguuccccagaaggccacucugcccuuguaacugccgagucuagccagugcgcuguucauuuccuuucuuuucugauuuuggagauggagccuagugucuugugugugcugagcaagcagucuacuacugagcggcauucacaguucuucuccagacaggguuuaaccguguauucuagucuugccacggguuagcuaucugccugcgucagucuuuggaauacucuaccaucuagucugguuuccuugcauagccagggaacuucauuuuaaggcuucuucuguuuuaaagccuccauuuaaagggaacuuaccuguuugugaaugggcugaauguuuguguucuagaaaacaugcugacacauaccaguauguucguauuaggaggugagcguuauucagggggccacaugaggacacagggagagggugacaccggggaaccagaaagccaccucagacauuggcuauauuacacugugaauuuggaguuuagucuccauaacucuaggaaauagaugacugacugugcuuuaugggccaagccauucauggcuaucacugcagaccacacugccuauggcucuccaccuaccugucucaguuaugcacaucggaaccuaaacaucuauuucugaacauuguuaucaacucacaaaauccaauucacgucagggagggguuggaggguuccuucugacaggaaccacauuuuuuagcauagucuuaacaucuuugguaaaguucucuucuaaggcaugcuaugaguggagugauccaagaccagggugugugauauucaucccccgugaugucuuucacucacuaucauaggaauguucccucaucucucuggauuccucggaggccagugacuagaagaggcucuugcucucuggggaugcaaacagagaguagggaccugcaguggauggagggauggagggacggagggaggagcauagacggacugcagcagcggcaugcccuggugacugggauccaucggugacuggguguccaucugccaugguggccuaccuacaguaaaacaguguuuugucugcugcaggccuaagagaaaccucaggcaggaggagcuacaagggagaccaggagccugaggccaggaaggagaagccuaggagaagcacugguuuuuuaccucgauguauuuuccuugaguaacuucaaaaaugugugaaaguuuaggaucaugcacaugcgccugagcugucuccugcagcaugguuuuuguuaccucauuggaguuuugcuugaguggcagauaggugccuggcugcagccccugguugcuccauucccguuugcucgcucgcuacccagggcagcuuuuaaacuuuccaacuucugcucuuucuaaucccuugcucuucuuucagccugaaguuuuuuaagccuggacaagaagcagugaaguaccaggguccuagagacuuugaaacacuggaaaacuggaugcugcagacacugaacgaggagccagccgugaguguccccuccucccucccuuuacugcccagaggccagaagaggugacaugcugaaguuucaauucuuuugaaguuguaaauagaccuucuccgcuugugcccuuucugguuggccaaagaguucaaauuugcacacaggagcucaagaacauagcauagcugccccccacccccacccccccaagcagguucuccugagcacaagaguaaacaggaaucauucuuagaagaaguaaaugauggcauuucuacguuggauucuucuguuggguauacuccuguugucaggacaaccgcagacuuucagacuggcuguuuggaacaggcacucuaucauauuggucuugcaaagaccuggucuugguuuucuuggggaagaaccacauacaaauucuuccuaauauucuuuaguuccauaucuauggcccucagguuucucuucuuguuuaguguguuuuucacuguguagcccaggcuggccuugaacuuaggaucccuccgcccccgccccuugccuccccacggcugggauugcagguaugugccaccacgcuuccaucccugcuccuguuugcaauuucuccuuuuguagcucaguaacuaccuuuaucuacuuuuuucuuuaagugguucaccacaauuucuuuaggguucuaguaauuuuuuauaugaauguugccuuaguuaauuuacugcuaugaacagacaccaugaccaaggcaacucuuaugaggauaacauuuaauuggggcugguguauagguucagagguucaauccaguaucaucaaggcaggaacauggcagcauccaggcaggcauggugcagaaggagcugagaguucuguaucuucaucugaaggcugccagcagaauacuggcuucuaggcagcuagagugagggucuuaaagcucacgcccacagugacacacccacuccaacaaggccauaccuccuccaauaggaccauacccucuaguagugccacucccugggcuaagcauauacaaaccacuacacauguuuuuagguuuccacuccauucugaguuauuuagcuggcagcuggagcaggcaaggcagcucacauuccuuggaggcuguuucugauggcuuugucauggagacuguccacagcaguuaucugcuuucuugccuuccguuauacugaauuacuucauguaagaacagccguccuuuuguugagcagaccaccaaugguggucauacuugcaaacagcgguguccuguccuguccaguugcuuguggcuugacuuugauuucaguuuucucuacuccauucaggggaugcaggagugccaggcuguggagagcuucucccagacuauuuaagcaccuuucuuagaacugaccgaugauaacuugaaaaguuucuuaguauuacaaauauucaaacacauagaaaggucccauuuucacugucuugccagccugucuccccuuccccuccaucccucagggagugucaucuguaaauauuucagggccuauucucacagacauguacuuucugcuuuguagcauagccacuaugucaccaucucaugagcugcagugagcagccauguguuuguacuaguggcaggcuucuaccgccuggagucaggacaaggcccaccccagaaucuccuguuugaggcagugcuuucuccugauuccccaggucccauaguucccucgggcuugcucccacuggcuauccguaguguagcucuuuccuuugcuucuuggucuucaguuuuccaggccuuaaccagcuugacuaauaauggaaaaccuugaccaaguucuccagugucuuccugcaucauucugugugcaggcgccaucagaucacggucagagccuaacuuccuaagcugauauggaagucuucauuguguccuaagucguaacgaucaccacacacgacuccauuacucauccuucugugcguggaugguuggauuaagacagacuuugaugguuuaugcugcgguguggguggcuggggcuggacuagaagccagcauucccuccuuucacaucucuggugaccgucaagagcuccagggguucugaguacaacuggaacugaguuguacaguaugaguaugagaggguuacuugaggcuacuuuauuguguuggagcuguguacugaccggaaggggcgggccuauggcgucaugugaccccagcacucggugccaucuugaaagguguggaaucauguucuuuagauggcccagcucaucagaagcucugcuccuucuuuagugcuaccgugcucacauccaaaacauccagcacuguguuccuaguguuaacgaguugccuggggaaugcguucauuuuagguaaccggaggaagccacaagcuucccggagaauuugcuucucuguccugcuggagagcugcagggccaggugggguuuucggguugaagcagaaauguuuacucugugaaaauguucuuuuucugaagggguaggugugaggcaagugugaaaugcuuuagauaagagauaauagucuccccacauuccccccccccccaaaagaaaccuuuaaaaauaaacuuugcacuaaagaggccuuuuucuaggauguccuuguccugcuccuggagucagagggcaaacuagacggauagguuauucuuuuuauuauucuuuuuaguuacacauguuuaauuuguguccaugugcaugggcuggguguggaugucaggggauuggauuuugaaauguucacauauauguaauaagaugaugugggguggaccccacgucuagacaugaaauucacugaugucucauaguuuuguuauaugugcuguuuacaaacagcccaaaggucgucuuuguacaaucuguuuagugucccuacuuuuugacuucagccugugaugugaggccaguguggguucuccauuguuggugccuguuggaaugcaaaagagaucagguuuuggaauauuugugguuaggguuaaagaaguugaaucuguaauguaaacaaagucaugauugucuuugucaacuugacacaaacuugauacaacuuugacaacuuaaccagggaggagagguuuuugccgcccccuccaucccucacuuaaguccucucccccauuccaccuuccccuucucaagaggaagccccccucugggugucaccccccacacuaccaacccccuuauucccaccuccccaggaagaaugaauuaacugagaaaauguuuccauaaaauuggguugugagccagccugugggacauuucuuugauuaaucauuaaugugggagggcccagcucccugaggggcagggccauuucugggcagguuguucuggguuguguaagaaagcaagcugaggaagccaguaagcagugggccuccaugaucucugcaacacuucuuucagugacgggcugugaugugaacguauaagccaaugaaauccuuucuuccccaaguuaguuuggggucauaauguuuacugcaacaacagaaagcaaacuggaacaucaacuuuuauuuaaauuaaaagugaagcucuuaaaaaaaaucucaauuugacuagauaugaagcaauuuaagaacauuuuaaaguguacugaggaaaaaaaauggccuuuuaaaacaauguuugucguuccugaaagguaaauaugcuggaauggacaugcuguguaggcagaucugagaggucuaguguauguggucacggggcaaagagcaacuaucaggucuucagcccuguucuucuguucaguucuuuuaacauguauguauguauguauguauguauguauguauauuuuucauuaugcauauacauaugccuguguggagguccgugcacaugugugcaguugccuuggaggucagaggagcugguguucccaguggcugugagcugucugagugggugucgggaaccacacucugguccucugcaagaacaauggacacaaacugcugagccaucucucuagccgccucguucauuucuuacugcuggcauuuuauaucguuugugcuuguuggaugacuaugcuccuguugguagaguugguaagccagcauuuacaccgcccugcccugcuuggccuugggagcagacgacuucucagcuagagaucagcuguguuggucucuguggccucuuggguagguucgccgggcagccguguuaguaaacacgcuuguacuugugaugaggugucggccgaccuugaucuuaccuccuuagcuuuccuuguccucuucacugucauccucucuaggcugucuguggugaagagggccuguggaguugucaccuguaaccccauauguguucgguguuacuggagucccuugcucugcugagcccugauugucagcauacccuucccccaucacuugccucugcugcugcaauuguguguccggugggcuccacacaugcaguacagugagaacugucaccugugguagggcugguguccugagcucugcaucucgccuccuuuucccacucucaguaucccagaaguucuguuggaaucgugaggaggaccucuacaaggcagccagcaucucuaaggguuauguguggucaguugcuuauugccuguaacguuucuccuucaaaaccucaagcugcagugccuuucugucccccacacugggaaggcucuucccagguucuccuguguggugaucugcugcaugcuucuguuggugaggacgugucuguuucuuauacuguucucuaguucuuccuugggauuaugucggauccucauggcagacgcugccugcgccucuguugccugugguaccuggcauggugucagcggcucuggcuuugggcaugggcuguggcucuuggagcuuagccuugguguucaugguuaugaugaugaaguggcuuggacuggcugaggcuccuccggggugugaugggaacaaggccggagcugcucaaguuuuaaauagcuuuuauuauaguacauuguugugauuucuauuuuauuaguuauuauuaaaucccucauugugcuucacuuauaaauucaacugucaugggcacacauacucaggaaaugaaguagauacagggcuugguucuauccaugauuucaagcgugggcucugggggugugucaucgucaguaaaggauggccccuguccuggcagaagauccuuugcaaggcuguguccuucugucccaaaccuugucucaggaauuaccuuaagguuuagcucacagggccuaccuggucccguucccugguuccucuugcuuguugaguucuggguucucaugacugaccuuucuguuggucuuuaguggcugcuucucugcaugcuuucccugccccgaguaggagcugagggucaccaggacccuugugauuuugccuccagguuugccuguuuaccuuugugucuuagcuccuuccuguguagagaggcucauugggaauuuacuaugaauccuguggggaaucuccgaucagguucaggaagagggcaugguuuccuggguguacagacuucaguugguuucuuugguugguugaauuuggggcggagacaacugcccuggggcucaagccaguagggugggccuggugcuaaagcacccagaguucuucuuggcgggggaacuuccugugugaccuuguacaggugugagauagacaggagggcagauagacauuuuuagauucuaaucaacaaggccugguccuccuccacgccucgauugcauccucagguacaaaccuacuauugauuuucuucuuccauuagacaccggagccggaagcggaaccacccagagccccugagcucaaacagggguuguaugagcucucggccaacaacuuugagcugcauguuucucaagguaaggaugggacuggugaccacggcucggggcuggcuuuuccucuugcuaucugaggacucauagcaauaucuagucgaagcucacuuugucucuucagcaccauuuggacuguugcuuaaugagcccgcucuuuacgauguauuuccuccuuuuucguccuuguagacaugccuggccuaagccucugcuaaaguugagagcacacuaggcacacacaacagccuuggcuaaaaaagucuuuauuaauggcauggacuuguuuauuuguuggaggccgagagaagcauguuucuuacuuguuuaaacaguguaguaggacuguuaaaacuaugaaucagauuagguguucuuuauauacugacuuuggaaucgguuuccucaauaucugcccgcagucuccacugcgaauaaaacacaaaccuccccuuguuaccacauggacaggguucagacguuggcucaagcacauaugggcagcaaguagacaccacuuccuugcuggcucuguuaucaagugcugccacagagaggaacccccuggaagacuggguugcacacacugugaaaaaggacuuagaagccugugucccugcugggagccuggugucccccucaccaccugccuuacucagcaacuuuaucaugguguccuccguugcuacuagaaugacuuauauaaucagcacugcugcuccagcagugggaccuggguguuuccccugggaagucagacugacuugggcuuguguagaauauuuacauucuacacagauccccucauccuagacagucaguuucccgcuggccagccaagcuccacccaucgcaagcgucucuugcaggacacacccugaagcccccacgugguugugcuucaggcucgcugaggcuuuuucuucacaaggcagcuauggcuucuugcccuugcuggcuucccauggggcugcuuggauucugggaguucagucuccaucuugcugcccggggucuguacugcacauggcugcauagagacgguguuagccucgaagaucaguugcucaucauuucaaauaagcgauucacuauuucccuggaaugcguuauuggccuagcuucagccaucaguguggcugcucacugcuacacgcuguguggccacugccugacaucugcugugaguccucuccugaccuggggcugcuaucagccuaauguagaagcagaucaaccagauagaaaaauguguccagaaaaucauguugugaggacuuuauauuuuuucuuucuuuuuuuuuuuuuuuuaacucaccaggagcguuauuuauuuauuuuaaaaccugguuuuguuguugucguuguuguuuguuuguuuuuggcaaacaaaugauaaguacaaaaagaauugacagggcucagugaaggcagucuuccgugacuacaccacagccuguuuuguaccacccauaccccaggccucucucccauucccuacccagaggccagcccuugcucuuuguguggaacccaugccuggguuuggggccucauagcucaggugugcacuggugaauauucgacuucagucugcucaucugacauauaugaugguucaguuuaaugcuccugccccuaggccuagguuggauuuuauggacuuuuuuaaauuagguauuuauuucauguacauuuccaaugcuaucccaaaagucccccacauccucccacacccacucccccacccacccacucccacuucuuggcccuggcguucuccuguauugaggcauauaaaguuugcacgaccagugggccucucuuuccacugauggcugacuaggccaucuucugauacauaugcagcuagagacacgaguucgggggggggguacugguuaguucauauuguuguuccaccuauaggguugcagauccccccaucuccuuggguacuuucucuagcuccuccauugggggcccugugauccauccaauagcugacugugagccuccacuucuguguuuguuaggccccagcauagucucacaagagacagcuguaucgggguccuuucagcaaaaucuugcuaguguaugcaauagugucugcguuuggaggcugauuaugggauggauccccggguauggcacuagaugguccauccuuucgucucagcuccaaacuuugucucuguggauuuuaugaaucuuaaaugcauuuguacacucauugaaggcugagggugucugugucaagguucuguugaucuacauguuccccagcauuucuuucugcauucuuugcugagcacauauggcuuguggaccugcagaauucucugaagucuggacucugcuggucaaaucucugguagaucacauaccaccuugucaugguuuucccguauaugcuuuggaggggugcuggagggccuuaugacugcuagugccucugacgaucuguugccugugauuggagcaguacucauggccacugugugggcccucccucaucagauuaguuggugcuaacuucauuuaucacuugcaguguuaggucgagaaaaagaggcaugguaaaugugcagcucuuucccuuuuugccaguuuucuuuuagcaugaguugguucucuguuacccuucaaagaugaccaauuugguuuugaguuauuguuuugaaugcccauauaaacaaacauaggugguggugagccccuuuucucagaaggacuugagaucucuaagcaagggaacaaagcuguauucuugaguccagcauuugguucugugguguaaacccauugccucuuccuguuccucuccgccuuggccuuccccgcaggcaaccacuuuaucaaguucuucgcuccguggugcggucacugcaaagcucuggcuccaaccugggagcagcuggcucugggccuugaacauucugaaaccgucaagauuggcaagguaaguccaagcccguguuaaacuggaacagucugccuugggccagauuaauuagcagaguaguccauuauucauucugugugcaaaguugcaaacuugauuuauuaauuccaguuagugugccacuugacaauucauuucaccuucacagauggcagccugguuuuggagucugcuggcuuuuccacaggauggagauacauuauggccuuggccaauuuauucugaaggaauggccaauucugaauuggcagcccuggagcugugcaaagauaugggguagagccuuguagaauguucacuggguaucuguggagcucagccaauagcuuuccugaaggguccuuccuggguucugcacucacacaggaucacagcagacccuuuauggcgaacccucuuuuccacugcuagccacaguuccuuccaacuguucaaacagagaagccagaaggaauguguaacaacuucugugugcccgggcuuucuggaacugucuagagcagccccugggcuucuggcuacuuuuaaucuuauugacuuugugaugcucaccagucgcucacucucuauggaauuccucuagaaaaaugucuccuuuccccacgugcugcagggcuuguuugcauacagaagaggugccucgugucuggguaugacgaucagaagcagaagcugggggugguagaccuggcaggcuggcccugguugagaugucuccccucaguuacuucuuugcagaaaggaaacaagauggauggcugggugguguaucggcagaugagagucugcuguuuagcauggcccuuggggguggggugaugcugggcacauuguuauucucaccgugaguuguauggauucuauccuuuugucuguuuugcuuucaaugucguagucuaccauugacggauaauacagugacugacaugaucaauaaugcugauuauuucagucguugaacauuguguggaaauacaaggcgaaaauacaucuugccuucuguccugcauccgucuuggcauccuuacuucaaauuaagaguuuuugugggaggugauuugucucuacuuuauucaguaaaggcucugagcagaagcagacaugagcagucacaggcugugagggacauugcuuuagacaggacccucccuggagaaugcuugugccccucacagaccuagcuggaagcuuccuggaccucauuuuaacaccuaauggcucuugcugcagccuuaccgcuuaacauaguuuaaaccccauuuuauugacacagugaaagccagcuuaguuccgcuuggccaauuuuaaugauuaaaaaaaaaaauuaaaaaauaaugcuuguaaaaauaucaggcaagcagaaucuugcuuuacauguaguaaccugagccaggccugaugguacaggucucuaaucucagcuauucuggagucugaggcaggaggauuacaaauucaaggccagcugggacagcucauugggacucuaucucaaaauaaaaauaucuuaagaaaagggcaggggauguagcucagcugugcuugccuccuaugaacaggucccuggguucaguucccaccagaauaaauagcuacugaaaugcuuacuuggacaaguuucuaaugcuacgcuuacugaaugcucuuauuaaacacgggccacuugcucaaguuugucgggcugugugcacaggaacugaacuacagggaccugugcacaugcuaacaugcuuugucacugagcugucgucgucccccccacccuugauuugaaacuauguaagugccagugauaucagguuuccuagcauugggaaaugcccaggugaguguccggugagugucuuacucucugcagccugccucacacuccuucccacacgaugggacuuccuagaccugccauuuucaguuaaauucaaauaaaucccacaucucaagacaaaucuccucaccacguuccauuagcguggguggauuuguggguggcuucuaggcagagucuucuuaaagcuugcagauugcuaccacgguugcucugggaucuggauuaaaacuuuauuuuuuaaguauaaauggucugauagugccuuuugcaaggcuguggagaagccagcugagugcucugugguucuguuuucagguugacugcacgcagcacuacgcugucugcucagagcaucaggucagaggcuauccaacucugcucugguuucgagauggcaagaagguaugucuuuuuuuuuuuuuuuuuuuuuuuucuuuuucuuuuuuuggucuuucgagacaggguuucucuguguugcccuggcuguccuggaacucacuucguagaccaggcuggccucgaacucggaaauccgccugccucugccucccaagugcugggauuaaaggcgugcgucaccaccaccuggcuaagaagguaggucuuuagcuccugugugcuguguggggauaaccuuuccacuagccacuguggcugaguuacugagaguguacagauacaggagauggcuacugucggcuguuggaggaacguguacuguuuaaugcgugugaauguguguguuucccuuuacugauagaccuaguaaauacaaaacuggcauuugccaaacuguucugaggcauuuugguaagcuuggguuuccacugaaauuagacaccugugcaggcccuggacgccugugcuccgguaugaacgaccuuuuagcccucagaaggagauuaaucuuugcuccuggugggguucugccuccccucuccuucaaugccuugcccaugguuagcaucucagaauucucaaggaagucaauggaugaacagcuagccccuacuuuagacucugaugauguacagcuugggaugggggugaugaaaucaaucuaauuucccaucugagugggagugucugcucacaagagacacacacacggcuggcgcugagacuccugauaggggucuaaccggacagauggggugggauggcauacgaccaagaaugcugaccgagcccgugugucuuggacagguggaucaguacaagggaaagcgggacuuggagucacugagagacuaugugcagucccagcugcaggguucagaggcagcuccggagacuguugagccgucagaggccccagugauggcugcugagcccacgggugacaagguagguguuugucagaauggggagggagagggaccugaguaucuauagagucuucucacauggggucuucugagugugaaauuguuucuggucuacugcuacaugcaccucguggacaaggucagcagaggugucccuugagaaucccugagggaagaugcuuggugucaagccuccagagucuguccguuugcucuaguuacuugggaacgauguguaugugagaguuugcugugacucuucuccgcugcccuggccccauuucuguucccuccugagcuggccgcugucauuucacuuuggccccguagcaaaggcucuugggagauaugcaucaggaagggcuauggagaagaugggguagccggaucgcaaaaugugucauccauuagguagucaccaacgagguagucagccuagagagaagagacaugagcaaguugccagaugggggcgcaugggagccagauacggucaggagaaucagcuguuggguaucaggaaagcacugggaggaacuagguccaguaaaggggugccaaagagcagccagggauagaagcuuggaggguggagcccuggcagguuggaguaggucagcuucaggaagaugaugugcaguugcugaggcauugggcucugaaugacaaggagaccccaaagcaagggugaggcagcgggggcaggaggaggggagccuaaggaucccacucuagugaggauaguucaggggguggggcagggggcaagaaaagaggcggguucugaggucacuccaauaggaggagucuuuggccaaugguggcagauacccaaacacaguaagaaguggggggugggacauuugguugccugggacugguuuccagguuguauauaagagaggauggagcaaacacucagugcagcacucaggaccagggcaggagggccacagugagugacagguagcaguuaaagucuaugggaggaucuguguauauuccaugcagauugccuagucauuucaugggugcaaauccuuggacuguggacuagggaggccccuggcaccagcaucuuguggacaccaagguauaacuguggggacaguguugucucagcucccacugcugagcucguccuuugacagugggacacugggggucaugggccgguccccugggaugagggcagugacucacugaauacccgucauguagagagagggugacgcacacuggaacucaagaaaacucaguacuuggaaauuggauacaucagugcugucagcugccccugcccgggcagcaagaagccuccucaagcuuagggucucauuccuuaaguuuugguuuaagaaacaugaccacccacguuaggggagcaugugugucaucccuaacaggguaauuacacauugcaagugcuuucaucaaacaccauggcuauuuauaacgaaguuuuccaucucuaaucuggccucccggagaacauggcugcuuaucuggauguaggaugguaguguuuguagucaguacauggaucccguguaccgacuguuggagguccagauugugugaugaaugcaccccagcgccucugagggggcugcugaacacuggcaugaagaacuguuuaaaaugccugaguuggguccaugcaguuuuuuguacaucagaguacauagaggcccuuugauauggguauaauaaaaaccauccaccacacccgugcaacaggucccuguuggcuagaagaggaugcuugaagauaggcagggcaggagagaaacacagcaugugagcucaugcagaccuacagaggcaucuugggcuacaagccugggagcuauaggccuagccuagaauggacugguccaugcugcagagcccugguagacaguaccugaagcccaugggcugauuauggguagaacagaggucugggaagugggaaggucugugaagggucucaguguccugcccacaaccccucggcagcucuuggacuugguacccuggucccugugccaaugucucuguccaucaagagaucauauggcugcccugcauguaauuuguaggcugcucuggccagaucccaucuucugcccuguucugcucuaaucaguguguuuaaauugaccuuucuccccugaagggcacugugcuggcacucaccgagaagagcuucgaggacacuauugcacaggggauaaccuucgucaaguucuaugcuccgugguaaguugccaucucagacauugugccagugcuccuugucacagcaugugucucagcggagugggcacgggucacacucacacguaggccaccuugcaggaaaugacucuacuguaccccgugcagcaaccguuauuuuagagaggaagaugagcauucacuuuuaaagcucagccuacuuaggcacaaacaaaaccaucagugaauugugaugggcucagcuuucucgucgagccauucaguacgugaccuaguaacccaaaccuuccuggcacgggguccucggggacuagaaucucaguggacggagagcaaaccgagaccuagauagccuggcacuggaggacagauggguucuaugacuuccaugaacagcuguaaccugcauguccugugauggcccugaaccucaguuuccuuaugucuuugucaguacaguccauuugaacaagcacaguccauagagaugaucaacccaaauacacaguggucaccgugacaccccuaucagcuuggugcuucgugcacucgggggugcugcugcaugcaggugugcugcuaaggaggaugugacccgugaguugggcagcuuuugcccuugaauagaaaggagacucaggccugaagucuuagcaccagggaugcuaaagcaggaggacugugaguucguggccagccugggcuacaaagagaaacaaaggagaaagggugccacacaaugcuauuaaccuuuuaguuuagaagcccccagagcuguacagauaggugaguggagagagaaguggggaaggcagaaagagagcaaacggcagcaaagggaagauuugagcagagcucuguugugaaugaccuaucaaggacgcccugcccaggcagugcaaucuacaccaucacugugugaccucacaugugauucccgcucccccugcugcucacggucacuuuaggugucagcccugcucaccauucugugagaucagagucuaacuuugcaaaccugcucacuucugucaggcuaccaaagguggcagggcuuucacuuccuccuuaggagaggaagggcgggcccaugugcacccagugggagaauuuggugguuuuaacugauucuacgaggguguggugaccagaucuugguacagcuaaccccugcucucuucuagguguggccacuguaagaaucuggcuccuaccugggaggagcucucuaaaaaggaauucccaggcuugucagaugucaccaucgcagaaguggacugcaccgcugagcgcaaugucugcagcaaguacucgguggguaccuccgggaggaggcgcgggggaggggcgaaaugugccuggagguggagcugaggauuggaucagugccccaagggaccuucacucagcaucauggaaugaguuggcucacucuggccaggccucccuagagagugauuuguaucuugaguugugccauuugagaaaaaaagggccuuuugcagcagaggaggcuggccuuucagaguggggcucuggguucuugcuggggucuagcuguacgguccuaagaugugacguguugggagugggguacugccugcugaccggcuguugggcggcggacguggggggauaaaggggugggagaaaaccugcgucccaccagaguuccagugcucuggacggguggacgugaaggacuuccacuugcucuccacucagccccgggucuggcugugggaagccacggaccccagcccucgggggaugaaagggguccaaggucucugggccucacggaagccagagauaacaguuuugucuuggacaucccagacgcugcugucugucucggaagagcugagaacaaagugggggccccaggggcagcccuauuauccccagagcugaagagaggagagggcagggguauagggggcacgcuggugagaguccuugguucucucugaagccugagguuacacgcggcucuuuaggggaaagccuaucccauaguucaagcacagagggccuugaacagagauggucuaugguuuuagagcuuuauuguagaaagguggagagaaagagagacgguaaagagauuuggggggggggagagaaggagggcuagaaaugagaauaagaaaggugagagcuuaagagagaggagagccaagcagcccauuuuauagugggcugggcuaucuuguaguugcaggguagcuguggggaggagcauaccuggcuauugucagguaacugugaggguagagucuagcuagaauaccagagcuuggggcucugugguaucaggcaccugucucugggaacuuggcucacuguuccaucccuuguagaguuuucuacugggucucuggagcaagcuucacucaaccaaaacaggcugccuuucacagccccacaacuguccagcagcugucuugucuuaaccagccaagggcucagccuucaguuauaaacaggcaugcugaaggauggggcugaaaggaaugagcgaaucaaaacaccccuggaaaaggccauggcuggagagauggucuguuuaacuggcacguuucuucugagcucagcauacgaugggcuauguguguaccauuuauaauuugccuucuacauguauggugcagggcguagaaccagggccucguguauaccccagucauacaguagcacuaauauucagaauuucccagccuuaccugagcagguuugugugcgugugcuguguggacucuaaaacauugacaucagaugucuuucuuagacuucacugaaccuagcacucacugauggcuugggcuggcucgccaguaagcucugagauccucuggucucaaccccagcaggacugagauucuagauggguacuccagcacacuuuuuguacauggaugcuggagaaccaaauucaaguccucauacuuacucuguguguggcacuuuacagacugaaccaucucucucucuguguguguguggcuuaaagcacucucucuuucuccuuuaaagguacgagguuaucccacguugcugcuuuuccgaggaggugaaaaagugggagaacacaacggagguagagaccucgacuccuuacacagcuuuguucugcgccaggcaaaggaugaacuauaggagaccccggggaagucauccagccugggcuuaggcgugaccucacacagacacacguguuuucacugugguuagucagaaagcugaauguauugagcuuguguugcuuccugugugcucucugagccaccacacacuacggaccuuaaguuucucuaaucauggcucacagucccugggcaaaccaaacguuuucaguggcgauccauccuguaacccuucucuugacagaauuaaauuggcucccuuugcaacuuaaaauacagucaaggaaagccaaauugcugaacucugcuggcucccagggauguaaggacaucaucucgcaggagcaauuuguugcauugccugaguuuugggaaggaggccugcggcacuguugacuuaguaaggugucgguccauaguguacagauuucaaaacaaaagcccacagagcccuggagaucccuucauagccacugcuggguuccugggucucauuacuucucuaguggagagagguaagccauaacaaaugguacuucugaugugugccccaaauacucaugcuguucaaaggauccucuugucugcuucgcauaggguggaguguggagauguacgucuucugcagaaagggaggguaugggaugcaccacaagguggguccucacccgauaggcuuucccagguccaaggaccagggagucucugcagcuccucucgggccuuccuagaaacagcuucugauucucuuccuaaguaguucuuuuagcagcucgcuuuauaaucuccaccuuaaaggaggcugaccaucucucuaaugauugagcagugggauucaucugaccuccagaccaaagacugcagucggcagggcugcccuugccuaggaagcccaagguuggauaucgcauggcuacuuccgguucccgccuuccagguuauuagacgccgcugcucguaacucugugaagaugcagcccacgucaugccucugucugucuuguucucagaaccacuguguuugugcccaggcccuucaccuaccucccacgagcggggugaaaucagcaccuggcacaagacguguagcaaggagacuugaaaccagaccacgucugcuuccaaaacaucaggagcagaggcgccccgccagccuguuaugaacguuuauuauuaaucacgugugggucacagcuguccuuggaaaccaguucuguuggcccagcucacaguggcuucagcuuagcaucauggucuuauaugaaaagaaaacucaagugguacaauuugguuuauacuuucuaaauaaacuuuuuuuuuuuaaagaaaaaaagucuggucuuugcuuaaauguuacagcaaaauggauauaaaauagacaauaaauuauaguuucuauuuacaaagaaggcuguaaguacaguuacagauuguaaauguauuauuuaaucaguuuaguaugaaauuggcuucccgguacaugauugugaaaaggacauuuaaaaaauauucuaagauuca

SEQ ID NO: 6998 - RNA, 2071 nt, Mus musculus
aggaccugugugaugccuaucaucagguauugggguaaaauauuagugaaucuccugacuaucaacaaacauuuguguggacauaugcagugacuacaagauguaaagauuuauauacacuuaacacauuuaaucccauaauucuccaucucccugcaggaucucaaaaaaaaaaaauuaacaaucccccuucaacuguuaagcagcagggauuguacuuaaacaucuugugccuccaagaaccucugccuugcuuaaauaaaaacguaacaaaaacauagagguaguuuucuuacaagguacacauugcauuuucuccucccaugaagccacaggaaaugcaucuccaaucaagccaugcuguggaccgaagaaugaccauagaaaacacauucaaguucuaacagacauaggacugcccagggaaaagagacugacuccuuuugucuaccaccaguucucaauaguacgagugcugcuagcaggcuaguguugucuguuuccuacagccaauuuuaugagaucccccgcugcacaaaggagcaauugccacggacaaaacuuucuacgguuugcuguuuaggaguucccuagcauuuuaaacugcagacucagcacaucgaugucuuagcuuguuugugauaccauuccuauuuauguuugacaucacugauaccaagcaguugggugagcauuuaucauuauuucacuggaauaaaucauuguaauaucaguuuaauaagaugucuaagaccacuauccugcaauacauagaccaagaacaguggcauauugagaagaguuuaauuuaagauaaacuuagggagacacaggaccagaaguccauguggagauacagucaaagugagaaauuccauuuaaauugauggaagcagauaguucacuuuggcagguaauauaaaaagggagguacccauguuaaaguaggaaggacugaggggugugguccgggaggguguggucagaccaaagcccuugguuuucugagacaagcagguuuuauuguauuaacacaacaguguuuuaagguacugaaacugucgucaggagcaacaaauaugaaggauugcaaacgaugcugucaugaagaucagggugguuguccccagcuuugcuauagugcaaagcuuacaagccuauucauucucugagccaacaauuagugaaagaaggauuugcaguucugggaccauugcagucucaguggagaggggguuugcacgugcaugcuuuauagcuaaggcugauucccauuaggguagaaaaucaaguguaugauucauaauaagagauugcugccuuugaaaccgcuuccucccauaauucagggccacuucauuauaaugguaauuagaaaggaaagaaccagaaauguccauuugaagggaaauuagugccuaauuuccaggacuguuuuguuucaacggauugccacucuggcaagauuuuacacuuaaauugcaaaccuaagaauggcagggcugguacuucugaucugucuucuaaauggacagcguuugaggcagccugcaacgaugcuggaguaucugaugcagugcacaucgggcagucacauagacucugauggaaggauuugaaagggagauuucuguguaguuauauaacuggucacugcugucguuaaccaaagagcaacuguuuuaguguacauauucaguguggcuaagaagaagagaaaguuuggugauaagaaaaagucacauucuauuaaaauaccccaugcaaucuuaaaggaugcuuucucugauaaagaaaacaagaucuaagaugaaauaccauaggcuaguuaauaguuagagucuuugguuuuauuacuuauuuuuuuaaagccaucuuuuaaaaaguuuucuauuuccccuuguuagaauacucuaccuuauuggaaauuaguauacucucuggaaacugcacuguguuagucagauauucauuacugagacaaaagaaucagcuucagagauuuuuugauggggggcggggcagggcuuaugguuuuagaugauaugguaucaacuccaagccaguauuu

SEQ ID NO: 6999 - RNA, 22931 nt, Mus musculus
ucaacauaaauaaaauaaaacuuuauuuuuaauaauaaaguuaaugcccccggucaggaagcaauagcaugucauuccuuuagcaguacaaacaaucuuuuauccaaaagaauacaucgggcuuuauugggucguuugucugaauacagacucaguggaauaucuaaaugauacccugcucugaacuccaaguugaaaguaaguuuuuauuauacuugagggaagcaauggguucagcugcuuauugcaaagagcaauugccaagggagaguuaaacucaauuacuguaaccauacugaauaaaaaauacugccaagaacaaaaauacgccuggguaaagacagccacugaauaaaaaaaaaaaucgacauaaagcguaucaaauauuuauuuaucugggcaacaaaggacuaugauacauugacaggcauagaggcuccugccagagcaacucaacacagugcagcuaggacugcuuccaauguggccagcgaagacaaggaagcccagguggucccaaauguuuaaagaugaacaaagagaggcagagagagagagacagagaaagagagagagaaaggcagagagagagagagagagagagagagaagagaagagaagagaagagaagagaagagaagagaagagaagagaagagaagagaaaucccuaacccuugguuuaaagacaauauucauuuauugcucgaaggaugcuuuuaagggaggacagugaacucaaauaaacuuuauuuuucuccccaugauaccauagaaggauuaucaaaucacuccaguuuaagaaauuuuuuuccaaucucccaauaucacugauuuuuuuccugucaguucaaugaaaagcuaaauguaauacuaauuauauauaaauuuuuauuuuaccuuaaaaauguuuuuguucagcuguuucauuauaaucguuuaacaugcuaccacggggcuaaauccaugaauuggagaaaagggguggggagggggagucuuacccaaaccuuggauuucuaaguaaaaccacaugaagaacuaacagggaggauccaaagcccacuaaacaggagguaaacgagaucaccagauaaauaaaaaaagguuuaaaacagacucaccauauuuacaaaucccauuaaauuacacauaaauaaauauauacagagacgugaacacugauucccuuauagaauuguggauugugucaucagaggaaguucaagugggugguuguaccuugcagaagacaacuucuacaacugaagacaggacauagaacuucuguauuuguguucaaguuuauucacaauacugauaaaaaaugucauuauccucuuugccuuuuuuuuuaaaaguauggcuacaaucugaaguacgcaagggaaggcgaugaguuagucccaugaagcucauauacuuuuuaaauuuuuuaacguccuuuuuaaaaaaaaaaaguuuuaauguuuguugucgauuugauuaaaaaaaaaaaagguucacaaacgcgacagaacuuuucuuugcuggcuucacgaccuguucuguucucuuaggcuccacacgaggguaaaggggguguugguacugauggggaaguugaggcaaggcgcugaguaggcagcggcugccccacuggcagucgagagagcaauccggaggacuccggggacgaagggcggcgcggcaacgcagaguagcagcagcaguaggaguggcuggucccggagcugucaccugccgggugggggaggggcgaguggggggacgcgggccggugaggcgggcgggggcggggcgggaggagagccucacuuucuguguuucucuucuuugucacugcuuuuggcgcuguuguccguguggcuguugggguuguugcugagguacauuuuguccauggccuugagggccucggugagauaguucugcagggccguaaccgcugcacacaccgccgggcugccgaagccaugggagaugagguugaagugggucaagcaacucuggaugccaggcuccaggauaggauugggccgcgaguuccccaggggagaucgguccugagccagcaggucagugaacucuuugcagaucugucugcaguggaacagagacagaagugaaagcucccaucaggccuuagugguagugagaaaccaucgcucccugaaguuaccucagccauccagcccaccuucccccacucaggacucaaggccagucacucagaauaacaaagccugucacuucuaaaccaacacuccucccuuaaaugaauacccuuccuacuucaaaaagaccuccccuucucuccccaccuccaacccucagcccugacaaacuucugccuacaccuuucucacagcaaacacccugaacacaggaaagcauuucacaggcaaagaaaaguuacaccggaagugaaaaacacaaguaucccucuucaguauucuagaaaugccaggcuuguucuucaaaauaucaccagagccugcuccccacaucccuaaaggaaccacaauaaaagcugguggaauggggucuccucucauucaccuucaaaccagaugagacuugaauuuaggcagaaaggcaaacuuugcuuuuucaaaacaacagcaggccccggggagagaacucacacuugaccacaccacacacacacacacacacacacacacacacacacacacacaaggaucugccuuuggaugcucagaauuuauguaagaaucuagcuuggaggcuuaugucuuuaaccccagcgcuggaucagagagauagugggaucucucugauuugcugggcagccauuuuaguccaaauagugagcucuggggucagugacagacugucucuaagacuaaaguggggagccauagagagagcuaccucagcacacaggaaguuugucugguccuggaagccagcaguagcagaggccuuccugagguugcuacagcccauggagggaggguguguguguguguguguguguguguguguguguguguguguguguguguauaagccuaucacuaggccagaaacugucccacacaaggccucucucugccucuuaacucucugcugcggugcccuucggugacaccagcuuuugauaauugaggacuucuaaacaagccuuuuaauuuccagcaaacauaucaagacagucauuuuucuuuucaaccuagagaagucaauucagcccaggcacuuugggaauauaacuugggccaucuugaaacccugagaugauagcuugccaguuaacuaaaacuuacagaguuacauaguauacauaguauaguauaacuauguaacucugucucugagucucucucucucucucucucucucucucucucucuguguguguguguguguguguguguguguguguaagagagagagaggauagaaacugggauuagagguaagaguagagcuguugcuggacggcacauuuuguaggccgaguuagccucugccuuucagaacacagugauagagagaaaacccaggcaagccuaguugguagcccugugaggauuugauucugacuuuuucugaagcaacacaaauccauacucuuucagugaaacccccggcugcaaaccacacacauccacauucauuuaaaagucaacacagaaagagacagacuuuaggaagaacacagaaaacacagggacaaucccacucugguuccuuugugacacagacugcgcucacuucgacacuggugcccugauuucaguauucacagcaaagccgaucaacaagaaaggaagaugggggugggggguggggggagcaggagcuaauuucuguuucuuuugacagugaacagcccagacccugcagagguaaaugccuuacuuuguggccaggagcauguuuuuucuugccacuugcucauugggaucggaauguugucgguugagaaauucugcuacugcuuuggcaggaaauucaguuucgcacacguacccaaagucccuggcuagguggacggcuucuccuggcaagagguggaggagggaagugagggccagagaaccacggacuugggaucaaaguuuccccuccacacccaacucccuaaacuuucuucaccaaaaguuggaaggaacagaaaccacuuguuuccuuucuuuagacuuuucuucuucucugugcgauccagagagcaaacucagcagugccuagcuggcuuacaaggccaagaggguuugaaaauguuaaucucgcccauccccacccccacccccauccccgacugcaguuuccucgacuucuguuugaaaauggcugcccuguuccacccucacaccuaucaacacacccaucaguggcgcuuccuaaucacuccuugagcauuucagcaggcgaacaaccgagaaaguuuacauuuuaacuugaucacauacaauuaucuguucauccaagccgauuaaccaagaggauuugagggucacuccacugagucugucuguguuguugauuuucgaaucuuugguuuuaauuuccugaaccaguugguuuuuacugcggggcuuccugccauuagcuccggcuccggaagaacgcaugcgccaauuagagcaucaaagcccucucugcagagcuuguuuccauaaaauggugcggaucacaaacaauaacaguucuccagaaacugccuccccucugccucacucaacccccagacccagaccagugccucacgcucuacccucagcuuccaccaccauuuuccuggcauauaauuuggggauuaugauauggacagcaggaucucuauacacuaccauuauuuuaacauaauguugcuggguuugaauuucuggcccuaaacaauagauuuuuuuuaaguuacauuaucaccaccuucaacaccauuuaacacccagaaauccuagaaugccuucucaaaaacauuguuuccaauguucucgagaaacuuucagauucuuagauuccauggcaauaucucccucgaugcacuaugcaaauaaauuaugccucauuaaaacauaaguggcuagcuuuaaaucugccugguaauaaaucuccaucuucuuauuuuucuauuaaugugagauauaacaagacacaaaggagagcuauucccugauucccaaccuuaaaugaacugaguaucagaagaaguugggaaucuaggaagcaggauggugagugagcagauucuggugacagcuuuuggguagcuggccaggguggcuuuuugucuuaaggacuuugaaggguggguguguguguacuaaaggggaggcgggggggggggggagccggaguaaaaaacucuuuuacaauuugucuguuucuucuucucuuucuguaucaaacaauccagauucuagaauugcucacuuucugccccuccuggagagaagacacacaauggaaacaagagguaggaaguauauggcuggaaaccaacaacccacaagggcuuuuaacccugagcuuuugggacagucuuaaagcaggaugcaggucagagauucccaaauucauucaggaaguaauggucacgcauuucucaaaugcagaugucagaauaacuuaagugauuuacugcugaguucuuuccaggagacaggaacuuggggaauguguaguucuuaaauuuguucacuguuuaggucagguuugagcugaggguagggugacucugccagacagaggaagaagaacauauaggcacgagucuauacaaauaggcuuuggaucuuuuguuuuauuuuguuuuguuucuuguuuuuuuccuuggcaucccaaauucuuuucaauucccaguuacauuccauggaaaagugaagccacccaaaggacacaaaacacacucaaacaucuggcuacuaaauauuauccaccccaccccacccccaaguugacaguucccuuccagauagcaagcagaucuguuuaccuuccacuagugacgugaggaggguaacguuggcagcuuuacgucucccugcuggcagauucaauccuaucuuguccaguuuuucucuuaaagaucucccuccauucuuagacuucgcucuguuucagaaacaugggaggcagggguguuaaaaagauugauuuuucucuugucacaucagagucauucugaacacuuucuaaaauguguucuuaaaaacugagggucaugguuccaaggcaggaaaagagagagcaagaaggaacuauauagaaagaucauggaagaugaaaggcauaguugucauugcaacuauuguggcagguugggaacuuuccauuuucacacacacacacacacacacacacacacacaguucugauugcaagaguuggagguauuccugaguuccacugauaacuguguugcuuucccuguugcuauaaucccagcaaagcccaguggggucuuuaaauugucuucacaagaucugcuguuagguuguucccagugaccaaaguuaucaucgcgcucucauuucauguccuggcuuugaucccaaugggaaaugcaccuugccaaguguuuacaugccaugucaggagcauaacuggaaaugucaagaggcugauggcugauaucagccuucaaaauuuuucccugauuucagaaacaauggagucacuucuaaauagaugucuaaauagacucccauaaucagaaagugguuaagauaaauuguuuaaauaaaacagcaaauuaauuaauuucagauuuuauucccuacucaagugggucuuuaauuguguggauuagauuauacucccauaggugagcagucuccgauauuggggauggggggaggggaggaaaaagcagagggcagagaaagaucugugacaguaaaagauaacuaaggaaagccgcugguauuaacucugcaaaaacccucuuagaguauguaggugggccauacccaccaaggcccaacugagaguuauuaauauacaggaauaaaguuagacaacgaauuacaggucuuuuguagagaggagaguaagagacauacucuuuggccaaauuuaauacuaggccuacaacucacaccauuggauagaucccuaagaacacaccuggcucugaaacuuuucucucuuuagacucuaccucccuggcccuugugaaaaacaggacucacucacuucagagaggugagacuccuguguuaauggaugcgacuacauauaaugaacagaaaccugucacacaucacagcaaaucagaacgucaaaagaacaccccccccccccccccccccguacagagacuggaguggagguagagguuccuuauggcaggaagugccagcaaccagggaugggaggcacgcagcaagcagaagucacucucuuucuuuacuugaaaaccugucuguuaaaucuccacucaagacccuacaguguaguaaggcaaagcaaggagcccggaagcuuuucugagcuuguaaccugugcgcaaccagggaaaaggcagcagcacggcgccccacggcugccaaggcugggacugagccccagacguagaaaacugcgccugcgugcugcagaaagcggaguucccgagugcgcaggcgcguugccucacaccccacccccgccuucagccacgcccacaaagcgccacucuuuucucuccgccccuuucacgucgcgcgugcaguacagcuaccggcccagcgcaggcgcacuggggccggguucccgggguggagcggggcggggcggggccggguggggcggggcggggccgguccgagccucaccuccgcaguacuccgcccaggagcgacgcguuaagacacucgggcggugagaggcgccgcuguacuuccgccaccgugaccuuguacuucgagguggagcugaggagcgacaggcgacccggaacugaacagaagacuucguugggguuuaccacgccaccgaagagguuguccuuguuaauagggauggcggagacagcauugcuguuggacuuggacagggacacggggccugcgaagacagaugcgggcgcguguggggggcggaccgaccgagcgcugcucagcucaggaaucccgaggcggcauccugcccugacccuugcagcaagcugucuagagauggcugaugcugucgcgacccccuaggcucucaaagggcuccgaagugaugcaggagcuuggguuuagggaggcaacgaauggguuuuauguguaaacccgagacaggguugguguaguggggguuuugcuggcgaaaggcucagugccaaaagaaauugcuguuaaaaccagcagacaguuucgauugcugcagcagccaguaaaugaacauuucaguaagcuagcaagugguggauucuguuaucacacacuacacguccguccuuucaucaauagacccuuauguuccauuuaaaagacacucgggcuuuggagaucauuccaagcccgugaacaggacucaagaauaggccuacaguugaacauuaggaaugcauccuuuuguugagcaaauacuaaaugaacccugucugucuaagccccuucaaagggauggggguuaggauauauaaucaguuaaaaccauaagcucuucauuguuggaucuaccauuguuagaaaacaaauucaagaccaucagaacaagggguucauuucuuaacacaugaaauucagaugcaccuacaaccguuuaaguucaaugcguuuguaucuuaaaauuccacacagagacauauaauaauaugcacagucucaucauagcaccucucauguuuuuguuuuguuuugccuuuaaauagggauauucuacuuguauggggaggugagggccucuagguuuuggauagaucacuugugacauuaauagcucuggggaggcuaauagagacaauaggaguuaaacgaacucgggagagauuacuaauaaaagagccaauuaucaugucgacuuggaaagaguaccucuuaacauuuaucccuuacacaucuaauuugacaugacaaagauuucacagaugcaaaaaugaaacuuuaaacuagcuaacaauauacugauucggggguuagaaaugagaacaguuuuauauagcaucauccucugguggugcccagaauccugaaguaccugccaccauaacaacaaaaguacugcugcugcauuuaauacaagaaacuuuauuucuacccacuaagcacaaugcagaugauaaacccaugcaaauuauguaacaucuuucuuuucuauauacauaggucaacagugggcaucuucaagauacuaauuuuaaccaaaagcuaaauuuuugcuaaccuaauucaaguuuuaaagccuugaaacucaaucaagagacuagaaacuaaaucagagaucucgaaaguuguccuccccugauagggugcauuuuuucaaucugacuuuuuauuaauauuaaauuauuuguauuauuucagcuugauacacuuuugaacccucauggccuuuaacugcacacaauuaauuaacuaugagacuauuuccaaaucgaaaugccacuuccaaaucaggucaacuagugcacauuucacuuugugcaaauaucauuaaacuacauucaacgcugaaaucccgauuagaacaaagcuagccuguugccauuaucaagguccugaaagcuggugguuuaagcacuguucuucuaugcguaucuauuugcuaauucugagccuuuaggaaauccuauuugaaaaaaagaauaaauacaguccuguauguucuuuuaaauagcacucugccuguaaggacaugcuuggaaugaagaaggaaauggcuuaccuuucuuaauuacaguuugaucugggauguuaauacccgggucuucuacgugcugcaacaaaaggauacacaugaauguaagcguauaaucaaaacaaaaggaaaugaauauucgcugcaaggugggggaggggagcucucccuccaccucccccaugacauuuauauauaaacaucuuaucuuggcuugcugaauuuggagcuuuaaaacucaagagguuucacuguauacccucggcccauuucuccucccccuucccccccagcagauaauccacgcugaagagcuccggauggagaauaaaacuuucuuugaaaaucaaaugaaguuuuggaguuccuaaucuuuuuuuuuuuuuuuuuuuuuuuuuuaaacaaucaguucgaccuuuagaaaugcaccuagcuuuagugugccaccuuucagcagccucagaccucagggaucccaguguggaggcagcaaagccaaagaaacacaauagaaaggacggggugggagaacagcagacuguuggaaacccuguagguaauucacaaagcgcacgcacacacacacacacacacacacacaccuucacuuaaggaaagcuagaaauaauuuucaaaagacugcugccugaaguagauauggcaggaauguggaaauaucaggaacaaaaacccuuugaggcuacucuccuguuguccagcaguaguguggggucucccccaccaccacccuucucucucucucucucucucucucucucucucucucucucucucucucucucucucucucucacacacacacacacacacacacacacacucucacacagauggauggguaugcguauaugcuagaauccaaacgugauuagaaaguaaaaugaaaucauguuuucuaaugcagaaacugacaggcaauauaaugucuggcuguguuuacaaauuagcaccagggcugcugagauagaggguuucgcaaucguuaccaagcacaggcauugccauuuaaaaaacuauuacuuccuucucuagucuuuguccaacaauaauacugauucgaaccuuuuccauucugccuuggauuuaugcucauguuaauuguggcugaucgcuaugauuccggguggauggcacuaaguugcuuuauuacagguuuuauuauacucaaugcucucauuuguaacuugccuaaagugcuucuggauuuaaguauaauuaaauugagaaauguucagaaaugacuacugcugcaguucuuguguuuuaacuauauggggaaauaugaucccuuuaugcuugcacccuaaacccauaaaguaaauguaguguggaauaauacuuuuauuucuguuauuucuagcuagaccuuguccauacagggaagacuguuaaguuuaaaaccccacugagauauuaaugauuaaguaauuuucaccaucgacuugauuuucuuaaauauuuagcagucauucuuauuaaaaguuaacuguggcagcaaugagaaaauugaaaacaacccuuuuccugacccaaauuccuuugaaagauuuuuuuuuccccuugaaaggugggggagggugagaagagcacaaggcuuccugcuuucaugugaucauuugguuaauuucuccuacugaccaauuucaccacaaagaguuaccacacagguaucaagaauucccaccagccacaggacauuuuuugcaaaaguagaucuauguccaaugcaggauaacuccaaagcuuacggcauuauuuugcuuugcuacuugaguguuuucaaagaacaggcaaaaaaaaaaaaaaaaaaaaaaaaaagaauucagagacuuucuaacuaaaaucaccauaacuucuaguucuauucaaaauuauauucacuaaggaucuaguucuauucaaauucacuaaggaucauuuuuaaaagcacgugaauaugcacacaaacacacaccacaaacacacauacacacacacacacagagcucacuuagccuuacaauggaccaagcgccugcuuucuguguuccuugaaaggcuguuaagcauaaccaacaaauuucagugauuaacuaggcuaaaugagagagguaauaaauuuucuauuuuccuguagaacuucaagaauguuuuaaauccgccaggcaaucagguaaguucauguggcccguuuuccuuacaaucuaauucaguaaucauuaaacugucaacagacauaccacugcuauauuugauguaguaauuugaaauagcauuuuagcaaaaaucacauccagauacauuuccuuuccaaagaaaagcaccuuuaacagaagauauauauauauauauauauauauauauauauauaauauuauauauauauucauauuacacuucaggaagaaagccacaaauuuauagagccaaggcugagauacugguugcaauuuaauuuuaaaaaguauuuucaaauuauccuuagccuggguuacauucuaaguaguucauaugcuaagggcccugcuuauuuagaaaucaucuuaaacugcauuuauugauaacugaauuagaacuccacacagcacccaauagucuccaaacauuuaauugaauaugcaguguagcagauucugauaggcguugggaaccuagcuaaugauuuaugaggucacuacuuagcacccccaggaagagaagaaagcugcauuuuaacguccccgugcuuggauuugcugcuuaugucccuuggaucaggauaggguaggcauaacuucuagguuuuacuaauguguauaaaagccggaucaaggaccuuacccuaagucucccagacuuguacuuugugaguccauuugagaagcucuagguuuaaauuuaaccucuuucggaaaacagcgagaaaucaucccccacgccacuuucagcaguggaauuagaaucucccucgaucucacacaguuuacugucucggagaggagcuaccugaagggugacaaucgccugauuuauuugugucgguuggaaguggugacccaggcauuguugagcgagcuccaggaugcauuguucucaauuacuuuuuaauuucaaaacucgguuguuuaagugagucucacccucacccccaacuauuauugaggaaaaccaaggcccugagggccugggcuccacgaagcuucccagagggcaggugagccuagggcugcguucccucccgcggccugcaccgccucuuaccgggacguccucgauggcgugagguaaggaguggaucgggagguccccgagcccagagccgagcccgugcgggccgugcaagagguccucgugccgccgauagucccugcgaggguccaggcccgacaguuggugggguaagccccgguguguguguaagagcccagauuccuggcucugccucugaccgggccagcccgggugcugcggcugcggcugggcgugcagaggauucaggcuguaggggucguugacgugggaguaaggaucuugcgacuggggguagauaggcugguagggcggggggaaguagggaggcuggaagucggcauuaggggugugggacagcggcggggcgcugguguagggagauugaccuacagugcccagcuggggcaaccgugccgucccguugcuggugccgucgugacgguccuggaagaaagcaagacgggaaggggaagaagaaaugaggcgcagggcuucaacuacccuacuaaauccauuccacaagcccaauguggggaggccgccgaaguaggggguaucaacuacuacacuguucauauuggaaaacacccaagaagugaagcaggccuuuccaaaaaaaaaaaaaaaaaaaaaaagcaaagaaaucagaauauguaaauauaguggcacaguagacucucagggacauuccucucaaaggagggaaggagacguaaaagacuguguccuguaauacaacccuuaacagccgcaguaccaagccuuccuuaagcaaaauucagauagccacuaaauauuaaacaggagaagcggccuuugcuuuucccggauuugaaccuguccgccacugcauuauuguuuacucuucuauuaaucucgagguggggaaaaucauaaaccuucaaagacuauuaccauuucaugacuauuuaaguagaaacaugcuucacacggaggccuuaagaaagcgcacguuuaaaugacuagcuuaaagguuuuaacugcaugguuggggggggggucugucuuuuccgcuuccucuguuuguaggcuuuuuacacgacaggaucguuuuuaugauaugaauggggagugaaagacgccaagccaggguuuaaaauagaaagauucugccgcaccgaguucuuuuaaaaagaaagaggugcaccccggagcggaggcccccgccccuuccaccccagccccaaagggcaaaagaaacccccgacuuuagguuuuucaauugcaagcugcuugcaaagcaagccaagaguggcuuccagagagcgggaaccucucuccgagguuuagccgccaggccccaggcuaggggaacacaccgaggugcgccuuucacccccaccccaaaagacggauugaacaucagauauggagagcgucucuggagcaaguaaagacgcaaggaaauaaagacgaacccggcgagaaacuggcccaaggaaagagcugcgggguaggucugcgugcacggagagguccagcagggacagggcaguggcgacgcguuggauuuggggauggaaaggagccagagaaaaguggaaagggagauaggaaugcaaacggaaagcgagguccacaaggaacccuggccaagaagcucaggaucucgggcaguuucucggcugcggguuucuggaacagaauuccuaaggaaacaggguuggggguggggugggacucaccauagcugaaaaacugugaacuaacaucugcgaagagucugggguaaccagucagggugaggaaaaaaaaaaaaaaagccaacaacaauaaccaaagcaaaaaagcaaaaagcaaaaaaccaccacgccucgagcacccggcugccccgcggcccgaaagagccacacacaaaaggcgccgagagccccgcgccacccaggacuccagucaccgcgcggacgcugccgcgagcgccggagccccgcucggauccauccgaacuuguaccaccgagucgcgcggcgccuucagcuggucgaacccacgaucucuauccucccaggaucgguuaggauuucagagcucuuuaggaaaaacaaaaagcaaaaaccacaccaccaacaacaacaacaaaaaaaaaaaaaaaaaaaaaaaaaaaaaaaaaccaaaaaaaaaaaccaccaaaaaagaaaagaaagaaaaacgaaaaaagugugugugugugugugugugugugugugcgcgcgcgcgcguguuccuuaauccgugucucccccucuuuccuuagcggcggcuucacuucagcuucuaauaaccgcgcugggcagcguuccuggagccuccuaauagcagauauucaugacuauuaauauuacacgaauacuuaauaagggaagaaugccuggaaaucgagcgugaagcggagaggcaacucgcgccggagccggcucucaaugcagucauugacgggagucucaguguagcaaaucggagguggggagagggagcgcgagagacaaaaagcgagcgacggagggagcgggcgagcgugcggggggccgcggcgcggcgucuggcgaaucacagcaaaggggcaacauuuuaaaagguugcagggccugcaaaagugaaagagaaagaaggcgagagagggaggccgagggggucggagcaccgagagggaggaugugucugcgugcgugugcgagaaagaaagugugggcgacuagaagagagaggaguggagagagggagggaggaaggagggagcgcccgggaggaggaagggagggcaggagggagggaggaggagggggaggagggggccgagccggagcugcggagggggagcccgcggcgggguggggggggaggggagaggaagcgaaggaggacaaucggaccuaaaaggcuagggcagaccucgggauggagcgggggucgcgcgccgcgggcuggagcucccgggacccgcuggcggcugcccaccgaguucugcgccugggaggugcuucccgccgcucuccggccgcgggauucucuguugcgcagcggggccugggacucgggacucggcugcccgcugccucgcugauccuccauggcccggcgucccgccugggagcaacccgcccgcuucgcuaacccuuguccuccgccuggucgcgagccgccuucccuaggaccucggagccgugagcccgucggcugcggcuucuccgaucucgguugguccccggaccggguuccgggagcgggagccggagccggagccgggacgcggccccgggcgcgcacagacgcgaagcggcccagccugggcgccucuggcgaaggcuccuggcucccugcacaaacccgucggacuggcugggccacuccugccgacacccccuagaugacagagcuagcucuccccucgcgucgccacugcuagucggcccgccugguugucggaacaagcggcaccucgccucuugcgugucccugcagagucucagccaaaucagacaacucuaagcccgcucgggaacccgaaaucuccgcuccagagcuggcuaucccgcugauaccaaaguuguugagauugcccagacuuuuuuuuuuucuucuucuucucucccaucccggucucaucacaccccucuccaaccccucucucaugcgccuucagagucccucugggggguucaaguucaucucgcgcccuacccucgaguuuccuuugguguguugagccacacuaagauucuuaacgcuuccacucagggcgcuuguaccccgaacugauuucgggguuccaagaaagugaaaaaaccaucagcuagagaagggagcccagaucccuaagggggaaaaacugcucuuaaagagucacaguagaaccuagcccugccggcaaaagucacccuuagucuagaaaacaaagcugucugguccuacaugggguuccugggccccucucggcgcaccacaggaguccccagagaagcagggauauugguagggaugccugucaccuggugucccagguugggaguggagagggauaaagggaaagacggagaggagaaaggcgaaaaaacccagcauuuuaaaagaaaagggggagggagcgggugacacuucccucacguaaacccaguuucuaauuucgagugaagucagaauuuuugccucugcgcgcccgcgagcagacguuuuagccggaaccccuagcuccaaaugccgaaagggggggggggggaagaaagaaagacagacagacagacagacagacagacagacagacagaaagaaagaaagaaagaaagagagaacagcgaaagucaaggcuacuacagauuuggauaaucacgggcuucccaccccuccgucacaccacucgcugaucagccccuuucagugggguaugaaaaaaaaaaaacccacacacacacaacaggcugaggccaucccucccccaccccccgcacaagccguugguucuuuuuucaugccucccugacugucccaaaaguuaugcucugaggcucuggguuuuaaaauggguucccaagggacggcccucucucugaucccagcggacuaucggcaacuggagacgaucggcugucgccccaggauuuucagggucccgccgcuaagcacuggcagguagaagggggaucccucccccguccccgacucccagaggccgguaacgcacccacacccaaccaccaccacgggguguguccaccccgaagcucggcgggagaaacuccuuagaacuucaaggacuauagcagcuaaagagugacaccaagggcugacgugugggcucccaagccgaacgugcuuuacaggucagggcgaagugugugcgcccuucuccaaaugcaagaagggaacgucuuuagggagaaagaaaagaaugaaugaaaaaggggguauuaaugucagggagggagugaaaggggggacaugguuuuauuuucuuccugcuacuguaggcacccccaggaucucgcucaaacacaccagagugcacaggcacgugcccaguugccagcuuuuuuuuuuuuuuuuuuuuuuuuaaauccaagcucuucucuuccuuccacucucaggcagaaccaaaaguaaccaggagaaaaggggaaagaguggaacacgagcuucgaaagacaaaagugaaagaaccgagauccauguccacuaucuccagcgucuccccugugcuauucgggcgacauggaggggugggagcugcgcggguguuaaguuugucccacucgcauuucgcguggagagaaggaggaggaggagagggagggucgaucuccaagccuguggccgcaaggaugacugagucggcgccgcgcuuaccucgcagucuucguacuugauauuauccgucaguuuccaaagcauuuucauggaucggcgugaucggauuugccccucugcgccucgcaccccagcggagcuacucucuggguuagcgcaaagugcgggcugcgggcggugagcaaaagaggaggagggggggaggaggagaggagggcgaggaggaggagaaggguaggaagggggaggaggagguggagguagaggaggaggagggccaggagaagggcgaggagggaggaggagagaaggguuagagagcucccgugugcgcucggagaucucccucuaaugguagaaacuuuucccuuuuccugcuccucgcgaacagccuaaucgccucauuagcauaucaacaauaguccaauugcucgccaggaccacaaucugccgccggccgcuccgacccagguauaaaggccucuucuagccgcuaacuugcuccuagagcacuugccugcaugccagccugcaagcccaacaacucuuccuagagcuccagcacccucccuguucgagcguccccuauccccaauuucaucucuuuccccuucgccugucuucggguccugcuagccaaagaugcuuuggauaaagcucuguacuacgcaggguaccagcggcggcgccuagggaccaacuuuuaguaccccaccucccacucuuacuacaaccgccacuaucugccuuucguccccguccgauuuuauuagaaaucauuaucccuuucgcaaugaaccguagccaccaaaccaggaccagcaaagucacuccaagaauuuugcccaacuagagaucgccuccgcucacggcuguuacccccucgggcugcagcgcccugggaguuuuauuagcuuugcgcuccccccuccccccagguuggagauucugccagccggcuccgguggcucgguugggguuugcgaucucuuaauugcuacguguaaaauaaaaguuguacccugaagagguuacucgacagauccggggguuaaaugauuuuccuccgguuuguaugaagcugaaucggacugacuauucauccgggcguuuggacuguaagguuucccaggugcaacguggacaacaacacagaauucggauggggaugcacaaccccuucuggagugagccaaaccgcagacccaugagcuccugcgacucuccaugcggugucguacaugcaucaaaauaaaacauuaggaaccaacucuuccugugcaaaucggcuccaguuuucccaagauucuccuuuuuaauuaaagaaggacgcgacccuuuaugacuugauguuacuaacgccggcguuuuggcggcgcaauggccggcuggugaagaaccugaaggcaggagacaccccuuccccaaguuggccacuccugacuccgcccaggggcuuacucacuccaccgggacccuuccucccuuacugcaauuauucuaaaguaagauauuaaaaaaaaaaaaacacuaaagacuuuaaugugacacucugauauagagggauuucucuggcugaguuuucccacuagcacuuuaaaaaauauuuuuaucugucuuuguccugcuaauuguggaucaacgacagcagaucuccucagagaccucugguucaucugauucuuuuuucuuugguuuuucuuccuucuuuucuuucuucuuuccuucccccccccccaccccaaauguccaggccuccucgauuuccauagugaaucccucauggggaagaagacaucggcaaauccaaguguuugcuaacagguggaagaaaagcaagagaagagaacaccagccuccacucaaaacuguagaggugcaauucuccuuccugaagacccugucuaagcuagagucucuuccccgaaaagccagagacaagaccagagcugacaagugaauucaaagucucaaggcccuggguaaccccuagagaugccuuuccacauuuaaguagcacuuuggcugauagguguaggaacuuggcuucccacucugcccaggaaaaaaaaaaaaggucaauuucuaaguaaagcuccgcaagguuuuucccccaagcucaacugaccuguaaaaaggcuuaaaaccuagagcucagucucugggaggggccagcaccuccacuuuccccagaggcagccacagcccggugcccuaugaccuguaggcccgcuccaaggccucaaagcagggguuuuuacguccugcgggcucgccagggugcuugcggggaacucguaaguuucgcuuucuuuuccuucaguugugaccuagggggaaggcgcuuaagggguuauuugcucucuaacccgaccccccccccaauccccuccccuguccccgcagcucagugccggcggaucucuggcuccaaaucagcuaaaggcuacuaaacuguaguuauacuuccgccaagggcaccauugacguguagauugggccugccagcucugggcggccgcagucgcggccccgcagugugggcgcugaugaaaggcuggggagagcgggucgguuggguagccccugagccugggaagcacacgcuugccugagcuucauuaccacaacucgucucuugcagucaguucugcagcugggcaggggccgugguucccuuggauaggagccuagaguuagagcugaggauacaggccugaccuggggggaaugaacuauaccgaggcagggacaucgggaguaacaaagaaacaugggucggaaugaucuucuguucucugauugucaacauccaccgagaugagcgauacccaaguggccaagccugguagaucuguucccauaggucucaaaaccacuggcccucagccccagauccaggcccuacagccauuugccaacuguaggcucuccccgcagcaggcccugaccuccagccacaucucugucucuuuucuuuagucaccccuggcuuucaaaaccuagccugaaucccuagaggccuggucccaaccauagcccacucuaggcaguggguaccuucuccugccgauuucuuuagaauuuagcuauaacagcaucaggcuucagcacccacaaagaguuagguacccaggggguggggagagaagggcguaggcucuagcguuuguguuuggugugaaacuuucauccuuaaacaaagucaguuuaaguuugaggaaggaauaucauuuaacagguuuaacuagaggaagaguauaaaaguauucacucaacuaauaaaaguaauaaauauaaggggaaaacaaacagccaaagaucuucauuucuccaacuccagacaauguaaugaagaugacacucucagaacuuuacccugagcucucaggcaaacggcagaaaagcagcucaacuccagggccuugcccuggaaggagcaaagcuuccagcucuguuuuuugguguuuuucuuuuuuuguuuuccuuugggaagguagaagcucuugguucaaaaugccccuuaggccuguggcuuagagaauguagaucuaaccaggccuugguuggcucgggcaaaaaaagggaagaaaacagggcccugcgguuccuauuaugaaauccucaacuggggauuggcggcgugcuacuucaaccuagcuagagccgcccuuguuuccccgucagggcaaucuggaagcacguucccagggugggugcuggagucuguggaucuuuuaaggccagacccggcgccuacuccguuuugaggaguccacggucuaacagggucaccuuuggcagguucuaagaccgaaaauucgcugucuuuacucaccaccgcaauucuguagcccaacaaccgaaaaccuacccuaggaagccgauugagagaacagcuaaacuuuuggcaaacuuuaaaaagugucuuucacagagagagagagagagagagagagagagagagagaagaauaugcucccggcuauugucuggcuaucaggacgucuuuuuauuucauccuccaaggaagguccccgaaaugcaggauaccaaccggucaggugcaccaggucuaggggcgaaguugaagguacggccaucggggaacccauaccuccagcccggcgucccucccuacuucuuaauuagucauccacccaaguuucuguugggaugggggugggaaaauggcuggagaucaaaccacgagugacccgaggggccaccuguggcgccugagccggacucuuucccggauucuggccccgagggccgcgcucuuggcccccagcuccgaggcuguugccugcgcugguuuguccagucuucccucucuugggagcacucuugggcgcugccaggcgugccucaccgaggacuccccugcccugggccacgguacuucuucuccgccuccccacucccggcccccuccuccgcuccacccccgcccaccucagccccagccaaggcaaacccccguaccugccagucccccauuuuggcaaguauggacaucgcggcucggcgcuccuggcgacggguccccgccgggcaugggcuagagggcucagccgggcccgcucccuggaaucgcuu

SEQ ID NO: 7000 - RNA, 7357 nt, Mus musculus
ugcauuuuaacguccccgugcuuggauuugcugcuuaugucccuuggaucaggauaggguaggcauaacuucuagguuuuacuaauguguauaaaagccggaucaaggaccuuacccuaagucucccagacuuguacuuugugaguccauuugagaagcucuagguuuaaauuuaaccucuuucggaaaacagcgagaaaucaucccccacgccacuuucagcaguggaauuagaaucucccucgaucucacacaguuuacugucucggagaggagcuaccugaagggugacaaucgccugauuuauuugugucgguuggaaguggugacccaggcauuguugagcgagcuccaggaugcauuguucucaauuacuuuuuaauuucaaaacucgguuguuuaagugagucucacccucacccccaacuauuauugaggaaaaccaaggcccugagggccugggcuccacgaagcuucccagagggcaggugagccuagggcugcguucccucccgcggccugcaccgccucuuaccgggacguccucgauggcgugagguaaggaguggaucgggagguccccgagcccagagccgagcccgugcgggccgugcaagagguccucgugccgccgauagucccugcgaggguccaggcccgacaguuggugggguaagccccgguguguguguaagagcccagauuccuggcucugccucugaccgggccagcccgggugcugcggcugcggcugggcgugcagaggauucaggcuguaggggucguugacgugggaguaaggaucuugcgacuggggguagauaggcugguagggcggggggaaguagggaggcuggaagucggcauuaggggugugggacagcggcggggcgcugguguagggagauugaccuacagugcccagcuggggcaaccgugccgucccguugcuggugccgucgugacgguccuggaagaaagcaagacgggaaggggaagaagaaaugaggcgcagggcuucaacuacccuacuaaauccauuccacaagcccaauguggggaggccgccgaaguaggggguaucaacuacuacacuguucauauuggaaaacacccaagaagugaagcaggccuuuccaaaaaaaaaaaaaaaaaaaaaaagcaaagaaaucagaauauguaaauauaguggcacaguagacucucagggacauuccucucaaaggagggaaggagacguaaaagacuguguccuguaauacaacccuuaacagccgcaguaccaagccuuccuuaagcaaaauucagauagccacuaaauauuaaacaggagaagcggccuuugcuuuucccggauuugaaccuguccgccacugcauuauuguuuacucuucuauuaaucucgagguggggaaaaucauaaaccuucaaagacuauuaccauuucaugacuauuuaaguagaaacaugcuucacacggaggccuuaagaaagcgcacguuuaaaugacuagcuuaaagguuuuaacugcaugguuggggggggggucugucuuuuccgcuuccucuguuuguaggcuuuuuacacgacaggaucguuuuuaugauaugaauggggagugaaagacgccaagccaggguuuaaaauagaaagauucugccgcaccgaguucuuuuaaaaagaaagaggugcaccccggagcggaggcccccgccccuuccaccccagccccaaagggcaaaagaaacccccgacuuuagguuuuucaauugcaagcugcuugcaaagcaagccaagaguggcuuccagagagcgggaaccucucuccgagguuuagccgccaggccccaggcuaggggaacacaccgaggugcgccuuucacccccaccccaaaagacggauugaacaucagauauggagagcgucucuggagcaaguaaagacgcaaggaaauaaagacgaacccggcgagaaacuggcccaaggaaagagcugcgggguaggucugcgugcacggagagguccagcagggacagggcaguggcgacgcguuggauuuggggauggaaaggagccagagaaaaguggaaagggagauaggaaugcaaacggaaagcgagguccacaaggaacccuggccaagaagcucaggaucucgggcaguuucucggcugcggguuucuggaacagaauuccuaaggaaacaggguuggggguggggugggacucaccauagcugaaaaacugugaacuaacaucugcgaagagucugggguaaccagucagggugaggaaaaaaaaaaaaaaagccaacaacaauaaccaaagcaaaaaagcaaaaagcaaaaaaccaccacgccucgagcacccggcugccccgcggcccgaaagagccacacacaaaaggcgccgagagccccgcgccacccaggacuccagucaccgcgcggacgcugccgcgagcgccggagccccgcucggauccauccgaacuuguaccaccgagucgcgcggcgccuucagcuggucgaacccacgaucucuauccucccaggaucgguuaggauuucagagcucuuuaggaaaaacaaaaagcaaaaaccacaccaccaacaacaacaacaaaaaaaaaaaaaaaaaaaaaaaaaaaaaaaaaccaaaaaaaaaaaccaccaaaaaagaaaagaaagaaaaacgaaaaaagugugugugugugugugugugugugugugcgcgcgcgcgcguguuccuuaauccgugucucccccucuuuccuuagcggcggcuucacuucagcuucuaauaaccgcgcugggcagcguuccuggagccuccuaauagcagauauucaugacuauuaauauuacacgaauacuuaauaagggaagaaugccuggaaaucgagcgugaagcggagaggcaacucgcgccggagccggcucucaaugcagucauugacgggagucucaguguagcaaaucggagguggggagagggagcgcgagagacaaaaagcgagcgacggagggagcgggcgagcgugcggggggccgcggcgcggcgucuggcgaaucacagcaaaggggcaacauuuuaaaagguugcagggccugcaaaagugaaagagaaagaaggcgagagagggaggccgagggggucggagcaccgagagggaggaugugucugcgugcgugugcgagaaagaaagugugggcgacuagaagagagaggaguggagagagggagggaggaaggagggagcgcccgggaggaggaagggagggcaggagggagggaggaggagggggaggagggggccgagccggagcugcggagggggagcccgcggcgggguggggggggaggggagaggaagcgaaggaggacaaucggaccuaaaaggcuagggcagaccucgggauggagcgggggucgcgcgccgcgggcuggagcucccgggacccgcuggcggcugcccaccgaguucugcgccugggaggugcuucccgccgcucuccggccgcgggauucucuguugcgcagcggggccugggacucgggacucggcugcccgcugccucgcugauccuccauggcccggcgucccgccugggagcaacccgcccgcuucgcuaacccuuguccuccgccuggucgcgagccgccuucccuaggaccucggagccgugagcccgucggcugcggcuucuccgaucucgguugguccccggaccggguuccgggagcgggagccggagccggagccgggacgcggccccgggcgcgcacagacgcgaagcggcccagccugggcgccucuggcgaaggcuccuggcucccugcacaaacccgucggacuggcugggccacuccugccgacacccccuagaugacagagcuagcucuccccucgcgucgccacugcuagucggcccgccugguugucggaacaagcggcaccucgccucuugcgugucccugcagagucucagccaaaucagacaacucuaagcccgcucgggaacccgaaaucuccgcuccagagcuggcuaucccgcugauaccaaaguuguugagauugcccagacuuuuuuuuuuucuucuucuucucucccaucccggucucaucacaccccucuccaaccccucucucaugcgccuucagagucccucugggggguucaaguucaucucgcgcccuacccucgaguuuccuuugguguguugagccacacuaagauucuuaacgcuuccacucagggcgcuuguaccccgaacugauuucgggguuccaagaaagugaaaaaaccaucagcuagagaagggagcccagaucccuaagggggaaaaacugcucuuaaagagucacaguagaaccuagcccugccggcaaaagucacccuuagucuagaaaacaaagcugucugguccuacaugggguuccugggccccucucggcgcaccacaggaguccccagagaagcagggauauugguagggaugccugucaccuggugucccagguugggaguggagagggauaaagggaaagacggagaggagaaaggcgaaaaaacccagcauuuuaaaagaaaagggggagggagcgggugacacuucccucacguaaacccaguuucuaauuucgagugaagucagaauuuuugccucugcgcgcccgcgagcagacguuuuagccggaaccccuagcuccaaaugccgaaagggggggggggggaagaaagaaagacagacagacagacagacagacagacagacagacagaaagaaagaaagaaagaaagagagaacagcgaaagucaaggcuacuacagauuuggauaaucacgggcuucccaccccuccgucacaccacucgcugaucagccccuuucagugggguaugaaaaaaaaaaaacccacacacacacaacaggcugaggccaucccucccccaccccccgcacaagccguugguucuuuuuucaugccucccugacugucccaaaaguuaugcucugaggcucuggguuuuaaaauggguucccaagggacggcccucucucugaucccagcggacuaucggcaacuggagacgaucggcugucgccccaggauuuucagggucccgccgcuaagcacuggcagguagaagggggaucccucccccguccccgacucccagaggccgguaacgcacccacacccaaccaccaccacgggguguguccaccccgaagcucggcgggagaaacuccuuagaacuucaaggacuauagcagcuaaagagugacaccaagggcugacgugugggcucccaagccgaacgugcuuuacaggucagggcgaagugugugcgcccuucuccaaaugcaagaagggaacgucuuuagggagaaagaaaagaaugaaugaaaaaggggguauuaaugucagggagggagugaaaggggggacaugguuuuauuuucuuccugcuacuguaggcacccccaggaucucgcucaaacacaccagagugcacaggcacgugcccaguugccagcuuuuuuuuuuuuuuuuuuuuuuuuaaauccaagcucuucucuuccuuccacucucaggcagaaccaaaaguaaccaggagaaaaggggaaagaguggaacacgagcuucgaaagacaaaagugaaagaaccgagauccauguccacuaucuccagcgucuccccugugcuauucgggcgacauggaggggugggagcugcgcggguguuaaguuugucccacucgcauuucgcguggagagaaggaggaggaggagagggagggucgaucuccaagccuguggccgcaaggaugacugagucggcgccgcgcuuaccucgcagucuucguacuugauauuauccgucaguuuccaaagcauuuucauggaucggcgugaucggauuugccccucugcgccucgcaccccagcggagcuacucucuggguuagcgcaaagugcgggcugcgggcggugagcaaaagaggaggagggggggaggaggagaggagggcgaggaggaggagaaggguaggaagggggaggaggagguggagguagaggaggaggagggccaggagaagggcgaggagggaggaggagagaaggguuagagagcucccgugugcgcucggagaucucccucuaaugguagaaacuuuucccuuuuccugcuccucgcgaacagccuaaucgccucauuagcauaucaacaauaguccaauugcucgccaggaccacaaucugccgccggccgcuccgacccagguauaaaggccucuucuagccgcuaacuugcuccuagagcacuugccugcaugccagccugcaagcccaacaacucuuccuagagcuccagcacccucccuguucgagcguccccuauccccaauuucaucucuuuccccuucgccugucuucggguccugcuagccaaagaugcuuuggauaaagcucuguacuacgcaggguaccagcggcggcgccuagggaccaacuuuuaguaccccaccucccacucuuacuacaaccgccacuaucugccuuucguccccguccgauuuuauuagaaaucauuaucccuuucgcaaugaaccguagccaccaaaccaggaccagcaaagucacuccaagaauuuugcccaacuagagaucgccuccgcucacggcuguuacccccucgggcugcagcgcccugggaguuuuauuagcuuugcgcuccccccuccccccagguuggagauucugccagccggcuccgguggcucgguugggguuugcgaucucuuaauugcuacguguaaaauaaaaguuguacccugaagagguuacucgacagauccggggguuaaaugauuuuccuccgguuuguaugaagcugaaucggacugacuauucauccgggcguuuggacuguaagguuucccaggugcaacguggacaacaacacagaauucggauggggaugcacaaccccuucuggagugagccaaaccgcagacccaugagcuccugcgacucuccaugcggugucguacaugcaucaaaauaaaacauuaggaaccaacucuuccugugcaaaucggcuccaguuuucccaagauucuccuuuuuaauuaaagaaggacgcgacccuuuaugacuugauguuacuaacgccggcguuuuggcggcgcaauggccggcuggugaagaaccugaaggcaggagacaccccuuccccaaguuggccacuccugacuccgcccaggggcuuacucacuccaccgggacccuuccucccuuacugcaauuauucuaaaguaagauauuaaaaaaaaaaaaacacua

SEQ ID NO: 7001 - RNA, 7357 nt, Mus musculus
uaguguuuuuuuuuuuuuaauaucuuacuuuagaauaauugcaguaagggaggaagggucccgguggagugaguaagccccugggcggagucaggaguggccaacuuggggaaggggugucuccugccuucagguucuucaccagccggccauugcgccgccaaaacgccggcguuaguaacaucaagucauaaagggucgcguccuucuuuaauuaaaaaggagaaucuugggaaaacuggagccgauuugcacaggaagaguugguuccuaauguuuuauuuugaugcauguacgacaccgcauggagagucgcaggagcucaugggucugcgguuuggcucacuccagaagggguugugcauccccauccgaauucuguguuguuguccacguugcaccugggaaaccuuacaguccaaacgcccggaugaauagucaguccgauucagcuucauacaaaccggaggaaaaucauuuaacccccggaucugucgaguaaccucuucaggguacaacuuuuauuuuacacguagcaauuaagagaucgcaaaccccaaccgagccaccggagccggcuggcagaaucuccaaccuggggggaggggggagcgcaaagcuaauaaaacucccagggcgcugcagcccgaggggguaacagccgugagcggaggcgaucucuaguugggcaaaauucuuggagugacuuugcugguccugguuugguggcuacgguucauugcgaaagggauaaugauuucuaauaaaaucggacggggacgaaaggcagauaguggcgguuguaguaagagugggaggugggguacuaaaaguuggucccuaggcgccgccgcugguacccugcguaguacagagcuuuauccaaagcaucuuuggcuagcaggacccgaagacaggcgaaggggaaagagaugaaauuggggauaggggacgcucgaacagggagggugcuggagcucuaggaagaguuguugggcuugcaggcuggcaugcaggcaagugcucuaggagcaaguuagcggcuagaagaggccuuuauaccugggucggagcggccggcggcagauugugguccuggcgagcaauuggacuauuguugauaugcuaaugaggcgauuaggcuguucgcgaggagcaggaaaagggaaaaguuucuaccauuagagggagaucuccgagcgcacacgggagcucucuaacccuucucuccuccucccuccucgcccuucuccuggcccuccuccuccucuaccuccaccuccuccucccccuuccuacccuucuccuccuccucgcccuccucuccuccucccccccuccuccucuuuugcucaccgcccgcagcccgcacuuugcgcuaacccagagaguagcuccgcuggggugcgaggcgcagaggggcaaauccgaucacgccgauccaugaaaaugcuuuggaaacugacggauaauaucaaguacgaagacugcgagguaagcgcggcgccgacucagucauccuugcggccacaggcuuggagaucgacccucccucuccuccuccuccuucucuccacgcgaaaugcgagugggacaaacuuaacacccgcgcagcucccaccccuccaugucgcccgaauagcacaggggagacgcuggagauaguggacauggaucucgguucuuucacuuuugucuuucgaagcucguguuccacucuuuccccuuuucuccugguuacuuuugguucugccugagaguggaaggaagagaagagcuuggauuuaaaaaaaaaaaaaaaaaaaaaaaagcuggcaacugggcacgugccugugcacucugguguguuugagcgagauccugggggugccuacaguagcaggaagaaaauaaaaccauguccccccuuucacucccucccugacauuaauacccccuuuuucauucauucuuuucuuucucccuaaagacguucccuucuugcauuuggagaagggcgcacacacuucgcccugaccuguaaagcacguucggcuugggagcccacacgucagcccuuggugucacucuuuagcugcuauaguccuugaaguucuaaggaguuucucccgccgagcuucgggguggacacaccccgugguggugguugggugugggugcguuaccggccucugggagucggggacgggggagggaucccccuucuaccugccagugcuuagcggcgggacccugaaaauccuggggcgacagccgaucgucuccaguugccgauaguccgcugggaucagagagagggccgucccuugggaacccauuuuaaaacccagagccucagagcauaacuuuugggacagucagggaggcaugaaaaaagaaccaacggcuugugcggggggugggggagggauggccucagccuguuguguguguguggguuuuuuuuuuuucauaccccacugaaaggggcugaucagcgaguggugugacggaggggugggaagcccgugauuauccaaaucuguaguagccuugacuuucgcuguucucucuuucuuucuuucuuucuuucugucugucugucugucugucugucugucugucugucuuucuuucuucccccccccccccuuucggcauuuggagcuagggguuccggcuaaaacgucugcucgcgggcgcgcagaggcaaaaauucugacuucacucgaaauuagaaacuggguuuacgugagggaagugucacccgcucccucccccuuuucuuuuaaaaugcuggguuuuuucgccuuucuccucuccgucuuucccuuuaucccucuccacucccaaccugggacaccaggugacaggcaucccuaccaauaucccugcuucucuggggacuccuguggugcgccgagaggggcccaggaaccccauguaggaccagacagcuuuguuuucuagacuaagggugacuuuugccggcagggcuagguucuacugugacucuuuaagagcaguuuuucccccuuagggaucugggcucccuucucuagcugaugguuuuuucacuuucuuggaaccccgaaaucaguucgggguacaagcgcccugaguggaagcguuaagaaucuuaguguggcucaacacaccaaaggaaacucgaggguagggcgcgagaugaacuugaaccccccagagggacucugaaggcgcaugagagagggguuggagaggggugugaugagaccgggaugggagagaagaagaagaaaaaaaaaaagucugggcaaucucaacaacuuugguaucagcgggauagccagcucuggagcggagauuucggguucccgagcgggcuuagaguugucugauuuggcugagacucugcagggacacgcaagaggcgaggugccgcuuguuccgacaaccaggcgggccgacuagcaguggcgacgcgaggggagagcuagcucugucaucuagggggugucggcaggaguggcccagccaguccgacggguuugugcagggagccaggagccuucgccagaggcgcccaggcugggccgcuucgcgucugugcgcgcccggggccgcgucccggcuccggcuccggcucccgcucccggaacccgguccggggaccaaccgagaucggagaagccgcagccgacgggcucacggcuccgagguccuagggaaggcggcucgcgaccaggcggaggacaaggguuagcgaagcgggcggguugcucccaggcgggacgccgggccauggaggaucagcgaggcagcgggcagccgagucccgagucccaggccccgcugcgcaacagagaaucccgcggccggagagcggcgggaagcaccucccaggcgcagaacucggugggcagccgccagcgggucccgggagcuccagcccgcggcgcgcgacccccgcuccaucccgaggucugcccuagccuuuuagguccgauuguccuccuucgcuuccucuccccuccccccccaccccgccgcgggcucccccuccgcagcuccggcucggcccccuccucccccuccuccucccucccuccugcccucccuuccuccucccgggcgcucccuccuuccucccucccucucuccacuccucucucuucuagucgcccacacuuucuuucucgcacacgcacgcagacacauccucccucucggugcuccgacccccucggccucccucucucgccuucuuucucuuucacuuuugcaggcccugcaaccuuuuaaaauguugccccuuugcugugauucgccagacgccgcgccgcggccccccgcacgcucgcccgcucccuccgucgcucgcuuuuugucucucgcgcucccucuccccaccuccgauuugcuacacugagacucccgucaaugacugcauugagagccggcuccggcgcgaguugccucuccgcuucacgcucgauuuccaggcauucuucccuuauuaaguauucguguaauauuaauagucaugaauaucugcuauuaggaggcuccaggaacgcugcccagcgcgguuauuagaagcugaagugaagccgccgcuaaggaaagagggggagacacggauuaaggaacacgcgcgcgcgcgcacacacacacacacacacacacacacacuuuuuucguuuuucuuucuuuucuuuuuuggugguuuuuuuuuuugguuuuuuuuuuuuuuuuuuuuuuuuuuuuuuuuuguuguuguuguugguggugugguuuuugcuuuuuguuuuuccuaaagagcucugaaauccuaaccgauccugggaggauagagaucguggguucgaccagcugaaggcgccgcgcgacucggugguacaaguucggauggauccgagcggggcuccggcgcucgcggcagcguccgcgcggugacuggaguccuggguggcgcggggcucucggcgccuuuuguguguggcucuuucgggccgcggggcagccgggugcucgaggcguggugguuuuuugcuuuuugcuuuuuugcuuugguuauuguuguuggcuuuuuuuuuuuuuuuccucacccugacugguuaccccagacucuucgcagauguuaguucacaguuuuucagcuauggugagucccaccccacccccaacccuguuuccuuaggaauucuguuccagaaacccgcagccgagaaacugcccgagauccugagcuucuuggccaggguuccuuguggaccucgcuuuccguuugcauuccuaucucccuuuccacuuuucucuggcuccuuuccauccccaaauccaacgcgucgccacugcccugucccugcuggaccucuccgugcacgcagaccuaccccgcagcucuuuccuugggccaguuucucgccggguucgucuuuauuuccuugcgucuuuacuugcuccagagacgcucuccauaucugauguucaauccgucuuuuggggugggggugaaaggcgcaccucgguguguuccccuagccuggggccuggcggcuaaaccucggagagagguucccgcucucuggaagccacucuuggcuugcuuugcaagcagcuugcaauugaaaaaccuaaagucggggguuucuuuugcccuuuggggcugggguggaaggggcgggggccuccgcuccggggugcaccucuuucuuuuuaaaagaacucggugcggcagaaucuuucuauuuuaaacccuggcuuggcgucuuucacuccccauucauaucauaaaaacgauccugucguguaaaaagccuacaaacagaggaagcggaaaagacagaccccccccccaaccaugcaguuaaaaccuuuaagcuagucauuuaaacgugcgcuuucuuaaggccuccgugugaagcauguuucuacuuaaauagucaugaaaugguaauagucuuugaagguuuaugauuuuccccaccucgagauuaauagaagaguaaacaauaaugcaguggcggacagguucaaauccgggaaaagcaaaggccgcuucuccuguuuaauauuuaguggcuaucugaauuuugcuuaaggaaggcuugguacugcggcuguuaaggguuguauuacaggacacagucuuuuacgucuccuucccuccuuugagaggaaugucccugagagucuacugugccacuauauuuacauauucugauuucuuugcuuuuuuuuuuuuuuuuuuuuuuuggaaaggccugcuucacuucuuggguguuuuccaauaugaacaguguaguaguugauacccccuacuucggcggccuccccacauugggcuuguggaauggauuuaguaggguaguugaagcccugcgccucauuucuucuuccccuucccgucuugcuuucuuccaggaccgucacgacggcaccagcaacgggacggcacgguugccccagcugggcacuguaggucaaucucccuacaccagcgccccgccgcugucccacaccccuaaugccgacuuccagccucccuacuuccccccgcccuaccagccuaucuacccccagucgcaagauccuuacucccacgucaacgaccccuacagccugaauccucugcacgcccagccgcagccgcagcacccgggcuggcccggucagaggcagagccaggaaucugggcucuuacacacacaccggggcuuaccccaccaacugucgggccuggacccucgcagggacuaucggcggcacgaggaccucuugcacggcccgcacgggcucggcucugggcucggggaccucccgauccacuccuuaccucacgccaucgaggacgucccgguaagaggcggugcaggccgcgggagggaacgcagcccuaggcucaccugcccucugggaagcuucguggagcccaggcccucagggccuugguuuuccucaauaauaguugggggugagggugagacucacuuaaacaaccgaguuuugaaauuaaaaaguaauugagaacaaugcauccuggagcucgcucaacaaugccugggucaccacuuccaaccgacacaaauaaaucaggcgauugucacccuucagguagcuccucuccgagacaguaaacugugugagaucgagggagauucuaauuccacugcugaaaguggcgugggggaugauuucucgcuguuuuccgaaagagguuaaauuuaaaccuagagcuucucaaauggacucacaaaguacaagucugggagacuuaggguaagguccuugauccggcuuuuauacacauuaguaaaaccuagaaguuaugccuacccuauccugauccaagggacauaagcagcaaauccaagcacggggacguuaaaaugca

SEQ ID NO: 7002 - RNA, 28954 nt, Mus musculus
ccccaggccucgcccgccagcgcuccucgaugucuccccggcggggaggacgcugccugcgacacccgccgagcggcgccccccggagcgccccgcugccgccccgcggggacgaugagggcggagggcgccgaccacucgaugaucaaccugucggugcagcagguccugagccucugggcccauggcacggugcugaggaaccucacggguaaugcgccgggcggagggagcggugggggacccacuccacggguguucggggcguccgcaaacccggcccggugcgggccgcuggagcacgcgcgagucgcgccagugccccgacuggaucacaguucauguuucugucauuaacccccccccccccccccgccuuuccccgugcgcgcgcgcacgcacauacaccgcuucuugcaguuucgaucuuuuuuagucuuucuuuccugguuuagcccuuuuucuugcugacagaugucaaaccaauugcaguacuccuauugccugcucaccgugaucacgguggaccgaccguucguuccuuuauuuguugagagagagagagagauaugacuaaguagauaauagcggggucaggggcuggaccaaggucuagagcagucgaaacaguugucuucucugcuauuuccuuuugucuggcugucuccuggcuucaaguugcuguauuugugaaauuggagaauucuguguauuucccuucauuaaucaaugugauugggaaugggguuuagcuacguuauagcaucagguugucagaguaagcauuaguacacauaauaugauuucauaugcagguuugcuugugaagaaacuucugguuuucucaguguggaagugcuuaaacucuuuugaguuccgaguuuuaaaaauagcgucuaaagaguaauauugacuggaaagcaguagggucaacaguuugacuccggaguagcugcuuuugugaaaccacaaccaaaaccccaaacaaaaacucaguucuuuaaaaugucuuaacuccaauugaacguuacuauuucaaaaucugugugauagcaaauuaauaguauguaguauacuuauaggcaaaaucuggcaugauacaggguucauauguucaaggagaaaaauauaacggcauugcguaccacccagauaaauuuucagguugcuuaauuccuuacuuaugaaaaccacaccaguaaaggagacccuggagccagcagaggcgucuucuuaguugcauuuuuauaguucugaaaaguuaaauuuacauaaagaucaucucaagauagaucccuuuauuuuacuuaugaccuuguucguauuugcccacagauucacauuuauaaagcaugaauuguuuauuaaaguacaaugauuaaaaacuuagugauauauauugccuguauuaaugaccagcuuggcucacugaagcuguuucguauguagcuugauagucaagagaugcugucugcugugccauguacugcuuagccuguacugcuuagccuguccaaaauaagcaagcaaauucagcuccuaagaggagacaauaagcucaccauuuacugaguauuacuccaacucugcaaagcauauacacaaagcaauucaggcaaauuaaacugcccuaagccagauagugagcaagugggccuuccgaaccagucugccuccgagugucuucccguuaccacuguacagcucuucauucagcuuugcccucugcuccaucagacagggugaauuucuugcuucauccugcuacuucugcucuuuguaccuacuucuguuuuuaaucacauuauaauuuuuaucucuuuuagcuugaauguguuuugagaguaaggucuuugucuugcuaaauuaugaguccuagcauaaucuggcacauaauaagugcugaauccauguuuauuaaagugagguugugaaauaauaccuaaugcaggauuuaaaccugaugcuguguuguaguucacuggaguaaacgugcccuuaaaguacaaugggguguugaagcaacuuuuguacacaaucaucucccagacuuggaaggcaggcacgugcccacugaaugcauuuguauucugugcugaauuuugguuuccauuuuucuuuauuugauauuuucaacaguuuuugagagcuuguuuauauucacuuuacagacauugaagcagagagcaagcuuauguuugguagcuaacaugaaaaaaaucuuuacauuuucuguuaauucagaagacauuuggcaucauagcaaacuugcaaguaaaacagauacuaaaaagaagcauaguauaaaacaaggcaggcuaucuuggauuauagcugaaggaauuacagaagucuagguauuaggaaccuggguuaaauaccaaaucaaagggaaauaaacucuugcuucuguucuuuguacacacgagcaagugugauauuauucuuuucuuaggauuuuaccuaaaaagcagggggucuaccuuuggaaaacagucuuauguaugugcuccuuugauaggaauaaauguaaacagaggagaacuggaagcaguaaccuagagcaggcacuagagucucugugucacucuuagcagccuguggugagcgauguugaucagaggcagggccagagccugucccuguccccacccucaguuccacgcccauccuuucugccccacauagcuacuuaaggcagacaggucugagagguaguaagucuuaugauacuuaagauuagccuggcacauaucugucccagccugaggauauguaaagguauccccaguagcugggccccauacauuccaauauaucccuccaucucucucucucucuuccccccccuuccccccuaaccccaggacugccugaaacuacagauagcaucuaguccugauuacacacacaccuaugauaggguuuaguuucuauuagaugcaguaagaugcuuaacaauaucacaauaaagccaaaauguuuuuaacucugcaguguaauaaaauucccuguaucacaacuguugcacucuggugcuauuaaguaaguaaaugggcuauuugaacacaaguaucacacugcuaucugauagcuaacaaucuaucugauaagugagaugaauccguauacccuugacagaaaugauucuugcuuugagugagacagagucgaacagcauaagaugucugaauggccagcaaguuaaaauguaugaguuguuuguuccuagaauuuuccauuuacuauuucuuaagugguugaugaagcagguagccaaagccacagaaacuggaaucuugaaugaugguuggcuaauugguccaguaaauaaaagaugcuagaaaaugugagauacuauugagaaaacaaugcuuucuaaccuuuugaguggcuaucauucuguaaaagcuaccgacccauguucacuguauuuccugucuuaggaauccucucagacaugaucagcuguuugauagcucucuguuuuagagacacuuacaaggagucugagaacagccauucucagauccugugucugccacuagaagacggcuguccacaguuucugugugucuaccccuuuuacugggguguaaguuuuaggauccuucauuuguuuagcccugaauagguuauaggccuuuuuagccuacuagagagaugaaugguuuccuuucuucauucacaaauaccuuuuucuaugacuguauucuaaauucccaccccucacucugaagugggaguccauacuaugucuaacuuuucagcuuuguaaguugauuuuuuaaaaauuacuaauuauuagcuguaucuuuuuguuuuauuuuguuuuucuuaacugauuuggcucccaauuuguauucugauccaaauuugguuacuaaggauuuagagaagaauuuuuccuucagaaaaggcagauccuuaaacugcugggcaaauauaacaggguuagucuuggaaagggauauuaggcccuggaagaaaaguggguacugucuuaaguuguccacuuucuauuugacagcagaaaauguggggcaagcccaccccucuuuuucuuuauugguaauaaguguugagagucugggguccaauauaugaugaaagauauauaccauucauuuuacauauguauauguauguauguacaguuguuccucaaauuaugaugguuauagucugauaaacucauuguaaauuuuuuuaaauuaugaacagaaaagguacuuauacagcuauuuaccaagaccaacacuuagccugaccugucuuaaaugaucugcuguagcccugguugaccagaagucuucuuguugaucaagcacacagugcagaacugaaugguuguguaggcauaggcuuacaacauugcaaagcugaaaauggauaagucaaacuacuuguaauuuggagucucuauuucucuauguuuuuuacuuuuagaauauucauguacauauuauuauaguuuauguuuggagcuuuauaguugauauaaacuguuuuugcagucagccaaaaagggaggaaugguucacugaccacuggcuggugguucaguuggugccuuccccgucguuguuuucagauagcugugccucccuugguguggcuguguucaccacuagauucccauaccuuaugaaggcggccguauguagagagcagucucagaaauccacugaugucacucauccagcaacugcagcauuaaucagacacuaugcuuuuuugguauuugugccauauaccacaauugacuauuauugaaacaugcgauuggcauuucuuauucuuguuuuauagcauagauugcagacagaguugaauuuuguaucaugcaucauucuagaaggcccacugugugucuggcggaacacuuuguaagcuuugaaaacuuagucuuacugccauuggcucucacuccauuuccacuccauuauuuuggaaguguacauaagcccccauucuggaguauugaggauucauuuuaagauuauguaggcuauuccuuuugacucuuuaauaauuaacuacacaauaugacuucuuuuauuucugcuuucuuuaguaacuaagacagugagauaaucauggagacaggucagagguguugugugucuggcaacuguuuuggaaauggaaaaggaagggacaucggguccauggaaggaagccagaauaaaagugaucagaugugagaagcaagcccugagaguugagcacugacccagaggaaaaauccuaaacauggcuacucaacaucucugugugccugaaaugaagagaacauuucacauaugucucacuguaauuagugucuaaauaauuuauuauauuguguaugauuauauaaggugugauaggcuacuuggauauuuuaaugaccuaguauuuaagcaauaacauuuaauuguagacuacauaguggugccaucaacacauggaagaaauaccauuaaauuaucaauuucauuuggugaccuugaacuaaguagacuaagcuuaaggaaacuuuucucucaacuugauggaaguaggaaaagccagauuuaacccaagucuaaaugccuaugcuauaauauaaacuguagaauguaaccuaggggcacauaaugacguccuacgggacuuaaagaagguggaguguaccuuuggggggucgggguggggggacugugcagacacgaucagcuuacuaccaugcucuguccuugcccuuccuuugaggugugugcuguguacuugagaauacauugauuuuuuucauaauucaccauagcuuauauuauccuuauauaaaacaauuuguguuuagcauuuuaguuuuaaggaugggcacauguccaugcuaaaaacuuuauuuguaggacauaacauuuuccuaaacauuuucagugagcaggacauggcucuaagaagauuucaugugguuuuaguugauucucacaagauuccauguaguaggcuccauuaacuccaucuuuaaaccaagggcacagucauggagacauuuugccccugcuuacagagcaugcagaucaggacuugaggcgucauugcuguccagcaaauguugaguaacuaccuggacgcagagcugugguaaacacagaggugacuagaauguggugaccacccuugcaggccucuuugcagugaguauuagcuuacaaauuugagcuauuugccaaugcugacuuacaguuacucucaaauuucauagcucagaauaaggggcauaucacaggucagcugcucaggaggaauacuggguuggaugcuccaguccaucugucagcugggccugugaucucugcagauugcccugggaccagagacacaguuuccacaagcauauugaugcaguagguggcaggagggcuuccauggaacuggucacuguuguuuuccccacaaaaggugggagggcuuagaccaaaagagaagccgcagaguccauugaccccaaucugcaaguguuauuguauagucagguuguauuccauugccacaugggccagcuccugucuaguauggaacuggaaaacaaaagcagguuugccuggcacaguugggccugcuuggucgccagcuugaacacuuaaauagguguggggaaagggaaagaagccuucagagggagcaauggugucagcgcagagggcacgggcaugccaucuuagagaaagagaagcugacaagagagaagguugcuugacauguagagucccauagaguagcugugugaagucccuucaagagcugagauccccaggcuggccauugguacauacugcuaaacagacaaaaugaucauggaggacuggacacuuucagaagagcuucuuuauggcuuguugacuuuggagggagggggacugugaaauaacugaagaguggggaaugaccuuguaugcugguaggaagugagcagagagcgguugcuuguagaauguuccaggcauacuuugcuaacaggagugaugcccuuagaugugugugccaagcaaagguugguuguuuuguuuuguuuuuaagcaguaauagaaaaugagguuucuaccuuagauucucuuaucccucugcugugcacaacuucaggcugauguaguuuuaaaccugcugcuuaugggaaccacuggggcugguuguacuggggaggucccaguccuauauauaaaguaugggucuucaaggaguuuaaaccagcucucagguaauucugccauugcaugcucagcaaaugagaaugugugcuuaaaaacuaagaagucucgggaugagguuuagugaugcuguagcgugugauauauguuuacacggcauaucuagggugacagcagacaggaucucuauaugaacagcucacuuucaaaggcaaaggaugauuggcuuuaucauaauuuauauugaaauauuuuguuuacauaaucauuagccauaaagaaugaucccuauuaauguaauaagaaauuuaaguaguuuuauuaaauccaaaguauauagaagaauuaaauauuuaaaguguguguaaauacauaagauguaaguuacugaagugucccugacacuaagcuuauguggcucuucuagguuuaugucuauauauagagucuaaagaaacaaaagaauuugugucaggaaaaauuugguugcugcugucuuguucagcugucucacucuguuuuuuuuuucuuuucucuuuagauuuguuuguuuuaaaaugugugaguuuugccugcauguguguauguguaccacacgugugcccagugucuaggggaggucagaagagagcauuggauccccaggaacuggaguuacagaugguugugagccaccauguugguguuggggagcaaaccuggguccucugcaagagcaacaagugcucuuaaccacuuaacugucucuccagccacaagcugucuuacuuuaggcaagcuuguaucacccaaaccuugcuuucuuuaccuguagcacuuaacuagugucaauuuugaucuaggcaugcaccaccaugccuuuaaucucagcagagucaagccaaucucugugaguucaaggccagcuucaucuacauagugaauuccaagcuaaccagugcuauguagagagacauugucugauaaaagaaaacaagauuaauaauaauaauaacaauaauaauagauauuaagggaaaacugacagaaauuuuaaagaguuaaggaaaguucagaaaacauuuuuaaauuuauuuauuuuuauuuuaugugcauugguguuuuuccugcauguuugucuauaugagggugucagaucuuagaauuacagacaauucugagcugucacauggugcugggaauugaaccugucuccucuggaagaguggucaauguucuuaaccacugagccaucucucuagcuccagaaauucuuaugaggauuccagaaaacaaauuuuccuuuguauguaaaugucucauuaaucuuuggauucucuucuuuucaagcagcccuucuucagcccuuuagugcacuuguaggauaagagcuguuugaugacugcuuccuagcccuuggacauucuuucaguucugaaaugacuguuguuuguuguuguuuugcuuuguuuuugcuuuaacuaaugugguuuguucaacuucucauagcguucccuuuuaacacuaagaguuuccaccuaggucuuaacaccccugcuugguggauuugugacugugccaucugggucagaguuauguugauuugcuguauuucuuauugguggguuucccugguuuuaguguaucuccguuuuuauuguuggaugcaagauagaauaagacagagaaucuucacucuuggaaaagaccagcagugauccaggcuugguugggcuggacuugaguuuagcuguugcugugguuacccuugcuguaccaaaugcuucacacucucuggagguugcugcuauuguguauagugcuugagaugggaccugggaagccucgaguuagugcuccauugucagccuucagucaucucugcgugccugcaugcaguaggguccccucgugugcaugccugcugcugagcuuuugcuagugacagcgcuaggcuuacuguggggauucccugccuuugugagcucugcuggccaagcuugacuuuugucugcgcuugguccuggguaggaguuuccaugccuucaguaggaauggaccccugcuugggguagaacucuugguuuguggacagucuucuccuuccauccuuccccauacugaauuaacaguauauuucuguuugucucuggaggguaucgagguuugcgggccuccccaguggcugaagguguuugcucuauguaaaaggaucccuagaggcaggcucuucgcuccuccugucuggccuacuuacauccacagguggcuuuucuaaucugccaccacccagucuuccuagagcacaccaaggagacaaugugugucucucgcaaugucguuuuacugaggacagcacucugguuuuucuuacucacuuauguggugcccagccauggggguagggugucuuuugacuuuauugccuaauaccuuccucaugaacugaggagaaguuuugauuuucuauaucuguuaaggaggagugaugauuuuguaguuuucuauauccuaaauucugauucacauuuacuguuugaguaaacaguuuuuuaaguaugacaaaacagaugccacauuuaggugguaguuuaacauauaaacucaagguauaggucauauuaacuugauggauuugacauuuuccuguguuuccuuucuuuaguuuucaucucucacuagcauuuggcuaaguguuguagauagaccaaacaugcuuuuucauggguguaaaccauuuacucuuaucuaucuacggauccuuucuagaaacccggauggccagauaggacaucucuauuguccccuuauccaggcuagaccagugguccuccuaaauaugucucaaguucuuuccauuuaagguuaguauccaaguccaggacuccugacaguauugcaauugcucaucugcuccagucucaguuuccuguaaauaucagagaaauguuuuuaaaaguuaaauuugguuauauaacuuuuguauuuaaaaucugaaguaaguccaagcuauggcagggucauugcaaucaugagcacaguaggagcuguggcuauauacacacaaacacacacacgugcacacacacacaguggggaaggaggaagggagggagaggcguaugacaauaguagggacugguuaggaagaagggcagucagaagaagggggagaugacagagguaaugagagugcaaauuaucauaauaucguguauacauacaugaaauuguccagaguuuaaaaaugaaagacuucuuugguuggcugccccaaaccuuccaccuucacccuaaaguguaucuagaaucccuaccugcuuuggcuccaacuuaccauaucucccaacagcuuuuggcuucggucagaucagaguuuuucaaucacauacaguugugugauuugaacaucgagucuuagagaugaugcucuacuguacgugaaaaucaccugggaaacauuagaaaaaucccagugcccagugugugauugccauguacaaggcacaagacccuagauuuagaccccagcccugaaugacaguaguggaaugcuauuauccucuaaagcugugguucucaaccuuccuaauguuuccuuuaacuguuaacacaguccccuauguuguagugacucccaaccauaacauuugguuuuguugcuacuucauaacuguaauuuugcuacuguuauaaaucauaauauagauaucuguuuucuaauacucuuaggcaaccccugugaaaggguuguucgacccccaccccaaggaaucuugacccagguguugaaaacugcuacucuaaaucaaaaauucuuauccauaaguuauucuccaucaacaaaaugagucaauucaagccgaauuaaaguauauagaggcagguuuauugggggacagcucuuggccagguucacugaucccaaggaaguaggccugggaaauugcugcggaagaaggaagagaaaaaagagcaugcauaggcagggagagagagacuguagggagggggagagaaggagagagcagaaugucuggguuguacagggaagggcuucucagggagaggaaacccagccccuggcguggaacgcagggcagagguauggugugccagccgugcaguguaacuggcaggaacugaaggaugcugggagaaccuggaggccaggccugcuuuguacguaaaauaugcaccuuagccaaguuugucccaggccugaauccagcacuuauauucuguaaguagugaauucacuaaagguauuuggcuugguggcccuucuuaucuguguuacaacuauucugucuaccauaguaguaugauagcauccauggauggucugagcauacuagcugguauucauguagaauuuguuaugaaauuuugcuuuuuauauauuuaaaaaucuucuuuaacuguacaaucauuuuuagccagagauuguucagaaacaaugcagagcagacaugacuccuaggcuguauguauuuauuggcccaaaucuagggggccuuaccaaauuaugaauguaauguaucccauaacucaaucaauacaggaucagaaguuucugcuguuagcaauguagugggagcaaauucuguauauuucgguucucuggaaugaaaaaaaaaaaaaaaccaacucuacagucacguuuuuuuaucacauuauuuaaaaauauuacauggacuauuuacauacaguagaaaauuacaaacaguucccaaacauagucuuuuauguguguuuuucagcuugggggauagaauauguugaauaguggguuuuuaccuguuugcugguaacuuuauuucaaagggguguguguguguguguguccguguccacauguguguguccguguccacauguguguguguugagggaaugcauaccugcccgugcauaggagccguaagaugacaucaggugcauuccucuaucacugugucucugagggcagaguuucuuccugaacugggggcuuguauuuccucagcuauucuggaagucaguaaguaagacaugggcaucuuccugccucuacccuucucugaccucagguuuuaggccugggccacauacccggcuugucgugugcggcaucugaacgcaaguccucaugcuugcauagcaagcacucuuagccagcucagccaucucuccaguccuguuguucucuucccuuguuuguuucuuuguuguuuuuugauacagggauucuccguguaacagccugguuuuucuggcuugcuauguagaccaggcuggcuuugaacucgcaaagauccuccugccucugccuuccgagugcugggauuuaaggcuugcaccaccacugcccaacucugaacuaaauguucucuuuuuaaggacuaaauguucaaugugugucuuauucguguacuagaauauuuaaauaaacaauuuuuuuauguaaugguagcccacuguuugcaucugugcuacacauuaugacuacuggaaggauuugauagaaauauaauugauuaggucuuaccucuagggaauaaguugcuuuuuagguaauucucaggagcagccauuagcuuaauagagcauuuuaucuccuugaugaguuaaaaaauauaauaaagcccaauuuuuaaaaaacauauuuucaguacaaauguucagaaguauuuuagacuguguucaauagugaacacuuuaaaauacuguuacccgucauccaucuuauguaucugauaccaggucuuugguugguuucuaacaagcagaucacccagugucugccucucucugauguuuuuacucagugauuucuaggugucucaagagauuaauuuaucauaaacuauguuuguucagauuaagaacaaaagcauagaagauagugagugacuugguaacuagggcugaugguugucacagaugggagcgagcuauucuaguacuguuuggaaacuagaguacauucucuuucucucagucucaccagaaaauaagcagacacacugcagugacccagaugaaguuggugugaggggaagguagcccugcauguggcaacugacuaggaaggcuguguuguucugggagcagacaugucucuugcacugaguuauugugauuauuugcaugaggcacuucaaaguguuuacuucauguguugucauuuuuagcuguuuguuguauagcuuguuuagcaccagcagugucaucugaugcggccucuuuccuuuauugccuaguuggaggagcuagaugggagauggacagauagaaguaaggguggggugagggugggaugggucuacauguucacauuagcugugcaggcuaaacaguugccccacccaguucugccagugcuggguagcuacacuucccucucugagauagugggcauggcugucggcugccucugauacagcguagugguccaggucagugcucacacaucagcaaguucacauuugguuaagcucaggaaggggaauugggaacuuuaguauugugaauacugccugucggccaguuguuggauauuuggaaauuguuggugaacauuuagucagguuuugcucccuguuuugcaaugcauaguuuagccugacccuaccauggacggauuugugggcuuuguagagugccaugcugcugugauugguucagcaugcccccuguucuuaaugauuucuguuguggaaguuauuauaagacccaaaacaugaagccugguuggaucuuauguaaagcaaaguguaagacuauagggagcagaggaagcugagugagugaaguugugaguggggguguguuguugccaugagcugcccaugucaaggaccaacgcuucacucaggcccauuggaaauggacaagcuuuuccucaggugaggcucagagggucagcaaagucuuccucugguccaagugugaauguugauccuauaugcaggaaaagaauucauccuagcuuucccaccacuccuccugaagacuucuuacugucucugucaaccugccccuuguuuaucuguauguaauagccccgccucccuguucaacuguauauaauacacgugcuaagcuucuggaguacuguggcuucucuaucagagacuagucuacccaaucucuauguucauccgucuguccgucccucccucccucccucccucccucccucccucccucccucccucccucccuucuuucccuuccucccuuccuuccugacucuagucaggucagucccuggaaccaugcaggauaggcccaagaccacaagaggacaucaugguauguugggcuugcauuugcccaaaauaugugcuauaaucaaaugagaugcucugcuuucagucucauuauacugcaugucauaucggagcagacuuuuguuaacugauaugaugguuuuaguacaaauacuucgauggccuuuccaaaugaauacauucuagagauccacuguuugguggcugcaacaaaggagaaaaagacucugagaguacccucuugguaucauucuuccuuagguauaugggugccuauuacugagguccuauaguucucuuuacuugagccaaagguuuucugugauugccacuggggaguggguccuuagacuugcuugcccagagugaccaagauuuaaggagacccucucuacccugaaggccauguugaaaugucaggaaauuaaaaacaguaguagcaacucugaauucaaccuaauaauauuagcagcagaggucaguguuuucuaaggugaauaauauaggauaauuaagagaauaaaauggaaccaugcuuauaaaccuaacuuugggguaguuugaucaaaguuaacuugacagaugaugcuggccuggaccuugggaccucaugagguuguauauuaguguauugucuuuugauagcucggaucuuuaugaaacauugaacuugaacuccccuuuuccuuauuaaguacauuuacuguaucgagguaagauauucagugaguaaauagccccacuuuuauguuagauaacacuguguccacacguuaacuauagucaagaauuacucccucguguaguacagggacauggaagaggaccuugggguaagaaauggguucagcucuccugaguuugcugggcacacaggcuuuuguugacaucuggcacugcauuguuugugaccgcccugagauugugcugguccagaguaggauguggaaagcacuugcuggugacacucaccccuucccuacauuucacuuuguugggcucacuuuguauauucuuuaauauacagauaucugcugagcuagguaaacuuuucaauucuuaaugcaauuaugguugaagcuguuaggcuaugauaugaaagcaccuuuucucuuaauuaucagagucuuuaauuguugggaagcaugugugguauuuuauuuagcacacauugugaaauaugucagcugucuccuccuugaaacgaucaaguuuucugauucuguucuguguguagcaggagagcccaugcucucaauuuuguuuuguguauuucuguccuucucuuccuaaugauuaaaccuuucauucugagauaauuauaacuccacagcagcaguaggaaauaauauggaggagagagcugguaggccuuuuauccaguuggccugauggaugucuuucuaagacaucagcuuaauuucuaagacacagcugaguuacugacacccauucggucucuacucagcuuccuccagaaccguagaugugcuuguucucauuuguacaccccuucucuccacccccaccccguaucugugugugugugugugugugugugugugugugugugagagagagagagagagagagagagagagagagagagagagagagagagagcgcuccagcagggucaguguuagguguguguggccguagaacucacacagugacucccugacugacacucaguggagagcaguccccugaccaccauguugcucuuuuguaccuuucuucauuuucaagauaguuuuuguuuuuaauuuuuuguuauuuauugucuugacuuaaaaauaaauguuagaaacuuauauccacguuuuacacauuuuaacuuauuuaucucuuaaaauagugguuauaaaaauaaacauauaaugaaacacauugauuauuuacucuaacagggaagacucugggacaagcaguucuccaaggcaucaacuagguguccugucauuccuuucaauucugacauuucaccuggaguaacaccuggucccacaagucaagggcucagucccacagacuggcucacuucagaugccaauucaacaucuggacuuuccuuccuacuagaggucuuggggagcuccaccugagaggccacauguuacucaagaaauuagucucuuugggcuuguagucucauagauaagaagaauuuaagaaugaauucagaaggaagcucaaggauaauuguauuggaguuuucuuuaaaaacaaaacaacaacaacaaaacaguggcgaaggcaggcuggccaccugagcagcugccgggaguaaggagaaugagaguuccaagaggggaaaaccucaccuuuugaguuagguauugaggccagcaaacagccacuuggcacacaggacaaggaacagggugugucuucagaggaaaaggaaggaaaugcaaaaugucagaggaagcuguccaggcauggcugguaucuaaagggaagaaacagaugaaaagacagaaggauaaguuacuagguccugaacaguuucauucuugucuuuguccagaagcagaauuugucuuugauucucuggccaggaaugccaaagagaguucugguuucuucuccucaaugagaacuugcaggcuacaugagcaggugauucagaacuuaggaaggcugagcugcugaugguggcuuggcaagugacuguucugagagcaggaggcuucugggaaaaauaaguauauuacacuguuaaggugacaauuacuccccucccccuuuuaccuuagucuucugaggccuuggucagaggcuuagguaauugacaaguccagguggauuaacucucaaaagaggagacaaccuaaucuaaccuucagaacagaucaggacgccaugugacuaccuagggccagaauagaccccauuauagaagggguccauacucaguggccuuuauggcuccuguaacauuccuccuucaaaaauggggaccuaaaaucauuuaggagauaggccagaauuuggaaauagauauaacuaauuuuuaccauggaaaugugaaguccuggcuccaaagcuguucaccagagaugaauguuuggacuggaguuugggucacccacccaagcacagccuguagacaggaauguucauguaggaggagauaagaaaccaugacucuggcauuuguagcuggagaaccaaggacagugccugcuucuggcagaggagcagaauggaauuguucacuuuugaggacucugcuccaaacugcauagcugauuucuaucuccuguucccauuacuaugucucaccagaggguaaucuauguccuccacuugugauuugguuguuacuaagugaccccaguacucauaaagaucauguaauacaugcccuucagugacugauggguucacucgacaaaaguacucaagguucauccaaggugaaucaugugacagaauuuuuucucuuuuuaaaaugaaaucauuucccaagaucuguguaugugauauucauucauggguugauacacacuuggguugcuucugccucuugaguugugguggauauguggguaugagcuuggcuaugccaguaucucuuggaacaacuaguguacucuucauccuuuuggguauuguauucaucaguuuuauguugcugugauaaaaugcucugaccaaaaucacguuaaaaggugauagguuuauuuuggcauacaguuccaggggacuagaguccaucauuguagaggaagcagggcauggugguaggaggaggaggcugggugaccacauuucuccuacccacaggaaacagagguagagaacagggcaggaagggaagugagucugcauacucucaaaaccugucaugauguacuucauuccacaaagcuccacuuccuaaagguuucauaucuuucccaaauaacaccaucaacuggggaucaaguaugcaaaaucaugagccaaggagggacaguucuccuucaaaccaccauauucuaccacuggcuuucagaggcucauggcugucucaugauacaaaaaugcauuuaguccaacuuuuaaaguccauauagucuuuuaacagcuacagcacuguucagaaguucaaagucucuucuaagacacuugagauauuuuuaagaaaauuucuuaacugugacucaacugugagacuuaaaagcaaauuauauaccuucagcauauaaugccacagaauacacguucacauuccaaaagggaggaaugggggcauagugaggaaauaauggaccaaagcaaggcugaaacccgggggagaccaccaaauccuguaucuccacguccaguauuaagaguuucuguuucaaugggcuuaguggcucuacuccuccaccuccuugcugccugcaacaugcaucucucuuuugggcuggucccccuugcuuuaggcagaucucuuuggcagauaucucauggcuuuggcaucucccaacaucuuggguucucugcuacaacacaggcuucacaaaguucacaaguucacacaaugaccucucagaggcucugucccugccacauguugcggagccucaggaacugagauaacugauauugguugucagcuugacugcaccugaaguauuaaaaucaagcagcugggcaaaccuaugaaggauuuuccuugauuggaucauuugauauggaagauccacucuaaucuuuaucauuugagguuagaagaccacuuuaaaucuggcccacaccuucugguggcuugccccaaugacauugaagaaaggagcuuuugguuuuugcacgcuugcuuucacucuugcuggcaaauucaucuauccugccguuugggcauuccuuugcugguauuggaacauacuucuucagucuugagcugaaugugggcagcucucucuaggaccucccucaagugugagcaccagcuugggccugccagauccauccucauaggcugaacaacuacaggacucuuagcuuuucucuugggagacagcuauuguuggauuagccagauaugauaaauccccuuuuaauguauguauagaugcagucugucaguuuugcuucucuagaauccugacgaauagagccacucucuaaaauucuggagacagaaccaaugacuuucuuaaccaugcaucuuucaugccucagaaugcagagcauguggauggcacugccaaguugagcugucaguguggaguagacacugcucccuuccuuaaaccauaguugcagaagcuucucuaugcugaagcugugggaaaccuuggcuaaguguuuguuuaccucuuagacuuucuccugucacaugcuguaugcuuagcugggggaggccuugcugucgagugccuuuucucccagugaagggcacaaagauugccuuuugugaugcuuuucucucuaaaaaucacagccuuuuuuuuuuuuaaauucaaaugucuuuauggcugcuuuauucuuccucuuuaagccgcacauccuuuucuuucugcccuaccuguugcuuuucuuuauguaggccugcaucagaguaaucagaaauagccacaucauagaccuggugcuaugcugucuugaaauuuccucugcuuaagaguuaguccaccacucuuuauucuugccucauagaaguuccuaggacauaagcagaauacauacuaguuagcuugcuugcuuccuuucuuccuuccuuaauccuuccauuccuuccuccccuccucucucucucccuucauuccccccuucuuuccuaauuaccaagacauuuuucuccuuuucauuauauacauguauauacauauaaacagaaccugcugagucuaguuuugcuuguguguuauguuuuuugagcugaccacuugguguuguacaccaauuaugagguuaauuucugaagaaugguuuuucccucucucaacagucaucaguugccugccuauagcucuccaucuggugugggggccuuguaagauuuccccauucacuuuggcaugcuaacugauagcuggcuuucuugcuguuuacuuacuuuucuuuaaugugugugaguauuuugccuacauauauguaugugcaccaggugcccauggaugccagaaaggggcauggauccccugaacuuguauuacagacagucuugagcuaccaugcugggugcuaggaagagaacuugagauagcugggccaucucucuaguccccaguuagauuucuuauguagucuaggaaugacugugcccacucaaagcaauuaucaauccagauagucucucacagacaaggccacagagcacugugaucugagcagcacgucaagugaggguccuaaaccuaaccagcucagauacccaccaaggaauggcauuggcucauaugguaguucuguucuuaggguuuuugaggaacuaccauacuguuuuucaugguaauugcaugguuacaaauuuccacuauaacguuugggaaaauagcccuuacuuuuaaaaaguguccucucauaaugacuugacagaaaguccgaguagcacaaacggcagaagagacccuuccucauagaguguuugcauaccaaagaggacccucucaggggaggcuaaacaugcugguuggcuuuucaguuagaagcaaacuuuccugaacugguucacaugaagcaggugcuaaguagggagaaacugggauguugucuucuguaugaggauaguaauaugauagaccucggaaguugcugaaacacagucuugguggccucuugucauugguggauuucuuucuuucuuucuguucuguggccugcacuguguggugaaggaaacagguuuaauuucaguuacccagagauggagaacagugagugcauuccaaucaaaaucucccagagaaagggacuguucagccccacacagagcagcugcugccucuuggauguggccagggagauggaguuauaccaguaccgagcaucagucucuaggggaaguguguggauagugagaagcaacagaggccuggaagaaaggaaaugaaggcuggagaggcauaagggggugugcuccgucccugugguguguuaagucagcagugaacaguccauugggaacauguugaagacagcauaaagcacagugaaaguccuggguaaauuauuacaguuacaggaggcaagcugauggauugcuuucuaaaugggauguggagaggaagcgacaacauggccuucaccuuuugagaucauggagcuauucuuccauuaagccuuaauuagcuuuaauaauagucccugacucccuuucuccuguggaucagauagcaggugaggccuuuuaugcacucucucuuguucaggguucuccccagccauggguacucacugcuugcuggcugagucuuccgaacuacacuucugcagcaggacuaacacuguucuuucccuuucagagaugugguacuggaucuuccucugggcucucuucuccucucuguuuguccacggugcugcaggcgugcugauguuugugaugcugcagaggcacaggcaggggagagugaucuccaucauugcugucagcaucggguuucuggcuucuguaacuggagcaaugauuacuaguaaguugacuuauuuuguuuaaagauauaauuuuauaugcaaauacugcuuugguaagugcuguuguuauuguaaaagaaacacuauuuuucauguagacugguccucagcacuuacagccuagaaggcaaaggugaguugauuuacucaccggacagauaacgcauguaacuaugugcguuugcucugcguggauuugugagaaauggcauuggcaaggggcauggcugauucagucugaaagugcuuuauagcaaaagaagucucugcuuuaaauaugccuccugucuauuaaggaaagaagauagacacugaagaucgagccuuugagucugugggcucaucugccugugacaacaaccacuuaugauuucucugcuucaggaaauguacaguuuucugcugagcugucuuguggauuuccuuagccugucaccuguuuuguucuccugacagugaacuugucccugcuccucgcuguacuucagaguuaguucugguuucugggcugcugcuggagcagaaccccguugcauccggaagccccucagcugcuuucuuaccggguugugcuuauggcugcugacuuaggucccugcugcuuuugagccauagacacacagggcaggcauuccccuuggcugucuucuacacugugggcccuaaccacugcacugcacuguuuggggcucuccacagggacuucuuucuuucacuugauucuggccacagaauaugaggaaagccuuacuuauauaguaccggccaggcgcaggucuagcuccugggguucucagagagucaugaagaagagacuggaguaagugcuaaucuugaaagauuagucaagaagucuggagauuuuucugcaggccacagaaaacaaguagauauuuuuauuuuucccuuuuuaaaagauugccugccuaucuguaugucugugaauuuugugcaugcagugcauacagaggcuagaagaggauugcgagccacuguacuggaguuacagcugguuguuaguugucacauagguacugggaacggaaccaugucuucugaaagagcaauauaugcuauacaugaaccucugugggugggcuuugagguauacaugaaccucugugggugggcuuugagguauacaugaaccucugugggugggcauugaggacauaaacuucugagcaucucugggccacagaugggugggggcgcucuucagucagauuuuguuuuauaacuuuauggagaguaugagaagaagcaagagaaaacucuuaaagguagggccuucauugccacacccacuaguaaagcuaccuagacaguuguucuguuagcuggguagguggggugaaagaaaaaaagaaggaaggaaauggguagaaucaagaagggaaauaaagaggaaggaagaggaguuaagagcuaugaguagaaucuauacuggaugaggggcugggcuaggugauagcuaugugcugcucacuauagugacauuccaggagacagggacagucagugugggcuacuguuguggucuaugagcuggggacacagagaagcaguuugcucagauguuauaaacacuaaccauguggauaugucauuguaagauuuugaaggguauguggggaauucugccuccauuuaugugaaauauggcuaugugcauguaaccaacccacuucaguuccauggcaaguauaauaaauuagugauucuuaaaacugcaaugaaauguugagaaauccuugaaaaugugagucugccacaauuucagauaaaaauuugguuuuuaucugaaacauacagaaauguuuuguuaguacuauuucgacuugcaaacaugaauuaaaaaauaacuagaauauuuagcuguaugucuucucuuucucuuuauuuaaaaaaacuuuuuuccauuuuucuucuaugcauaugggugcuuucccugcacgcauaucugugugccacauucaugcaguguugucagagagaugcuagaagagagcaucccauccccuggaacuggauugacaggugguugugagccaccguguaggugcugaggagcaaacccaggugcccuagaggaguacucagugcuuuuaaccacugagcuaucgcugcagccccuguaugucuuuuguuaauguagcuuauugguggcuuauauagcucuacauugaauccagcaguugcuaaauagccuuaucaguaugaugcugaugggauguauauuggcacauauccauuauguuguuacuuagauuuuguuuccaagaacaagugaugugucauuuggguauauaguauuuguucuucucauuuugguuuauauugauacugccuaguuugauuuaaacagaaaggggguggguuggaauggugcuagggagguaacucagugugaguacuugcuguguaaaugugaggaccugaguuggugccccagcucccaugcaauacccuggguauggccaugcaaaccuuuagucccaugggagucaagguuuuaggauagccuagcugccgaguggugagcuuccauuucauugaggcucgaugucucagggguaagguagagaggacacccaggaccagggcgccuagcacccuucuuucaccgcaacauaugagcgcaugcagccuguucccuguuacauacauuaggagcuucuuugugaugugugugugugugucugugugugugucugugugcauguuugagacaggauuuuucuuuguagcccugguuguccugaaucacucucuguagaccaggcuagccuggaacucaaagauuugccugucuuugcuucggccucuuggguacugggaucaaagguguguguuaccacaccuuguuacaaauaaaguuuuaaaaaagaaaaaaaauggguuuauuucuguauugugcccuauuuuaguugucuaaucuuuuauaaguauuaucuaaagauauagagcgacagcuuuugguugauuuaauuugcauuucucuguguacuggugagucucagcgucucuuucugcacucgcuguugacaaagcuuuccccucugcacauugcuugauucucugugcucuucuuuggcugcccuggcuccuccuuacugccuuacagacacuccucacgugccuuacagaugcuucacuccucacguacuuacacugagggccugguuuggguuuugcaaaccauuuuucucagguucuuaucgguucucuucauguagugaguuuauucaguagaaauguuuaaauaacaauguaauauagcuuacagguugguugguuuguuuguuuguuuccuacuuaggguuuauaauuuggggcauuaagaaauuuugucucgggccuggagagauggcucagugauuaagagcaccaacuguucuuccagaggucuucaauuccuagcacccacaugguggcucacagccaucucuaaugggaucuggugcccuuuccugauauaucugaagacagcuaugguguacucauauacauacaauaaaucuuuaaaaaaagaaagaaauuuugucucauaccagaauaaaaauaauaaauauucuucucugauauaaauauauauauauauguguguguauauguguguguguguguguguauauauaucuccuuuauuuuagaccuuuaccuauuauaguaaaguguuuaauucauuuagaguaggauauugcugugaagagacaccaugaccaaggcaacuccuauaaagacaacauuuaauuguggcuggcuugcauguucagagguucaguuggaagcauggugccauucaggcagacauggcacuggaggagccuagaguucuacaucuuaauccaaagacagcaggaggagacugucuucuucaaguaccuaggaagagacuggaauuccacacugggcagagcuuaagcauaggagaccucaccccccaccccccaccccaucacacacacagugaccugcuucuuccuacagagccuuacauauuugaacaaggcuacaugucuuaauagugucauucccuaugggccaagcauucaaacacacgagucugugaaggccaggccuuuucaaaccaccacaaagaaucaggagcaguguucuuaaaggaacaaaugguaaauguuuuagacuccggaagcagugaucucuguuaagccugcuguuguagcaccaagcauagauguaggaaaugaauggauaccacuuguuccaaagaaaacuauacacagaaacaggcaugugguagucgacugucacucauuccuggccuaagucuaccuuuauugucgguguuaguugccuucuuauuugcuguauucucaacauccauggcuacgucucuuggcucuugugauugguucaucuucuguuucuauuuucucaguagggccuuaguucuuagaccucugugguuuuguaguguaucauggaggugcuuuggucuagugaguguguccuagguaauucagaguuaggguagccaucuguucauggucuguucuuucauauggauuucagaguuuaucuacugaauccccccaccccucgccaagcaugaguguggugcuguuagaacccacuugggaagcucugggauguuugggggugugacgugacguguccacuuaaggaacccauccucccucucauuagagagaaagcugcuuccucaguaggagucgugugcuuugcacaccuccugaacacugaugugcaugguaguucuuggucacacuuugguuguacuggugugaggaaaucgugugccucuuggguaguuguguuuaggaagaauucacagaggccuggugcagugaagaggugaguggacugcggacaagcuaagcauuaagucagguacagacugggacugaagaaacaacugaaguguagucaaagauagagaaucuaaaauguaacauuuauucaacaguuacaugcuacuaaguguaaaaugucaaaaugaacuuaaggaggaauacuaauggaacaguaucuuuaaaucacugaagugcugaagccacacacacaccccccacgcccaaucuccaggcccaaauacaguauuuggagcaucccuaccagaauuuuaaggaacauuuacccucccuccuuuuuaauccaaauuauugcagaaaauagaguaaaauuuguaugauuuuugcugagacuggucuggccaugucaggaaagacaaaaagggguaaaggcagcaugggcuccaggaauacugccccugggugcagagguuacuugcugacaucuagggcuuugcuguugguuuuuaaauuuuauauauuuguauauaggcauuuuaccugcguguaugucuauguaccacuuaugugucuggugcccauggaggccaaacagggcauuggaucccuuggaguuaacggauagccaugggcuaccauaugguugcuagaaauugaacccaggucccuugagaaagcagugguugcugugaacaccgagccaucucaccaacccauguuugcuugagaacucacugagaaccaccugccucugcugagagagagagagagagaaagagagagagagagaaagagagcgagcggugguugagggugcuguugcaccuggcccucugccuuuucuucucuccuacuuuuccuuuauugccucuccccuccucuccucuuuucuccugcccacccuccuuuccuucuaaccucccuuccucccuucccacuuucuucccugugguuuuaaggcccucucuuucguaguauacugaacccauccacuugguuuccaaguuuacagcugugguuuuauuuuuagccuuuucuucuuuuaugauggcauggugugagguaggaccaggauggcuauuccagcaccguaaguugaguuaugaggcacugauaguuccuccugccgugacugcucucuagaguuagugcccagagugcugggaccaguaccuauuucuuuccuuuucaauaugugcauuuuaaggggauggaugagaguguauucuggaguaaacaugagugucaguucuuauugaaaagauccucacauuaaaagugcugagagcgugaacuguggacuguagaguuccguuaaaagcaccguucuuggguugugugguucugugggguuugggaacgguuaaccagccguguggaggagauccucagucaggugaagaguggggaagguuuucuguuuagguaacugaaaggugacuugccgcaggcagccgugcguguggcagguggggcccuggaugacucugcucugcuucccucccaggugcagcaguggccggcaucuacagaguggcugggaagaacauggccccgcuggaagcccugguguggggcguggggcagacugugcugacacucaucaucuccuuuucaaggauccucgccacacucugaguucugagggaaugucuucuucacuaaggaaacguguggacagaguccccggaaaugugugguuaaucagcugaaaugaagugguacaagcagggacccagcaagaaaaaccuagggaagaccuugagccguguggcaagccugcccucuggcguccaaacguuugcacuaccgcacugcaccuuacgugccuccaucccaggcaaggugcacaagacucucugugaagcugcaagaagaagcaccuuguuuaguugccaaucagguuaacauugguguugaaaccgucguucucaacgguguuguguuaaguuacaggaacguuuugagaaauugaucuaugugccaaacuuuccuuucuguuaacauugaucaugugacaguuugcaaguguagacauaggugagugcugugaguauacuugacauggauucagguaacguagccaggcuuagcuuugucguguuaa

SEQ ID NO: 7003 - RNA, 5096 nt, Mus musculus
ugauuucuucugcugugcccaggccugcugcucuucccaugcauucuuuguauucuugcuguuuucuaaacuuaaacgugagcaucuuuuccagguaaccccaguuuucucuccuguuuggcuggcuuugcucuugucagcaacucagagcuuugugugccagcgugagacuuaacugucucugacauugacuuguguacagaacaaauauuuguguuaacaugguuaucuuaugaucugagaaaguuaucauguuaaaguaauacggagcccauuguucaaaucuaaaacuaacuaaagauuaccuugauacauugacuaugugaaugaauggaccaaagagaauugcgcuuguuuugugcucuagggugaaagucuaaggggguuaguuaccucuuuagagacuguccugcggucaucucauugucaagcuaauuugcauuaagaauuguguucaugugugcacuuuuaauuugaugggcauuuuuaguuucuucaguuauuuccauugggauuuuguguaacuaucaacucuugguauuuugaaaugcaauugaguaguguggauuuaugaaacugucuauauaucuauuuauaugguaaaguuuucaagaagcuguuucuuauagagacaaaguguuuaaugaaauauauauauauauacacauaagaauaucauuauauauacauauauagauagcuauauaugaauacaguccaauuggaaagcuuuguuugaugaacauuuuccuguucuucuggagaaguugauacauuuguuugguuaaaugcucuuugaaauagacuggaggguauuuaaggguuugcuggagacccuuguuuuggaucugacaaaagcucucacugacauagucaguuccauuuucuuaaaagcucagccauggauuagcagcacauuuucuuccuuagcaccccaucucaugugaccaagagccugaucaccauacaguuccaucagcuucucaggagacaugguuaacucaaguccucgugugugucagcucagccagugguaaaggcuuacccaggauucuuucuuaguauucgaaacacagaauuccauggcuccuuuucuaagccuucaggagauuuuuuuuuuuuuuuuuuuuuuuuuggugaaagaagggaaauuagguguguugugaagaacaaggauaauuaagaucugaggaugcuauagaaaacagugccuccaggaccuuccauucacagcguggaaggcugggcgcccucuuugagaugccuaggcugguacucaccacuuagcucaguuugcugaguucuguucuauagaucuccuguguacaaagauggcugaaauaggauuuccucagacucucccaggaacuggacaagcaguuucaaagucuaaaaagguugggguaguaccuuacuacuuccugagacucacccuuucucccuccccggaccucauuuuucuuuuuccaucucauccucugaguuggacauuucaaugucuuagguguugcucugacaaggaccagacucuaagccaaugagauagaucugaguccaugcuccgucacgugguucacuuugaucugagcaucauuuaaccacucucagcuuuaggucucacuuugaauugauuaauaccuccuauggguaaacaguauguuugugacaguaagucaguagaauucuaaaguuauauuuuuccauaaccauuggguuuuaugaaauucaccuucauccauuucuuuuuuuuucuauauauuuuaagaaaaaagacuuuuauauaauuuuacuuucauuaccuccucuuugccccuuaaaaucuacagauaacuuuucuaaggagacuuugaggaguugauggugaugggcgugauggguaaauaggaauauauuacagguucugcucaccucugguuaauguagagagaauggauguggccagcauuuccuccacugccauuuccuacuugcuccuuuugguuugacucagaacauccuuugacugggucccauaugcaaaguacugcccucguauuagcucccgccccuccuagucaucugucacugugacguaaagaauauggaaacauuacugaggaauuucugaugauggcuuuagauuauagagaagugugguaacauagcuuaaguaugacuggguaguuacugaaucuuuuuaaaaucagggggcuguauucucagugguuagacuugacagucagccaguaguguccuaguuauccauaauuucucauccuuugaaacuguucaggauauaaaggacauuauucaguuuuaaaauguaauguuucuugaaugugcaaugccauuuguaacagagagaaauucaaagugggggauguuagagaggcuaauacacaaaacaagagcauaugaaaacccccuguguuugcaagcauaguuccuccauccuguuaagaccauaaccaccauggagagagaaguuugcucaugccuugguucagugugugugggcucuacaaaacacaggugcucauggcacguucuguggggggauuuguccucccuugaggaucccuguuuucuguaggugauccuguaugguggcuuaguuucugaauuugccuaucuuagaaucuagcuggaaucuguuugggagaaauuaauguuuccuaugugaaauguuuucaggaagcaggugcugcacugcuacaccuuucugagcaagcugagcugggaugcaguacccuuucuucauuuagauccgcuuucacauucuuuaccuacauguggggcacauguauugaacacacauaauggccuuuuggguuuugcaaacuaauauauuuagcaguuucucuaacaaucuccuuuccaaagcagaugucauacauccuaacuuagaugugugcauuucuugacagaagcugacgugcugguguagagagacuguucagugcccauguuuaugcugugguuaucucauugaaaaggaugcauucaaggcacagggcugggggugggguaggcagagaguccaugugaugcuccugcucuccuuugcacgauguccugcacccacaccugcuguguaggcuccgugacacggccuuucccuuuggggaaugccuagcuccauacucugaugcugaucaucuggacucaccccaugagcggagcacuucccuccuagacgugcacuggggauucuuuucaagacauucacuuguucagaggcuugagagcgccacugauuguaaagguuuugguuugguuugguuguuguuguuguuuuuuuuuuuuaaguuuuauauuuuugagauagagucucacucuguagccuagacuagcuuugaacuugugauccuucugucucagcuugucagguaccaggauugcagauguguaccacugugcauggcuccuccuuuuuaagucaaaagguuuacauuucaucucugaaagugguuagaauagaauaguuuuaaaguuuucuuucuagaaagaaaaauacucuuguuugccuagguuuuuuucauagugcuuaugauaguagcuguguuuuccuuggggcacucuugcucuuccccuguacacaccuuuauucaugagcuccaccuguuucaugaacaaguaggacgcuccccucagcucauugucgccauaugaucuggcagaaugcucacccgugguucuagcccaaguauuagccccugccuuaagaugucccaggaugagagagcagcuuuaguuauaugauaacauggcuuuguuuaaguagcacaaguauaacugcucuagcagauacuaagaaacuaucagccagcccacugaugaaccauuuagcuaaaccacaguauaauuuuuuuaaaaagcuaaaugauaucucagggccuugaaaguuaagaaucuuuugcaaaguggacuuagggaggacugggguuuggccaaugagcuggcuuugugcacagcaccugcagagagaucccagcacuuacagugggccacugagacaaguccagcuacuuaccuuuuacaguuccgguuccguagacauuagccacugacugugacaggccacaacugcuucuacaguccuucaccacacggggguauuugccucuccuucuuucccuuucuuuuuuuccaaguaaguaugaaaguagaaaaauguagacaaacaaaugugggauuuuaaaguugaguuuuagguaaacuagagauuccuguguggacaguguuaguuuaauauuguaguuacaaaggcagacacuuuauguaaccuuuagacauauguuuaccaucagggauuuauuuuuacaauagaaauauuaaauguacugugaagcuuaaagacaggaagacuagacguuggagggugauacucagacaaaaguguguuuggugagguacccgcguuaugugaacaugacuuccccuucuguuaagacuauaaacuacacuguaagaguguguguguugcauguuuacauaaaacaauuucauucugaaggauuauuucaacuauguuuauauguaauaccuaacagguuguaaauaguguauacuauugauuuuuaauuuuauaugagcgauuuuuuuauuucccaagucauguacaaaucucauuguguauauagcauaacucccuggagacacaaauuuugcagugaauuuuaaguauuuuaaucgcuguaagcaucauguuagccucagagaugcugguccuuauuuuaaauuauuuuucaccacacauuuucuucaaagggcagcaauaaacauaugcaaguuauuuugguucuugaaaguuggccucagaagauaagagugcaguucaauucacagcuguaaagaaaagaugcacaacuuacaccauccgcgucuggucccaggacaacuucugagauccaucugcacauggcucuccucuuuguaauauacagggugaacuguugaaaacacacaggacaucugucacagugaauccagcacuucagugucauuacacagaauuuauuggauuaaaguuuguaauauacaguauuuuaauaaaguuucuguauucaauuucaugcacuuauauauauaaauaaaccugucuuuaaaaacuauac

SEQ ID NO: 7004 - RNA, 1019 nt, Mus musculus
caacacuggacuuagugagggaacauucaaaccacagcaccagugaacagugauuucaacagaguuggugagauucgggcagggauggcaaaacaaggcccuuugcacacacucgcgaucuuuaagucauggauugggagaccugauggaaaggaagaguuggaaguuggaaaagccaggucacaaagcaugaagagcugagaauccaugcaggcgugggaagccucuggcauuuuuacuagaccauccaggaggcuacuggguaaugcucacaaggauuauucuacuggcugguaauccaccccgggggagaggagaaaguagcacaaaaguggugugugaugggcagaggaggugaagaggcaagggaaugagcgcuauggggaauggggaaagggcuggcuggcagcagcguugaaggcugggucucugcauuagucacccccccucccacccuauccccacccccaguggcugccugugggguuauugggcacugagaauaaucuggcugccuaucaggaaggggguugggcguccauuuaaaucugccuggggagucuacccaggccacacaccaggcgaccgaucaagcgaucaaggacacuuucauucaguuccagaauccaggggcuuuuggucucuccuaccuacuuagguuuuuauuuuugucucuugguauuucagagaaguccaggaucugcuguuuugagugucugccucagcgaagucaugcuuccuuuugggguauuauacucgguugccgguugccauggaagugagggcuggcugauucacacaggagggggguggggcccacuagcaagcccucaagcacacuggaugauuucaauuaccuaaaucccugcagcuucucagaagacaucuacguguuuuuuaugacguaugaauaccuuugacuuugauuuagaaaucgagaugcauuuuuaaaaaucugugaccuguaugagaacagucuauugauaaagcaccaagaauaaauggaacuuugaaagcag

SEQ ID NO: 7005 - RNA, 4476 nt, Mus musculus
ugauggaacauguuucuccagcagacugccugggaccugggacuugaagagcgacucugagcaucuguagauggaacagugcagacagauggcagugugugagucaugggacaggggccacagggcugcugagguacauaucguggggaugggaguuucagagacuuggggugcaacuagugcaagagcaguggcagacacacaaugggugaguggguuaugcaguggauaaaaggaagagccucuuucacaggaagcucuuucaucuuuuaggguguuaccugcaucguuuaucuccucagaaaugcccuauuuuccugguugcugggcaucuccuguugucugcuaguuaacaaccaaguaagagauacaguaucuguuuguauccacuucuuccugcucucacuguuguggucaccccuauugaucaauacuguuuuugucuguacagugaauuaaugucaaaaauuaaaauucccuaacucuugguccauggacccaugcuccuuuguauaauuuauugcuguggaagguuaugcuccuuauaaacccacuugaacaaaacacagucauaugguuggugagcaaguuugacuguuggagacuuugcagucugaacuaacugcaggaagugcuuuacucuuuuguuauuaaguacucuugaugccaggaaugaaaucugcaugauaaauucugcuuauuacguuucuccugaaaagcauccuggguaagaggcuauggaacauggcaguguggggcagauaauuccuaccugaagacucagugucuguaacgugcuggucugugauagcucccuugugaaggcagaagcuacuggcuguucagcuucauaaggaaacagcauguaggaccauuucucacaugcacauuuuaauaucugagaacuauauuuuggcacaguugcucuccuuuuuuauccuguguguuuaugcauuuacagacagucuggaaagggccauggauuuuacaacaagcaaaaccagugaagcuuccccucaugguucccagugccagcaaggacaaagaugaacugugggcacuggcaaguagcuugccucucccccuuugccucuguuggauucuguggaggugacauuucugcucugaguaucauuguugauauuuucaaauaguuguugaugcauaugccucagagccauggugaagacugagcugugaaguccccagcaggccucugucaggagcgagcucaccugacugugccccuucguccuaauguccauccgaagcuggcuuuaacugugggagacuugcuguuucucaugcauuccuccauugcuauuugucucuucugauuucagcuaaaaaugaaaucagcuauaauuucaaaauucucagaauauaggacugcaccucuguagcuggaaggcuugcuaggcuaggcugcaggaaggaggggggcuuuuguguguccucuucuagcaccccuaaggugguaggaggcacagacgcucauuugguaaagacgugugcgcaggggaguagcccucauccaaaaugcuugggacuagcaguguuucccgucucugauuucccugcacuguggaauaugugaccagcuaguuguacaucccuaacucagugccagucuaacuggcauugccuuuuuguucuggaccaccuguuuuuccuuuaccaguuuucucauuaaauauuugcuagucaccuuugguagaaauuuugccuuuuauaaaccaaaggucaugaccuaaagugaaaaaaaccaauuuaucuuauugucuugaauucccaccagagccguggggaaacuggcuuugcaaguaacucugcuuugggguuagguggugggaguccugcuccuacaggauccauagcuccuacagguuuuuuuuuuuuuuuuuuuuuuucaauaaaagugacauucuuuucuuuugccagucauucuccucugguauucuaaauguucugucccaucuuaauccucaggccagcuuggcuggaugacagggagggcuggacagggagggcuggacaggguggcgcuggcacagauuuacacuaaugaagccggaugaguuggggcucuugcuuauuuauuuacuacauuuauuuuuauguguauaggugucuugugugcacaugugucuguguguuccuggugcaugcuuuuacagcuccccuaggcuuggagucagauagagaugguugugaggugccaugugggugcugggaaucuaacccagucaucuggaagaguagccacuauucuuaaccagugcgcuucccuaccaagcugagccgagcuggcucuucaguuucuuaaccaguacgcuucccuacugagccgucucuucaguuucuggcucaggauucucgauugcaaacucucuggaccuuuaaacucagggacagaauuuguggaaaaauaccaauuucugccgcagugucccccuuacaagugggucucuguguuuaaagauaguaacaagaagcuuugcagcugauacaagcgagaucauugcuaagauucguuacuaaggaguagcgaggguacugggcagagaguacuuagggagggagcaccagagcacuaagccuggcaugugccuggccuggcucugcugcuuggagaugaggggagacagcuuggcuugacugacugugcgucuugucuagcaguggagucucugucugugaggagagaauccuguugugguuagauuuuuggcugcaccacuuacacacccgcccaggagcuaucucggauccgugaauggagaacacacacacacacacacacacacacacacacacacacacacacacacagaguuaauuuuaaaaugccuuggcuaccucauaagcuggguacuccuaaaccuucccaugcuaucccaggcucagucagggaaguggccaguggccacuuaucugaaaagcuuacccucaaaacucuaagugucuugcucugugcucagccauuggccucuggccucuuuauugauagaucaaaagccaauucaaggcccuucagcgucaguccacacagacucugcauuaacucaaagcaucagcaccacugcucuccacaacccuacugcuaggcagccacagggacagagagagccccaggccggcugggccuuggggacuugagaugugcuguugguaugugaggaugugccugccuuuggacgggaagaggucuuuucaucagaguccuaauggggcuuugaucagaaggaacucgacaccucuacgaaugaagagagcucccaggauuuggggcauugcauuucuaucagaaagugcagaucuguugguguucacugaaggaaagcuuucugggaagaugagaaaaaauuaaauuuauucauguuguguuuaagacaguucagccacaaaaaugugaagaauuguugaucugauuccugauuuuguucugauuuuaauaaaauaaggcauagauuauauguauuuaaaauacauuuaacuaaauauaccuaaauaauuugcugguuuuggggcuuuugagacuguccguuucuuuguaggaaucccugaggagagcagagucgacacgcugcugcugcuucuuucuucaugccauguuacuggacugacagcgugucgagucuggaaacccaagugcucgccagcaggagaauggcucaggaaauugauaguaauguuuacauacugugugaucauacuaaggguugucuuagaaaaaaggcaaagcucugcuauacaaaacagcuuggauauauugugagggaauucccguguccagacagagccugaugcaaaguaguaugugcugaggaaauuugauauacgauguggaagaacaggaaaaacuaagcauuucugacagcaccuugguagaaccugcugaagcuaaguauccucacaggagaauaugacugccacgcccacgaugcacuugucaaagacauaacugaggaugcuugauguucccucagguugagaucaacucaguccuacagcggagggaagauaaaauuacauuugguaucuauacagaugacugaggcaauaaaugaauagcaagugaucgcuuugugcaacacaguggauaucccccaccaacaugacugacagggagguugcacacucacacacacacacacacacacacacaugaaugagaauggaucuaaagcaaucaugaugcuuaggacuggacacuugcacgaaaguggccaucuggggguguguauggcagugaccacaacaggcauaagaugaucuugggggugccagcauaaaucuaggggucacacagauggcuugguauaaguugcagaguucuguguuuuuauguguguaguuauuucacaucagaagacuuacuauaucacugaggauaaagccuuugcaaagauagccggcuggggcgcuggcggucugggaguccucgggacucuggcugucuaggaguccucagaa

SEQ ID NO: 7006 - RNA, 8725 nt, Mus musculus
caagggucagacagccgccuuuccguuugccauggugcagcuccggccccgcuugucgcguauucccgcgccggcugaggcgaugguggacgaggaccaggcggccucggaggaggaggaggcggagcacggccugcugcucgcgcagccuagcaguggcgcggccgccgagccccuggacgaggaggaggacgcggacgacgaagccccggaggagcugacuuucgccagcgcccaggcggaagcccgggaggaggagcugcgcgugcgcgcgagugcucgcaggugcagcgcccgggaauguuggcgccucgggacuccccaggcucggccggcgcugacccgacuccuuuccuuccagggauaaaacgcuguugaaggagaagaggaaacggcgcgaggagcuguucaucgaacagaagguuggacgcgggacuugucgcuuauguaaacucggccggggcuagaguucccuugcuaaaagcuccuuaaaggauaggguacuggagaggugcaagggccauuggcguuucuuggagucugccguaauucaaaguaggcguggaagcacugacacucaucuaucccugacaguaggucuuacaggcuuccagagguggugagguuugcuugaguuuuuaaaauucuaggcuggagcuaaugauuucuuuuuucgcaccccagagaucugauuucgaguggccauaccuaaauaccuuucaguuaguagccgggauacuugaacguugagcuacuuuggguaaaaugacagggaauguauugggcuuucuuuucuuuucuuuuuuuuuuuuuuuuuuuuuuuuuucuuccgagacaggguuucucuguauagcccuggcuguccuggaacucacuuuguagaccaggcuggccucgaacucagaaauccgccugccucugccuccugagugcugggauuaaaggcgugcgccaccauguccggccuguauugggcuuucuaaauccagucuuaauguugucgguuuagaggcagcagggacguauucacagauuggcccgaauucaggacuguucgaaaugaguaacguuagaaguuaucuccaggcauaccuguaccucacuuuaacuugucaucaaaugucuuuauccccaaagaaaagaaagcugcuuccagaugcuguauuagagcagcuaacuacagcuucagaggccgaguaaguauugcaguuucuacgugcauaaagucuguagacccuaagaaauucuccccaaacuuaaaagcuacacagugcuuuuggaguuccucaacuuugucuagcaagauagaugguaaguaagugacugagaacauuuaguguugcagcaggaacuuaaacccagacuuuccuuuagcuugcucuaccugccgccaccccuuucucuguuccucauuucguuuagcagccguguugccagugcuucaaacccaaagcuugaguuuacgcccugcugaauucacuccuugguacauucuuuuuguuuuucuagacaggguuucaguagcccugacugucauguaacucuugcucuguagaccaggcugaccucaaacacagauuugccugccucugccucuuggugcugggauuaaaggugugcaccaccacaccugaccuuagaacauucuaacuucucaagucuuuuuucuuuuaaaucagaauaguaguuccaaauuguugguuacuuuccauaauuauucagaucuuuaauccaugagguauauaagcagauguuugugcuuuuaggugagguccuucucuuuccuacccgaggucaaguguggacccuuucuucucgcucccuccuccauaacuucccaucuguacaggccucugugcuuucucuuccaggcaguuuagucacuccguagguaccuggaacucauccuuggucuccaggguccaaacuguugucuaaaucuaguuucucaauacugugagacuagcaccagccuuuacuugaucuuuggaaugcuaaguuaacaguucugaguuucuauuaacagugcucaaauuuaaguucugaggacacuccauacuagucaaaugacugggaguuguggcagcgcuguguggcucagugaggaaagauuaagggcaggggucaugaaaucgagagaggaucuuggauacuuguuuugaguacucucuauugccugccagucccaucuuucguuuuuuuuuuuuuuccucccgcagcauaaagaaaucaccagaaaacguaaaagguaugacuuguccuugguuaaguaacuucauguaaugguaaagugcacuugcagaaauuuuugguuauuugugguccuuaggccuggccaaaguuggcuuaagccuguuuuccacuauuuucuucaaaauaaaaccuguacucacaugauagguggucaccaaagugaguaacuuccauuagguguuaauuuauauaaauacuacuuacaaaguggaucuuauuuuuucaguuaauuugaaaaagaaaagugaacagcaugcaaaaggaagaaacuccaagaaaguuaaaguacagaaagugcagucugucggguaaugaguuuuguuccguuuuccccgugggaugcaguuuccauguaguugauaguauugguuuacuuguagaaaaguaucaguuuugauaguaacaaagugagaucauguaggcguuaggagucauaaaguacagucccugccuuguuucugugaggcccugaguuugacaccacccuaaccccauccaccuuaaggacggaaaaaguuggguuaaggauguuggccaagugguacaguacguacguaguguaugggagccaccuuggguugacuguccccagcaccauacacuacagaguuaugcaggagaacaagcauguacccucuaauuuacguugaccuuuuguauuaaucaccagucagauugaaagcuacauggcuguaaggcuuaaagaugaagaucugagagauucaaggcaagaggcagccaaacacuucauccacaguuguuuauaugguucagauuccaaaaggacuacugguaauuuucuuauggacuaugucugucucucccuuaguuucucacaaugacaaagcagugaugugugauucuucccuuuaguaaacaaguuccugucucugaacaacaagaggucaccagugaaaaaggcugcagcccaguuucugacuagcaccugggguaagauagcgcguucaucuguuggcuuuaguaguuuuuacaaauaaaagguuuuuggaaggaggugggucaugauuuuaaguugaaagaucuacuuuauguaaacuagacgcucagacuuuguuucuuggguuuugaauaccuguugacuguuuuuacaccuggagcuucuguucucuuauaggagcucagaaacaacaaaaugccaagagguuuaaaaaacgguggauggccaaaaagaugaagaagaaaacuuauaagugaaucaaagucaagugaaaugaaaaaccugcauuuugcaugcauaguuuaagauuacugggugcagagaggguucauuucucaaaauuuagucacugauaaaucauuguaacggaucauuauaaaaaucauaaacauauuuuguuugggaaaacagcuggucacauuucuuuucuagaacacaauugaguguccuggagggagaagcacucacuuaaagaggaaucuucaucuuuugaguggccccaggaaggggaacagagaccauucaugaagucuuuuaguacagcugaaaagcuauucugguguuauugaugugauuccuguugucaaggaauaagaagucauuguuaaaaagcacaguguaaaaaacaaacaaaaaauccacagaacagguaaauaaacauguguuggagaagacuucaaccucagcuaguaccuuuaccucaccauggacgaaauucauuggaauuaaguguuuuuuguucuuuaaagagaaagguaggggugugugugucacacacauagcuggugugucaggagacaauuuauauagauucuucccuaccauguguguccagagguuguaacuaaguaccuuuaccugcugagcaaucuugccagcucuggaacagcuuuucaaauuuuauuuuuaacuaguuuggagguuuugcuugguugacaguuaccuguuaaguuccuauuuuucuauuuccuugcacaguguaagguuuuaacuaaugcaguuaccuaaagguaguuuuagucuguagaacuugaacugacucuaagcaguauaugagaaccuaauacauaaaauucaacugacacuaauaucuguagaaguaaauuuuuaauggcugguuaauuauaucgcuacauuuuuuuuaauaucgcuacauuuuuuauugcaauauaguacucauuuaagcacuuaaaaauggaagguguacaaagauuaaauuaagacacgguaaauugacuaaauauuugguuuuuauauaaauaaaggucauaaccacacuguugacauguaauacuguuauaauacaacaguuaaacuugugagucuacaacagaagucaucuguaguuaaacaggaaacaaaguugaaaaagaccauguuaaaacaaaacuacugggacuaacagguugggauuguaaguagcaacaaacauacucacucagcuccugaguauuucaaguuuuacaguacacauuaaaaaugauuucuuccaucaacacuauuaauucaaacugucggauguuuaugcauuuugcaaguuacacugauugaaugcuuacacaggagcgggggucggaacagcucccaauuuguaguuuacaucacccacaugcuaacacaaacacaacuuguuccauuuccuucccccuucuccccccaacaaagaaggcaggauuuuugguuucuuuuagguaauuguuuuaaaggauuucugaugaucaauuugaacgucugaaauucaguaauauuuaacucuuagacaacuaagagguuaaaagauggaaaauauuuucuccuaacacuaaguuagaaaaucauuugcaucaugcuguaaacuaggaagcaauguaaagcgacaaaaaccuguccccaguacauaauuaaaaaaaaaucuaaauuucaaaucagcagagccggucuacuuccauguugacuguuugccacaaugugagugugagcucuugaagugcauagcuaauguagguagucuuccacuguggcaaaugcacaggacccaacuccugaccgagccaucaggccuagacacuguguggccugucccauggcuagggcaaguggagguugcuuuggcagauuguggguuucuaaggaaaaagaauuagaaagugaaaauagcaauuaacaaccauuuuaaaaaucaucuuucaaucagggccauaaaauauuuugcuacaucagugucugaggaucugaacuaucugacuagcaaagcaaauugauauuucuaagaaagguacuuggggaauggagguacuuuuuuuaauuuuauuuuuugauacauggucucacuuugcuuuccugucuguccuggaauucagagauccuuguuaaauauauauauucaaccuuuuacuucucagugaacauugauggaaaauauguaaccuagcugacaucugagguugagauaaggaaaaucuaccauccaucuacuuaggcauggccagcugacaguaacaagaaaaggcaguaccagguuuucacucaaaguuuccagugaucauaccccacccaccccuauagauaaacuccagugagggcuguuguguugagcugccucuaaggugugcucagaaacauuuuucagaagcaagugaaggccugucagaguacagagcaaagccauccuagagucgaggagguugaccucugauuaguucagauacuuaaauaaauagaauguucuuggguguuaggcauuauuacccucagacauucuguagaccaggcuggcauccacccucugagugcugggaguaaaugugcagucauuacaaaggauggcgugaacuaagggcaacgggacccaacucacaugcuaauauuucuauuuggagaugguguccaaacuuuugaaaaacuaaucaguccucugcuggcaaauucacaggggcaaaaccaguaccaauggcugccaagcccucuauccaauuaucuacaaccucagcucagaguuuacaaaaaacucucaaggaaugaagcauauagaaaauaagagcauggagcagacugggucagaaaauacagucuaauuaaaaguggucugagggcuaagauuauugaaauacucauuuauugauauauacaaagggaaauguuuuaagaguuauaggaaguaucuuugcucacucaagugagcacggggcgggggcauuacuagacugacuaaaggaggccucugcuuuuaaucaucuuuaagcuuuuaagauauauacaacacacaguacauuaugcauuacauaugucugcucaugaguagcaaaaagauuguuuaaauuuaucauuuuuaauacaaauauaagcauucuuaauagauuccuccaccccacccuagguguaacucuguagucccgacuagccagaaagucucuuauguaagaccugcuggcuucaaacucagagaccugccugcuugccuagaguugaagaacucaagaaauuaaaagacacuacaagaaagguagccacucagaaacucauugccuaaaacagcaaucagauauuauuacauuacuaaaaaagcaaucagauauuauuacaucagcuguguuagcaaaaauaagaaaauguaauaauaucugauuauuauuauaaaaaaguucauugccuaaaacagcaaucagauauuauuacauuuucuuauuuuugcuaacacagcugaucuuauuuagccacugaaaauacaacacacaaaccaaauuuguauuauucuacacauaaauccuaauuuaagaaacuaacacaaaagccacuauucuuauacaaauggcaguauugacccuuaucacuggauuaaugauaaauacaagcacuccauccauggcuuccuuuacauuucuguaagaugaauauuagccuucaguccaaguaucaaugucuaaauuacucuuuacucaccuaacgguuaagauucuaaaccucaccaggccaaaauucagcacaaacuucuaaacuggauuggagucucauuuuacuggggaagucaagacuaugaaagucagauguaaaguaacccuugaucuaaauuaccucugaagaaaacagcuuagaaauuaacccugugacauuucauaggcguguaaauacagaauuugcauaaaaguauucaguaugcaauuacuauuuacaucacugcagugacagagaaacuaaccagacagcguuccacuucccaucuacaccgacaaagccuuacuacugacucggccugcaaauguuugagugcagggguugcugguacugcuuaugucuuaagcacaggagcugugacaugggagcuucagcuacccuuacuccuuagggugacuccagcugugauuccugaguuaccugaguacucccuucuagccucacuuuccuguggagcaacuaucacaacucauuggaaacaugcccaaauuucuuuuacagcagccaaaccaaguuuugcucagucuauuaaacauagcuacugacagaaaaguucuguaccuuccuauauugucaauauagucgccuuucucaccugagcuagugaaggucaccuguuaacuugguauuuccuacuucuuccacaacuuagcccuaaugacauacacuuggaaaaacaaaaggcuauuccccaaccauguccauauccucuucuauacaggagcagcagcagcuuaggccagguagaugagagaauuuagaagaagaaugaaugccugugauucccauucccaaaauggauagagugccuuuucaguaugguuuuucauuuagacacaaagaugcccaaacaccuuguucuaaauggaaagacucauuaguauuuauauauaugcaggcaaaaacuuuuccaagauacauuccagaauccaccacuuuaucagaauccauguaaucuguucaguauggaggaaauuuucugcuuuaaaaagaaugauacgucacuacuauuuugcugaaacaaauauuaggacaauauccucucaacuccugagagcguguaccugaagucuaggugacuugcuuuaguuacuuaccuaauauugcacuguuaagagcugagcacacagguucucucugaauugggucaagcugauuuccaacuggacuauuccaaggauccgaauaugcuaguaagcugaaugcguccuguugaaacaaugucaauguguucacagcagcuccagguugaaagguuaagauagucuuaagacacugggugauuauauccuuuaaacuuaugguuuuauguuucagaacacagcaaagucuaacuggcuuccacuuuucguguuuauuucugccauuccuccaccacaagcaaaccggggaaauuaaccaguucugaaggaaugggcuaauacgaagaaggaagagacaaacguccagaugcuuucucacaugugaccucugauaucaauuugacaccaggggauaagcccugccuuauuuuuggacaaauaugggcacugaagagauuucauugacuaccaucucaaguuuagugguaguagaauauuaaag

SEQ ID NO: 7007 - RNA, 3294 nt, Mus musculus
cagccgccuuuccguuugccauggugcagcuccggccccgcuugucgcguauucccgcgccggcugaggcgaugguggacgaggaccaggcggccucggaggaggaggaggcggagcacggccugcugcucgcgcagccuagcaguggcgcggccgccgagccccuggacgaggaggaggacgcggacgacgaagccccggaggagcugacuuucgccagcgcccaggcggaagcccgggaggaggagcugcgcgugcgcgcgagugcucgcaggugcagcgcccgggaauguuggcgccucgggacuccccaggcucggccggcgcugacccgacuccuuuccuuccagggauaaaacgcuguugaaggagaagaggaaacggcgcgaggagcuguucaucgaacagaagguuggacgcgggacuugucgcuuauguaaacucggccggggcuagaguucccuugcuaaaagcuccuuaaaggauaggguacuggagaggugcaagggccauuggcguuucuuggagucugccguaauucaaaguaggcguggaagcacugacacucaucuaucccugacaguaggucuuacaggcuuccagagguggugagguuugcuugaguuuuuaaaauucuaggcuggagcuaaugauuucuuuuuucgcaccccagagaucugauuucgaguggccauaccuaaauaccuuucaguuaguagccgggauacuugaacguugagcuacuuuggguaaaaugacagggaauguauugggcuuucuuuucuuuucuuuuuuuuuuuuuuuuuuuuuuuuuucuuccgagacaggguuucucuguauagcccuggcuguccuggaacucacuuuguagaccaggcuggccucgaacucagaaauccgccugccucugccuccugagugcugggauuaaaggcgugcgccaccauguccggccuguauugggcuuucuaaauccagucuuaauguugucgguuuagaggcagcagggacguauucacagauuggcccgaauucaggacuguucgaaaugaguaacguuagaaguuaucuccaggcauaccuguaccucacuuuaacuugucaucaaaugucuuuauccccaaagaaaagaaagcugcuuccagaugcuguauuagagcagcuaacuacagcuucagaggccgaguaaguauugcaguuucuacgugcauaaagucuguagacccuaagaaauucuccccaaacuuaaaagcuacacagugcuuuuggaguuccucaacuuugucuagcaagauagaugguaaguaagugacugagaacauuuaguguugcagcaggaacuuaaacccagacuuuccuuuagcuugcucuaccugccgccaccccuuucucuguuccucauuucguuuagcagccguguugccagugcuucaaacccaaagcuugaguuuacgcccugcugaauucacuccuugguacauucuuuuuguuuuucuagacaggguuucaguagcccugacugucauguaacucuugcucuguagaccaggcugaccucaaacacagauuugccugccucugccucuuggugcugggauuaaaggugugcaccaccacaccugaccuuagaacauucuaacuucucaagucuuuuuucuuuuaaaucagaauaguaguuccaaauuguugguuacuuuccauaauuauucagaucuuuaauccaugagguauauaagcagauguuugugcuuuuaggugagguccuucucuuuccuacccgaggucaaguguggacccuuucuucucgcucccuccuccauaacuucccaucuguacaggccucugugcuuucucuuccaggcaguuuagucacuccguagguaccuggaacucauccuuggucuccaggguccaaacuguugucuaaaucuaguuucucaauacugugagacuagcaccagccuuuacuugaucuuuggaaugcuaaguuaacaguucugaguuucuauuaacagugcucaaauuuaaguucugaggacacuccauacuagucaaaugacugggaguuguggcagcgcuguguggcucagugaggaaagauuaagggcaggggucaugaaaucgagagaggaucuuggauacuuguuuugaguacucucuauugccugccagucccaucuuucguuuuuuuuuuuuuuccucccgcagcauaaagaaaucaccagaaaacguaaaagguaugacuuguccuugguuaaguaacuucauguaaugguaaagugcacuugcagaaauuuuugguuauuugugguccuuaggccuggccaaaguuggcuuaagccuguuuuccacuauuuucuucaaaauaaaaccuguacucacaugauagguggucaccaaagugaguaacuuccauuagguguuaauuuauauaaauacuacuuacaaaguggaucuuauuuuuucaguuaauuugaaaaagaaaagugaacagcaugcaaaaggaagaaacuccaagaaaguuaaaguacagaaagugcagucugucggguaaugaguuuuguuccguuuuccccgugggaugcaguuuccauguaguugauaguauugguuuacuuguagaaaaguaucaguuuugauaguaacaaagugagaucauguaggcguuaggagucauaaaguacagucccugccuuguuucugugaggcccugaguuugacaccacccuaaccccauccaccuuaaggacggaaaaaguuggguuaaggauguuggccaagugguacaguacguacguaguguaugggagccaccuuggguugacuguccccagcaccauacacuacagaguuaugcaggagaacaagcauguacccucuaauuuacguugaccuuuuguauuaaucaccagucagauugaaagcuacauggcuguaaggcuuaaagaugaagaucugagagauucaaggcaagaggcagccaaacacuucauccacaguuguuuauaugguucagauuccaaaaggacuacugguaauuuucuuauggacuaugucugucucucccuuaguuucucacaaugacaaagcagugaugugugauucuucccuuuaguaaacaaguuccugucucugaacaacaagaggucaccagugaaaaaggcugcagcccaguuucugacuagcaccugggguaagauagcgcguucaucuguuggcuuuaguaguuuuuacaaauaaaagguuuuuggaaggaggugggucaugauuuuaaguugaaagaucuacuuuaug

SEQ ID NO: 7008 - RNA, 2144 nt, Mus musculus
uagagaggaacucuaagacauagugaggugugggagauuugccaccagaccuaggggaagucagucguaugaaacugaggagagguaaccagccauguggcaggcauagaauaguauuaacgaguuaagugaauuaugagcuagucauagaaacaagccuagcuuaaggccuaggcauuuauuaauaaauaauaagccacuagguuguuauuccggaacugggcugaggguggaaaaagccugagguuaagugugugugugugugugugugugugugugugugugugugugugugugugugugccaggguaucuaugcagaagucagaggacaacuuucauuucaggacucaguucucucacucuccaaacggcuccaggggucaaaccccaauauucaggcucguaggacaaaugacuuuaccugcugaucccucucaguugucccuguaaagugggacugcuuucaauggcugccccuuggagucaguacauaggaagcacagacgcuguccuguaccuugacgucaccuucccugacaguuugcuggucucugauaucagccaauaaugccaauuggcagauaaagauuacuaaaucauuuccuaaaccuguccggcuucccaagaucuuacucacgaggcugcugaguugauccaguccuggggacaccaguugggugagacucugugggacugucauuuuggggucauaacauguaguaucccugcuauuauauguggaacaccauagagcacaaacaaccaacaacuuguugguuaaauagaccaauaaguagguaaguagguugagugggugaaggcacuggccaguaaggcuaagggccugaagcugaccaguggaacccacaugcuaaaaggagagaaccaacacacauaugacuuccacauuugugagguggcaugugcaugucaacacacacacacacacacacacacacacacacacucagacuauauguaacuaaaacuuuuaaauuuuuaacagguaggcucacuggugcacaccccuacuuccagccauucaggaggcugaggcugaggcugaggaagugcuuggguccaggaggucuggacuauaggaugcuaugcugugagacaucucaucuugccuagggaaggagcaaaccagcagguaagauaaaccuguuaaacgaacccagcuaugaccucugaauucuucuccacauaauucuacugaaagcucccacaaguugauuggauuuggcagcacaaggaacccuuuugcugugacugcuuuaaggaaauacaguacagcaucugccaacacagaacacauuugcucaucucugcacaaguguguguguguugagaacacgcauaauguguaugcaaauacaguuugcuuagaacacgagauuuucugccgcccucccucccaccucaucccuaaauauacaguuucgugaaaaccacaccugugacugcuuauggggaugggaaaggguccagguuacccucuccaauuuccaacccucgccuaugaauuucuaagccaugcuuccugugauaaaccacagggccuggcagaaaggugcaaaauauuuauaucugggucuaacaaaguuuucauuggcuuccucgcacagaguucauuacagccacguuuguggacucugcucucucaucucucccucccaguuuggcuuccuaccucugucuucgcggcuuccagcucuuuaggaugugugaagacucagacaccaucagcacugaaguagacaucgguagaucccgugagugguuaacauuuucaacaugucugugaaaaccaacuggaaaaaugagcacaagaggagcagacggaauuuuuacguggugucuuugucuccuagcgugccuagcucagcuucaggacaaggcgagagaugcgauguuucccuugccauuggaaaagacaauuccaaauuagucuccuugucaagcccuuuacucacugaccucuccucacaacaacaacaacaacaacaacaaaggcauucaaucagagagcugggcuuccaaccaagccugugaagaaucuuccccuugcuucccccuuugcgucucucagaaaccuuugggccaccacaggaaggacauaaaaugacuucaucucaccau

SEQ ID NO: 7009 - RNA, 3830 nt, Mus musculus
acaaaguccaccgcuuuauuaaaagaaccucuuuuguuuccacaacauuguauggaguucaguccaggcugcaaaggagggcccaucccccaguauggcacacauauacucucaacuuccaaauuuaguuugggacacauuaauugaaucaggacucucacaugcaaaugccaaauagcacuuaucuccggugacaugucaccucuaaacucccgugucaggguuuuuaaacauucugcugcuuccugugaacucauccuaaccuuuaauuuaaggugucuggauagaaaggauacagcguauguaugguuuucuauccucugugguuucagggcccacgggggguggggguggggucuuagaacauaaucucugcagauaagggggcaccauauguagacguaugcaauccuguauuaagucacucacgguugaugaaagcccuucccccauagugggacuguguggaugaacaaggucuuagaggagauaugccacgcucuuaugucuaccucaaucuuuucacuuaagagauucaaaguaaccaguuugugguuuaaauugguccaaguuguuccuuggauggcguucuauggugaguuaggggaccacuguggcugccaccuugugcccacuuuugcaccaugaggcacuaggcuuaacuuugcuucagggaugcccuguccaauccucaguguguauuauucccacauagcaggcuccucccccaggcuccaggcaugauauaugugggcuagaauagaauaugaguguagacuucuccaucccaugagugaccacaugagccaacuagucaauuagucagucaacauuacugagaagcaagcuuaggaagcaaacuguuuucuccucugcgccacuuaacuggcucauaagaagauggcucauggagguaccaccaugacccccaguggaaauuccaagaaugaaccauuuuacugaagacagcuggggaaacugaggacaggagagcagccuccaugaccuccaugcucucaaacaacauuguacuugacaccagcucuuuucccgaggucuaaaugagaugugccaagaaucuauuuugcuugaugcuauuaggcugcuugcuuacuggcauggccaaaacgcuccuguuggaugcaggaaguaaguagguacugagaggauuagacccauuuuaagauggaaagauggacaggaagaaaggauagccccaucaguauaagagucauauggauuauuuacagagaaugguguacccugaacauuccuuuauggugagugcaaaauccucccugcaggcucauguguuagacuuccuguuccccacugggugccaccauaccauacguggaggcugcagaaccuuuaggagcugggagcucacugaaggaagcagguugguagugggaaaggaggucuuaagguucacagcccaacuuaucucuguuuccuggcccaucaagauggacgcaagcaaccugaugccgcagcucagagcuuccaagaucucugccaugguuccuccaccaugaugaguuugcagccucucaaagccugggcugaagcaagaucuuccucucuagcauuccuuccuuccuccagguuuuugucguggcaacaagagaaguaccccaugagcguuccaacaccaaaaugucuuguaagcauucuaacaccaaaguguucuguaagcauuccaacaucaaaauguccuguaagcauagaggggguuuuaacaaaacuuggcgcggaauccugguauagaaacugacgucuuuuauuuuucaaauauuucugacucuccaauugaguccaaauugauuugcaaagaaagcaaaucucgggguggacaaacagaagccucagaggugggagggaauaguauauguggaaucuacaauuaucaacucuagauucagaagaguuagagaaaaaaacaguaaggaaacgggaaaagccagauucauacaauccucuuguccuuaagaagucggguggaaugugccaagcuaaauaagugugaggaaaaaucaaauccugagggcuuuugaagaugccauuuuucaucucugaaucuguucucccagcaccccaccugcugcucaguguagcgcuggagcguguuaucugucaugguccccccaauuagcacuuugaaugcaaccacagcaauggggaccgugcccucuaucugccaugggugggcugguuucuacaauuaagcugaaguucagguuuuggcuaauaacagacaagggcugugacagggaacggaguccuuauucauuagcucaugcuaaugggcgcuagaaccagccccgccaccagccugcuagugugagagccaggcauagagugucacucugaucucagagugucugcagguuuauuucacaacaucgcugaggucuggcaguuaucuaaucaggagcaguuuuaaggggaaagaaagggauaauuuguuuuaagugccagccuucagucuccguauucuaugaaacagucauuaauuaucaauacaaggcugauggcauuauuacgaggccugugugcuuacacagagaccguuccuuggauugcacucagcgcuuggugaguguagggaaaauaauuaucuuuuauuuacgugaggcaaacgguaauuaucacaucagucugauaguucugaaaagauaggucacugcaaagaaagaguuggacugacuacagucaucccccccuacuacagcauccggauucccauuuagauaaugcaauccucacaugcucgggacucacauaaaauggcucaguguuagcacagaacccaugcauagccuccucugguugccccuugguuacuuaggacaccuacuacaauguaaaggcugugucaauagcaguuaucucuuauuguuuaaagaaugaugauagggaaaauuauguacacacuuaggacuuuuuuuuuucaaguauucucaagcccugggugauugggucccagaaugaggaaucuguaagagcaagcuccaccuguaccgcauuggacaguacuggauguagaacaaaugacgcucguggcugaaacaacagcuauuccacagcuauuauuuucacauagaacuauugagugcuggggcuggagagacaggucggucaacaaaaguguguggcaggcaacccugagguccccagaauccacgauaaugaacaaacaacuaggcaugcugggagguagauacagagagaaagacaccuagggcucaguggacauccacgcuagaggaaucaaagaauuccaggucaucacuagucucucaugauccugcuucaaaaguaaaagagaagaggaagagagaagaggaaaggagaggaggggagaggagaggagaggagaggagaggagaggagaggagaggagaggagaggagagaagagaagagaagagaagagaagagaagagaagagaagagaagagaagagaagagaagagaagagaagagaagagagagaaggaaaaggacccuugguuuuuucacucaugcacauauacacauuuauuugugcuugcacaugcauguacauccauacaaacaugcccccccacacacacauacacacagguacuggguacccaccaagugucaaguguucuaguagcuguaucauguucgauauuaaucaaggcagcucuccccagucuucugcccacuugaguucuuucacccauggggaauuagaucucaggaggcagagcucagucaugugucccaugcaggaaaaauuguaacagagcauuuucugcuccacaccgugucuuugacugccccucauaggcagguccu

SEQ ID NO: 7010 - RNA, 2259 nt, Mus musculus
aaggaagaaaguguucucuuaaggaaaaaacaccauuguaaccacauugggagacaguuuaaauuaugaugguaaauacaguuauuaugucuccaagguuugguggauaccucuuguuaacuauuacauaaaaauccagucagugauguuucaagaugucugaguuuaucugugucucagcagcaucccuuguagcaaggaaagaagugaccuucaguugaaagacaaaggauaaauacucuuaaacauuugcacgugauuuaucaccacuacuaucaauuauuaaucgaggaaggauugacaugugcucaauguggguagagauuuuuguuuaagcgccagcccagagagaccuggaaaggaaaccaacagaggaacaugaauuauaaauacagauccugcuguaagaggucgagggaaguaugaacggccuccauggggaagggcuccgaaggcugcagccgccagaacuuuguagugccguuaguguguaaccccggagccagggcaaagugccuuuuuaaggcuugcuagggaccugcauccaggccuuuccugagaaaggguccaugucagggcagggccacaacucugcaaaucuucagaggaacuuauuuauguacuucaaaaucacucaacacacagaauaucaagaguuuugccuuugggugcugggaagaaagaaagcgguuaagagcauuaagggcaacaaugaggacacaaguucaauuccccaacaccuacauaaagagccaggcauggcugugcauccuuuaaugccagcacugagggacagagagaggugcguagaugcauuuuaugacaaagacucaggccugcaggcugccuaauuuguugauaagcgaauucucagagaugccauucuggaaaagacucauuuagaaugcagcagguggaaggauugggugccuaauuuauguauuuggauaucaacaugcaauaagcaaugguaauaaucacaacaaucccugcugguucuagaauguucccgggaggagaacuguaauuaggagagaagccagcauuaaguuuggaaucuugcuguucuucaucuaucuucucagcauuccucuccuugguuucucagcaucuugauguauucuggccacagcagauaaucuuccugugugugucgcccucuuuccuccgcuauccccauugcucuaccucuugcagccugagucgcuagcauguucgcugccggggaccuagcauugcacaaauucgccaucugugucucaucaggugagucccguggugccgcuguuccaucuucuugguggaaggacugucaauacauuuucacagggcgagggaaaugucucuucugcccuacaaaggucaugaacucacaauauaucacuggaaaagaaaugcaccgaaggcacacaggagaaugauggccgucugauaacucaaucagacucaggcacucuucuucacaggagagugggggagagguguggaaauggaagcaguuuuuuuggggcaguaagugaucuucagacagcugagugggccccaagaauguaagaguguaaaugauucucucuggaagcuggguagauugagaacacacaauggcuggcaaugaagccuacccucuuguaguaguuuaguccauccugaccaaagaagccucaggaaaggaacugaaggcaauuugucucauuuucguugacuuucuagagaaucugucgugugcuguauggaagcaucaccugucaauaaaauagcuguuggccuauuauuagcuuaggcagaaaacaggaggugggaguucuggcagggagagaggauucugggauagagucgggugugggagccaguucaccccaacagcugacgggagagucuucaugagcccgaggagagguaacuaaccauguggcaggaccgagaauagaagaaauggguuaauuaagcuacgagcuagucggggaguaggcccaagcuguggccuaggcgauuauucauaaauaauaagucccagagucauuaucucgggaacuuggaugaaagcggaaaaccccgagauuacuguugggagccuuuuaggugauaaacgaauguccaagaguuuucucucuguuucagagaggagagcaaggggggcuggagagauggaacgcaguuagguguguuugcugcccugaaacauuaggaggagcaaagcaagccaugaagggugucuccgaagcugucuguccguuuucguccguuuucuguagcgacucu

SEQ ID NO: 7011 - RNA, 2266 nt, Mus musculus
ccuuuggugaugaacaucaauguagaaguguaagcugaauaaacccuuuccuccccaacuugcuucuuggucaggauguuuugugcaggaauagaaacccugacuaaggcaauaccuauaucuaaauaggcauuugaccgaauacaugagcacuguggcugaguugauucgccaggacccaaggcugaaaugaucuacuuucugagguuuaugaacaaauuagccgagcucuauauacacauagagacuuuagugaauacguucucacuaaauuuacccaucccuccugggaaugcuugcucucucucucucucacuguggcagugacgaguccuuggugucaaauauuccugaagucagcagaguuuucgucucuucuuuuccuuccuugugcuguaagagucuacagguuuccuguauggcaaucuggggcagagccugaguccuccugguccccuggagaaccaggcuacugggcauugcuuuucacuggggcccucagagaggcccaggagaagagaggcuccaagggagggcagcugaggacagaugcccugggaacuguguuguuguuuauaccuuggcaggaagcagacacccucuuuaauuucccuggcagggcaugcaugcagaaugccuauuggccugauuguagucccuguuguguccuggccucucccagccuggaaggauugucccagaaugggccuuucuacuccccagcccuuguugccuggcucccuuuuaacucuaaagugggcucuaucucucugggacagcuguccccuggcuggccucucccuaccugaccaagggagauaccuuugagagucaggcuucauggcagccucuguuuagagaaggggcaauuuucauuuggccuugggauuaaaaacagagcuaaaugcaaaagaucagagaggacaauggagaaggaaaucugggggaggaagaagccaaaaggagggguggguacagggauugggggguggggggugggaugaagacaccagugaaagaaucaacucagcuuucaucucugagucugaucuguuuugugaacccuaaugggaaaggucaugaauuuuaaaacaugucucuccagccgacagcuccagucauaaaaaccaacccugucgaaagcucagcuggcacuggaggcugggcccauggaaucugcagacagggaggcacgggagugcaggcccuugucaggaagugagagcaaaccagccugaagccaucagccugggcaggcucccagcugcauuggguagaggucugcugcaugccuggccaucagcgauuuuuugagcaggccucacauggaugcuugucgcugucaguggcaaaaaaaaaucacacagacaccugcugcagucucugcucacugacucucaagguaggggaagacacagacuacuggggacuggccucucucaccagggucaugaggauaggccagcucaagaaagcaaggggacacaucuucaguaacaauucccaaagggugagucugcagggucgcugagccugcaacuggccaguuuccuuauggacaguuuugaaguagcaaugagguuaagggucaucaaagcaugaggagcuguaauaaagggucacagcauuaggaaggucaagaaccuucuagauacuucuuauagauagccuuguggcucuggaauggaccaacagggaagccacugggcagacugauaagggauuuucauaaugagguuacauggagugaaaagagguccaauucaagugugggugacagccaggcaaaagaaagucccagggaaaaacacuuuugcuuuuugccuggcugccuuccagucaugcuugcagguacaucuucucuguccuaucuacccuauuguugcuguuauucuucuccagccuucgaaccuagacugaagaccacagugucuccaggaaucuuccaggccugcagcauccaccugcgauggcccagguaccuagccucauggacugaagagcuacaggggucucaggcucuccaguaugaagacaaccauuguuggacaacccagcucauuuccugcaagccaaucuaauaaauccccuucuaauguguaucauucuguugguucuguuccucaagugaggacacggaucagacagaaucggcccuucugcgaucagcuuguuuaacuucacaugacaucuucacguuuguuccugucauaguguauuuuaaaauggugguaaaaauauaugggcaugagguacuguuuaucau

SEQ ID NO: 7012 - RNA, 950 nt, Mus musculus
gaaacucggaaugaauguguaucugacaugggcuggccauguuaaagauucaugguaaacuagcaaagcuuuucaccucccucaaucagguucagagaagcaaagcucucuucugggccaaauacaagcguuuaugaaugauugacuagugugugcaaaaucgcaaucgcaguguccugagacuguucaacugcaggaucagcuaacuccuccccuuaacaagcagguugagguuccugccuguuguuugguacuugguaccacuccaucagaacacacacagcuucucuguauguuugucuaugugucugugugucugucuuuuccacauucccucgccagcccuacucagggcuccagaacaaaguaguggaggcucuggcaccccacccacaggccagcagauaugaaaguuggugacugugcccaauggaguuucaucuaguuguaaaaagcaaaacugucauuuucagggagaaaauguauagaacuagacaacauugugcuaggagaacugagccagaccuagaaaggcagccaccgcaugcucucucuaagacguggaacaugaggggcucuauguugguuuguugguuuguuuguuguguuugaaaguagaaggggagcugucugggaaaugagaacagaggagggagagagaaaauguuaccauucugucuaaacuccaccccacaguuaccuggcaacagccagggaggccuggcccacuacaaaaggggcugcuugcccucuccucucuuucuuacucuugcuuccugcuugcuucccucuuacccucuugggcucuucccuuccccuuucccuuccccacucuuucuacgcggucauggccagccucuacuucuccacucucacucucugccuuucucugccucuacuacccucuuagcuccccucccuaugcccugaauaaacucugcucuauacua

SEQ ID NO: 7013 - RNA, 379 nt, Mus musculus
agagauggaauccaaccccaaucagaaugaaaugagucuucagauuccaagucccucagaaucagcaucccagccaccugccucacccucugccugcacugaccuggacacugcugaugccccccucauccagucugaugaggaggagguacagguggacacggccuuggucacauuacacacugacagaaaguccaccccaggugucagugaugacagugaccagugugacucaacucaggacauuuaagugacuugucagcugugcgcagaauccuccugcaaagccaggugcuuagagguuuucaauuuuacacacuugcuaaugggauguaagaaccauuagagaagcgcucacaauaaagcuuauggaauaaac

SEQ ID NO: 7014 - RNA, 855 nt, Mus musculus
cuuuuuuuuuuuucuuuucuuuuuuuuuuuuuuuuuuuugagcaguagcuugcaacuuuuauuugagaaaaacagcagguaaauguauguaucaaaagagcgcacagauugacagagagggguggccagcaauggcuaugggagauaggcagcaggcugauggcuucuacuuggcuccagacuguucggacuucccagcuucugggcccccaauuugggcgcgggccucgaaagugaucggaauggugaucuccgcugacugcgugacugcuuugggcaacggagccuccacgguaagugugcccucaggggauagggaagaggacacuagggugggguccacaccuggagggagcguguauuuccgggugaagcaccgagagauguagccauguucguccugccuuucuucgugcuugccagugaucuccaccacgccuuccuuggucuucacugugagcuccuccggagcgaagugguugacguccagggacacgcgccagcgaucagccgucugucggaucuccgagaccccgcugcugagcugucgguugagcgcucggcugaaggcuggugcggccagggucaccgccgcggggcccucggcggucgcggcgggcagcgggcgcacguauccgggccacccagcggcgcugaaccacugcgaccacucaucgggcaaccggggcaccccgaaagcuugaucgaagaggcggcugugugcaggguaccagucccggaaugguucccagcucgggcuccgcagcagcgagaagggcacgcggcgcucagucauguucuuggcuggucaaggcugaggaucuagaagcacugggcugaggauccgagaagucu

SEQ ID NO: 7015 - RNA, 2462 nt, Mus musculus
agacacucacuuuggggguggguggguuacagauaauuuuuuuuuaaaaaaauugcacaaaagaaaaaugaauguugaaaugauucauucaguguuugaaagagacagaucuguugaaacuaugaguuucauauuuuguguguaaaaaaaacaaaaaaacaaaacaaaaaaaacaaaacagaggagggguuugaaaguuacauguuuggggguuuauuuuuccuguauauagcaauuuguugucuugaucaucaaauuuguaugguuauggccuggaagaauuaugaugucagaggcucuucaacuauaccguaccuaugcuuacuguucuguuuuuguuacacacggcucuugugugaaggaugggggaacucuguauuccgcuauuugaggauacuguccauuccuaggccgaaaguacuucccuaaguucccuucuuaagccauugcaacuuuacuuuggaugaugucugacauuuucagcacuuccuguuccuaucaacccaaagaauauaauccugaacaugaaguguuucuaaaagggauccuccuucccaguagacagaaaaaagucgagccuuucuucugccucccaccccagaccucauuccuacagggguagaacacccauuuuggcuugaaugccuggcuuuuguuuugauguuucucaaguagaggccagacgaaaugcagaacgguuucucagaguuauauuccagcucagcaguugcgcuggguggugcaaaccagacagcgugggggcaguaaacagacccuaccuuuaauucuucaauuuggguucauguccccucccuuaaggcgcaaguucuuauugcuuagauugaccuugacaaaggcagaagcgagacaucgggucagcuuuucacauccugacacgugcauacaggaacuucaccuguauucagaugaaguguguuuggccaauagauaccgucuacaugauaccagucucuaagaacuucccuaacacuuuuuaacugaaaggaguuaagucuuccacuacagaucacuuggagacuccauccacgcauguccucuugucccuuugcuugccuggauggcucaugugaaggccugugugggaagcacuguuuacaguaacccuuaccaagauaauauacuguccccuagacuaccgagcugaggugacacuggcuuagaacuguuggagugaaagaucaguuacuaagaagguuggugcacagguuuucuccaguucuuacaggagccccuugcucggaaguuauucuccaguccaagggugggaugcacuguugaguccaugaugaggcguaaccauggcaacccaccacagucccauucugugacuacugcccccuccccaacccacacugcucaagugugacccagguagugucagcagaaaggggguugcgguggaguccugucaguauuuaugguggccuuucgguaagacagucuacaucucuaaccaguggagucuuggcccuccggaaccugagaucugcaccaguugaaggguuuuaacaucagguucccagacccuccaauuuccauucauugccuccccacaggccaagcggaaacagacaccaaaacuugggcuaaggguacuaccauguggagaacuagggaaaacaaaaugguuuuuuuuuuugcaccuuauugaaaagaaacuuuuaagugcauacauaguuaagagcuuuuaucgugacaggagaacguuuccauaugcgugcauacucucuguaauuccaguguaaaauguuguauuugcacuagcuuuuuuaaaacaaauauuaaaaaaauggaagaauucauauucuauuuucuaaucguggugugucuauuuguaggauacacucgagucuguuuauugaauuuuauggucccuuucuuugauggugcuugcagguuuucuagguagaaauuauuucauuauuauaauaaaacaauguuugauucaaaauuugaacaaaauuguuuuaaauaaauugucuguauaccaguacaaguuuauuguauaauacucguacuacuaauaaaauaacagugccaauugcaaaccugugucuucgccgucugucagaucccuaaagaaagcgguggcugaaaagaggggagucccucuucacugaccuauccacaucaccucagugcacccuggggagaccggugugagaugaggcaugacugucucuaaccugccaucuccucucugcucaacauucuagguuuuucuucucaaaugauuggcaagcuuugugccuaauguggcauuuaucagugacgucuucaguuuggcuccaacugguaaguaagcugugguugcuugagcagguuucccuggcgugcauacuuccuagaaaccugugggacagaggucuuccugcaugagaaagccugcucugcaacugucucggaaguacugugcacaggcugguguugggcucagcuuu

SEQ ID NO: 7016 - RNA, 2530 nt, Mus musculus
acacaagcuccucuccucaaagauggaggugugaaugagcggucuugagauuuucucagauggcaggccucuguccucuucuccauugcucaugcugaaugaugacuaaggucagcucuagacuucgcgucugguaagguucugguuggcugucccuccacuuccucuuucaacgcgcuccuuuccagauaauuuuagaaaccuucaugagcuuuuaaaauaauaaaaaauuauaguuaucuacuucccuuuuaggccccucccccaagagcccuagaucacguucauucacaggguacccaguccucccccaagagcuccucugaguuugaggcagagccucaguuucaguggguggggaggacucaggacaagaaugggaagaucguguagacuguaaaauucucuucuauugugaaguagauuccacaaaagccauauuagcugauuacccuucuggugccugcauuuuguuuauagcguaggcagcaaugggggacucaguucgccuuccaaggagcucacugcacccccagaucacacugacaguccugggagcuaaaucucucucacuuuccccucuauaacccaaaggcugcccguugcguccauguggaaguccauccugccucccccacaaugaugccaugucuauuuaaagaaauguuuuugagcaagccaucuuuucuauugguucucauagagugucaauguuggucuguuuugcaucucuuacucuuuucucccugaauauuucuagguaguaauuaauccuaguucccaguauccagucucagcaaauaauuugccaucuucucugaaaggagauuagagguaacuuuggguuuuuuuuuuuuuaauuucaaauuuauuuauuuuuguguauccauguuuuucuugcaugcacguguacuguguguaugcacugcccauagagaccaaaaggcagcccuggaauccccugaaacuguacaguugugagucccuguguagguucugggagcugaacccaaguccucugcaggaaaaccaaguuuuccuaacugccaagucaucuuuccaguccccuuuuaugagauucuuaaccaaagccacaaugcaaaauggcggugcaaugaaccaaaugggaccagccagcacacuagggcuaucagcucacuuuacuucuauccuaacacagggagguaacuauggcuuaccccauugguggaaccuugaccuucacuaucugaugcgauuagcucauucucaauuggugugaagagggaagcuguaaauggaguccagucucagaaaugauugacaugcaaggauugggcaaacaggcaagaaacaguuucacaaggugagggagauuuguagaccaccagccauugguggauaagccauuguugacaaaaaagccuguuccucacagaaacaauccauccuagcaucugggucccucccucucugauaaucagaaggacaccccaccucaguguuuggagccuccuuguucuccacagacuucucgcugacucaacaaugucuuccccggcauuucucauuuuuuuccuuugauaagggaugauggacuccagucagcgugaggugccacauuaagagggcaugaaucuagcuaaagucucucagcaagaaugucacucugaugaacaacauuugcaguggccuuugccugcugcauagagacaauauucuguuuguuuuucccaaagagauucaaauaagaacauuaaaauagcaauauuuacuaaagccuaagcauauauggccuucauccuugcccagaugugauuuccugggaaauaucacaaacaauacuuaguuugcagucaaaguguaucuuaguuuccccugcccaccucuggugauguacuuccuccaggaaagcugucccaccaaaaccuccccaaacaguccccuucaaaugcuguguucaaacgcuguguucaaaugcuggagauaaggguggacauuuuccacucaaggguccacaacaagcaucucauagaagaacuucuccggcugcuauagauggcagcguagugcugugucuauggcccauaccucacucacucugacaacacugaaaucacugagccuggugguggccaacacauggagacccagcuacuugccagacuaaggcagaaggugcuaguuugacaacagccuggguagucaaccagacuuagucucagaauaaaagagauaaaacaggguagggguauaccucggugguuaacccuggauuccauccuccagcaccaugacaggcaucuaacugugugagguauggauucccuucucuauagaccuguuauuucugaggccccagaauucagauuagagggaaaucgggguagccguuuuauagucucgaaaauucagaauccaucaccguguuccuuugguccaaauggucagguauagcugaggcccagagccucaacaggcaagaaaacuccacagcagccacagguagaggaacaaacagcacggauaacaaccggccagaaccugucug

SEQ ID NO: 7017 - RNA, 8606 nt, Mus musculus
ugacgcccacugcugcugugguggcgagcgagcgagcgguuggggaggggccgccgagggcgggcgacggcgccuugacaggcagcgcggagggggccuccggggcgacgauggcagaggggcccgaggaagcccggagccgcccuccggagcaggauggcaguggcggggaccacgagccggucccuuccgagccaggcucucccaccaccaccgucgccgccaccgccgccgccccccgguccccggcccucgcgagcgucgccucggcagugucggagcccgagccgcagugcgagcuccgcaagcgccgggagacgggcgcggagccuccggaggcgggagacugcgaggcgucggacggcccggggcggcugagcgcgcgcgaguacucgcggcaggugcacgaauggcuguggcaguccuacugcggcuaccugaccuggcacagcggccuggccgcccugcccgccuacugcggcccgccaccacccgccgccaccgccccgcagcccgccguccccucgccgucguccccgccgacgccgucguccccgccgccaccgccgccgccgcagcuggcguacuacaaccccuucuacuuccugagcgcugcggggcccgggccgggggcggccacgggcggcgccaccccgacggcugucgcgggccucacggcccgggccccgcacgugcagccaucggcccgggcggcccccgggaccaggguggguucugcagccccugcgcggacugccagcgacaccgggcggcaggcaggugagaucgggguuggcgcggggguggggugggggguguuggguaggauggaggagggauagagucgagguccuuuuuaaaaaaaaaaaaaaaaaaucacugccauuccuaccacuaacauuuuggaaggaucucacccugugguguaggcuaacacaguauguaggccaggcuagccucaaacuuggaauaagacaggucuguacuagccagaggggucucuugaaggaucauugaacaaguaugcucgcuccugaaaaaauauaaccggggagcugcugcuaccauugauaguucccacauacaucagcuaugguuugcccaggcccuaaauucuaaaaacguacugugaagcaauguugauuguccuucccuuaagaccuggcacggcuaguagguucccuuacuccugacacuagcccuucuuguguguagagacguaugcuuaucaaaccauccucucuguaaucuucaggcucuggaaagauccaaagcuagccuuggguggcaagcccgcuguugggaggcucgagauuagaauacuagaaaucaccaagacuugggccguguaaagacaguggaacugaaaggcgauugacaugauuacaaaacgagucuagagagcuuugacuggccucaagccuauuggucaugaauaucaucuaguaaaugauguguagucacuggucuuagcaaaccguaggaaaguuugcagccagucuucugagucuggggcuggaaugcugggauuacaggcauagcucaccauguccagcucauuauuagauauuuuagaaacaggaucucuugaugggaucauugccguuggcugaugcaaagcuauaaucuuaaaaaguuuaguuggaccuugacuuuacuuugccgcuuucuuaucuggcuugguucuuaaacuuguguaacucauuuuuuuucuucuucuucccaauuuccagguagagaguaugucauuccauccuuggcccacagauuuauggcagagaugguggauuucuuuauucucuucuuuauaaaagcaaccauugucuugagcaucaugcaucucaguggaauaaaguaaguuaagaacagucagaaaauucuggagcugucauuuagggaucuuguuuuguaaauucuguacaugcucaugaguaacucuggguaauggauggauguccaagaccaagacuucucuaugaaaucuuuaccaguucuauuuguuucccuauugguuguuuuuaaguguguuuauauguaaccaagaggucuacuuugguuaucuucuaaucucuccuauauuuuuuugaggugggaucucucacuugacuuggggcuugucaucucagcuggaccagcuggccagcaagucccuaagaucacugguccucccucucagugcuacauagguauauagguguccugggcuuuagauggauucuggggaugcacucagguccugacauuuuauauaaacacuuuacccacugagcuaucaccacaagccccuugguuuuaagaaagaaacaaagaacuucaguauguuguuuaaaaucugagggaaaaggagggaggcuuugguggcauguuccuuuaauuccagcacucaggaggcagaggcaggcagaucuccgugaguucaaggccagccagaguuaaauccuaucucaaaaaagauuuuaauagguuaaagaagccuucagaccuggcuuguuuuuuuuauuaaccauucucuugggccaggaauguguuaguuuccuucuuauuggccuaugaaggcucugccaugaaagcacagaggggcugggucgguggucagggguuaagagugcucacugcuugucccgaggcuccaaguucaguuuccaugucaggcagcuuaucacugccucuaacuccagcuccagccucauguauacacauggcauacauuuguauacacauacacacacacaauuuucagagcacaaagagcuugugguagguggacuuaguaaucaauuucagugggguuguuuucaguugagcagauucaaugcaaaguauggcauuuacuugagaaacucaaguuuuaggauaaugccugcucccaauugcuaagcauuuucuaugagacacuuauuuacguuuaugagacgaugucagaauugaaaagaagauagaaaagucaagauacaaaguaguguuaaccuugggcccccgacagguguuggguagcuccugccuguccccuaacacagccuuuauuauuauuguuuacauuuauuuauuuggagggcagaaaaaagcugcagaacuuaaccucuccagccuuaacaugcugcuguaguuucuaccgacaagauaaagucugaauuucauuacaugguuuaacaugcccacauucuccucagucuccuuacaccaugaaauugagcccuaucacuuguuccaaggcuuucucuccugccuggagcuucuuccugcuucuuagucuggcuggcuucucuucauucuuuguauuguauugugcacuuagaaaugucauuucugagaagacuggucuguuuucugugguguucugguuggcaucccaguuuauuuuuguucuauuucccuugcuugguuagaaucucugugaaagcugaggagauacuuuuaguaucccuugcugugccagugugcccucugaugcagugauaaauaccaugaucaaaagcaacuuugaaaggaaagaguuuauuccauuuuacagcuuguaguccaucacugaaggaagucagggcaggaaccuggagacaggaacugauucggaagccauggaaaaaugcugcucuucauggcuuacucagccugcuuuugcuuuucuuauagcacccaggaccaccagcgcagggguggcaccacucacagugugcuaggcccuucccacauccaucauuaaucaagaaaaugucacauagacuugcuacaggccaaucugauggaggcauuuucuuaacugagguuucccaauuaaguuugaguuuacaaaccagucacugcccuaucaucagggcuggcaucuuauuugcucugcagugcucuaccacugagguacaaacuaccccacaaucacaaccaugcuuuugcuuuaauuuacuuagguauuuguuauuuuuuugaauaaaguaauggguauuuuaugcacuuuguuggugagaaccuaauagcauagaauuucacuuaaauuuuaugaccuaauuaugggaaaaugguacaaaacugacuuaggagcuaauuccuucuaaccccaaacccuucuuuuugugcagggacaucucuaaguuugccaugcacuauauaauagaagagauugaugaagacacaucaauggaagaccugcagaaaaugaugauuguggcgcuuauauacagguuguuaguuuguuucuaugagguaagcugcuaacuggagcaaguaaccguuuuaaugguauuuuaaauuaucuacuaggaaaaaaaugacaauuuacaaauuucguaaauauuugucauugaguuuucauaauuuuuaaaauuaacacuuucaaguaaaaaaaaaaacccuaaauacuaaauuuuggaaaaaagaugccuuguuauacauuucaguuuuagaaauaacauuucauucauaagcagauuuuaguucagagauauacauauuacggacguguguguguguguuguguaucaaauaugucagucaucuuuccacauccucuggaguuccgagauggcaugugcuaagccagcuuaaauggauaaguuucuaguauucuauguaauuagcacauccgauguaccuuuuucuauagcccuguuuggcuugaaacuguguaucccaggcugacuuuaaacucacagaaaucccaaguacuggaacuaaaaaaagaugugugccaccauaccuggcccuccaacaugucauucuuauaaagcaugaaguaacuuacuagaaaaauuaguaaacuguuuuccaauuauccuuuuuuccuuagauaauuugcauuuggggagcagggggagcuaccccaggaaaguuccugcuagggcuucgaguugugacaugugauacaucaguacucauugcuccaagucggguuuuaguaauuccuuccucaaauguuagcaucacuacguaaguccuuugcuuagcuuaaucuacuuuauacuugcaaaaccauuauaguugucaccuucugcugcaugcuguuuauguuuguggaagugaacugauuuucuuugcauucuugggcucagaaugaguccuguauuaaguggcacaggauuguguucaauaugcaagauugcaggucugauacaguguuuuaaaauacuuuuuuuucaucacagcauacacuguaaucauaucaacuuagaugaaaguuuaugagccuguuuuucccuuguuaccuuugacaaacauuuucaaaaugauuuuuaugaaauacguuagaaugauaagauauuuggguauucucagugcucugccuagcuuuauucucuggcacuguggacugacucccuggccuccagccaguacccacaguugauugcuggucuugguggagcugggaaggccagugagcagugagcagcugagucaaacaggaauuagcuauaaaugguacaggaccgacucauucagaugaaggaaagcaagaagcaggcuagauguugugacaugcagauugccuuacaacuuugguguuuuaauucuggcuauuucuuuuaauaaggcaauagugguuaguguucauugagcauuucucagaauccaggcacuuuaguaacacagcauuuugaucucauuuucauaguuguggauucagaguccacacagcuagccacugacaggcaagaaucuaacaguguuaggguaguucucguguugaaagcuucuuaggacuucuuuuaauuacuggagcccauacaggaacugauuguuuccgguaagauagaaaguaggacugcaguaaacauacucaauucagaagauucuagaaagccaugacuauggaaaagguaagcaaagagauguucuuuucuucugacaaaauagagaguacuguuacacuguuuccucauugguguuuuuagauguuccuaacugccaugcauaucaaaguucuagucuuguauguagcuuucuuuagaacagguaguucaacuauauuguuugaaaaugucaggacaagcuaccuagucacccaugacugacacagccugacuugcuacuucugcuuguuuccuuuagguccaccauacgagcuuugaucaagaauuuuucuauugcuucuuuuuucccugcuuucaucacacugcuguuuuuucagcauaaucgaacagccuaugacauuguagcaggaaccauugugguaaagagaaauggggucagaugauguccagaacccugaaucccacucuaaggaauaacgacaagacuaaauuauguaucaaggccaucauuaucuauggguuacauugaugauuuaaaaauuaaagcagucauuccggugugaucaggggucuguucucaaaguguugacuguacuugaaugucaaggaacuucuucagaaggaaaaacuauuaaauuuaaguguuaaaauauuuauaggacaacaaagcaaauuucauaaucgauauaagcaaauacauacuuuaacauuuaagauaaccaaaauuugcuggaagcauuuucagcuuuaaauucucuaaaucaaguuuuacuuuaaaguuuuauuuuggcuuauccuagagugacugagaaauauccaauuguguuuuauaaacaccuacagaacucccacagcucuucuuauggaagcugcuuuuugugagcauugagaaaucaucaacucaacaacccacuuacuccauggcagguguugggagaaaagggcuagugaggaaggccugagaguccccucaccccacacuugcaggguagucuagagcuugcugcaguaguggugggauguuucagcuucuuacugcuuauguauuuggaggcaagauuuucaugaugaugaaaauguacugagcauaucauugauauuuuuaaaagguaaguuaguugccuucuguagggacugggggugggaguggggauuggaguggggauuuccauuguaaauucaguuuagaauucaugugcccaaaaauccaacuauaaauaugcaggaggaauauccaaacauucccaguaugugcucuccaguguucugaauguaccuguagauucuauuuauguacaguaaauuccuaaggcacuguguauucuauacaauuccaaaacugucaagacaucaagguguuaagaguguauuuugugaauaacuuguacuagcagccugugaaauauuagcaguuuuccuauuaugaauuguucucucuaaagcaaggcagcauauaaucuucggacuuuauucuaguuuaagcucauuuuggccuguuagagaugaaauuuggagggggguggggaugugucauuguacuuugcucuguuggugaaacauuggauuuaugucugugugcuuuuguugugucaguuagcuagcuguaccaaaauguuaguuuaaaacuuuacuucuuacucauucuuguguaggauuuuccugagaaacacuaaaucauauugcacaagagagcaaucuugacauuuaaaacugugaaaugcauuuaauaucuacagauacuuuaagaaucuccuaagagcucauuguucaucaaccaugguuucucagaauaauuuuauuuaaauuaaauacaacuucacaggaagucuuauuugucaaaagcaguacauagagcaugugcuuguggcucuggcaagauuuuaaagcucuucaaacacuacaaauugggaagcuugguguggacaaucgccauugaugagagaauucaaguugaaaugugcuucacccacacagcucuggaguauuuaauuauuguuucuacugcgaguauugaggucuucacugaggauauuuuuauuuauacgguaaauaaguaguuaaaauuuguuauaguuuaaauaccaguuaacucgacaaguucuuuagaucuagcugugaauucaaguugugccauauaggauguaagauaaaaguauugcuuugccuccacaauagaaccucaguuauaaggagaaaagggaaucuggcacauuuuuccaugccgaagcuguauccugaaggggcaaaaugaagaucuuuaaugagcaugcccuaagccuggagucuuguugcugcauugccauucaggcuaaacaacuggcaagugauagucucucaguacucaucacuagggauguucuacacucuagguaacagcaugacgacaaaccuuacugaguauucgugacuauaaacacaugccacuuuugacaguguucauugcuugacucugccuacaaagcauuuaccuaauugcccaagccucaaaauugagucuucaaaguaucuuuaaaagcauuuuaacuuuaaaugaaacaaucacacccguuucuggccaagggaaguaguucugaaggaagauggggcauuaagcuuucucaucucugaggacgguuccuagaucaacaguauuccuaaacaaguacugguucagcuccuugccaccaccauccacauaaccaaagaccaaaguccuuacucgugccugggugaaguuccucauuuuggcugguauguguagauuuccuuguaguucacuauaguagggcuuacccugaaaacagcacucuauuuuuaauauuuguaugucaccaguuuguauuuugugucucaauaaauacgucaaugucaacaguguugucugugccu

SEQ ID NO: 7018 - RNA, 2298 nt, Mus musculus
caugccccgcuccgugaccgugaccguggccgugacugagggcugcgcggaggcagcggagcagcgggagcaaugggggaggaggcgacggcgguggcagcggcuggggugcggcccgagcuggugcgggaggcggaggucagccugcuggagugcaaggugugcuucgagagguucggccacuggcagcagcggcgcccgcgcaaccugcccugcggccacguggucugcuuggccugugucgccgcucucgcgcacccgcggacgcugggccucgagugucccuucugccggcgggccugccgagccugugacaccagcgauugccugccggugcugcaccuccuggagcuccugggcuccacccuccacgcguccccggcugcccucagcgccgcccccuucgcgccggggacucucaccugcuaccacgccuucggcgggugggggacccuagugaaccccacagggcuugcacugugccccaagaccggacggguaguggucgugcacgacgggaagagacgggucaagaucuuugacuccggaggaggaggugcacaccaguuuggagaaaagggggacgcagcgcacgacgugaaguacccacuggaugucgccgucaccaacgacugccaugugguugucaccgacgcuggcgacugcucccucaaaguguuugauuucuuuggccagaucaagcugguugugggaaagcaguuuucccugccuugggguguggagaucaccccucacaaugggguccuggugacugaugcagaggcagggacuuugcaccugcuggaagcggauuucccugaagggguccuucggaggauugagagguugcaagcucaccuaugcaguccccguggguuggcagugucauggcucacgggggccaucgcgguccuagagcauccuugugccuuugggaggacuggcuguaacaacacaagggugaagguguucaacuccacuaugcagcugauuggccagguggauagcuucgggcugaaccuccucuuccccuccaaaguaacugccucugcugugaccuucgaucaccaaggaaacgugauuguugcugacaccucugguccagccaucgucugcuuggggaaacccgaagaauucccagcccugaagccuauaaucacucacggccucucccguccuguggcacuggccuucaccaaggagaauucucuucuugugcuggauacugcaucccauucuauaaaagucuuuaaagugauggagggcaacggagggugauggggauccugaagccaggagucagaaaucuuggugucauugggagugaauuggucucacccauccauccagacagaaguaaugguaacugaauggcaaaagcaguuacuaaggcaguuuuaaaagacuaauaauuaaauuugucauucggugaaugccuguucccguguuaagaaauuugcagaucuuagccuguuugcuucuuaacacacagcgauguuaauuccuauuauccguccacuugggagaugagaagacagacccagagcauucaguaugguuucuuuagaguuguauucacugggacaguugaauucaguucuggcuccaaaccacuugcucuuagauaugauguuagaugucgucaacaacaacaaaaacugugagcugugucuuauguauguauguucuccuuacaaguggguaacugguaaagugcacaaagacaagaaaggggucuucauggggauuuuaggagaaaagggaaguuguccaucaccuucagcugugagcucccccaaagguagaguagauagcuuauuaccaguuccaagauuugaacaagaaacaaaguugagcucuuuccuuauaaggcaaaggcugccaggaugauagugugugccagaacuccaaauccugagaaguggaggcaggaaguucaaugcaaucugcagcuuagcuaccuaguaauuuugaggcuaagcuggacuaguguguucucucucucucccucucuuucucucccucucucccccucuuucuucuuccucuaugggcacugggaacuaucccgcagugauaauuugagaaaaaucugcagagccacugccugcuagcgucaugggcauaugagacucguguuaauuagaucuugccccagcacauugauggcagaagugauuuuguuuggugugguaaaucucugacgccugaagcacuuugugauggaggcuuuucucuguguaauuugaaaugugauucaaacacuguacuuaauaaacagucuucguccuuuuagag

SEQ ID NO: 7019 - RNA, 2265 nt, Mus musculus
gugacugagggcugcgcggaggcagcggagcagcgggagcaaugggggaggaggcgacggcgguggcagcggcuggggugcggcccgagcuggugcgggaggcggaggucagccugcuggagugcaaggugugcuucgagagguucggccacuggcagcagcggcgcccgcgcaaccugcccugcggccacguggucugcuuggccugugucgccgcucucgcgcacccgcggacgcugggccucgagugucccuucugccggcgggccugccgagccugugacaccagcgauugccugccggugcugcaccuccuggagcuccugggcuccacccuccacgcguccccggcugcccucagcgccgcccccuucgcgccggggacucucaccugcuaccacgccuucggcgggugggggacccuagugaaccccacagggcuugcacugugccccaagaccggacggguaguggucgugcacgacgggaagagacgggucaagaucuuugacuccggaggaggaggugcacaccaguuuggagaaaagggggacgcagcgcacgacgugaaguacccacuggaugucgccgucaccaacgacugccaugugguugucaccgacgcuggcgacugcucccucaaaguguuugauuucuuuggccagaucaagcugguugugggaaagcaguuuucccugccuugggguguggagaucaccccucacaaugggguccuggugacugaugcagaggcagggacuuugcaccugcuggaagcggauuucccugaagggguccuucggaggauugagagguugcaagcucaccuaugcaguccccguggguuggcagugucauggcucacgggggccaucgcgguccuagagcauccuugugccuuugggaggacuggcuguaacaacacaagggugaagguguucaacuccacuaugcagcugauuggccagguggauagcuucgggcugaaccuccucuuccccuccaaaguaacugccucugcugugaccuucgaucaccaaggaaacgugauuguugcugacaccucugguccagccaucgucugcuuggggaaacccgaagaauucccagcccugaagccuauaaucacucacggccucucccguccuguggcacuggccuucaccaaggagaauucucuucuugugcuggauacugcaucccauucuauaaaagucuuuaaagugauggagggcaacggagggugauggggauccugaagccaggagucagaaaucuuggugucauugggagugaauuggucucacccauccauccagacagaaguaaugguaacugaauggcaaaagcaguuacuaaggcaguuuuaaaagacuaauaauuaaauuugucauucggugaaugccuguucccguguuaagaaauuugcagaucuuagccuguuugcuucuuaacacacagcgauguuaauuccuauuauccguccacuugggagaugagaagacagacccagagcauucaguaugguuucuuuagaguuguauucacugggacaguugaauucaguucuggcuccaaaccacuugcucuuagauaugauguuagaugucgucaacaacaacaaaaacugugagcugugucuuauguauguauguucuccuuacaaguggguaacugguaaagugcacaaagacaagaaaggggucuucauggggauuuuaggagaaaagggaaguuguccaucaccuucagcugugagcucccccaaagguagaguagauagcuuauuaccaguuccaagauuugaacaagaaacaaaguugagcucuuuccuuauaaggcaaaggcugccaggaugauagugugugccagaacuccaaauccugagaaguggaggcaggaaguucaaugcaaucugcagcuuagcuaccuaguaauuuugaggcuaagcuggacuaguguguucucucucucucccucucuuucucucccucucucccccucuuucuucuuccucuaugggcacugggaacuaucccgcagugauaauuugagaaaaaucugcagagccacugccugcuagcgucaugggcauaugagacucguguuaauuagaucuugccccagcacauugauggcagaagugauuuuguuuggugugguaaaucucugacgccugaagcacuuugugauggaggcuuuucucuguguaauuugaaaugugauucaaacacuguacuuaauaaacagucuucguccuuuuag

SEQ ID NO: 7020 - RNA, 1474 nt, Mus musculus
acuccagagugacuguuuaauauuaaaucagcacagaacuuuaaggcaugcuucccaaaaucuuucgugcagcaucagguguguaucuaaacaguauagcaucuaacuuugcuauagaguuugcuauaacaguugcuuugcgguuacaaaaaggagagagaggagagagagagaggagagagagagagagagagagcauauuuucccaguuugugaucagaacucucuccacagaucuaauaauuuacuuuguugauuaaauuuuuaacacauuucaauuauuuaugaagaaaugaaaaauccguuaaaaagacauaaaggguucaacuuucagaggcagcaucuaaacuacuuguuaaauagccuggcguuuucuggguaggcugaggugauucugucgugcucugugaagagaaaguaguggcugagcauuaggcagaauuuuaaaaaacaaaacaaguaaacaaaacaacaacaacaacaagaagccaucaucaccaccaaguucggaagaucucaggagcauuucacagccagcuugagauuugucugaacuguccaguguuccauuuccaucagucuuccuccucugcuuaaggagggacagcauuugggauccacucccgaagucacuuuccucaggaacugcauuauaaagaggaccuugugaugcagagaugacucuacaggucugauuguguguucaggcagggaauggcggcacaugcuuuugauccuagcauuagagaggcagaagcaggcggaucucugaguuggaggcuagccugaucuauagaguucugggacagccagggcgacacagagaaacacuuuuuuugaaaaacaaaaaacaaaaaaaaaacuccaacaauaauaguaauaaaagauuguguuuucaacuugaggucucagaggucuuuccugugccaucucagucucuuuaaaagccaagccucuaggacaugggacgugaccuuccugucccaaacugacacucuugcauucauucucucucucucucucucucucucucucucucucucucucucucucucccucccucuuucucucuugguuggaucuuacuggguagaaagccucugccaagaacagacucuguagggggcucuguuuccugaagagacccugcagaagcaaccacaggacaacagagaacagaggcagcccggcagccuucgccccucacagugccacuuggcaccaccgcucgcacugccuuuggggacagcaccuacccuccuacccuccguagguugggggcggggggaugggcaggagucugcuaggacaaagucuucacucgcuccguucuaucuuaugaaucacguaccugcuuuucaagcacaugggacuggaaacgaauuucuggcauggugaacgccagaguuccacgaguuuugaaaaagaccacgacucccugcccuggcauuccucaggugacacacuugcuggg

SEQ ID NO: 7021 - RNA, 1020 nt, Mus musculus
ugcugacucaucgggucccuucaacacugugacugccuccucaggggccaggccaaggucuguuuguuuacugucgccuucuacccaguaugcugccugaucuugacaugggcuaaagaacgucuucagaauucucguuggacuuguccucugcaacagagcaucgcugcugucucucucuucaccuccuucauugcuggaacagccuggagcuucugacuggaaguugcucccugcuggugggcuuggaaaagucugagagggagguccauucagcacacacacucugaggacuuccggacuagcaaaggauaccggggacgaaagagagggcucuaauucuguccuggguucugcuagagagaaagcaguagucagaaucacagaggugccuuguggauaggaacauuuccccaacagugauuccucagaugcucauaaauacucccuuuacaggucuaucuuccacacucuacugaaaacggccuucccacagcucugaaaggaaaacuaaaacacugaaaagccuuauggguaauguaugcucuguaagcuauuacaacuagaacugcuaaucguggugugaacguccaugaauacucgcuuuuacucuaucaggaauuacaagauucuucagugauuuucuuucuuuuauaaggaagugacuaaguuucaagucaucccccaaaugggagaggcaguaccaaauaaugucaagagguccaucugugguauucaacugaaugcucccucauccagaaagcaaaccaagaaaauaagcugggauucucuuaucagaaaauggggauucggcaaugaagcaggaugucauggacuccaacuauaagcccuuaaagaaaucugauucuugagaccgaauuaaucccugcucguugaauggacuucuugacaauuacuaaugcuguuccucguggcugcccaaagcuuugguacccagagcuggacaccaaagguccuacuguggucagcuucucaucaggaaauguguucuaaacuggc

SEQ ID NO: 7022 - RNA, 645 nt, Mus musculus
ugguggaccacuccuuuaaucccagcacuugggaggcagaggcaggcgcauuucugaguucgaggcuagccuggucuacagagugaguuccaggacagccagggcuacacagagaaaccaucuggaaaaaccaaaaccaaacacaaacaaaagaaacaauaagaagccaggcaguaugggcucacaccuuuaaucccagcgcuugggaagcagaggcagguggaucucugugaguuagaggcuaauuccaggacagccugggcuacaaagagaaacccugucugaagguugggaguuagaaggaagcagcccacuucuuaauaaguagguuucccccagcaaaggaagaggccuuaaauaucaguuaccccuaggugauccuuauggagagagaaaucacaauguggaaagaagugugcccaccccccaccccccacucccacacccccggaagugaaauguaccuacuuucuaauugcagccaaaauaaucaaagcuguugacagucuggagucccaaacaggacuuuacaccauggacuucauggccucaagcccacuucccugugcagagggcacccuaugaggagccagaagagguaaaagguggacccaguaagcucggcagcuuccuccgacuuuggca

SEQ ID NO: 7023 - RNA, 3525 nt, Mus musculus
aucaagucccccacugugucauaaaauauuuuauuggaaaaaagagucaccgucuuuguaagagagggguagaagccucagcgacauggggaggccagguaucagcugaucugcuagagacgacucugcucugcagggcagggccauagggaccugcacccgguggcgggguccccaaggcgcggaaguaagugugugccugccgguguccgggcccagaaggccggcuggaggccggggauaaaagugugggcaaggagcggggcgugaaugagcguggagcgccgcacacugcggagguccgagaaagaccagaagcuucggccacgcuggacacaagucucccagacuggggacagaagcucgcugacaccugggauuggcuuccgggccuguguccuuccuugucuggcccuuaauuguccgcauucaaaguaguaaugaaaugauuagaaagcaaacggcauggacgcggaagggccagcuccuggguccccgccgaccgcgccagccgcauccucggcgacgcucaguccucgcaauuucggucgcugggcucgcccggcgucuccgcuggcuucucugucuccuuggcacgcucuugcuccgugagcugcucgcucguggggauggaguucuucuugggccgucccuugggcuuggugggggacuccaggccgccaccuugcagcaccuguuccgugaaugaacaguacuaggugaggaaagaauccgaucaaggaccaccggaugcccagggcccaaccacggcaucacagugacucuaggcccuaaagaaacgguggagguuuaaagaacugcugaggagaacgagcggaagauggaggaguuagaagcugccaggaggugccggggauggggguucuguccuaaugaacccaagcagacacagcaguucacgggaugggaugggcagaagucuuagugugaggagggcgggaagguauuucuuggaggacaccaaggacaaagcccaggaaaccccagcccgcaggaagccaccagccacacuuacuauuuucuuccauuucauccuccgauuuugauaccacgucuucaccuguaacuggcucaggcccagggacucagcuagaucuauucuggaaagaguaacgcacacccucagcgggucaggccaccaccugccuacccuucccucgagcccagucuugcccggcacuaccugucagggguagagagguacuucugcuucucgaagcguuucuccagccccaucagcugcagcucagugaauacggugcgacuccggcguccuuucuuggcuuucgcgccagguucaccagagccagcugcuuccagcuucccgcggaguugcagcuccagcggcaggugcgaugcgccugcggggccgggcaucccaggcccggcggccaacaacgccgagcccagcccggagcagccgagcggcgccagugggaacuugaacacugcggccugcucagccuucagcaccgcuacagagcaaagagagaaggggagagagagaagagagaaagaucugggugaacuggauuccagccucccacgccacagcgcuuugcugcguuugggagcccgaaccagccacucccuggggauuuaaacccagcauccugggcgacccuccuucagguagcuaucccgaggagucuagaaaagaguaucccucgcauccuuugcucuuuuuuggaguccccaugagccaguaggcuccgagauuucaggaugcuuuagagcaaguucgcugcuccgaggacauagaguaugccuuucgugaaaaagagaaacuaagaagaaacgggugaauuuggaagcgggggcgggggugggggagcuuuugcauugggaaaagaacguuguggaaugugagcauuuguuuuucugggcgcuguaccuacaucacuggcugaggcuuggacauuggcgaggaaagggucaccaaagcauccuuugaaccugaaaauugucuuucuuguuuccucuguucagacccccuccccccaagaagcaugaagaccucuccauguucuuuagcccuaaaucggcuguuugcccgcuucaaacgaauugccaacaacagaguccuuuuauagugaacggcagcagagaggcugugaaccagaugaacaucaaagaggcaaacuggacuggcugcuaccaagacuggacagaaucuggggccgguuccggaggccgcuagcugagcuggagucuauauuggacgcuuccuuuccugguaggcuucuccuaaaagagauacuggaaaggauggaucugccuggcugagaaccaucaggguaaggggagcauagaaaacauagcaggaagugggaagagaaucuugcggagggggagagguagaggggagacagauccacuuuaccaaaaggcuaggaaggaggucaaccaaagagagucacuaagcccuaagccgagaugcaguacagggcagacugccucacaaucucccaagagacaagacggagacagaaaagaucugagcaagugcuucaagacgcacgaaagcccagcagaucucgggauggaaggaccaacugggcagcggaucacaaccaggccucuuucccucaaacaaggccuacggagacccuggccgcagcacaggccucggucgguugcugacuggaaagcacgggguucugaaaggcuccuggauggcuugggcauccaacacuaugcgacacgacccucuucuccagagcuuucccagucugggcagcuacuguuaugcccagccaacccuaccgcgaaacucaggcuuccccugguuugaagucauuuugauccagagugcucgguagauugauuuuguagcaaccauagggaugcggucucuggcuccuggccucgccuaucacccgauucgaaaaaacucgaagccgcccugaagcagaagacaaacucucuucuggucugacgcgaggacacaaggccugguuucugccuagcucauugcucgcacccuccacuuucccguuggagugcgcgaagagagguaggugccucgggccugcgcugagcugcaucccaggucgcuccagaaacaggggagaaagaggaugaauuacggacaaccccaggucuccgacucccacccgcccgccaagcccaguccucugcgcggcggccgcugcacguacccagguggcuguggaagggccgggcggccagcagcgccuguacgccgaacuugagcagcucgcccgcggcggcagcggcggccgcgggcgcugcgcccuugggccccggaggcucagugaggaucucuucgaucaugaagcugcgguagcgaugcggucggugauccgcacagcccucgggcggaccgaagcgcgcggcucccggcuccccuggccgcugcaucgcggcucccggggaugcgcccgcggcuaggaagcgacggcggcuaagcuccggcgcggggcccgcgcggggcucuaggccggcccgcagcucgcggcggcgcgcgggcgccggcucaug

SEQ ID NO: 7024 - RNA, 1144 nt, Mus musculus
gaagaaggguuggcauaggcugacugcaucccuucuguccauguaagugcuguauggaugaagguauagggauuacccaacauucucugucagauaaagugaaaaauugagcuacauuaaccauauccaucaaaugcuuagaccccuggaaauuaaggccauauaaaugaaaacgccuauuuuuuugccugucaaaaagcuaguacacuggccuugcccagcaacugggccaauucauacaaauagcucaugugcucuaagggccaggacuaagcagcaauugcaggacucacuuagggggugguauguacaccucucuaucucccguccuuauauuuugcuuauuaaauguaaacauguguuuagcucccccauuuuagaagaaguccuucaaggugcaggcucugugcuuugucccuuggaggaagagcaagggcugguaaaaaugcuacacacgaaccuuaaacaagcaagcagaauguccccucugugcugaggagaaaaggaaaauaagucuuucaucaaaaaagacccgguguucacaauaguuguuuccaagauggcagaguuaaagccaaaaaaucauaaaaguuccuuuuaaaaaggaaaaacaaccccucuuacacacaccccaaaaccccaaacaaccuaccaagaacaucagacuuaccacuguuugccauuagaccaagaacaacaccagguugaguucauauuaaguguguacaaagccucaaauuuggcccugaguucuggacagugccacauauggccaaagucccuugagcaucuuggcacugguccccccacugacccuucaauuccaguggugugggaaaaagucagugugucucuggcaaagugaggguccaggcccauaucccuggagccuccagaauccucuccuuccugcucaagccuaaacuuccaguccuuaaguaagguggaggcauaccuuggagccaagaagucucuuaggcuuagagcaaauguaauccaagugauauauugcuguccccaaguaaggcggucugaagauccagaauaauaagguuugugacuguuacugaggggguaagggggagacccuaugagggugccaugggagaagguauuuucagaauaaaaguuuucuguacuccag

SEQ ID NO: 7025 - RNA, 3924 nt, Mus musculus
ggcggaagaggcggcgccggggccgcggccgggcucccggggcggcggcggcggggcggagaaggcggagcgcuacucggcuugucgggcccuuuagggggccgcagccgggcggguucggggaggcgccugggcccgugcaggccgcgcccggaggccgcggccuccgaggcuggcuccgccccgcucgcggcugcgggcccgguaggcguggccggcagccagcgcuccuccuccgccgcgugugucgcgcggcgggguuagggggagccuggagcccgggagcgcgagccgcggaggaggacggcggcgacaagauggcgucgcucccgggacgggacggcggcuucacggccuggugucgggacccggcugaggagacuccccgagaggggcaagccuccccggcgugcgccgcccuccggagacgagcggacgugcgcugccuccaggggcucgggcugcgaggguccggcuaaacccaggcgccgacgguacguaugcugagccaggaccaaacguucugaaggagaagcuguccgcuggggaccugggcacguagcucaguuggcacagugcuugucugggaucuucgaucgcccaggguucgauucccgcguguugcuuaggccguaaucccagcauucugaaguggagaguagaggaucagagaaguucaaggucauuccauccaauuggaagccagccugggcuacaugaaacccgccucccgcucccccuucccccaagaaaaaggagcgguuuuuuuuguuuguuuuguuuuguuuuuuugcuuaccuucaauuuuucaucuguucuuuuucuagacaagccgcugcuggagcggggugcacuggacacaggagugacccauccaucgcacagaacaccaaguucaugcagacucaaagccccccaucagagucuucgagaauaggcaaacugaauucuauaguuucuuuuaauuuuuuuuucuuuuaaagacuauuuuuauucuuugacaguuucaugcguguauacaaugaacugugaucauaacaccccauucuuccaccaaucucaaacacaggcuccugugauguagacagaugaaaugcgcuuagggccuugauggauuuuccuuaauuuuuuuaaacccgauacguuaugccacuuauguauaaaauuagugaugaggccacuaguccgccuagcugaguagaaaacuuaaucccagaguaaguaauuccaugucauuuagaaauuaagauuacacuuaaagccucacuaaauaauaacaucccccaaaauaaucaaguuuuauguaauucacagcuaguauacaagauugcacaugaaucacuuguauuuucuuaacaagauuacauuccauauauauuucauucacuuguuuagguuuguguuuauuuuuguugugguuucuuguuugcuggccugcuugggcuagcccuuugccauccugacugccuggccuguuuuuuauuucuuuuaaacauuacugcuuuuauuuauuuauuuuaaaaagggagaggggagaaagcuuuugugcuagcacccaugauuuuggaauuaagcauacauuuuauuuuaagaccguaggauggugauccuucuaaaagaaaguaucacucuccuuaagagagccuuggcuuucuguggccucccagguuguuauacagauguuagcaaugccagcuuuuguagucacuucuguacucugugauuguauagacugugcuuuggaauuuugagaacuuuaaaauucauuuucauaauaaaagcccucaaaauuucaucaugcuugcuuucccuguuuaacuguguaugcccuccaaacuuauuaaugauugggaaauuguuuggcuaacaacgcuauaaagaaaauucaggaguugagugauguuuaaauuuucuaaauaucuaaauccuauuugaaaaauacuaaaucuuagagucugcuugggaauacaauaugauuagggacuuuuuuuucuccauuuagggcuguauuagagaaacuuuucaugaagugauuaccacacuacugaggggaaaaauaaaugaauaauacugcaugaccauagacuuccaagaauucucacccuuuuaauuccagaacucaggaugcagaggcagguggaccugggugaauugaaggacaaucuucuguaccuaaugaguuccaggucaccagugcuacacagagagacagagagacccugucuccccgacugccuccaaaaaaaaaaaaaggauuaugacuacuagauuaauagagagagccagccagccacagagcacagaacuuaagcaggcgggggcggggggggggggggggcgggaguuuacucucagcauuucaacuuguuucccaucggcuaauuuacuuacagcuuaaagcaggaaaauguugcccuuuuuuugguuugggaguugggguuggguuuugggaauuuucgagguuucacucauagcccaagaugcccuggaccccacugugcagccagccagccucaauauacagcaaucauccucagcccccugagaccugggauugcaagugcagggcauguugcccgcccaacaugaugccuacccgacacgccccgagaucaggaggagagaucaggaggagacacgguauucccgcugggguuugauuccuggggugugccuagcccuaaccugugccugggugcgacuucagaguccccacagagcaugcgcacgcuuggucugcaugcagucucaggcuguucuagucugggggcuucugguacucugggauuaagcuuucuacucagcuaggcggacuagaaauguucucuucacagcugcgaauucauuuucgcuuugagcuguuuuaaaaauacauuuuaugggaaaguaagauucuaacuuuugggugugucuuaauuaggcuuucucuugcugugguggaacaccaggaccaaaagcagcuuggguuggaaaguauuucuuucacuuacacuugagcuuuccuuacugaagggaaaucgaagcaagaccucaaacaaagcaggcaccuaaggcaggaaggagcuaaugcaguggcugcaaacggugacugcucauuggcuugcucggccagcuugcuuuuauaacccaaccaccaggccaggaaugacuccacccacaaauggcugggcccucccacguuaaucauuaagaaaaugccuuacagacuuguguacagccugaucuugaagaggcauuuucucaguugaaaucccuucucuuagaugacucuggcuugugucgaguugacauaaaacuagccaguacagcacagauaaagagaagaguccuaaccaggugguguggugcccgccugugaucccagcauucugaguucaaggacagcugggucuaucuacagaguagguuccaagauagggcuagacagagaaacccuaucuugaaagaccaaaaaagacgaugaagaaagaaaagagcaaauuccuggaaugguuacuaugugaagagcuacuucccaugucagccauaagucccugcauguccuugaggcuggaauugccccuugcuugcccaucuguacuaauugagguuguuugguguuccuuauguccuaugugccgaaugcuggcaccuaaaaccucuucucuagcaccccucuuuccugaagcuagagauuggggaccaugccuuguggacuuccacccaggacuccuaaacucuguuuuaggcuaggauagaagaggagaaaagagaagugucugacuuugcacuggaacccaggauccuaguaagaaaauuuuucugaaucaacaagucuuaucuuuuuccccucaaauagugaaugguacuaagaguguguugcuguccuuuaagaacccaugguucuguuuuccuccgauucccacauuaaaguacaaagccaag

SEQ ID NO: 7026 - RNA, 540 nt, Mus musculus
uaguccuauuuuacgcucacugcuuugcccguugugcucuguacccgccuggcuccaaucguugauuggcgggcgcgucugacgugacaaaaguaggggugccaccgaccccagcccagggacccggcagccacccggagaaccucaagccuuccgcucccagccuuuguggaguaaggugauccgagcuguggauaucacgaguaagauucgcguccugaaacgucagagcauggcuggugagacuguguggcgcgcgcuuuaugcggaauuugaaugacuuguggcgggccgcgggcacugccaaaaggaugccaacagccugacgcuaggggcucaggggagcccaggcccggauacuacuuccucuuguccauuguccguuaggauuuucuuucauggaaaugaaggcaccuccgugagcauaaugucaaagguguauuuaaauguuguccgucccccguuuucggcgagacguagcuguacucuucacuauaauucuaaauaaaacuucccuccuugcauggugauuuggauaua

SEQ ID NO: 7027 - RNA, 46173 nt, Mus musculus
auccaaaucaccaugcaaggagggaaguuuuauuuagaauuauagugaagaguacagcuacgucucgccgaaaacgggggacggacaacauuuaaauacaccuuugacauuaugcucacggaggugccuucauuuccaugaaagaaaauccuaacggacaauggacaagaggaaguaguauccgggccugggcuccccugagccccuagcgucaggcuguuggcauccuuuuggcagugcccgcggcccgccacaagucauucaaauuccgcauaaagcgcgcgccacacagucucaccagccaugcucugacguuucaggacgcgaaucuuacucgugauauccacagcucggaucaccuuacuccacaaaggcugggagcggaaggcuugagguucuccggguggcugccgggucccugggcuggggucgguggcaccccuacuuuugucacgucagacgcgcccgccaaucaacgauuggagccaggcggguacagagcacaacgggcaaagcagugagcguaaaauaggacuacaucucccacaaugcuaagggagacguagcuuugcgucacguuaggcgccugcccccuugagauuuagaccaaucacaagcgcggaccaggugggcgcaagggacuacggguuguguaguccaugcucagugggacugcagcccccaguguuccgcgcgcgucagggaggagcagugcggcggcgcgggcggccgucggggcugggcggcggcagcggcggcuaagagggcccggcuugugggagccaaggugggagccggccucggcgcgcggccaccauguccgcgccgucggaggaggaggaguaugcgcgucuggugauggaggcgcagccggaguggcugcgcgccgaggugaagcggcugucccacgagcuggccgagaccacgcgugagaagauccaggcggccgaguauggacuggcggugcuggaggagaagcaccagcucaagcugcaguucgaggagcucgagguggacuaugaggccauccgcagcgagauggagcagcucaaagaggugaguggucggcugcgaccccugccucgggcgcuaaggucacccugcccaguggugggagguaccagggguggggcaggagaccuagaguugcggucccgggcagugacggugaagggacccuguucggcccuguguccgguugcugggguccagacucccugcagccccacucacccgcuaguuuucuuugcaggccuuguuggccuuuucguugaggacugauguccugcuaugguuauugcugccuagggugugucugugugguugguggggagcagaugaugcccuuacaacugaggcuguccgugcaagugaccccagggaaaagcuggaccugggguugguugaccacaguuugucaccuucaagcaaaucacuucccccccauuuuggagcagcugcuuucugugcuauucaucagguuucgugaccgccugaggcugggaagggauggauacagggcugagugagucgcagccccugguugccuauggcccuugacaggccggcuuucccgauauccaucgcucaaccagcugcuuuuuccccaucucauuaauggugcucccacuacugggaugcauggcuuccaucgaccgcuuccugucuugcucugccuccuagggccugccugucaccguggagucuguguucuucuguuggaaacaugguacuuugugucaucccacuguaggaagagagguuagacucccaggcuggccaagagcuuggggaggggcaguaggagggaccuggguaagcuuucugggaugauuuaaguauuaguaacucucccaucuucuugacuccccagccuuguucuggagacugggggaaaugcuuuaugggagaaggacacacuugaguuuggaccaaccccuucuuauugcuugugaugggugagccuugggugagccauggguaagcucuccucaaaccuuagcuuccagcucugcaaaguaggaauacagcuuugccaauccagaaguauugcuuuuaguauucuauauuuggaaaggccuggcauggggccacacagguagcuuguuggauuaucucaacaguuucccuucccugugagacucaguucugcucuugaguauuaaucacaggcucaucuuuugauacuucugcucccagucagcuuuggauagaugccugaacucuugagagccucucugacuuuuaggggaaugaguccuuaaagucuggguagagcagggcugggugagucccagaagugccugcuucuuugggcggguaggaauugagucuucacacagauucucaaaucuguugccugacagaggacauuaguaacuuucccaagccuggcuucauuuggcagaggguugaccaaaggagugggaccccuggagggggaggggcaggcaacccccuggagggggggcauguaaagugaugugauagaugaaggucagaaaauauggagugaaaauauggaguggguguguccucuucccaaaucuagucuucugggcucccauuccccccuccuugguccuccaggcagguagcaacuguuaauuauagugccacucccuuugcacauacagauggguugccuucccacuuccuauggaaugccugugaaccucuccugggaagcucacuguccucuucugaauuaacagguuuucuucaguacuaugugcagugaaaacaggcuagcuggucccaacuuuggugacuucuauuggucagccucaugggauuauuauuaugggcggaaucauuuuauggcacagugaagagcaaugguuuacauauagccuugucguuaucuggaggaaaaccucucaggacacgugaucuagucucuugguugcccuuuagguaucugcuuagccuaaugccauccacacacuggcuauauauauaggcuugggcagacugcuccucuccucuuugugaggugggauaagguuucuuccagaaguuucuaguagaauccagaggaaugcaucagauucagagagggcugccaaaaguuugugccaauuugccucuugucagcauugugucuguucuucacacccaugccagagcaggcuccugugggaaguuuucuccccuagagaggugaacugucuuaaguuguuuguuccuuuaaaugugguagauuuaguuacuaacaaguuaaguuacacuguagcugaguugcugguacucuugcccacauuuaauuaugcaagucuuugaggugaggaagcugucugaccugggugaaaggguuuaugaccagaucuaaggagaggacucaguguugaccccgcucucuuuacuuuugggugaauggcugugucuugcugacaaccauggccuggguguugacugacacuacaaguggagaggaugucccauggccuguuuugcugauauuuugugucugacucagccagggccacaucugucccaagucauucugugccuuuucuccuuauccagaaugguggggaagagaauuagcuggacuuuugccagccuguucaugguucugaguggucaugaaacagcuugcuguguccuucacugcagcuuuggguauauagguguguugggcuggcagagcagggcagauacuguaggagaaugggcugaguucagcuuccccaucucugucaugagagauucccagaagcaguuucccuccaccugggcuugguccgugaacaggccuggacacacccucauugcuguccccugucacuucugguggggcugagcugagugcaucaccaugcccauguggguggaauccaguaucaggcugggcgcagacccuggcaccuaguaaaugcuuugucagccuagcuccacgucauccaggccucgagcuccucacugucgugcuuguagcaccucccuaugccuguuugucuuugcucgacuaucugcucgugccaccucugagggcugcccugugugucaugccuugccaguuucuggggccacucugcgucucccuucuuccuggaagucccacucaccucucaagcuuagauacuuucuggcaggcccuuugacucuggacuugccugagcugcugucuccaaccuuugcaccacuugaggcaggaguguuaagggguuagcagagggugcacuucuagguacacagauugguguccuaccaacaugaggcccagcuuccuagaguguuugcuuccagagaagggaaaguccuggucuauuuuuaagugaauaaaacugacauccucacaguguccuuuaauccauuucugagcagauagaucuuggggguggggugggggaagacaugggagccacaguauguuuugugggaucgugugggguaucaguaauggacuguuuguaugaaggugguccccuugagggucuugcagauccuugaggcaguugugaggcagcuguaggcaucuggacaguggccuuguggucugccuucuguugggugaccuuccuucuucugugccugccuuucuaacugucaaaugguggacagggggucaugaaggaaucugauaguccucuucuacuuuuaauaacguguucaccugccacaucagacccuggcggugcucugaggggcaugggaaucagauacuuauaucuggcagagaaucugucccaggcaugugaauggcugcuccaggccagcccugcuagcacauggagguguggccuuggccaccuuccacuggacacaggacuggcacagcugugauggagcgagccugucuucagagaugccaagcauacuuugaggcuuagcagguggagccagggggaggcccaagcccagugcugggagcuuaucacucucaggggagccagcaggccucagggaagucaggcuuugccugagcaagagaggaggcugacuaugcagugcccaguucugugaugccagaagaguguuuugggacccugucugggcucuuaagaauuguguggccuucaaugaaccacucuuuugucuaggccuugguggcuuaauaauggugccugucacaacagucuggcacacuaagacuacuuggauggucauuguccuucccuuaggucugagcagccaccaucagcaagagcccuagcccagguucaugugggaauccugcugcugggucuacuaagggacccaggucuuuauuugcaaguagagaacagauuuguucuugucaguugaggcagcacccccucuagucaggccucuuuuucauauguggacgggaugacagguucugcacaugggguaaagaaugauuucuuuaccagccauguugugaugacagugugugacucaugaccauguaagcucacauaggugaggguugggcuccaggucccucugguucagcauucaaagugaagcagaagagaguaguguggccguucucuuuccccuccaggcuugguagacagaggcugagggccagggcugaggccagucccccucaacuucccuaaagcgggauggccaccugugcagguggaugauggcguugaggagagcagagugggagccccuucccuguuuaaaauuguacaaucuaggagcuuccgaacacagagccgagcuuccaacgucugcuguagaagcugugccgugaggaguggggacacugcguguuucuccucguggguuccuuuucccaacaguaugugucagauacagacaccaccacagggaccacagggaagcccuguguggcugccacaguuuucaaaaagugaugaggugcaggguuuuguauuuugguuugguuuggguuuuaauuuuggggaucaaaggcgucugccaccacaucagccugaagagcuguaguuuuuaagcaaaguggaaguagagagaaggguucaguggacgcagccauaguccugccugcaccugcuagcuguggcuggucuugcuucugugccucaguccaucuggcuuuguuacuucuguagcaguagcuuuguugagaaaacaaggcguauuuucccacacaacaagagcuauugaguuuucaagccugaaaccuaacaauuccuuaaugguaucuguuugucugaguagcacuucgguuuucccagcuugccucaagugagauuucuagaguuauuugugugaaagugauugauaugugaguguacuggcuaguuuugugucaacuugacacagcuggaguuaucacagagaaaggagcuucaguuggggaaaugccuccaugagaucuaacuguaaggcauuuucucaauuagugaucaagggggaaaggccccuugugggugggaccaucucugggcugguagucucgguucuauaagagagcaggcugagcaagccaggggaggcaagccaguaaguaauaucccuucauggccucugcaucagcuccugcuaucugaccugcuugaguuccaguccugcauccuuuggugaugaacagcaauguggaaguguaagcugaauaaacccuuuccuccccacugcuucuuggucaugauguuugugcaggaauagaaacccugacuaagacagugaggaaagaugaaaauauugggaaucuuauguugccugugugucauuucauucauaaaaaacaccaaaaggguuggagauguagcucaguagagugcuuugcgagcuugcacggauccuuggugccacaaagacaggcugagaagaugcauaccugucaucccggcucuugugaaguggaggcaggaggaucagaaaguuaagauuaucuucagccucauggucagggucaaucuaaaggacaugagacccuggcucaaacaacgcuagugaacacagagcccugggugcagcuggcccgagcuacgagagaacacaguugugugucugauuggacauuuccuauaccaagaagaaucugccucuuaccaccucacagaagccccagagcugccagccuaggacacuacauccacaccagccccucagcaccuuguuaaagccaagugucaugcgccaggauuucuguguuuuuagccauugacugucaaacugugcugccuuuuuaucauuaauuugaaagcagaucauuuagguccauucuagauuuauaaaauuucagacagugcagagauuugguguggacgugcacccucgcccaucucauucaagcaguaucuuagugugauacauuuguuacaguccaugaaccagucaguaccagggaguugucauaaagccugcacugccucuagguggucuuugcuuuuuccugguguccugcuucuaacccagggcucaucugugauaucaccuuacacuuggucaccaugucuucucagguguuugaacucugacaguucucagacauuccuuauuuuuggcaacuuggacaguuuaaaggaagauaggucagguguuugguagacaucacuaaugggaacauuugguauuuguuauuuuuuaguggguuugaaugacagguucagaagaggacagucauaguucugugcucucacacuccagggucuguacuucaccauggcuuuuguuuacugagacuccuggcgagaggcagggugugcgguguaagagauugguucccgaggugauaaaacaguuguguauggcacugaaagguaugacaugauacugugcaccuuuccaagccagggaacaugaacaaaagugugaagguuugagacagggacucuccucagucuccacagauuucuccacauuagcauuagcguuguuucuuucccuguuucacucacugcucucugggaggaacucagugaagugucugggugucucacacagucuuguccuuugcucucacuucuccuuugcaguuuuaucagaagagacacauuggagcuuuacuucauucacuggguuguaaugauacuuaauuuggcuccuacaacuuuuucuagcuuuggcucuuaugaucccgacauagcucuauugugauuuuuuuuguuugcuuauuaagcacucucucucucucucucucucucucucucucucucucucucuguguguguguguguguguguguguguguaucagggguggguaguauccagugcacauauguauauaggcgagacauaaaguugggugucuucuucaauugcuccccaccauguuuuucaggacagggauuuucacugaaccuacaguucauugauuugguuagacuggcuggccagcaagaccuguccccaccacucuccugucuugccucuguggugcugggguuguagaugccuguacauaagugccuuugaucugaacucacuugagcagcaagaacuuuacugauugagccaucuccccagccccuuguuaaauaccuuuuuaagcuuucugauacuacaagacauucuauauuuuguucuggagccagcuaucucucccaagaagcccuaguugcuuuagaugagcgagguauuaguaacaaagaucgaguugcucauccaccaagguauggcuaaugcuaggcucuuucagccacagagcgaguagugucugcuaaguagugucugcuaaguacacacguaucugcaaccaggaguucaguuacuucacuaucaucacaugcuuccuucucaccaccugcucaucuggagccuccuaccccagcagugagacauuuggcacccaccaucugucacacugacacucacugguccuaguucacaugugcagguguccagaagguucaugugugccccaguaggcuacuucaccagcuuuuugccuuuuguuuugcauaauucacuuuaccccacaguuacuuaucccacuguaauauuucugcacccuucauuuauaguuuaaauuguuugaccacauuaugcauucuauccuaggguccccaguacagauuuuuaaaacauuuauguaucugaagaucuuugauugcuuuguguguguguguguguguguguguguguguguuuguguguguguugucuggccuuaacaagugcauaguauccuucuaauuugaagaagacuugcuuacauuucaccuacuuccucucaccccaccaagccucugccagucacugaucuuuuuacuaucucucuaauuuuauuuuuaugagaaugccaugugacuggaaccaugaaggcuuaccuucgucuuuaucucuucucaccaacucuucacccauugaagggaguucuggucgcuucaccuuuucugauuaugaauaaaucuacuguagacauaaguuuucuaaucuuccauuucccuguguaagaaguggaccugccuuccaagcgggcuguugauuccccucaguagugagugagugcucccgcugcccccguucauucuugcuagcuuucccugcuguugcuggacauuggccacuuuagugugugcacagugggaugcaguagcuacuguguaguuugcagauccugaggaugccuggcccugggcaucuuuucaccuuuucagucugucauuacuacuuugccaugcucagguuggaacccagggcauuuuccuuuugccccuuugcaauuaguaugauuugauaccuucccugaucuuuuggacgucuucaguccaguugcuugcuuucauauuauucaguuguaagugcuguuuuuaguacauguguggccacagcaagcacuuggcugucugagucuaaguccuagaccguacuagucuuuucagucucuuagugguguguuugacagacagguguuuuaagucaugccauucucacuucugugggucguguuuuugguguugcaagcuucauaaccagacccagggucacguagauuuuuuuuauuuuaauguuagcuaccuucacaguccugcacuuucaugugagccucugcucuaugugaauuaacuugagugaagacuuuaagacucuguuuauuuuuuguguguggguguccaguugguuugguguggcuaguugccuuugcuccccugucagacaucauuugguguggcucucuuucugggaccccuguuuuguucaguugagcaacgugauuuuucuuugcuaguacaaugcuguucuaacaguguguuagccacuuuauugggcuucuaucuuuuuaaauuaauuuauguaugugucuguauaugugugagagagagaaaagggagagaggaaggcgccauauauauaugugguggugcaugcaacccugcacuugugcagaggccugagggggacauuggguguucugauuucaccucacuccuuuaagacagggucucucagugaaacuggagcuuggcuggggcaggacgccucaguggccuuucuaccuuugccuuacuuugccucuaugucacuggcguuacaggaguguauugccauaccuggcuuuuuaugugagugcuuguggauuugaauuuuaaguucgcaugguaagcucuuacccacugacccaucucuucucuauguguuuuuaacuuuaaaauuuuguacacccugccuccccccccccauguccauaagcuuggaggccagaggacaccuuaugggagucagucuucuuuccacuguggguucuaaggaugaaacgcaggucaucagaucugauggccuacggcugucaucccagcucuuugcuuauuuuuauguuaugacucaguccaucuuucuccucauucuguggccauaccccagucuucaccauggguugccuuucucccuaacuguaagaauaagucugaaagaccguccuauucccagaaaucccaagggugagugagaccaggggauugccuuuccccaaccccuccaagaagucaucuuuggugacuugagguugccugcacccuuccuuuaaggacucugcauauaaucccguucuguaaggucuuggugaggguuguaaggauugcuuucuccagauaccagcugugauuugcauuguggccgugggaccacaucugagucccauuccuguuacuagaacagaacaucagaaggagagggcuuucugagcauacgguucuggaggcuggaaagucuaagagcacaacaccuguacuugcuggccuucugcugagggcugcugcacaagaaggcacucaucaugcaugaaggcucucuuucugucauguuugucuccuguuagaccuaccucccagaacugcuauauugugagaacaaacuagucaaccuaaagcaggcuaugacaucguccaugguuugucuaaaagaggauauccaggauuauaggaugugugacagcaugagaaggugacuugacaaggccaaagcaugagacaguauaaggccuggagauaagacauucccagaauccuuuagucugagucuaaugcuaucacuucaagguaugcaaguuccuugugguggggacuugccccuagaggaccaagguuggaugugcaccaggguaugugucaccgcugcauccugaggcagggcugcagugcuguccacaagcucaaccaucuuccggaaccuucagagauagaaaauggagcccaugaaucuugacagccuguaguggucucucaucucucuugggcucuuuucuuguuauugguccugaggcgagaaccuucuagggucugaguagaaauggccuguacuugagguucuucugucauuuucuggccaugagccucacugauuucucuugcuugaacaggcuagugaggugaaagaauguggcgagggcuagagacaguaagaaaagugggcugcugccacaugcaccuguggucuguagccaggcugcuucaggcugcucugaugccugucgaguugucagaugcugcccauggggugucuaggccccuccuacuguccugaccacagauugcuaaauggaaguccuguguugagccagcugcuguggaagaugaugacugguccccaggccccagugcugggcucuguguccuuggaaagggaagccagggucuccagagaccucuuccagucccagggcucagcuggcaggagcuugccugcugacaccagggcaauuaggguguaaucuucucuaaauggugcccaauucuggcuaaaucccuucugcccagggaugaauccccaguuuucuaaaagcagcuuaacauuuggacgcugcccagagcagcugggguucucaguuggcaauggaauggcccauguggauugacacaggccucauggggaguggagggggaccagcaaagacaaggaccagugacaaccacuguggcccugugcuguuuuggggugccuccagggccucuguccuuaaugaucaccacagcuguaagcacagggcuccauagggaaagaagcuauguggaagcuaccucagcuccuugcugaugaugugucuguggagaggccuggguuugguggccuccugaacaccugccaugugauaacugggcugugggguuggacagagguagguggucauugugcccacauggcuccugaugacuuccuggaaacuuacucuuucucucaagggcuuuucugcaaagacagagauggauuuugauaauuaaaaaaauaaaaguccuggugaugcccugaguugaacugcuuggccuuucugagcccuaguuugccuaccuaugagaugcagaaguaaagguccuuuuguauaaggcaccagauaaaagcccuuucuucucuugcugucucugggggccugcauugccugugccuaagcaggaaguguccuuuagacaauggaaguccauuggaagcccuccuuagaaucuucucacucagcaagaaugggugugaacagcuaagcuggcuggaguuggugugggguagagucucccaugaugucucuggggacccuuuaagggaguugacaggucuguguacccagaucugccuacauacaagaucaugucagacuuuuaaauauuccaaagcucagaccacacccagggugauuaaauccucauuaguauuauugaugcuucugaaauaauccuagggaucuaaguggagacucauucccugugucugaagcuugccaacauuauccacugauaugauugguccauggauaccaggggcaauccaggauaccuuuguauuccucuuuguaguaugcaugagccugggaugugccugguagaaaugagggagaccugggagagggcuagucugggagcaacucgucagucagugguggggguacgagugaggagaugccccucucccaaggccagcccacccagucccauucuguaucucagacuugccaucuccaucugucacaaagcuguguccucucaucuaucuugaauucguuaucuguauccuuucugaguuucuucugccuguuacacacaggcaccccccuaauuucugccccugcugaggaggcacagcuuucuugccaguggaguacaccaggcagauugcccugccucaccauauaugguugggaugcuccugccuugcuuccugcagugggaagacacagggcucuuuccagccauccagaaagcucuuucuucguaugggagccuggugggccuuccuuagaggcugcaaggagacucugcugcucacugugggauuagugugaucacugugaggggagaacugaguucuguuuucguguuuuuccucuuuuuuuuuuaagcucuauuuuauuauguauacagcauucugccugcauguaugccugcagcccagaagaggcaugguuaugagccaccaugugguugcugggaauugaacucaagaccacuagaagagccacccaugcucucaaccucugagccaucucuucaaccacugaguucuguuuuaaaccaggcuguauuuuuagggcagcuuuugaccccaaaggaugucucuucuauagugggcugcuauaguuucauuguuuaugaagguuuauuuuguuaguaaugaagagauagugguuaagagcaguggcugcguuuccaguuuuaauucaucuacauagaaacucccagcaguuuauaacuuuaguuccaggggaucugauacccuuuucuggccucugaggucaccagguacacaugugauacacagacauacauauagacaaagcacccauauacaucaaauaaauaaacauuuaaaaauauuuuauuuuaaaauuauguguaucuagcugggcaaugguggcauaugccuuuaauuccaacacucaggaggcagaggcaggcagaucuauucccggacuuccagggcuacacagagaaacccuauuuaaaaaaaaaaauugugugagugcuugugugugugugugugugugcacgcgcgcugugcuuggcuaugugcauguaaccguaggugcccauggagaccaaaagaggguguuggauccucuagagcuggaguuaaauacagcugugagcugcuucaaaugggugcuaggcacagaacccagguuuuuugcaagagcaguacauucaugaagccaucucuccacccuaguucucuuuuucuaaaauggagacgcaugguggugcacacaguaacuacagcuuacucucuugaaggaccacaccuaguaccuucugcucugcugcagugacuagaggaccacucaaagugugguuccucucagcccucuuggggcugcaaggugggagugagcagcagcccauguggaccaggcacgaggcuucucggugauguuugcaugugcccaucuuccugagggggauccuauagcuccuuuccccuccacacaugcauggacaggcugccagugaggaggugccuucacuuccugcuuuguugccucuugcccugugucuagggaagcagggcuaggugucaagagggaacugaguuucuguggaaaguggggugaggcuugggacgugcuuugcuucaucugaaauaggccuucccgcugcuaaguccaagcuucccaggacccaggccgcaccgcgccacagagcaggugccuccucugggaguggaugcuuccuauuccccagaugauucugcgaaacaagcaggcgucggcuagccucuguggcuucuggcucaugaggcucagacuuuuugcucuuucugucagacucucuuggggaaacuuguuuggagacacguguucucagaguuguuuucuuaguuccagaaggaaauaauauuccugugagaggcuagcaagcuucugucaggguaaacugaagugcagugacccuggaaaucaucaauuuuuuucuuugggaccauucuugcuuaccuuuuaacagcuguugucauugucuucugugccuucaucagagcuggaacaagccugugcuuauagccugaguugucuucauauaaagcaguccaagacuggugccguggaugugacuggagguugggagggaacaccuccaacauagcaaauccaaucaagacgccugagagucuguuccugaugugucuagagagccccgccucccaccgugcuguuguguccgccugugucccuugcugccuuggacauucccacaggcucaggccuuccugucuuggauccaggucguuaccagauggaauagucaguagaucuauguucgacuccaugccccuaucugguucuacaugggguucucccugagauucuuucugcagauacucugagcugucugugcaucugucuaugguguguguuaguguacguuauauacuguaaaccugcacuccaucuuuuuuuuggggggguaccauuaccuguccagucuguucuuuuugagaugaggguccuucauuggguggccuugaacuagaaacccuucugcccugccuuccaagugcuaggauuauaggugugcaccaccaugccugauucugugcaguuuuuaggauagucucacuguucgcuauggcuggccuagaacuuguuauauccaccagauuggcuccagacucucaagagaucuaccugucucugcuucccaagugcugggauuaaagcccugcaccacuaugccuagcuaggcuguguucuuauaucagauuuuuguugaaaauacauuuauggaaaugaggucuuucaucuugucuguggugccauuguuucaguaaucacugguaacugaacuccauggaguggauucagacuuuagguacauuuggcuuggcauuuuauuaaccuuugaaguguaauuccauagugaacagacaaucagaugcauguauguguuggcucccuuuguuuuuauauccaggagucagaauggccacagcucuaugcucuagugugccagguguguguucuagcaacaccuuagauaucuugucccuguuguugaguuguucuuacaauucucuuuacauuuauguauauauguaugggugcucacaggaauacacacaaguaugugcacauguauggaggcuggaggacaaguugggaguccaugcucuucagucaugaucaaacucaggccaucagguuugguggcuggugcccuuacucacugagcaucucacuggcucagguuaucuuuauugaaacagaguugacuuucuguuuaccuuaaagcuuuauucgugauaguuugaaaagacuuuuuaagaauuuauuuuuacuuuuguauauauguguagguauguacacaugugugcagugccugcugagaccagaagagaauaccagauccucugaaacuacagucacaggugguuuuuaguugucacgugggugcugggaacugaacccaguccuccucaagaguagccaguguuuuuaaccccaaggcaucucuucacuccuagcccuuguauuaguuuuaaaaguuaaagugagcuuucaaugccuuguaagaguuacagaaaguacccagauugcaauuguauggcucuaugauucaucacagugagcgaagccaaugagaaaguaagaaggcauguguggucagccuccgggguugcuugcugggucuucaugaguugccgacaccgugggcagcuguacugcucaauugugcuguuucccauggagccacauauugccugauucggguguguucacugcauuacuuuguaaaguugauccucauuguggugccugagguucccacuccuuguugcauggugauugccuguggguguagcguccuuuccucacucagugucugauaccaaauagagcacacuugggacacuuucaucauggggcuuuagaaugcuuagguggauagcagaugcccauuucuucuguguggaauggcugggcaguggugggaagcccaccagacagcacagcaaugugcagagcgccucuccucauugcuguuggcuuuaaauauagccauucugguugguacagggcugugagccuucuccacauaugguucucaugguucugaccacugaagacuguaaggagcuguuagaccuuuguuguuaagaagcaaggugugcauccucucccaccagacagcaccucuggcacagugcugagaaggagacagcaguuggggggagggacagcucuaaucuaguugugccucugcccugccacagccuugaccucugggaacuugggugucuuccucccgaacaugaguucugagaaccuugagguaggguugagugcaguaagguuccuuaggggcccuacacauugguagacacuauucuuacuaacaauaaaaugaagagaucacaugcucaccacugcggugcaguaguugucauaacuggacaauaaaugcagcguaucuguggacagacuagaagugcuucucugcagguagacuguacaguggguagcccagcugcccuggggcugcaguaugaccuagcagccccuuuccaggcauguguuaguuucuuuucucccuuucccuggaggcaugugggacugaacaguuuaggggagggggauuuauuuuuucggcucaugguccaggaacuacagaccaucguggcaggaagggcuggcagcuguggcuucaccuugguggcaggggcuuggugguaugggcuuggugguaugagcuuggagccuagcugguuacgguguagaagacugaggagaagcagagccaucucuugaccugaagcaguugaauaauaaccaagcccuagcccacagugauccucuuucaguuagugccaccuuccagcaguuccacagccuccccagauagcaucagauagcuagggacaucucacugaaacacaugacccuaugggggcagaucacaaacugugggggcagaucacaaaccaugacagauacccaagagacuuaaaaauauacaucuacacaaaaauggauaggcgaaggccugggauggugacacgugccugugauucccgcacuuaagagacagcagcagcagaguuacaaauucaaaaccagccugggcuguguagugaguucaggcuacauagacccuggcucaaaauauugaaaagcaaagaccuuaaacuaacaaaaccaaaaauucuuccaagacuuuuaaauggagaaucacaacacuguuuguuuuguuuuguuuuguuuuguuuuuuccuuuguuuuuuaagacagggucucucuguguagcccuggcuguccugguuuguagaccaggcuggccucaaauucagagauccaccugaagcuggcuggguaccaccacugcccagcuaguacuguuauucuuaauagcuucaaaggagaaauaacacauauguucaucacaugaucaguggauaaacauguggucugucugugccauagaauaauauacagccuuagaaauaaaggacugaaggcuggagagauggcucagugguuaagagcacuaacugcucuuccugagguccugaguucaauucccagcaaccacaugguggcucacaaccauccauaauggaaucugaugcccucuucuggugugucugaagauagcuacacuguauucauauacauaaacuaaauaaaucuuuaaaacuuuuuuuaaaaaauagaggacugauuaaagcuuauaagauguauagaccaggaaaaaaaauguuguacagggugaaaauaaaacacuaagacaaauaguguaugaauuacaugaaauguccagaaacagacaaauuuauaggaacagaaaauagauuuuuuuaauugucugacucugggaaaguggaccuggagaguuauagcugaugggaacaguguuuuuuccugaagagggguguuaguguaaaguuaaugauaguugucauacaacuaacuguaaauguaucccccccccccaaaaaaaaaaucacugaguucagucucacugaauccaaaagauggguguucauagaugggccauaucuuuacaauguguggcacguguggcuccugagguuguagcccaguugguagaaugcuucuguagugcacaaaacccuaguuccaucuucaguuccacaucagucaggauuagugugcagcacccaggagccaggaggugggaacaggaggaucaggaaauccagaguccugcaaagccagucugggauacaggacacccugacuccauaaaacaaaaacaaauaaaaaaauaauuaauggacagggagauuuugguugcagaauuuucuagauaaauuucuucacagucuuaagaaaucaucaaaggauccaaggugcuguaccuauggugacuauaugaaaagaacuuugcaugauauugagagauaaucuuccuuuacuaauccuuagccuuucuuguuaccguguuuauaauuuuuacugaauaaaugucauuuuuacucaaacuggcaucuguggaguauguacuuugagguaaagguuauaaguguaauuuuuaaaauuauauauuccuaacuguacaaucuacuuugaugauuuuuuaaaauuuauuuaucuuuuaauucauuccggggaaucccuuuuucaauuccuuuaaguaauuaguuuaugcguggcagucgauacuccaccuucugacguguagcuucuuggccugucuuguuucuuagcacacacugaauucacacuuugcuuaucccacauuugaguucagggcauguucuucugggacugaauaguucauaaagcagacucugugcauuggguuugcugagcugugacuucugugaucagcgugguuacugagcaccugcuauuugggagggaagaucuguugcaauccugucagugccccauuugaguggagcccagggagucccgggcccaaguccugcuguguggcuuaccuaaggaagggagguggagccauguaugugggaacucaacucucaaguggcugcaguugucacugaccagucagugaucagcuccugaguuuggguugcacauugucagacuaaccacacaguagucuucaacacuaagcuaacaugguugcuuuguguuuuguuuucuguguccaucucugccgagugaggcuuuggcuugcuacuuuguucagagucagggagcagcucuuuuuaucauuaguguuuauuuuuaguggcagcccuuccccugcacaguccugcuggacagccagccauucugaguguugauaagauguuucuauuuuuuauuuacuguuuccuguuguuugguccuguaugccuuuucuaguacagacuaauuuaagagauuauuuuucaauuuuuguauguuuggguacaugcuggcguagucaguuuucuggugcauuuauuuuucagacguuuuagauuuauaaaaaacaugaaaacuguauuuuguucugcagcacacaaacgugcuagcagugucuuccuauuucagaucacucuuucugauaguuuuccuuacaaacggcuguuugggaagaagauuauguccguccugcuggagaggucccugaugguccaucuaccuacuugacaauuuuacaugguguauacuagccucuuccagucaacauagguuuaaucaacuguugauuauagauuuaaucucuuaaugcuguaaguucuuuagcucuaaaugaaugguguugagcuugcauuucugucagcuuaauauccagagcaccaucuugaauuuaauaagcuuugaugccauuugguguccuguggaauccugguaaucuugacucugagcggccacauagagcugcacaggauggagccaggcucacaggccgauccuaauggcacuucucaggcccauguggguuuuuccuguccaccucagcucuucuccagguguuuaagacauuggauuccucuuuguaguagcccacuggcuuguauaugugaguggguggugaauccuucagucugucagugucuuugaccagcugugcccuagggaucccgauacuguacacguuucaccguugguacccaugagaggccaggcaugguaaagguugauagaaugcauguaccagccuguaggcauuuuuaacaagccuaaauagaaagaugggugcuguggugggacugcccuuguguccccauucguuccgagugggggugggggcagaugagaggcauaccuucuuugcuuuuguagcccucaccaagaaccaaacagcauccccauuucagcaggugguagaaggggcccugcccagcaggcgugccaggaugggcagcugguccagcuuagggauuccugggauuccaagccuagcccgaugcaggcgugguggcccuuuugggacaaguguggaacccacagucuguggguaggcggugcuggaucagcccagacaaaggguuggaggaucauggcuuuguuguggaaucugcuuccuggaacaagccuucgucucauuagauuguagaggccgccagcuccccuggguugucaagcguugugccugcugcaucauaugaucaaacugguuuagucagaauucugugggauagcccugccuggaggacucuucccugacuuguuagcauaggccuucuccagggacccaggcccccguggauagugugugucaggggagagggcuugaguucaguucugguuacaccucuucucaggcccuccguguguucuguuugaagggucagucuguacugcuugcacagaugaguagcucucacagugagauguucacauuacucucuggauagugcugaguaguuggggcuuuccuuuguuggugaagaaaagaucaguaggcauuggcagggagccaagcugcccuucugggugacuguagagcaggaaccuuguggguuccauagaaccuggccaagugugaggaaaacugaagaggaguaggcacuaauuugggcugauccucuaaguucucauccuuuucauuaguaggcuagucguggauaaccuuggcuugguacccauguucucucagcacagggcuggacauccucacacccagccuuaggaauuagccuuguagccuaguuuucuaacaaaguucugaccagcugccuguuucccauucuguaccaagcacaggauuggggauguauccuugccuggauaaacuuagauuuucuacaacaaaucaugggaaggaaugcuugagaguuggucaggguuguugguacagugggaaacuuuacagguguccuggccaugggaggaugggacugcugccuaguuuggguuucagcaaacccuuucuuugggaaacaacuugauguugcaauaaaauuuuauugguaccagccuauuagaugaccuucagugucuugaaacuucuggaggcaugccauaguaagggccacagagauccuuauguuuuuaaaaucauaggacgugccugccaggccauaucucuguugcuccucacauugauucucagcuucuguucucuguguugagaaccugagcaacugucaugggcuggucugacuccuggccugcacugugcugcccucauucuguauccuugggauugggagcccgggagcacucagcaugcagacagugguccagggagcacucugagugccgacaguggucuggggagcacccagcaugcaggcaguggcuggggagcacucagugugcaggcagugguccgggcaugaguucuuugucuugagucagacauuauguuuccauuugggcgaccaggaaaggcagaaugauucccugaauuuguguuugaaggcuucuguuauugaggacugaguggggcucaagggacagagaggcugcuucaucucugaugagggaacucucgauucuaaauccucucagcagcaagcuuagacuaaaagguauucuuaacucagguaugaccucaggcuggaggcauuacuaacccagguuauaggugaggaagcugagggacacucaucugugcccaacaugguccccaguuugcaguguuguagcauauuucagagguagaucaacugagcagcaaaugauguucuuuguccuuccugagaugguaguagugagcacagguggguuugugugcucccacauguacccagggucuguucucucuugcuaugcugucuggcuuucaggauagacacauguuuuagaugugaccccaaagcccugucccaucagcccucccucaguguuauaccauccuacaaugcaaccagaccaagcaccugugguaaagcacuaagcucugucuugccucaguuuuugugugcaaaguaggugcuugugcaaccccacccccaacccuaccccauggcaccaugaaauggucuaaugcuuagggcauuccuguuuuauggcuucagucaucugguagauucuguggauagcaggcauuaagcccuugucauagacacaagacugucccuugcugccucaccugccccagccuccuuccagggauauaguuucagcugcccuuccugacugggcuuuuugucuuccucaccccuaacuauuagccccccauaccauugcucaugcugagcaccugaggcacaccaugcuugguuuugaaauuugccccuuagggcugcuaugauuucucuuccuacccagagcuucucuucucccaucuuagcuaaggaugauccagcugcugaagucaugauuggccugguuccuuguaggcacagaggauugcaccauagcuacauggguguggcugaccuugaagccagcaucccagggggcuauguguuggccagaagcaaacaugggccguguuccucuuguaggcgccuggcuggccaugaccucaugcuccagcuuuucuggcccuguugggucuugcugaaccugggcaacuugagagcaguaggcaggagguaggucaggagccuguguugaguacaucaccagagcauugcuccuccucaaaacacagcaucuaccauucuguggucaagacuggaggagagcuaggcugcuucuuuguccucuucuuuccuugaagcagcuuguagaaggggcagguuagaggcuauaucugcuguucaggggcugguucuugauacuaggguggcaaaggcucccaucuucuguggugccaccugggaggcccgagggaugagccagggaaaucuacaaacacaaccacagcugucccccaccaaccugcaggucaggaacaccuuuccagagagcauuuuuucaagggaggacagaagggagccuacaacccauagaacaggaagaugauccuggguauugcaggauuuaagauggaguugaaagguuguauaggauuguaugcaguggcgucugaaaagaucagaagaagugugccccaacagguaucuacaccucucugacccccagccucacacagagccuguaagcugggcuugguggccacagggaugggcugugucuuauagguucacacuuugcaggugagggguguagcacuucaggaacauccaugcaguugccuuagacaacuucagugagcuucaugcauugggguguucaguauaaguuuucauguaaguauguguuccuucuuuuuuguuggguauaguacuucauuauaugaauuaccauauuuaguuuuuuuauaaaaaauuuaucauccgugugugugcaugugcacauguuacagcauauuagaggacaacuuuguagaauugauucucguugcaaccuuauuuauaugguaucugagggcugaauucagguuaauaggcuugaauggcaaaugcuuuugccuguagagcaauuucucaggcccuguauuuuaaaacaauggagagcugggauuacagguacauacacuaucacaccuagucuguaugcagcuuuggggauuuaaaacuguagccuuauucuuacauggccagcgcuguaaccacccagcccccugugguuguuuuccugccaagaugagaucuucuccauuguccuggcucuucucaaguccugcuucagccuccugaguauccgggauuacauguguuccucguuggcuaccgugcucagcuuuaagguucugugugugugugugugugugugucugucugucugucugccugccucuauguguguaugugugugugugugugugugugugugucuaccucugugugugugucucugucugucugccugucugugugugugucugucugccucuaugugugugugugugucucugucugucugucugucugccugucuguguguguguauaugagcuacuugcacgugugcuguggguucaaggcugucuuucccacagagcuuuuaucaggucagcuggucugucucuaagcagugaagugccuccugguugugguagcaggugggguagucuugcucuuucaaagucauuuagucuguucuagguccuuuaaauuguuauaugaccuuuagaaugaacugaucauucucuaugaaaagcugcuggaacuuuggcaucgugaagaggugacauauaggcuccuuaaacuugguacacacuccaugguugcgcucucggguuuauuaggcuuugcuuuauuuuauuauuauuauuauuucauuugggcccucauuuuggcugccuuucagaguugguuaauccuuucugaugcaguguguccgcaguuggccccugcuuucccucugcagaagugcuacugggcucuuuuguguccucuguuggcgcucugcuucugacugagggacuggguucugguccccgagucucagcuguccgcucuucugcucaggacugugugcugucugcugaugaacaguucugccuugggucuucaccauggaacuuaccuguuggcagcuggauguguuuguuuuccugaacgugcuccgagcuuuguucuaggguguaguggcucggaacuggauuaauccuuucauggucugucuuuacacuuugugcugcucugcuagagcaguguguaauccaggcugauucuaccaggccccggacaugcucucucugagccugugaaucggugguccucuugguggugggaacaagcuugcuuucagacuucauguuagggcuugguccugcucuucucugcugaacuuacccauggcuuccuuaacccugcccugaccguccucagugaacucaucugguucuuaguucuggcugcccuuacugcccugccuguagucuuauuccacaggcccugccaucugccucaguccuguuguguaccaugccccaaaguuccucugaaggcaugcagguugucaauuuccccaguaccacagaccaaugccuguuauguuaucauauguaaagccauuugcguguguguaugcuugguauucauaugcccuaaugcacauguggaagucauaggacagcuuuugggagucaguucuuuccuacauugggucuugaguguauacuuuggcuauaaggcuugauggcagauacuuuuacaugcugaucugccucagcagcccuauaccaucauacuguuccuguucuuugcagguuuuaguuucccacucuacaggaaguagagucugucccugugacugugugucgucucaguugaagguagaugucuccaucacagcauguuauauuugaaaagcugcccaggacauguuccugggccccaggcugguagcuuggguggaggaagucagcacccagguuggcaggccuaggcuugaauauugugucauagugcuuagccaucacacuuuggggaaaacuucugagguguccuugucccaacuccuaaguuggcgggugugucccaaggagccacaggugcuggacucuucaguacagucccagaguccuugguuggggccagcuggggguuugauuuccuuuguaugucuuaugguggacaggcagcaugggccaggugcuguguagggagcaauuuguggcuugaccagaguaaaggcaaacagaccagaaaucacaaagcugagcugcuuugauuuaugcagaguggauauaguguuggggacugaaagcaaaugggcaggaccugccaccucaugggugacuuggaguguugcacugugagcccuagguuaccccuccacacauacgccagugccaacccuggugcaacuggacuguguuguccucuggcccauugugaggccuucccacagucucucuggacacagcauacugccuagaccagauccugcuccguucugccaguucccugacaggaugaaaagaaauugcuuucugcauuuacauguguuaguauuagaaacuucucagcucagcaacaucccuguacaauguggcuuuguauguuuugcucauuguuuucuuggucugaauuccuagauuuguaaaguaaugaaaaaaaaauucccuuuuucuuuuaaaacuaguuaaagccaucauuuucuuguuuuucaguagcucuucucuuaauacuguuuucugucaugagccacggguccuacaaagagucaagaaaggaaggcccaggagguggcacagcccucugaggacauaugauaggcagccaggggcccagggucuggauacagcauagcugcugaccucgauaugacugccauguuguggugggugaggccagaacuuuuugcuaguugcucuacuugauagguuuucuuccuucaucccagggccugacacacuugcuucucaccagugucugaaacacgcagguacaugugucucuacacacccugagguagccacuuuagcuaauuguuacugugcccuguccuuagggcugggggcacugguugcccagccccaguuugucccagaacaaaugaugauuugacaucagggagcaggaugggucagcuccucacccuugugccucuggcuagcacaccucccaauuuuagccuuaauuuuaaaaucuggaauuuaucuuggguguguucuggggaugucuaagcucagaguauacuuuccagcugguauacaccaucaggccucaaacuuaguucuuuacagagaguucuauguauguuugcagccuuaugccuuucacauuccuuccugucacaccacaucaugucccugagacaaguguguuuucacuguggagaagcacgugccuggcaugagcaccgcaguguguguuuuaacacaugcacaacauagagcugcuucccaggucaagggccuuuguguuccuuguggucuugggucuccauugcucugcauccccaggacaaccaucucaugaaugucuuaccucuccaugcaggcauuuggccaggcacauacaaaccacaagaagguggcugcugauggugagagccgggaggagagccugauccaggagucggccuccaaggagcaguacuacgugcggaaggugcuggagcugcagacagagcugaaacagcugcgcaacguccucaccaacacccagucugagaaugagcgccucacgucuguggcccaggagcuaaaagaggugagugccuggcgugacaucugccacugugacagugggcuccuugaggcugcaucuugcuccuguggucucugugccugcacugugcccaccucagcagugucaugaguccucugagcaggcccugaccagcauggugguccgucuuuccuggggccaggcccgguauccacaggaugccuugucauugguugacuguuugcuugaagagcaguuugggguuuuuugucuguuugguuuuugucucacaggacuuggcuaugcgugaauggugaaugguagaccacaccauaugcaaggaggaauaucaagguagaguaaugcagccagaguaaugaauagcccaacuugugauuugguagccacagacacagaaaucagucaagagucacagagaggaaucuguggaacucugagcaaggagguugaggaccuauuccugagagucuccgugugagcuagaauccuggcuaaggucucccuguccauggccuuaggguuagccucgggauccuuuaggcuugggauaacacuggcuuuagcucucacuugcucuugagaccaagacaaagccuugucuucauucucugaagcccuuuguagaggacccuguguuccgucacugcacaccuuccaagcucucugcgccccuuccuaguuguggaagccugcccucugcagcuuauguucucacgagaaagucagcugaacacaggccagcggggcaugcugugcaggacagggccuggagguaacugccucccaagcaggaagucacaagagggaaaaugggagaggcuguuaggagaaagguaguaggagaggucauaaggaaucuccauaggccagcgagaccaaauccagcugugggccagugccagacaguggggggacagucauguuaacaaaggccagcgagaccaaauccagcugugggccagugccagacaguggggggacagucauguuaacaaaggccagcgagaccaaauccagcugugggccagugucagacaguggggggacagucauguuaacaaaggccagcgagaccaaauccaacugugggccagugucagacaguagggggacagucauguuaacacgggucagcaagaccaaauccagcugugggccagggucagacagugggggggacagucauguuaacacgggucagcaagaccaaauccagcugugggccagugccagacagugugggggggggggcagucauguuaacacgggucagcaagaccaaauccagcugugggccagugucagacaguggggggacagucauguuaacacaggccagcgagaccaaauccagcugugggccagugucagacaguggggggacagucauguuaacacgggucagcaagaccaaaucuagcugugggccagugccagacaguggggggacagucauguuaacacgggucagcaagaccaaauccagcugugggccagugccagacagugggaggacagucauguuaacacgggucagcgagaccaaauccaacugugggccagugucagacagugggggggacagucuugcuaagccaggagaccacagcagaacauaagccaaaccuaagaauggugugagaacagaaccucuacccuagacuggugugcagauagugaaggcugaaggcugccugaggcugggcuggggggacccuccacagacuuggagacagagaaggggacacuuaaagcaaagguggcuaaggggugugcagggagacucaggauuuccuccuaaagcauaaacaggaacaacaggaaucucuucccccaccccagacgggccuggcuucaauucacugaccucauuuccagcccugaacggccauccugccuucuagguugccuaggggcugaaugugggagacaguccugcacuggccuuucaggaaggaggggcagacagauggauugucacuggggcugcuucucuuccucagugacagccccuccuccacccucaccagagccacacuugugggaggaaaugagaucaugcgcugggcuccaagaguggaagcugccucucccccacccccuauugagacugagcucaagaccucaaggaccccacaccagaggaagugacuccucccuguuauugauggccccugggucagaguccuugggccugcagaggcuugacuacagcacacucucuuggccugugcucugcuggacugacagcuaaagccagaguuaacuuuacagcaccaggcagccuuaccugugucaaaugguucuaaugucuuagacccuguccuccuaauggcucucucaguguacugucacaugaagaaacugaggcuuaugugguagagccauuuuaggggccugauugugaucucugugcugugugaagggccaaugguagacaccucagucaguuuuuguuuuguuggcauuauuccuggguagguaaaugggcauucgaggaauggcuuguugcagacaugacacuguuucucagauggaugucuggaggcccauuagucccaguacaggguaagaauguuccccuuggugaugaguggacagguauccugugugggaaggguugggagcucaagagaccagaaaaaagacugacaguccccuaacacggaggccucuugagccagaugguugucacaccccucaugcuggugagcaacuugaggacaggggguccagguaaaggagagcagguggcuaggaccucagaugcuuggcuccgaguccauaugcccacuacuugcaucugggcuggucaucugcacagagcagagccuguacccugcacucugggcugacaucagacacucacccugggaggagaugcuuuucugagggaaaacuaaaccccuguggcuaguuggagccugcuggaacucucaggagcugugcaugugaugggcggagguggcaggcagcaggccagcugagcgucucugcuaagcuaagccugguggcuuggguuggaagcagucuccacagaagaaaguguauguuugaguccugugcugucagcagagaaggugcauuuaaccugccacgugauguuaccuugccagcacaugacuuaaguaugugugcacauuucucuuugccugucuuuccacaaggacacccauccacaguccaugcaggcccguacacuccaccaaagggaaauucuuugccuagauccugggucuagcaguggcggaagaguggacguucuagagagccucaggagggucagguuuacagaggcacugaggacucacacagcgugugggcucugcuauagggguauaacacucccguguggcucuggaccuggugcucucaggcuccuauccuggccuucugccucugucuucagucacauagccauguagaaacuacugccuucuaagucgcuaauugcuaucacauaagcccugggguaaugguggccuuggaccuugcccugagggcuguggccacauggacccacuuuguacauguuugacuucccuuccccuuccccuuccccuuccccuuccccuuccccuuccccuuccccuuccccuuccccuuucuuucuuucuuucuuucuuucuuucuuucuuucuuucuuucuuucuuucuuucuuucuuucuuucuuucuuuaauauuuauuucauuuauguggguacacuguugcugucuugagacacaccagaagagggcaucagaucucauuauagauagcugugagccaccaugugguugcugggaauugaacucaggaccucugaaggaacuaaugaugugcaccauuacauggcaguguugaugcugcagcuauggcuguaguggcagcgguguugcugcuccucccccuccucccauccucuucucccucaucuuucucuucuccauuuauauguuauuuuguuucacugauccaacacuacuguuuuguguuuccuccugcaucuuaugaggcaauauggccuucagaagaacauauagaugugaucaggagcaauuccuguagaugcugagggggcagagcugugggccugggcugcuuccagggaucuggagcagguuguuguuggucuggggaggccauccaagcauugggaacagggguuagaaacaaguauggagcagggaggauauggggguucuuuagggaccauuggugguguguggaaaacaucuuccuagccuuucucugauggucuucccaacuccucacacaugacauggagauggaaaccaccuuccagcagcuuuuuugagaugguccacauccaguacaacucacuuaaaagugugcuccaugcuugcuucucaucccuguuccuaaugcuugaauggccuccccagaccaacaacacacuugcuccagaacccugagcaacaguuccagccccacugcucuguugucccuagcacugccccucagcaucuacauggucauaggggugugugccauccuguagcuguuuuucuuuuuguggugcugaggauggaacccagggccuuguauucugugccaggcaagacacuuuucccugccuuucaguuaauuuuagaguguuucaucauuccaguacucucaaaccccucuuuagccccacuagucuacuuuccuguucuggaucuuucuuacaaauggaaucauagggugcauagucucuuugcuggcuucuuugacuaagcagaaugucuuuaugcucauucguguuguagcaagugucaagacgucauuccauaauguggcugaauaacccugcacugcagagacagaccaugcuuuguuuauccauucauuugccaguggauacuugggucucguccaccuggaacacugggaacacugaugugcaggguucugcgugcuuuguucucugguguagacauaugcaaaugagccccaguguugaccccacuuaacagguuaccacucagauggccucaucuuccagauggagcaaagggggcagaguuagggugugggcgaaguccugagagaaguguauugugugacguggcaggaccauguuagagacaccagugccuugcucagguccaggagaauggcagagccuucccagugaggcuuagagggaugacaacgucuuccucuaguccaaauguggcugcugaccgugugcagagaaugcucugccugauguuuauggccugaagagugcuucccucauagacugcuccuaccuagauuagcuaaacccuccuuguucagcuguauaccacaagccccgccuccucguucucccucacugcuucaguuaggugaaacccuggagcaugcagagcucagcagggugagagcagguugggucacuugccugaaguuccacaccugagagaaguggaagagaucugaccguagaugucugcugcucugcacaaacccugcugcccugggcuucucuccuccagacagccauauuguugcccaaagggcucacagcguaccuugcugugcugagcccccugugauacuuggaagcacaugugcuagggccagcuauagaaguaaccacacagcauuuuucucugccccugcagaucaaccagaauguggagauccagcguggucgccugcgggaugacaucaaggaguacaaguuccgggaggcccgucuacuucaggacuacucagagcuggaggaggagaacaucagccugcagaaacaagugucugugcucaggcagaaccaggcgagucucuagaguagugucaccucugggcaucuuaguccuuucacccacccaucuuccccuucucugccucgguccacauaccugaggccaggaccagugggaccuccacaguggagacaggggaaucaaagcucacagcaucuagcacuauaagagcaugaaacaaggccuaugacuuuaguaugacaaguucccaggccaaguguagcaugggagucuguuucugcugagcagagauagguacugauggcauaccagaaaaucuaccuuggugaaccagugauaauauugagcuuacuuacgggagcaugacuaaggagaaaucuuaggaaugugggugaaggguuacuggcaggggcauaggugaaggguuauaggggcaugggugagggggucacgggcauggggggaggaguuacaggagcaugggggaggagucacauggcaugggggagggguuacagggauggaggugaaggguuacagggacaugggggaggggucacgggcaugggggggaguuacaggggcaugggggaggaguuacaggagcaugggggaggagucacaggagcaugggggaggagucacagggcauggggaagggguuacagggacaugggggaggggucacaggcauggggggggagagaauuacaggggcaugggugauuccagaauagcuacaucacuaaaaaaacuugcaucuuggcaugggugaugaccucuaacaguugcuagauggaguucucucuucauuuagccuuuuguuuccugucuacuuuagcagacucugaaauugcuugggcagguuuaggggacaggggacaagggacaggagggaggguguggcuagaaucuugggugagcgucuaaugcacuuuacccuuccuucuaugagagcauguguauaggccugaucuugugagggucuccgagcuggguaaucauggcugcucugauuucgagacagcaagggccaugucaugccuggaggacaguguuccacaucaccaagguaugggggaaacucagaaagacgaaccggcuguacuaagacccccccagagacugaccgugaagccugaaauacugccauggcucugccuguuguagggauggaggauguacccucugccuguggcagggacuagggaguccuccuggauggguaaggcuuagaaccacacagugccugaacacgcaccccauguucagagaugcccuaagaucuguaggcagcagggaacaggaaauccuagacucuaccccaaaugccauggguacuaugcuugcuuugguuagagccucuaacacccgaucaucucacuacagaggccucaccaucacugucacugucagggacccggcauuuaucccaugcaagaggaagccugugugucaggguagaagcuuccguguuugcacagcagucaagggauggacucuggagcuggauaaccacaggagcagggcucacagcuccagccuguagcucauaagcaugaggggccacuggggagaagaaaaauugaaccucaaggagaccccgcccugaguggagucauuccccaugggagguuccugugccccauucagggcacuggaaugugggcacacuuacaauaguguaccagguuuucuucccuaccccaaauccagagagauucauucauuacuuucuuacuguuacaguaagagguuuucauauaugcccacaaacccugagccacacauuaagcaucaacuuccauuuacucuuucuuuguccacuccuaaaucaugucacauuaacaagaccaguuaggcuuucccacucuccgucuagcucucccaggccugcauccugaggacucagugcugagguguucagccugggggggacguccaguuuacucauuuggaaauauaauucaaaauaguggucauaccacacagcaaagagucuauuuuaugugccuuaaaauaccugguuaugguuggugaaguggcucaguggguaaaggugauuacagugcaagccuugugaccugagcucagcucccaggacucauacacauaaagugggaggagagagccuccaccgugcacacacgcagauguacacacauuuaauaaagagagauuugguuaauguuaccugaguacuguuauagaaucaguaccuacuggugcuaauucucagaaacauaauaggaauuuggcagccuccauggugaguccuuagccguggcauugcagguuccaugugcacacuccaggcacacugguccuggcaguggggcuggaaguuucuauuacuucuagugcucuagauggccccuccuagcgccugucuugcuccaugcuggaaguggccuuagcugcagccacugcccucugcagaguagcauuucauuucguguguccuugcucuuugugcuggggggaggugguguccugacauuguccuuguuuaccaaccugaguggagccucuguacugcccugacgugggagugcuugcauucuucccuagguggaguuugagggccucaagcaugaaaucaagcgccuggaggaggagacagaguaccucaacagccagcuagaggaugccauccggcuuaaggagaucucugaacggcaguuggaggaggcgcuggagacacugaagacagagcgggagcagaagaacaaccugcgcaaggaguugucgcacuacaugagcaucaacgauuccuucuauaccagccaccugcaggucuccuuagauggccucaaguucagugaugauacugucaccgcagagcccaacaaugacgccgaagcccuggucaauggcuuugagcacaguggcuuggucaaaucauccuuggacaacaagacauccacacccaggaaggauggccuagcuccacccucccccagccucgucucugaccugcucagugagcuccacauaucugagauccagaagcugaaacagcagcuggugcaggugagcgcgcagagccucaugccccaucccucccucuccccgugccuuuugcaacacuguaagcugugcuuuugugacauguagcugccuuuaacuuccucauaccauacaugaaauucuuacugguaaagaguagugucccagaggaguagguuccugauuacuguguaagguuuaguaccuugguacccaugcugcucccuuugcuacccaaaucauguaugggugaggugaccugucccucguguaacuccuaccuacagaccacagcuagagucuuugcagggccauacaucgucauaucugaaaguuuacuguugaucuauaaaugaguguucuccacaacaugagaaagggaaguggcggagagcugggacacuuagggacccugccagcaugcccuggacccagaguuccacaaaugaaacccagcuccaccccagcacauguuuagugaccucuuauggaugagcacuauuguuggugauagucauggucgcuguggugaauucuguccagucugcugucaacaaguggcaugggcagggaauuuacauagcccuuggcccaucuggcucagcaugagauguuguuuggucauccuagagucuucuaagccuuguugaccuguuuuccugcuauaacuaccuuugcagauggagcgggagaaggugggccugcuggcaacacugcaggacacacagaagcagcuggagcaggcucggggaacccucucugagcagcaugagaaggugaaucgucucacagagaaccuuagugcccuccggcgccugcaggcuggcaaggagcgacagaccucguuggauaaugagaaggaccgugacagccacgaagacggugacuacuaugagguggacaucaaugggccugagauccuggccugcaaguaccacguggcuguggcugaggcuggcgagcuccgggagcagcucaaggcguugcgcagcacacacgaagcucgcgaagcccagcacgcagaagaaaagggccgguaugaggcugagggccaggcacucacugagaagaucucucugcuggagaaggcuagccaccaggaccgagagcugcuggcccaucuggaaaaggagcugaagaaggugagcgauguggcuggugagacccagggcagccugaauguggcucaggaugagcuggugaccuucagcgaggagcuggccaaccucuaccaccaugugugcaugugcaacaacgagacgcccaaccgugucaugcucgacuauuaucgugagggccagggcaaggcuggccgcaccagcccagagggccgcgggcgccggucaccuguccucuugcccaaggggcuguuggccacagaggugggccgagcagauggugggacuggggacaacaguccuucacccaguucuucacugccgucaccucugagugacccccgccgggaaccuaugaacaucuacaaccugaucgccaucauccgagaccagaucaagcaccugcaggcagccguggaccguacgaccgagcugucccggcagcggauugccucgcaggagcugggcccugcuguggacaaggacaaggaagcacucauggaggagauccucaagcugaagucccugcugaguaccaagcgggagcagaucaccacacugcgcaccgugcucaaggccaacaagcaggugagaggagugggagggggcgcugccaccagagccugcuggggggcgcugccuccagagccugcuguugggagggaucacugcccacugcugccacagccccuaggccugugccaucaccuuguugcugcugucuccuuccucagggcuuccagccaggggauggagugaguguggggauuagagggugcuuuagccagagcuuuucagucauuaaguacugcugcuucuguccaccuuacaguugcucacgcugugguaacagagagcaguggucugagugcccuguggguucuccaggacagagucuauggugcaucauucuuccuugcuaaucaggguugaagcuaggacuuacugaggcaaacuggcaugccaggagcauggcuagcauuuugucccgacagcugcaugagaaaaaauuuuuuucagagaauuuuucauggucagcaguuccaccuugggcccaggguuuccaccuugaacacagggccuuacacccuucaccaccccacuuucuacuucucugucccccagacagcugagguggcccuggccaaccugaagagcaaguaugagaacgagaaggccauggugaccgagaccaugaugaagcuacggaacgagcucaaggcccucaaggaagacgcagccaccuucuccucccugcgugccauguuugccaccagguaccugcuacacugugauacucucccuucugcagccucucuucccuggagcuaccuguuagccuuacccacagccuccagccucauuccagagucccacaggccuguugguucagcacuguaguagcccugccaggcccccaacacagcucaagguuuggagacuacagcccagucccagcauguguguggggcugcccuucucgacugaggaggaggaaaguuuaugcggucccagggcccucagguggcugcuccccagccucccgugccucuuguaggcagugccauuuugguagacauucagcagaggugugcauccauuucccuguucccauuucccucuucaugacccuggaugcuccauuuccugugcuuugagcauaggaguccuagaagcaaagggcuaagggagugagcucaggggauggggaguacaguuuugaggucuaguuaccaguggugacagaugcggcccagacuaguuuguuauuccucuccuguaguguagucagggcuccaacgcagccaguuugccauccauucccagccuuccugucagggaugggcaagcgagcuuuaggccugggguuaugcaguuuccuuccucuccccuggggguucuuccuguggccugggaaagagcagucuuaaaggguggaaaacaaggccccugccuaucacccuccaaagacagguggugccaccugcugcucaguguuggaaugacaguguggggauggcaaggcugagcaccgaaacugggucagcuggcuguuuccuguaaagugugaagaagcugagacaggaugggccaggaccuguuucccucccuccagccccagucucuuagcaucccugcagguagguccugccaaggcaggcacaagcagaagaguccagcauuucucuggacauuuccuaccagaucuuaggggaagaaaaacauuuuuuugagacaggucucacuauguagcccaggaacuugcuauguggaucaggcuggccuagaacucauggaacucuucuucccucugcagcccacccccacucccaccccaaacccuaccccacccuacccccuuggugggauuaggaaagaauucuuguaauuccucagcaucuuguacaaaucauaaccuuugaaguuuguucuguuuauaaagaccugacuuuucuggugaauccgggauuucaaacauaugaggaagacaguauguagucucugaggggagcucuuaggcaccagcaggguguggguaaagcagagccauggguagcagaagggcagugcuuagagcccauguguccaccaccaccucuagagacacuugcccagugucuuaagauuccaccagacccaaacuaggcaggugugccggugucacccagggaaccuuggccaggcucucucccuccacucgauggggguggggcaugcugcaucacagcagguggaggcuugggugcucugauugucacucagcaaaggcuuacuaaccaccagcuacgguuugcaguaggaucaagcucaguccucucucaguuuacacccagauccugggagcuagugaugucccaguaucugagauaccuuuuuguucuuaaagugggagagagcuuacuggaagaaagucaaauggaugagcgccaagccuugcuuaucagaaccacuucaagccugcaaacaaauacccccaugucuuaggguugcuguaaugaaauaccauggcccaaaacuacuuggggaguguauuuuaccugauagcuucuaguuaaucagcuagggaaguuagggcaggagccggugcagaggccauggaggggugcugcuuacuugcaugcuccucguggcuugcucagccugcuuucuaacaacacccaggacccaggcauggccccaccauggugagcugggccuucccacaucacuaauuaagagaauguaucacuggcuuacccaaagaccaaucuggcagagguauuuucucaauugagguacccucuucccaaaugacuauagucucuaugucaggcuaacauagaaaguagccagcacuccccaagccuucugcccucucucccugcaaagaaacaaaugcaguaccacugaguugaagguaaccuugcuguucuguuugagcacugccucucucguccuggccauggccuuauuccaaaggagccuuugcaccaggaaccagaacaagcuucaccagcucuggccccagcucaggcuccaggagagaugccuuggagugcagugggcacccgggccugcucucccucucagccucucagcugugcuuugucuccacaggugugacgaauacaucacacagcuggaugagaugcagcggcagcuggcagcugccgaggacgagaagaagacccuuaacucucuguugcgcauggccauccagcagaagcuggcgcucacccagcggcuggagcugcuggagcuggaccaugaacagacccgcaggggccgcagcaaggccgccuccaaggccaagccagccucaccgagcguaagucacaccugcgccugcgccagcgagagggcggagggcgccgggcuggccaaccagguguucugcagcgagaagcacagcauuuacugugauuagggcuguggggcgccgcacaccuaacguccgcuucaccucaacuaacccagcugcagcagcgggacagcagugcuaggccgcuccuaacgugacuaacgcacagagggcggcacucuaggcaaguggcagcguugggguacaucuguaaccaggacacuuugagcuuugugcugcuuuucaugccacagccccgcccccaggauauaccaugucaguugcuguccuuugggaugcugguaucaaaaguaggggugaagcugcacaccuuuguggaagacagcggagugaaaguuuuccagggccuccaggcacuguuagggaacccaagggugaguucuucccuggacacucacaggggcagaaccugaguugaaacuugcauguugcucgcaugugucuaauaucagcacuugaaagcaguuuugugaggcucuagccugcaucauaggacuagccuagguuagcucgcuguggcuggcauaguuucaugaagaguuuccuuguaguuugugcagcaucucacugcuaaccacauccaggauggcagucccagagggaauggaccaucucugguugcagccuguguucugcagugagcccccacaccucagacacgauaaccauagcccaggcagacagcgcagcugcuccaucucaaagauccgcaugcugcuguguccugaaaggugacaaauuagcagggccugagguccuagguuuucuuucuugacgagaguguuccaagugccuggucagaccuugguccuugguucagagccuauuauuugguccuuugagaucugcagcuugugcuugggucuuuuccuagaaguugucagacccaaagaagcaguguuuugagaacuacuagugcucuaccaaacugcacggcacaguagagcccagcugugugcuaggggacuuuuugugggcccggagcugugcucaaaacuggcagguaagaguugugugguucucggugcaguuuguggauacuacagaaggaagaaaggccuccgagggcucuccuuuuccagaugcucugucagugcggagcuguggcaucagaucaggugugugcuuuagugaguuguaaaacaggacucugcucaguauuucucucccuguccccauggggcaucuagucuugagacuccaucucccauaauagcugcuuggcugucucucccuguggaaaggcaucuuucaugauguggaacaauuacuauccaauauggcccuguagucucucaaacagcuuucucuuucucuccccuggauccugggguaccccagucugcucagauucuuggcagcacauggucguacacugggggcagaacaggccacacgugucccuugcauguccauccugggaauggcugcccgcaugcccacccaaccuucugccuuucuuucucuuugggccagaacgcagcuucucuuacacuguauggggcuuuguggacacuuggagccccauccccuaacacacaugcaggccuccucugccaacuaaugugcucgcgcacucccagaacaagagcuuuagcugucagugagcagggaguggcucucgacugauuucuaaugcugucuuguuuucuccuguuuucagcuguagaguagcugcugggaggaggcggccacccggcccugucacacagcagccccucccccuccccuccuguggcccaugcagaggaaggaagggcagccuaaaguccacuuagaaauguuuggauaugccacuguaauucuuuucaaaauagcauuccccaaguuuuuaaugggagaaaaaaaaaaaaaaagcuuuacuauugagaaugcugcaaucugcugcuugggaaggucucuguguggccgaagaaccugcuuccacagccgccgcgcugccaggcucucuaggggccugcuggacgccugccacaggcucuccuuauuacacaugcuccuuuuuuauccgaucaaccugugcacuuuugauauuuugauauuauauuugcuuccuuaauuccuugcauagagacggucuccagugccguggucuguguucaugguccuguagcuguccguccuggcucugauguguugaccugcgucaacucaagguagagcugugcuccaugguguguagcuagacuucgggugaggcuccgacccggcaaggagcuggccaguguauccacgcugugguucagcagccuuuagaggacacggcauugugguucauguuugaaauuacagauuuuaaaugccauguucauuaagaaauccaggguauuccaauucugggguuuuucauauuguauuauuauuauuauucuuaggaauaguucaauguaacaagaagaaaacuugaccuuugcucugguuaaaacaguaauaggcacuugaaagcauaaauuauugaaugaguaguauuaccuacaaauuccagaguuuucuggguuuuaggacauugugaagcaugacugacuaacagaauuuuauacaacugcaccagugaaauuccaaauuggaauuguuuuguuauucugguugucgugccaaauugugguacacuuagaaaauucuacagccgucgauuuucagguguucaauuucaacaccuuuuuguuaguaaccauugccaguagugccuucaucaguucagggaggugucccagccaggucaggucuccaggacgggcagcaguggagagcuaguugggaaugcugaaggccauuguggaccagcagguaccugccucacucuguacuugggcaucuucauugagggagagagaacagugauugugcaaaauucuguuagucagugauucuucaaugcaaauucaggggcuuagaaacaagacagcacacaaaccuggacugugcuuugggaaccaaauggacuucaugggacaagcuaagcaagcuguacagacaucacguuugugaagagcugagggcgucaggagagccggcgaagucggcaugcgaguggggaagaggguuagccauaguauucuuugcaaaugugaaagucagacauuauaucuucucuugcuugguguaacuaaucacuguuaauuucaggaaacagaagucaguaaaacuccuuaguaaacuccuugcuaagugagguucaggguguggucaaauugguacuaguggagggagggaaauuguccuccagccuaaaaagggacaaauuauaauaauauaaauuguuaagaauugaagaauucuguuuccuggaaugagcauuucuuauuccuaguuguugggacucuuugccuucuguuacaguguugauucauacaaaauauuguuacauuuaagauaacaucaucuguaugggguauuuauuugcaaugaugucuaaguacuguauuuuuucuguguguuaccuuagugucagaauguuggucuuuauuuuaaaagucauaugcauguucuccugccaaggcaccuuacacagacccaaaacaaaacaaugagcagaugccuucagcuucugagaaaaugaggccaagugaggagaaggcauaggaaggugagacuagcugagacuucugucauggcugauggcggaccgucuccacagccagcacacauaggaaaacugggccugggugaagagucgcauugguaggaccaauaaagaauaauaaaacaauugaagcacau

SEQ ID NO: 7028 - RNA, 2296 nt, Mus musculus
uguuagccagggaaguuccuaacauccuaaaacaauccaggccauugccagugcuguugcuggcacaugggaaauagaugguaaaaugcuauugcugaagacuucacaugcugauugcaggacaugcagaauucaaaugggcugagcugaaaguuuccuucuugcagagugguguuuggaaguuccauaagugcuauguaggcugcuagggagaauagucacaaaugguccugcuagucuauggacaccaguguuaaugcuaccugguacuguucuaauggguacaacucaucuucugauugucuuuaaguauuccucuacaggaaggaacucauguugguauuguacccggggaggucauagggcccuuguauggaacuacuucuauaguuaaauggguaugugccugucagauuuucuguugaacauuuaugugaguaccuauagaugacugugcuguuagugucaauuguacagagaauucccccccccacucccccacacagccaguagaaguuacuaggaagacagcccgucaaguugccaagaaucaaguggcuguugcuauggcauagugguucauugcucagccaaaaugaaaagcaaucaccaaacaucucuauugcuuccuucaaugcucagagaauacaguagaagagggggugggaggaaagccugagaaagaaugaagugcuguguacccaucuucggagcaaaacacagacuuugccaucuuaaucaaaacagccgccucagcugcauggguuuccagggguuaucgaagguagacuagcugaaggagaaacccacucagcuuuugaagaggaauggaucugugcuaggaugggagggguuuuuuguuguuguuuuguuuuuuucagugcagcugguuugaggucuuccacacuaauauaaauaacccuucacccaugcuccucuaagcaugaccuguaaauucauuugguucaccaagcuauacuuggguacauucauuucuguggucuugaaagaccccgagaggagccccucgcucaagucucgggauaauagcggacccccaagaacucacaaaagaccaaacuugaugcaaaccaccugaggcuuuauuggggggaaagccagagcucuggggacgacuuguaucccacgcagggguagaggaguugaccccgaggggaaaggggucccaguuuuuauaggcccucacggggggggggggggaggagaaggggggaguaggggauuuccagaucuaaacaaugucuauucuuaagaaauggguaugggagggguacaaggaaagagucuggugcagguggagcaacucuggauuggcccggcugugguuacuggggagauuuuucgauucuaucccagcaaccaauaucacaaacaccucgcagugaggugcagcagugggcacacaccuggguuuaaggaacggucagaacauuggcagacacacggguucaaggcgcggccagagcauugugcaccucuauuuuucuaaaucagugaagcuacuuuuacuaacaaugaaaucuauuuugccaauuugagggcuucugugaccuuuuacauucuauuaggaucuuucagucuguuguugguguccuauuuagaaugaacagguuuuuuuguuuuuuucccagucuuccuuggaaaaauuaacacaaaaaaacccauacuaucugccugcauuaagcuggauuuucuucacauacaccaguuacagcaauauucagugcuguggccaaacaauuuaacacaaauaugaaaauuauguuugagacaggaucucacuaaguaacccuggccggucucgaacuccuagaaaucucuugcuuccacauccagaaugcugagagcaucaccauguccagccccaaaucauuuuuaagagcacaaggaccgcauauaauucuuuaggcagcucuaccaggcagggccaaucuuccccgcauuaaaggauaaacugaggucauugcuuucugcugggauggggugggagagucuauugccucaucugcauuucuggaugucuuggggcaaaggcuccacggugagguuuccucgccacguuucccggaguagugugaacaccaccuaauggcucucuuggccggagcaaggccauugaaggugcaucccauucuacagauguaagcggaggcucagagucgcccggcgccuuacugcagccccacgaagauccagccguggcccuaggacagugcgagggugagcgccucggacucggggcgccaggaagccgccggccucaagguccgggagc

SEQ ID NO: 7029 - RNA, 3274 nt, Mus musculus
uguugcucccaucugggucuccaucuguccugugcugugacaaggaucaggcaaguaccugauucugcagugagcuuacagaaaaugucuauucucagguacuuuaucuauuuauuuauuuuccagauacagucucucuuuguagcuuugacuguccucagacuuacuacauaaaccagucuggccacaaacucacagagaucugucugcuucugccuccggugugcugcgauuaaaggguacaccacuaugccuggcuggguuucuuuaaaagugggguguggauucgcugcggagccggaggaggaggggagagguccggaggacaccaacaugaacaaguugaaaucaucgcagaaggauaaaguuagucaguuuaugaucuucacacaaucuagugagaaaacugcaguaaguugucuuucucaaaaugacuggaaguuagauguugcaacagauaauuuuuuucaaaauccagaacuuuauauacgggagaguguaaaaggaucguuggacaggaagaaguuagagcaacuguacacuagauacaaagacccucaggaugaaaauaaaauuggaauagaugguauacagcaguucugugaugaucuggcccucgauccagccagcaucaguguguugaucauugcauggaaguucagggcggccacacaguucgaguucuccaaacaggaguucauggauggcaugacagaguuaggaugugacagcauagaaaaacuaaaggcccaaauacccaagauggaacaagaauugaaagaaccaggacgauuuaaggauuuuuaccaguuuacuuuuaauuuugcaaagaauccaggacaaaaaggauuagaucuagaaauggccauugcuuacuggaacuuagugcuuaauggaagauuuaaauucuuagacuuauggaauaaauuuuuguuggagcaucauaaacgaucaauaccaaaagacacguggaaucuucuguuagacuucaguucaaugauugcagaugacauguccaauuaugaugaagaaggagcauggccuguccuuauugaugacuuuguggaauuugcacgcccucaaauugcugggacaaaaaguacaacauuguagcacuaaaggaaccuucuagaauguacauagucuguacaauaaauacaacggaaaaugcacagucaauuucugcuggcuggacugaagaucaauccucauaauucaaacugaggguugagacaaaacuuuuaaggauacaucuuggaccauaucguacuccauucuucuacuggugguuugggcuugucuucuagucugggccacucuaagcauuuauaauuccgacauuguggauuucaucuuacaccuguggaccaucuuagucugucuucccauaagucauagaaacuugauggugauuauuuugagguuuccauucuugcauaaagcacaaugcugucuucaucagaaaacaguuuggcauaagaauuaaacauaauaaugaacaccacaacaauuuauaaaaacuucuuaaguauaugcuuugggcuaguugcaaagacugugcuggcagcacuucaaaugagagugauuuaucugaguguaccgcaucugaaaugguguuugguugggggaauuuaauuucccuggcaaacuacauguacugcuggugugaguagaauaccugauauaagaaaugucaaaauaaccaacacaugaaaaaaaaaggauaaucuggggacucccugaaauaugucuuguguuucagaugcucacaaagguucuacagaacaggucugugguuaucuuacccauguuuauacaguguccugcagugaacuuuuauuuaaaaaaauauuguaaugagaucagauguuagacuccacacuugugcaucacacaccacauaaucggauuucauuaugcucugaaauacuucuaugccuucugaauaaguuaaacuauuucauuuguuuugaauguuuuggauugcuauacaauauaauauucuaaauuuaggcaugaggguauuagguuuguuuguuuuuuuuuuuuuuaauuuuuugucaucucacuauggaacacaaugcaauucacuuaauuuauaagaagauaguaagauuuagauuuugaauaugguugugaugagccgugaaguucaaccuuucucccauggcacugcucuuugaggcgugguccagccguguuggcugcugacuguugagauggcuuacugcuaaaucacugugguugccaagucuacuccagaagcagagauugucagacaggcgagcacuggugcagauaccaauggcuucuguucuauaaauuauuugacuuuugacuguuuuugucucacuugcauuugcuauuuccacaucacagcagaaugcagucuugauugguuuuguuuuuuguuuuuuguuuuuccaugacaggacucaugccuugcucuccugcugaaaaugcuuguuucucugauaacauacugacaugugaaagggguguauucauacauauuuccaugaggaaguuaaaaugaugaacuaaauguugggugacuggucuucaauaggaacagauuuugcuucauguauccagguccucuguaggguaccaaggaauguucuucagaauagcggaacaauuuaugcagauauggaaaugauuaaaacugcuuuuuagucacaugauuuggaaaaugcauugaaagcuuaccuuacagauauaucauuaauccaaucauaacuuuaauuuaggaaugcauuucuaccaaaagaagcuuagaguaaauuucuauucacguuacagggauuggucauuaaaaggaaaagaaucuugcuguuuucaguauuucuugauuucauuuuuguaaauauaaagaacuucaauuaugaaaaaaauuaaagauauauguauauaaucuuuaaaaguuuuacagaccuauauuguuuauucccuacauggaacauuuugaguuuugguauuguuuucagauugauugauucagauaugauuuguuuucaaaugagacuccauuagcuucuuucccugccucauaaauuuuuuuucauaaaaaaaaaaaaaaaaaguggggugugccuauguuccuaagcuuugguaacagugagucugaagucagucuggcuauauaagaccuugucucagaaaaccaaaauaaaugaaugaaugaauaaauaaauguauaaaauuuaaaaugcuguacagcauaaauuauauuuuuacuguaaauguacucuucuaucaagaaaaaguaaga

SEQ ID NO: 7030 - RNA, 23126 nt, Mus musculus
cagugauggaaaacauaugagcaguaacaaguuuuaaucucgcucuucaguacuaacauggacuaaucuguggaagcaguuuauuccaguaucacccaggagcagccacacagaggcugguaggagggcuggauuuuuguucucuuuuuuucuuuucuuuaaauguaacacuucuuuauuuuuucuucuugaagagucuugaggauacuuacauugcaguuaaguaguacaggguggauaaauucuacuuugaagaaaacuucucuccucugacaagguagguuuucaugucuguauuacacauaccaguauacaauuauuuuauuguuaaacuaagaaagcacuaauacuacuaauaaacaugugugaguuauacgguaaaauuuaaaccagaaguauguaguuccuuagcauuauauaaaaaacucugugaauuuuguaacuaaaauuacuuuaguuuuaugucuuauaauaaaguuauuuaaaauauuaugcauuuugaaaacaaaguaaaaaacuuucacuaaugcuuuaucauauuaacaugacugauuuuaaaaaguagacaacuuauacaaccuuuuaggaaaacaauauuacuuuaauaauguuaaugaaguuugaacauauuagauauauuaaaugaaaguuuuuuaacuauguaaaucuaugauaccacuuuuaucucuaccacugaaaaccuguacuuuuuucuugacaauugucuuauuguacaaugaaaaaguacugggcaauuauaacagaaaucaacauaauuucaagaaagaauaccuaucagcaauaguuuaaccagguuuauauuucauaugaaaaauagaaacuucuuuucauaaaccucauacuuagacuaacacacaaagauuuccuuuguucuuucacaaaguacguuuuauuuuuuacaaaguauauuauuauauaucuuagauuuuaaaaauuaauaaugcuuucaccacuuuucuuccaguuaucuaaauggaacauaguauucuuucaugcucauguguucagaggaguggcagccaguaaaacaguggccacauguuauaaggacugagucacaaagucacaaagaaccugagggguuucuguguaucuuaucaauugcucuaaaaguagcaugcuuuuuaauuuuucuuguaauccaaucaagaaucauuauguugagaaagagagagagagagagagagagagagagaaaagaaaacagggaggaagagagagagggggagggagggagggagggagggagagggagacacacacagacacacacacacagagagagagagagagagagagagacagacagacagacagacagacugacugacugacugacugagggagcagcuggagcucaagccccagcucauguggaaguauccaagcugcuguuccucguuugguuuuggcaugaagcacuguaguguaguaguggaaagaauggaagcgaugcacucuucuguuacaucuaaccacuacauuaaaaauggauauccugauaccugacccgaggcuugacacaaaacagacucacuuuacaagcacugcaggaaaucucagaaaaguggagaggcaagaauguuuugcuuuuaaaacagcaguuagggugcugaauauagcugaugaagagaaaaacugguaccuaaagaaagaaaaauagccaaguccuuaauuagaguguauauuuccaagcuaaaauuaauuaaagguguuguuuuaaaaaguauuuugucuaugaacaaauagugcagugacuaaauuucccaaugaaugcuuggacauuuauguuauggaggacaaggcugugcauguagucuguauucucucuguaagagacacgggacauguuugccacauuuauaccuggagcuuauaacauaucuaugaacugaaauaaucaaguugucaaguggaccuuuaaacaugggauuuaaaauuacagugacucauuuaccuaauaagguucugaaagaaaacagcaucucauuuagacaagauuuccauuucauguuuguagacaguuaagugguaacuacgaagccucuggacuucuuugcuacauuucuaguauuauuaugaagucugaggggcuggucaaaccucuccuagacuuuuucagaggaaagcugcuucacuguccagaagugacugugaaaugaaaaucuacucagaacaugguugaaaguuuuaguagagaggagagaggaaguugccuuagcucugcugccuccagggaguucuggaagcccaaagccuaaacauccugggaaugguuccugggaauggugucuagagcugucucucagcucuaacuggucugauuuauuaggaacaguaggaacacugggcuagugcucccaagaguauucuuauuaagacuacaacuugagacacaaacccaaaacuuuccaugaguacaaacacgggcaaagucugucuaaaucaggaaaauauugagaaugagguauaaacaauuuuaaaguuuuaaaaaauagcacaaucugaaugcugccaaaaccaguaagcuugacuuugaccuguuuuaacaagcuuaaaacaaccaccuuaaauaagaaauaauacuguuuugcguauuuuuccgaauagaaggcacuguuguacagugcucccucuucugcacugucaauauuauccaguggcgaguggauguacaacucgaacaacagagguuuagcaucuucucagauacuccucaaaucugcagcagagaccuagcaacaucaauggacaaucccucaguguaccaauguuggccucuguuuucucuaugagcaauagaaaacacagaaagauaaguauuuuuuaaaauggagaacagaggauagaacucacaaagagaacuauuaagagggcaucucuguuuuuaauauaaagccuuccauuagggaagccauagguggcuaaagaucuaaaggcggugugcuccuuagaguacuuugauuagcauuauuauguagcgcaguccagacuguuuaggaaccuccacuaagagguacuuucguugggguaacagacuaugaauauacagaucuguaccuuucaccagaaaaaagaaaaacugcuguguaggagcugguugccacaacuaacuaccuuccucuacuaugacagguaaugcugaaacuagcaggcagaagucucaauucauaccucauccacuacuguuuugaaaaaggcaaagaagcaaucgugaacuaccacuguaagaaaggucagggaggcaggacuguggcugaagcuuagugagccugagguagaauguggaagagaagcaagcccaucacuguucuguuuccuguuucucugccugccuguuuccuucuuacucucuuaccuccaaacucaacuucuccuaccccauccuguuccucagcuugaaccuccacucagcauugggggaauuacucuugagcuugcucaggcaagugggcuaaaggaaucucugucaccagcauguggaaagcauacaaaagaguccagcccucaacucugcugccaggccacauggaaaaucaagauguguucuuggcauucacucuggaacccuaacauauuucucuuguuauauauacuuuaaaauuuuccacaguuuucuuaguucuauauuucaaauaccuuaguguuaaaauaguuuuuguucuuauacuggaagcaaaagcccaaguuuuuauccugaaaagacuuaaacaaaaacaaucagccaacuuaauaaccuccaauuuucauuucuuauaauuuagaaaaugaggcuaagaccuugaaacacugccugacauuguggugcacgccuuuaauccuagcauuugggaggcagaggcagguacauuucugugaguuugaggcaaaccuggucuacaaaagcgaguccaggacauccagggcucuguuaaacagagaaacucuuauuuuugggauuuagggguaccgaaugaacagacagacaugguagacauagggugggcuuacagcuggccaacaacaacaacaaccaaaaaaccacccacugaccgggugggguggcacacaucuuuaauccuagcaccuaggcaggacuaucucugaguucaaagucagcuuggucuauauagcaaauuccagggcagccaggacuacauaauacucaaaacaaugaacacaaaaaccccaccaaaacaacaaacacaaccacacaaacaaaacaaaccuccaauaacagaacaaacaaaaacaaaagaaaugcucacugaauaacuaauucuggcaaccucaaacuaggcuaggccaaagacaggauguuccaaagauaccaauuguaaucuucuaauugguaaaguuaaaaguagccauacaucugaaagacagagcugcaauuuaaggaugcaagaguaaacuaaaggagcuggugcugaacuucaguugguagagugcuugcuuaguacucaggaagacccggguucagcuccagcacagcacacagugguguauaccuguaaucucagcaccugggcgguaggcacaugcacacuagcuguccaaggucauccucagcugcauaaagaauccaaggucagucugaggguauaugagacccugucucaaaacaaacaaacaaacagucagcgacaacauaagagucagcuaaggaccuaaagcagaauuucuagagaaagaacauuuuggagacugaggcuaaguugauauuaacaguaagaaagaaaccagggaaacacaaaaagguauaagguaaaaagauauaauggaaucagcuguggugacucuuaccuguaaacacagcauuccaguugcagaggcaggaggaacauccaugaauucaaggauagccugguguauuucaaguuuuaggccagccaaagcuacucagugaaaccacaucucagaaaacccaauuaaaugccaaaauaggacacaaguagggaagaagagaugaagcagggauaagaacaaaaggacucugaaaacgacaguaacuacaacccuauguaaggguuucuagauauuccagaagggagaucccacaguagcaaacaggcugacaguuaaggaaacaggugaccuuauccaauagaagccacugggcccuuauuaccagcacaaugcccccacuguggauuucauaaaccuugucagaaaucacuucacguacuuaugcaugugugcaugcagguccucaugccugcacaacaaagacuuuccugccugcaucaucagcccagcucuauucuugaucuuuaaaauucaggaaaaggcaaacccauguagauauuaaaguuugcgucuggguucugggacauaguaaacaguugacucaagcaucagguauucugaaauggggccagaccucacugacuagaauucucuuacugagucaccauugacauacaauguagacucagcagacuguaaaguggcugaagcucagagacuucuguagagcucucugcucuugacugugugcguauauauucauguugagacuugguuuuacuaaugcacaucacugguauauaucaaauuuugaugacuuuacuauauuuuuugaaaaugucuaagaauguauauauuucauagguugugguagaugucuauaaucucaauauuugggacugaggcaggaagauuaaccuacaaggagcugaccugggcuuucagggagacccuguuucaaaucauaaaauaacaguaagaauaacucucaaacgaggauauguaaauauauccaugggaauaucaaacaucagauggugaacuuaugcucuaaagguucuccuugauacauuccaguuuguauaagcuuuaacacacacacacacacacacacacacacacacacacacacacacacacaccuaaaaacaacauagcaucuaccagagacaacauucaaucauaugaaacucagugaaauaaugaacaacaaaaauagucuggccaucagcuggccgauaugggguauuagauaauaucagauuagaaauaaaagauuccaaugacauugugggaaaguuaucaauaacaagaaagggguugaguaagauaacaaagaagucaaggaaaauguccguauguauaagugccacugaggauauucuuggauagugacauagauaucagcaauggaagguguuaaaauaguauuaguuauuugacaauuuuaaaauuuauuuucuaauuauaaaagaaauauguauugcuuauaaaauuaaauaagaaacagaagacaaaacucaucaaggcuggggauaugcaguggguagaaucuaugcuuagcaaguucuaaguuugaucccuagcaccacacaaaccagguauagugcuauaccccugaauccuaaacgucggagguggaggcaggagaaccaggcauucauggucauccuuggcuauguaagggguuccaggccagcuugggacaaguaaaacugauuuucaaaaaaaaaaaaaacaaaaaacaaaaaacaaaaaacaaaaaacaaaaccuacagacuuaauucauaguucuaccacuguaauuuauaauugaucagauuuacuuguaugagcuauuuuuuauuuagaaauagacuaaguacagauuuuaaaauauuugcuucuuuauuucacagaaaauaaucuauauuuuaaaguaucuuugaaaacauuuuguugguuaaaauauauuucacugggcaaauacauucuccuuuuuaaauuuucuuuuaacuaauggaauugccuucaauuuuuuauuauacauuuuagaauuauuucuuaagauguggcuauucuaaaaauucagaauaaaaagaaaacaaagggaucuuauucauagaguaauucucuuuucaaaacuaaguacuucauuuuaacuuccuuuacugagauuuaucucaagguaucaugaggucaagccugcacuuguaaaauuuuguuccagucucucagguauugcuauuacaaacaugcaccaccauggacagacccagcuguuuaaauuaauagaaguauugaagcucccucccaaagcacaugcugaauugcuuucuaaaacguuuuauguuacacugcauagcaauggauaaaaaugucauuuugucauaauuuugccaacacuagaaauguauauaacaaaaguuguaucucuugaaacucuaauacucaaugucuacugaaugucagguuggacuuguacacaggccagcaugaaggaguaugugaugcuacugcuuuuggcugugugcucugccaaacccuucuuuagcccuucccacacagcacugaagaauaugauguugaaggauauggaagacacagaugaugacgauaacgaugaugacgacaacucucuuuuuccaacgaaagagccagugaacccuuuuuucccuuucgauuuguuuccaacauguccauuugggugccaauguuacucucgaguuguucacugcucugaucuagguaaggacuccagagucagcuuuguuuugaagaauacugcuauuccaaaaagguuaagggcauaaaauaagucacugaacuuucaaaacccucuucaggcacuaaaaaaaccaaagguuuauuuauacucauagguggaaggugaauguggcaaaguagacuuuuaguucacauuacuuaggaagcuaagacagaggacuaaguuacaggacgacuuagguaaaaauagacucauauuaaaaaaauauauaagaaaaaugaaguggugguagauuccugcuuacugcccugguuuugauacuagaacugcaaaacaggcagagaaauguucagguguagaccacaguagaccaauacuuauuuaaaauucagaauaaaaaggaaaaaaaauccugauuuagaggauuuuucucuucucaaaccuaagcacuaaaaaauuuuaauuuccuuuaccacaauucaacucaaaaugucaaaagguugauccugcacuugccaguaaaauucuaagguaacuaaauacagugccugugcagagcaaugacaguuauguagacuuccugaaaucuuuagacauuuuaaaugcaauguucuauuuguuaugaauaauguggguuuagaacuuccuagaaaagaagugguuggacuguagucuauuuaaaauuuauuauucuucugaguaacuucacuguguuguuuuguugcugcaacaaaauaacuuugggaggagccauuaauuuuggguggcugcucauugcagcuuacauacuggcaagaagaggggaaaggcaagacagaggaaauagaaagggguugggaagcaagggauaagcaggaaggaagcaaaguaaggagacagagacagacagaaugaauggcagcaauagcuaucuuucugcuucccuccccaccuuuuauucaguuuuaucagggaggaugucacuaacauucaggcugggucuucaccuuuaauuaaucuugucuauaccuagagguacauuucagaaucuagucauguuaaccaucaagacuaguuaacuucaaguuagauacacauauuaauuugacaccaaaagagaacaaggaggaaaucaugggaagucaaguuugaagggaggaaauggaagagagaaauuagauaauuauaaucuucaaaaaauguaaaagaacuguguaucucuaucuuauucugacauaacaaaggcagcuguugcuacugcaaagaagaacagagacuaaaggcacaaagguagaaaagugguaagagcuaaaccacuuuguucuguaagugaugaaugaaauaauuuauaucucacaucuacauacuaaucaagauauuugaagggucuguaaauaagaauuacagccaguuagaggaauugucuguaguaaaagagugccaaguuuuuuugaauaugcaugaaaauaaucuaguauaucuauuuuucuaaucagaacuuucuacucuauagucuauuuauuuagucauuuauuuauuuauagacagggucccacuagguaagccaggcuggccaacaacucacagagaucuaccaaccucaaccucuggagugcuaggauuaaagguguauacaaucccaaccaauuucuuuuugguucuccccucaaccucaaacaguggucaagacccuuaugguccaguuucuuacuaaccagcaaaucugcgaaaaagcuauuauuuuucagcccaaagagcauucuuuaagcuauugcuuguaaucucuacacaaagccaaacauaacacaccaccauuuauuucaccuuggagccagccagguucaaaacagauagauaccuuguaaaaauaaaaaauuacuuaaagagaucuugagauuuuucaaaagaaaauguugucuuuuuuuuuuuuuuuaacacaugcuaagucugauguuacuuaucaccgugaauuuuaaaagugcacaucucuacaagaucacugaucucaucuuuagcaucuguaacauguuuguuuguuucucaggucugacaucgguuccaaacaacauuccauuugauacucgaaugguugaccuucaaaauaauaaaaucaaggaaauuaaagaaaaugacuuuaaaggacucacuucacuuuauguaagaauauaugcucauauuuuuaaauauuuacuugaaaauccuuaucacuacugaaaugauuucuuagacuguauuaguguaaagacaucuuaguuuccuauggguguccuacugcaaaauuuuugccuucagccaaguaaaugcuauauauuuaauucaaguaauauucauagaguaauagccagauaaaagguuacugggaugagagcuuuaaugaguucauaaucagaugauuacacucacuauccacuaaaaugaguaagaaaauaauuauuucgagugcuugguggccuuugauuccagcacuuaggaggcagcaguagguggaucuuaagccagccagagcuacauaaugaaaccuuguuuccaaacaaacaaaaaauaauuaucuacaccaauaauaaacacaguauguaagaaaucuuuacguaaaacuacugacuuaaaauuucaccacaguuccucuaaagcacacagacuauguuuagaugacuaauauauaugucaucuuucccugaucuuuguaaaaggaaagaauuuucccuuacuauaucaauaaacauaauuaauauuuuaauuuccuaaugagcuuucugaguccauugacuuucugacguaaucugaaacucaguuaggaugaagagugugugcucccugacacagcugucaggcgggcgucacugcuccugucaguacugcccuuguccugcugagccugaggaacagcucuggcucuauacuauaugguauggugggccagaacuaccucuuccaggccauuuccuauacuucuaggcugcgcuggagaaaauaaacaugcagccggcuuuccuuagagaaaguaaaauucuaagaggagaagagaauucauaaccauacuaugucuuauauauagaccuauuuauauauaacaggagccaaggacagagucuguaucugggagacaugaggucacuuugcucccuagucauccaggucaaagacacaucuacuuauuauguuagaggaacacaaagguacaacuagcaagguauuguacccaaagccuagagauuaaguuaacucucucaaagagcuuguguuuaaguaacguacugcuugguaguuggccucugacugcucuuuugccuuuaagaaagaaaauguagaaucaccaaauaaaauguaguuuucauauauggaacauauauagagaacauauuaagauagucaagaauaacauaauggagucuaccaaagagccaccuagcccuucucgcuaaugugguauuauagaaacuuggagaaaacggaggucauuauuuuaccaucagauaucugaaaagauauuuacauauacauauguaauuuuaaaagagaaugugaaaauacaaaugaaugcuucuacuuugaaauuauauuaagcaaucaaaggaacaacuguuauuugauaccaaagcuauaaaaguuucaaaucaguauagcauaauuuuauuauauuuuaggaguagcucaggaacucaguagacauuacucucauuuuucauugaaaaaugauguauuaaaagaugcugagaaauucuuaugccucuguaguauuuuuaaagucaguuguauauacugcaguguguuaaggauaaauuucugguguugggugaaccugggcacagcucuucacacuaucagcgauauaacuggaggaaguugucucaccuucuuccacaguaagaaggguguaauaauggcauggauauuguagaauggguuauaagauuaaaugagugaacacauguaauuuguuauucaaagacagggauuucaucaacuguuaaucaguaucacugucaggcuaguuugaucagacugaccaaauguguuaauguaagccaccauccuuuuuagauuuuacaagacagguuucacuaaguuacccaggcuggccucaaacuccugggcuuaagugacuauccuuucuagcugucccaaguagauggaacaggaagcaugugccauggcuaaagcaguuucacaagcagguguuuuauaguugaaguagugguauacugcauaauuuugaaaaguuuaauuauaguauuaucuuauauuaacugucuuaaaagagaaucaaaauguuuugggacucugcuguauuucacacucccccuuggugcugguacucucauaggaaggacaacauacagagugacugggaccccugaacacucacaggccucccuacucacuucucugcugugucaccaacagcgaccacacacugcauuuucuucuauacuguuagugaugaauccaggcugcaggacagccaguuccuguguaaaagccaacacugacaauacaguugaccugaggcugcucugccaucaugccaggcauuacaucauuuggcaugugacagagcuggaugagagcugaagagaaagccuuacccuaguucuauuacuuaucacuccuuucauguaauuucaaaaauccaagagugaaaugagugagcaugcucugaagggauuugugugcagccaguauguguuaaggagcacucucagcaagacauauugagucuauuuagaaacaaaaggaagaacaguguagguagaauuuauaaaagaaucucuagcugcuauuugacagauucagauuauuagaggaacaaaaaauguccugaagauacuaagaaaccugccaccacccuuaguaaacagaaauucuuucugcucaauauagcagagggacaagaaagaaguaaauuaauuugcauguaaaccauuacugugaauuuauuaacaaccaauucaaaguuuacaaagacuguaucuuaacuaguaccagccauuaaaguauugcauuuuucugauucaauaauaaacauuuuaaagcugaaguuguaauugguauuguuaccuaauauacaaaugauagaaauuauauugauuuccugacuaauucuuguaaaaaccagucaucaauccauucccuuaaaccagugguucagccuuccuaguacugugaccuuucaagacaguucuuccuguuguagucaccagcaacuacauugaugcuacuuuguaacuauaauuuugcuacuguuaugaaucauaauguaaaaaucuguggguuuugauggucuuagacgacccaugugaaggggguuauguaugacucacaaguugagaaccucugccuaacaaaguguauuuuucuaugcuuuaucuaggcucugauucugaacaacaacaagcuaacaaagauucacccaaaaaccuuucuaaccacaaagaaauugagaaggcuauauuuaucccacaaccaacuaagugaaauuccacuuaaucuucccaaaucauuagcagaacucagaauucaugauaauaaaguuaagaagauacaaaaggacacguucaagggaaugaaugcuuuacauguuuuggguaaguuuucccaaagaaugggacaucuugaaauuguaauuaauagccaaauuuaggcuauucauguucuaaguaauuucaaaaauucauauuugaaccuguuaauuuauuaauaaacagauuauaugugaaaaauuauaggauagaaaguuuugugauguucucucuuuuucaacaaucuccugacacacuuggcucuauuuuuagaaacugaacccuaauuaauaaaaccuaugcuauuaaauuuaaagguuguauuuuaauguauuauauaaauuauuaaaacaugauguacacaauuaauucuuuuauuauuuggaauacaaaccuaauuuuggcuaucuauuuuuuaaauaauaugaagaauauuuuauuguacaauuugaaucucacuauuuuauuuguuaugccugucaugcaacuaugcaaucuccccguaacagcuauucaaacaccuaagcacgguucauguccauacacucaauucaaccaaaugccuagcauuuaugaaauagcuuguuacugacauuucuuuuaaguuagauuuguauuaauuauauaauuuauaauugacauauacuauuuuuaaaauaagagguagggcuagggagauagcgcagucaguaaaguguauaagaaccugaguuugauguucagaauccucauuaaaauguuggacaugguaguguauaccuguaaucccagcacuggagaagcagagaugggcagcuaccuaugguucaguggucagcuagccuagccuacuugccaacaaacaaaaacaaaacaacaacaacaaccaccaaacccaaccaaacccaucuuaacaaacaaaccaaucuaagauaguuauguguaauuacuuuaugucaacuuaaaacaccaugaaaaaaaucggggagcaccucaggaaugacauccaagaguaaccucuggccuccaugaaugcgugcacacgcacccaaacuguuugagagguaacaaaauggcaaacacaaauacccuuaauuauguaaaaaguucuuucccccugcugcauuauuauuauaaauggacaaaccaucaugcuuaugguacaguggaaaguaaugucaucaacucaguugguucaaaagaaagaaacaaaaaauaaagacuugcuauauauuccaguuuacaaaauuaaaagcaguguuuuccugaggucuacagaaagaagauacacacaaguagguauaaugaguggaaauaugaauacugaagagcacacuucuccaauauucuucagagguauccucuguggugaguuuccauaacugauuugugcuaaaucaugucauuucuuucacagaaaugagugcaaacccucuugagaacaacgggauagaaccaggggcauuugaaggggugacaguauuccauaucaggaucgcugaagcaaaacuaaccucaauuccaaaagguuuguauuuauuuuacucaaaauaugguguuuuaaaaaacaucuuuucccugucuugaaaaacaaacaaaaggacaaucuuucaauaaguaaacauuguuauauauuaucugacauuaauuccucagauguaaaauacuacagucuacacugucagaacuaucuacagucagaggucccagggccagcguaucugaccaguaugacauuuaauacuuuuccccauacagagaggaauacauagugaucuuuuugacauuaaaccauaaucuuuuuuucccaguaagaacaaacacuaaaaagcaaugauauuucuauuuuucuucuuuuuuuuucugacauuuauucuucuaaaccucuauagagguggaaaauucuguaaacagcagaguagguugaauggggaaagaaccuuaucacuagcugugcugcuauggcugagggggacagagacugugaggccagaugggggcagcacuggcuuuggcacgaagaauuugucagucucaaagagcugagacaucuucccagggguauagugaagauuagcaugcuaauacagugaaaggcuugaagacucuguggcacacaguacauaucaacaaccuuacuaaaaggagcccagaaccuuccguccugauucauaggacugaagcaggaacucaaagaaaaaauguuccuucacugugcuagauugucuuacuucugaacuuguuaccugauguuuucuguguugaugacuaucuggaucagaaauaacccacaucaauaccauuuguuucaauaucaguaucuaccaauaaaaacaacaaccuaucccuuucuacuacucugauucaaaguaaacaaaacaaagaguacaggauagggaauaugauauuuuaaauacaaaugaauuuauauggaacuggaaagauggcucagcagcgcucagagcacuggcuguucuuuccgagaacccagguuuaauucuuagcugcccacaagacugaucacaaccccauucugacuuccccagauagaaauacaugcagcaaaaccuauagauauaaaauuaaauuaucaagggaauuguacuggcugguuuuguuugucaacuugacacaagcugguguuaucacagagaaaggaggcucccuugaggaaaugcuuccaugagauccaguuauaaggcauuuuuuucaauuagugaucaagggcgggagggcacuguggguggugcuauaccugggcugguaguccuggguucuauaggagagcaagcugaguaagccaggggaaccaauccaauaagcagcaucccucuauggccucugcauaaguuccugccuccagguuccuuguuuggucauguuuggugguugucucuuggaggccugcucuuuccugagaagaaauggagagggagugggucugggggugagaggaggugaguggggaguggagagaagggaaacuuuggucagaauguauucuguaagagaagaaucuauuucaagagagagagagagaaagagaaagagagagagagagagagagagagagagagagagagagagagaaagagagagagaauguaaaauccuaagugaggauccauggcuucagaauggcgauuauaacuguauagaaauucacugaaauauguaaaguuuggaaccaacuguuuauuugaaugaucaccauuaucuaguuaugugauguuucuauuugcauguucauugcaauuaaauaauuuuauuuaauauuaaaaaauuaaaguaucuuuucacuuuuuugaaagauaaaguaaaaauggggagaucucaggaaagaacuaguuuaauucauaucuacacauauaaaauaccuuuagaauugaagugguuguuuacuagaaacccgaaguuuuguaauuuuuauagcagugacaaaaaauauucuacccaguaggucaagcauacauagcuccuugcauguaagcuggcauagagcacagagaagccagagaaggaaaggagugaaggugggggguggggacaaaggaggacugcaugccaaauucuauuaguaauauagcuuucagccgggugaaaugucaagacaucccaggaggucuuaucaggaagaaaguggaaaaggucuuccuuccuguuugugugggaaauucuacugcauagucccauguggguggggagugguuuguggugggaauagaucuuccuauacaaaagcauguuacuauuugauagcagcagaugugcuuuugcuagguucccauccugcauauaccucugcucacgccuaucucagaggcuagggcccauucuguucucuggccauucaccucccuuguguccuuaaguucacuaagcuccccacugaguuugcucuucuacaacuucuacagacugggcugacgcaagacacuaucuaguaauuccauguaaugaacugucuguuccaagagaauauuaagucuuuggugacagacacuuugucuuuuuuauuuuuuaaaugcagaacauaaaugauuuuauuauacuaaucucaauugauaaauacccaauguaauccccuacaccucagacucagggaauauccuguaagagcgucuagagagauuuuuaagagccaaagaccaggaugcuugcuucuauaucagacacuuugucuuaaaacugaaaguaucauauagucacuguagaaauauaauuaaguuaaaacagaauucaaguaauuagaauucuguuaauuuagaaaaaucauuuuucugcucucaaggugguuuacuuuuauauucaaauuaaauccagguaucaaaauaaauuuagcuguaaagucuacuguaacaguaauauauuucaauuucauucaccaguuucuaccauuaauauggcaaggaaauguuucaggauaaguugagaacaggaagcuuuuccagcaagaugaaucacagguuggcaaacaauacauugaaaaaugacaaccacagugaguccccuggucagcuucuuucaugccagcuacaaaugcagaagguuaggaucuggucacacagugugaaaagaacaaaugcucauggauugaccaccaugcuagggcacucuaguugaacuucucagauaagaguaagugcugcaauggacuaggcaucucaacaguguaaaacuuggaauacugguauuguuaagaaacaaauggcugaauagguaaucgugggcaauguaugaauuugccugaaucaagcuugucuacugcuuguucuauaaaaauaaugucacaaaguaaauaaucauagaaaauuacugagaaaauuccagcuaaugaauccauaaagaaagaaaaaaugaucgaguaaccaaagccaaguacaacaguacacaugcacugcuagcuauucuggaaacuaaggaaggagucugcuuugcaaccaggaauuuguggccaaccuugggacccuagguggacaccaucucaaucaaauauauuuccaauucuuaguaaagaccagccagaucaaggcaacaagccaccaaugccuaaugcaucaaaugaaggaugaccuacuccagcuggaucugaaggccaagucacagaagaaagaaagacugcaggguucugaugaacagugucaccuggaagcugcuagccaggucuaaaagauuccaaucaaauuagcuacucaaacaaaucaauagaaagggaaggaaaugcuaggaauauauuauuuaaauuucugguguguguuuguauguagaguaguauauuauuuguuuuaauuuuuuucuuauuuuacgugcauuaagaauuuacaagcauccaugucugugugagggugacagaagcccuggaucugaaguugcagacaauugugagcugccaugugggugcugggaauugaaccuggguccucuacaagagcagcagugcucauaaaaacggagucaucucuccagucuuacuugagccugccacuuagcuucaaucucaguccuuggguugugugcuucugagacagggucuccugugauauccaggcagucccugaauuugcaaccuucccaccucagcucucaagugcugaggacauaggugugugcuaucacauccaaggaaaagacacuuaaaacaauggagacaacuuaggagaacugaggaaaagaaugauaaaggauugcuggcaauuuugcaguauauuauaaggugguuauguaaacacuaaacaaaauaugaucuaaucagacaccuagugaaguauucaagauaaaauuucaucaugcaguagauuucagcuaaacuccugccagaaagugacuguauaagcaagggagggagggagggagaugaaguggaaacaugaggcuaguuguugaagcagggcaacgguuuggugguucauggaauacuuucuacuuuugacuaugccugaaaacuucuauaaugaacagauuuuuaaagagaaaguguuuacaauacuugccuaauuucacaaucugaaacuugggaagcagucacugaagccuggccuuacuuugucuaacacacuuuucuuuuuaggccuaccaccaacuuugcuggagcuucauuuagauuuuaauaaaauuucaacgguggaacuugaagaucuuaaacgguacagggaacugcaaagguaaauguucuuacagucuucacagaaucaugguagcauuaaugaaguagcacuaacaagagaaugcacagggaucuucuuaacaaaguguaaagggcaaaaaaaccagagaggaucacuauugucucugccuaugcuaauaggcuugcauccuacaaaggguaagguuuuuagcaaacucuucucaaaucuaaccauaauauauuuuuuaucaucuauaggcugggucuuggaaacaacagaaucacagauauugaaaauggaacuuuugcuaauauaccacgugugagagagauacacuuggaacacaauaaacuaaaaaaaaucccuucaggauuacaggaguugaaauaccuccagguaaaacauuguacuuguguuugguagauaggggcacuuuaguuuguaaagaacauacuaguguaucucaagcaaugauccagcaagcaacaacaaaacuuuaaacauaaugacuccaauguguggguaggggagcaugaggagaacacuuccuacagauaccacucaagaaaaauaagacccucuccaucuacacuuuuaccuacugaaaaugcugaggucacuguuacaaucuguuuauuaagcaaaccucaaguuguugaaguuugucaagcaggacuagccaugauacuaaguagaaucaugugucuuuuguucuagaaacauucuacaaggcaaagcaagaggguuaggauccaggugcuagguauuggguauacaguuuuaaacauucacagcagcgaaugaaauuaacugaaaaaucacuauucgaagcauguguuaguuuuauuuaauuguuguaauaagagcacaaauaagggaacuuauaaaagaaagaguuaauuguacuuauggggccacaggguaggaccauaaugccuaugauggcagggugaaacccauagcaacagguggcuggagcagcaaccagaggcucauauucugaucaacaagcagagggcagcguacacugggaaugauggggaucugagagccuucacccaguaacacaccccugcagugcaaguuccuaucuccuaaucuuccccaaguagcugcaccacuagggaccaacuauucaaacauaugagucuaugggggccaugcucacacuacuacagagcauaagaaguuccuauaaagcuacagauguaguucagaguuaugaugccuacauagaaugugugaagcaaaaggcugaauucucaguacccucacauucuaagaaguucacauuuuguccuuucuugcuggcagaagucaccaaaacugaagaugcuauuuugcacauaauccuauaacuuuuaguuucccuagguucccaucuauggcucucagaugaaaaauccuuauuucacuucaauccaguuuugccauggccuuuccuuauuuugcaaagacuuuucucucaaguagcaaagcaaaagcaaccaaguaucgaggacuauuuguacuacauuuuuuucuuuauugcucuuugagauaggaucucauuacguaguccagauuggucuuaaaaccacuaugcaguacagacauuuuaaaaucacauaauccuccugccucauucaaucuuuugaaugccaagaucacagguguguaucaccaugcccacauuuuucuccugucuuuuaaguuucauucacugcacucuggagacucaagcugcuaaaaauagacuacauguaggcauggaucuuggacuuugacauuucuguagccaugaacacagcccaguuuccccccucaagucaugccuuaucuucaccccaauuuccacaucuacaacucuguacuacaaccuagcauuucauaauagacacaauuuuaaugcagaaaagaacacaaaucccaaguuaauaauaaguaucugcaaaguuaucaaauucaggccuaccuuguuuuuacucucauugagcuuaauguucuaauaccuugcuaugacagugagcagucggagaaauaaacuaucuuucccaauauccuaagacugauauagaaaagaaugaaggaacaguucaagaccaaacauaaauauuuuagucaacaucugucuauauuacucacgaacagacucagaucaaucuuggcaaaugaaagcagauuacauaaguaauaggaauaaauagcuuuaccagcaaaaggcacauaaauauggcauaguagugauuacauguauaaggugagggaagcagaagagaaaagcaaaguagcuaagaugaacaggcuauguauucuggguggcgacagaguucugugugacaaaguucuccccaaacacuuucaauaacaccuaagcuugacuuguuauaaguacuuaacauauauaaaugaauauauuuaucuuaugggaaaauacuuucauaucgauauaaaggaaacagaugaagcuaaaguguggugguguaugccuuugaucccagcuguuaggaggcagaggcagguugaucucugaguuugaggcuagccuggucuacagaucgaauuucagggcagccagggcuauacagagaaacccugccucaaccuccccaaaacaaauaagcaaacaaauaagaaaaacaacugaauaaagccauaaaucauaaacaaaugcugacuauauccaagaauagugguuuauaucugcaaucccagguacuagucaggaggcugaagccagaagauccaaaguuuaaggcucguuuuauaaaguagcaagauuuugucucaaauaaaaauaauaaggaucagaaguguaguucagugggagaauauuucuuuaucauguaugaggcccauguuccagauaaaacaaccccaacuauuauuuaaaaacacauuucuuuuuauauuuaccgggcauuuaaaauuuauucuuuuuauuuaucuacaacagauaaucuuccuucauuauaauucaauugcaaaagugggagugaaugacuucuguccaacagugccaaagaugaagaaaucuuuauacagugcaauaaguuuauucaacaacccaaugaaguacugggaaauacaaccugcaacauuucguuguguucuuggcagaaugaguguucagcuugggaauguuggaaaauaauucaugacauccauuaaauauaaaauucaaaaauguauacauuuggaauacuugaacuguccuaguaaugguaguauuauacacauaagcaaaauucuauucuauauggucaaugacaaaaaauuucaacagaauuuugccuaauuauugaugcucagaauaaauuucuauugcaguguccuucugcacaugaaugauucuugcguaaaucuuuugcuugaacauucuuuuuucggcaaaaaaagauauuuaguauuuaacccuucauuaucaagucagucaaacagaauuguacuguaaacagaaugcuugacuuaguaacauuugugucauaucuuugcuguuagaaaaacaaaacuggcaagaacagcauuuugaagaguacauauauuuuuaguaguuuuuuaaaaaaaacuuggacaguacuguaauguuuccaauaauguuggaauacauauaguuugacagaaucaaaauucucaacucauaauaaagcuucaaguauucacagauaauauucaucagaguugguuugggcuauaacacaugaauaucuuuuuuaaauuauuaacuggcuauaaaauuguaaaaauauaaugacugcuaauauaaaaucuauaaugugcauuuuaugaucaguuauauaagcuuugaagaacacaguaacuguuagguuacauaguguuauuacuucaacuaggaauauuucaggauaucccuuuggaacaguauggacgccaaucaauuuuauaucaacuuaucucuucaaauaugcacauuggguaaugccuggaaacauagcuaaggugacaaaaacugaaaacugaacaaaacuuaauaguacuuucauguguuuuuuuuaaacugauauucauuaugaauuaaguaaaaagugacaauaaggaaaacauuaaauacugguuuucaauaaaaau

SEQ ID NO: 7031 - RNA, 10363 nt, Mus musculus
agaggauuuuauguaauuuaucaucgucauugucaggaacaugcacacuagcacacguggcagaggaaaaguugacaaccugcgggaauugagucucucuacucaaagucgucaggcucgguaguaaaugcuuuaucugcugaaccaucuugcuggcccuuacaaguuuuugcaugauaauauuucuaaguuuaaagaauauacaaagccauuugagcuuaguuuuuuuuauucccacuuaccauucuauuuuauauuucuuaagauuugcaucauuuuuaguaagcucuaagcuuaugaaguaaagccauuuucaccaacaucuuaaaugcaguucugaucuuuauacuaacacauacuuguagauauauuauuaugagcaguuacauguuuacauuuguaauuaguaaggcuuuauggaggcauaaauguguaccuauauaguaucuugccacucuugcaucucauaguaaugagaauuauagugcucaucugauacuucuugacccucaagaguguuguccugacugucauggucgucuuccucuuccuccucuugguagcuccugaaaacuugggucuucaguugaauuguuucaccguuaguacuccucugcucaccauaauaaauacuguguauacgagggaagcagaagaagauguaugaacuuauugguucuuucagcuuauuuugguccacacgaagguauguuaaauggugaugguguacuggaucaggagaaggacauaucauugucacauugaugccugaaaaauacaagucaaaaguuuauucugcauauugugguuauaauuucagguuggguuuuguuauuaaaaugaagugaaacuuguauuucauaucaccaaaauuaaaaaaaaaaugagcacauuggcuuuacugauuguauaaguaauauauaaguacuacuggaggaucccgcaauaccucuccugggcauauauccagaagaugucccaaccgguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaaugaauuuaugaaauuccuaggcaaauggauggaccuggaggguaucauccugagugaaguaacccaaucacaaaggaacucgcacaauauguacucacugauaaguggauaauagcccagaaacuuaggauacccaagauauaagauacaacuugccaaacguaugaaauucaagaagaacgaagaccaaaguguggacacuuuacccuuucguagaaaugggaacaaaacacccauagaaggaguuacagagacaaaauuuggagcugugacgaaaggauggaccaucuagugacugccauaugcagggauccaucccauaaucagcuuccaaaugcugacaccauugcauacacuagcaagauuucacugaaaggacccaguuauaacugucucuugugagacuaugcgggggccuagcaaacacagaaguggaugaucacagucagcuauuggaugggucacacggccccuaauggaggagcuagagaaauuacccaaggagcuauagggaacugcaacccuauagguggaacaacaauaugaacuaaccaguacccgggagcucuugucuuuagcugcauauguaucaaaagauggccuagucggccaucacugcaaagagaggcccauuggacuugcaaacuuuauaugccccaguacaggggaacgccaaggccaaaaagggggaguggguggguaggggauugggguggguaugggggacuuuugggauagcauugaaaauguaaaugaggaaaauaccuaauaaaaaauaaaauaacaaaaaaaauaagugcuuccuaguaaaagcaaucuuauuuuaaaaggaaaaaauacauuacuacuaaccagaucauaugucuucagaugcucucuaguccuucuugcuaauaauagacaagguggucaaguugaauagaaaagacuauaaaaguaaugguacucccucggccacuaucugccaucuccuuagccaaccucaaagcaacccuuuucaucacuauguaaagcauagauuauuaacaauucauucuuuauaaagagucaaaauaccauucuuucaucagacauguuggugcauuagggaggcagaggcagauggauauaucuauuaguuugaggacaagccuggucugcauaguaaguuccagggcaucgagagcgacauucgagagcgacauagagacauccuggcucaaccccacccucacccaccucccuaaauaccacucuuguucuuuuuuuuuuaaaugcaaaaaauuugcauacuuucuauuucauuauuuuguagguauagauguuccaaauuccuuggaauguagaaugcuugcuucaauuuauuguguccaacguugaguucuauaagauuggaaagauuaaagaugucauauggaaugucuuccaguuuguugugugauauucuuagagcaugaaguuuuggaaguuugucaaaauaauugucugguauagaugaaauugaauuauuuucuaaagauagauacauaagugaugaaggcaauccaaggggcauugauucuaaucuguuauuacauagguugagcugcauuaauuuuuccauuuuggaaagggucuuuucuuuuaacaucgaaucagaaagaugauuauagcagaggucaagcauagucacauucaccagcccguccauggcauuuguuggaaguauggagauuucauuauaaccaagaaggagucuuuccaaagauuuuggaaguggaaauggaaauucuucuagguuauugugcucuagaugaaguuguuguagauuugaaaguuuagcgaauacaccauaaucaaucuuuugagauuuaauuuuguuguggcuaagguuaauuucuuuaagaugaguugcauugaugaaugaauuugcagucacagccucaaugucauugaacugaagguugaguugcugaaugugcauuggaauaauugggauagucuugaguuuacgauugucacaguacauugauguuggaaaguuaguuggacagaagcauuccuuagcacaaccuaaaauauuauuauaaaagggaacuccauauucaauauuuugaugaaauuggaauucuggaucauaauccucauuuggcucuuggucauaaucgucaucccaucgguaagcuucauauuggcaguauacucuaacuccaaaacagaagaaaaggacauauauuggacuuaaaaagcccauuuucuuuucuuguccuauugcaaagagaaaauugauuaauacucagaauaauucucauauaaauugacacauauaaaauguauuagguugaugccuauauauagcagaauauucaggaagcaugggcaaagcuccaaugaaaacugaauguuuaaguaccugugaaauuuagaauaauaugucacauuaaacagaaaucaggccgggcgugguggcgcacgccuuuaaucccagcacuuggggaggcagagacaggcgaauuucugaguucgaggccagccuggucuacagacugaguuccaggacagccagggcuacauagagaaacccugucuuaaaaaaaaaaaaaaaaaaucugaagagugcuuucuggacuuuuuacuaaguaaucacugucuuuuauuuguuuacuuuuauuuuuuauagaccagauucccucaguaucucuuacuggcuagaauuuacuaugaaaaccaaccuguccuuaaauuacaggaauuucugccucugccucccaagugcuaaaauuacauaugugaaacacaaugcuauacagccaugauuuucuggaacagucagaggguagaaaggggguuggggggauaacaacuggacuguaaaaacagauuaaagauaaaaaaaaaucccaguugucuuguuuucuagacaugcuuauguuucuagugugacaucauucaaccacacucuaguauuuccuccacuguaaaugcugggcauucuugccagccuuuucucgauuagugguguuuguuaccuaugugaacacuuaaagaacuuugccuauuaaacuuuuaguaaaccaaaaucugucccuuacuacuucuguuacugaaacacuauccuuguucauuaaaagaacauucuuuuuuguuugguaacuuauuuagaaaacacugucauuuuuuucuuccuauuuccugucuaaggcuauguauaucuucacauuuuccucuuggaaauauuucuggaaaguuucaauuucucuuggauuaauauuuucauguucucucccugacuccuucuguucacuuuuuucugcgcucucucccucccuucucuucucccuccccuuuuucuuacccccccccauuccuccucuuuuucuuccuuccauuucuccuucucauagaucccugguuggccucaagcuugcuauuuauuuaggugagguuggccuuaaacucaagcucauccucuucccagguacugagacuacagggagcaucaccaugccuggcuuuggauuauagauguuaaagugccacuauccuugucuccuaggaguuugaaaucuaaugaaggaugagagacauacagugcaguguaacugaaggauguuguauugagucggauuauaaggacuccggaggcuuuguagauaauuaacagcaauuucugaugaaacuugaagaaggguagaguauguuguaaaaacauagugugaagacuuaaauuucauuucuuccauuuaacaauucugccucuugcuuuauuaagaaaauacaaauuguaguugcuagacauaugcucaugccaauagucccacuugcuuaggggucagaucauuugagcuuaugaguuggagaccaguaguacuacuuucaauuaaaaaaaaaaaaaaacaaaaaaaaaaaaaaaaacaaaccucgggcuggugagauggcucaguguguaagagcacccgacugcucuuccgaaggucaggaguucaaaucccagcaaccacaugguggcucacaaccauccguaacgagaucugacucccucuucuggagugucugaagacagcuacaguguauuacauauaauaaauaaauaaaccuuuauaaaaaaaaaacaaaaaaaaaaaccuccucagaagaauaaugugaaauuuguuaguaauaugaaauuauaguuaaauuauaccuugccucgugugugugcuagcacauguacaugugaaaucuagaagacaaccucauucauucauuaggcaccuuuuaauuuuucuaaauaagaucucucacuguguagacuggccagcuagccagugaacccacgggacugcccaucucugccucccaagcacuaggauuacaaauguggucuccacacuugguuuuguuucguuuuuaguauggaacccacucagagcucagguccucuugcugucugggcuguguccccagcuccauauuugccuucuuuaucuuacauacuuaucuugugucuugucuuagucuuucuguuuaucucaccuagaagauaaacucucccuuuguuguuguuuguuuguuuguuuuguuuuguuuuugagacagggucucacugugcuacuaggauggucuccaccuccuaaaauucaggcagucuuuacugcuucagccuucugaguuaggauggcaugagauauucauguaaaaguucuuagcaaauugaaagcugcuguccaguugacaccagcugauaugaggcccccaacacacauacaguagaggucuuccagguuuauguucauucagagaugaugcacuuaacccucaagagacugaaggccccagagaguuuagaggucagguggggugggggcugugggcauccacauggagacagggugggguugggaggaggugugggauguggaacaauaggagggugaaugaaggggggaaauaaaacauggaguguaaaaaauaaauuuagaaaauaaaaaauaaaaaaagaaauuuuuaagcgcccccccccccgaccuuuuuuucucuacucuucucauuaggguuuuuaugagaaaacaaauuuccuagcgucccuuuguguuaaugaaauaauuuacauuuuauucuucuagaaugcuacuccucuuuuucaccauugguauaacugagaaaauaguucaucauuucucugacagaucuccauuuguucuuuuuucccauguuauugucucaguucuuucuauacacucaugucccgggccugcuaauuacuaauggucauauucugaauuuugaacaacccacacucugaccguaucuucaguagugccuccacccacuaguaguuccugaguuccagggaucuagcgugauggugaugcuaccgguucuucacugccuccauccacacuuccacacagucauaagcucccucugccugagaugcuguaguucuuuauucuccuuucuucuuuucacauucccuggguuuucugaguuuuuuacaucuggcaaaugacuuuccucccuacucucauucugacucacacagcuaaauaugaagaaggaaaaacagaaccgggcugacugcgcucauucuuaguucuuggcuacgaccuuaaguauggcauggcugcucuuuccucugacaagacuacuagguugaugucuugguuuguuuuguguuuuuguuuugucucaggcuguaaaacaucauuucccgucacucuuuuuggaugauugccuugcuuuuuaaaaaguguuaaauaauuguuuguacuaguuaguauauuguauuuacucuuaucucuaagaaaguaccaaauugaaauacuuagugauauuguuguggugcuagugcuggugggguuuuguuguauguauguauguauguaugugaguacauuguagcuguacagaugguugugaaccuucaugugguuguugggaauuuuuuuuaggaccucaacuccgcucauucuggucaacuccacucgcucaaucccugcuugcuccggcccaaagauuuauuauuauacuuauuguugcugauuucagacacaccagaagagggagucagaucucauuacaggcaguugugagccaccaugugguugcugggauuugaacucaggaccuucagcagagcagucagugcucuuacccacugagccauuucgccagccuucuuguuguuuuugaaaacaguuucucuguguagcccuggcuguccuggacucacucuguagaccaggaugaccucaaauucagagauuugccuaccccugccucuccagugcugggauuaaaggugugcaccaccaccuggcuaugauuauuauuuuuuaaguauagcaaaucuaaauaauugcaucaauuguucuuucuuuacuguauaauucaggaaggacauagaaugggaacuguguuuugaagaacucuagaauugcauaugaaugauguaauuauuuccaaguagagagauaaguaacaccaugaccuaggaagugggaaaugucuagaaauaauaacuguucaacaagccagguccuaggagucuaaauuccuaaggaauugcacucugcuaaugaauuccuaauuuaauaaagaaguauguuugugcuaugaucuucauccugcaauguucuuaguagagucugcuuuggguuaaucauuuucuugcuguuguuacucagcuagauacuguacuuguaugcuugguacagcauuuuauaaauauuagugguuuaauuggauuauuuaagguuacauuuuuuaaaauuauccuuaccuguaagacaaugugcaauuagggaacaaagaaauaaagagaaaaugaaaacaggguccguucucugugaaaagcaaacaguuuagaagagaccaacacuggaaaaugaaccauaacuaaauggggauaguuagugagugcuugagggccaggucuugacccuccugggauaaacauugauugaaccagacuuuggcacguuaggagaaauggguuuggaaaaucuuacacauuuuacucuuuuguugguggcauuuuacuugaaauuuuuuuaggauuuuauuguacuugcuauaguaacuuuuaaaagcauuuuugcuacuuaauuucagucccaauacagccacuagcaguagauucuuaggggcugcuuucccaaaauacgcacugagagccaagaaguagagcuggucuguggcaccacgccaggccacaaaggacucuagaguucugccgcacuugcucaugagcauccacucugucuuuucguugugugaagauuuuauccuuguauggagaccauuagcaguccucaaaagcaaccuuacauuuuagaauuagaaucucaggaguuugagacauuggaagaaaaggaaaucccgauaauacuucauggcagcuuaacuuagcaucaaaaacaaaggccuuugacgauagaaggauucauguugucuccuuuuggucuucguaaacacuucaggaagauuucccuggagagccauuuuuccacugaaauccugcccuuuacuagucuuccucucuuccacugugguaccuucuuucucuuuagugauuuuaauucauuuuacccagugagucucuucuuagucauugcugagcauauuugguuacuuuugcuuccauauucuacaauuucugcccuguucuuuguaauauaacucagagaccaucagaguaacucacugugagucaucucauuucccagucucuagguuuuaacaaagccucagugcagugcacuugcucuaagcagucaaagaucuauggaaugagugacuuaagucacagguuauggcuuguuagcagugccuuucucuguuaauguuuauuucucuaggcauucaccaugcugguuucuuuagaugguuaaaaguuagagaacuuagcuguuaucuuuuguacuuauuucuauauaacaauaugugauauuucuuacuuauauugucuauuagaaauaugagagaugaagaaaaaauaaagcaaagcaacaauguaaaauuuaagaaauuauccauuaauaugaauuuugcaaauaacacaauaagaguuucuuuaucauaacauuucucuuacuugaagaaaaacacucauguuuuuaaaugaauguagguccuaauccaaauuaauaaaaguguuauaauuuacuuaguucuggaaacuuaaagguaaaagcauuguagcaugucacuguuuuaaagcucuuaaccguuuuacugauaggccauagaagccaggauauaaagaucaucuguaccuguuaauucuugucuaagacaacuuuaaauuuagucuuuugcucuuuaaaaaaagugugucucaguuaaaauaauacauacaugcauacauacauacguacauacauacauacauacauacauacauacauacauacacaauacauuuaaaucguaauuaacuuaaacuuaagaauccuuuaauaaccagacaaaauguuccugucuugggaaugauacaaaugaaaacaaacauucuaaaucagaaauuugcccaguagaaaaaauuacaacaaagcauuuuuuuuuagcaaaauuguuuagcaaauuuuuugucauuuaaaauuaagagcagaaaaacaaacccaagaaacuaaagagaaauugauuccuuuaaccgaagauucuuucccuuuguccaguuuuauuuuaaaaauaaucuaaacaaauauugcuuauugagucauuuuaaaucagaaauuuaaacucaccuugcuggucuuuuugcuuaaacauuuugcuuaaucgaaauuuuaauuuaauuuuuagucagauuuugcuuccccgauugcgcuuuuaugauaagugcagucuaauuuaauauuuagcaacccuaagacacuuuuguaacaguaagaauacauacuuuaagaguugaaaauuacuuuaucaucauaccuguugagauugcucuaguuucagggacugaugaauuggcaauccuuuaacugaaucagaaaugccuaaauucuuuagcgaaguuucuuaaaaauccacaguaacucagugugcagacagggcuguccuuugaauuacuggagcaauuuaaguaaauacaaucugcuuggaaaacacuuggguugaauuaaaauuuuguacuucuuuucauuauacagaauuuuguggauucaaaguaagauguuugugcucuuggucagauuuauguggcuaacuucuuucuuuucuccuuaauuuugguuugagguguggcaagaauuuucucuuaauaugaaaggcaaacaagacuaaau

SEQ ID NO: 7032 - RNA, 25941 nt, Mus musculus
cacuuccgccuacuugaaccggaaaucaggaaccacgcggcggagugucuuuucuguaggaauuaccgauuuuuauuuuucuuucucacacucugucaguuuuacaacguggaggagaacuaacagaacgucaguaaaagcgaaggcggaggaaauaaagagcccucuggaacugcgggauaacggaaccuuaggagauuggguuggaaacuuuguaggaaggaaaggaaaaugcacuugccggcacguguuauuagacguuaagugcuacgccgggcuugagcugagucggacaagcgcccugaggaagaguguuugcucgugagaagugaugggcuauugggcuuagccucuccucuccuuccuuaggggcuucucgaagagagagggcagggcuggaaggauggggcgguggcuaccaagaagggguacacuguagguuuuuuucccagagugcuggccuuugcuuugggcuucugccgcuauuuagugaucucgcuuggaaggagacagccaacuuuugagaaagguuugaguaagagcugaacauccgccgagagcuaaacgagauggagcgaccucuggaaaacguuuccagcaaucuugguaggacaguguuaacaauuccggguuccaaaauuagacuucauuaugauccuugcugucaccacuacuguuuucuaaguggcacugggaaaagccguaaccgcuccuacuccccugaccgaugagauccacucagacugcuuugaacaauacaggcacacaguggggaaacauauuuuagguauaacuuaaguugccgucuuugugauuuaacagcgcuuaggggacacuuguauuuugccauacuauuguaauugcagacuuuguuaugacuggagcuccaggaugaagcuauuuuuauccguuagcuuacuauuuuugccaguauauguuaagguaaaaauguagaaaugaaugggggagggcaguacuucgaauaaaaaaucaauaaggauaagauauaauagcugugguuguuuuagagaaaacaucugggagaagauguguggaugugcuguacuuaggugcaguugcaaaguguguucauugagaauguggauggagggccuuuguaaaaucuccacugauaaaaucugaaagcaauacauaugaagagacauagcuucauaagaugaaguuggcacagaaguuucaggggaaagaguuguguuaaauuucuggaaaacuauuaaauuguuuuucuguccaaaauuaacuuuuccagauagaugcccaacauccaugcaaggcaacagagaaaugaagcgccucuuuguggguggacuuggacagggcauuucugagacagaccuacaaaaucaguucggcagauuuggagaaguuucugacguggagaucaucacucggaaagaugaccaagguaaaucuguaacacgagggaguuaaaaacagacaaggucaaugauauuacaggagaagcaaccccagagcugaauguuagcgcuaaacaucauauauggcuuccuggauuauuucauaugaaaauuaauuuugaaaccagaaaaaguauaaaacauuugaauuucuaaaacaucuguacuuugaauuuucggagucaacauucuaacauuaucuuauuaaguagagugucacuaacaaucaggaugucugaacugauuacacacuaauauacuguuaagaggugucugaauugauuacuucaggguuuuuuguuuuuuuuacucauuuugaaauauuuugaucauguuuauaaaaaugcagacuuuagucaggugagguaaaaaguauuuucuuucaaagaauaaauaucuaugaaugcacuuuuugagcuuggauagcuucuuaaggcuagaugugguguuugauauuuuuugaucuagaccucgagggguugaggcagauguauauucagggccagccuggucuacauaaugaguuacaagacagccaguccuauauaauagagagacccugucucaaaaaaagaaguaaagagagggcuguugagauguauauuguuuucuggauaaggauuuaaaucaacuuaaaaaaaaauuuuuuuuugguaggaaauucacagaaagucuuugcguauguuaacauucaaauaacagaagcggaccugaagaaauguaagaucaucauguauuuuuuuauucuaauuguuaguauaauuguguaacuugaaaugacuuugguuccauagcuaagccuugcuagucacuuagaaguuguguagauggacaaccaugaucaagagaauucuggagcccuuuauuucggguuucagauguguuugugucagaaaguaugguaucacacauuggcacuuugcucagaaacuaguguuuucaaacaauuugaacaaaggaccaaacuaucaauagaaauugccuauuacauuuaucccacuugucauuagagcauaccuuuccuuggucucuuugguuuuuugggcggccaauccuuugucaguaagaccuguuauaaaagguccuugaauaugaccaaggucauuagaauaugaccuugccagagcauaucuuugaaacucguauucuuauuauaagauuaguaaagauaaggcuaaauacuagcuuccagugacuaaaaagauggagaugauuuauuguucagucgaugcaguuaaaguauugcagucucuuggaagucaaaaaaagaaauagugaagggcaggugccacugggagaggacagucagccuuugaucauuucauuugugaagagauuacccuugcugagaacauauaugagguagaagguacagugccuuaccuaauaaugcuauuauaaggaguaaguuaaauaauacauaguacauaguaaaauaucuccuucuuggaaaauuuuguuagugcuuacauuaaggaagcugacaauaguuauuagaaaaucaacuacuagggcacaacaguugaagcauagugcugucaguaguuaaugugugccugcuuuguagugauaauuggauugaggagaauaauuaaaaugcuacaagaucccaaaauguguacuaguucacccugaaaagauuuaauugauuauuugccauguggaaaauaaacaaaguagugaauaauuauuuaccaggaguuccuaaaaugagucuauaaacaaauugcacauguuuugcuuuauaguuuaugcauaauuuucuguuaguguucaaguaacugagaaauagggaucauaagaaccuggggcugcagggauaacucaguagucuagaaugccugacugcugcagagggcccaaguucaguuccuaauauccacaugggugguuuacagugacagauuccagggcaucugaugcccucuuuagccuccaugggcacccacacacaaacgugcaugcuaacauucgaauauacacacucaagcaugaaauaaaaauaagcuuauuuguuuauuugucuuucuuugacagguaggugucucuguaacaaauaagccuauuuuuccuaguacuaaguaauuagagagagaaaaaaaccuuguugaaauagaguuuugcauugaaauaaacuuuguuaauucuuuaccuuauagguaugucuauuuuaaacaaaacaaaauggaaagguggaacacuacaaauucagcuagcaaaagaaagcuuuuuacacagguaagauuugccucacauuuauuuaaacccauuucuuuauaguguaauuguuuuuauaaguuuaccugacuaauuugaaaugauugaguaauauauuacuaguugucaugauuugcuucucaacuugauacaaccuagaauaagcugggaagagaauucuaauguguauuauuauuaucuguguuugguuggcuugugguuguuuguggcagaugguuuugauuccuucauugaugugggcagccugagccugaaaguggauggugccauuuccuaguuugaagccuuugauuguaugagaguagagaggugguugggacuaugcaugcauucauuuauucugucucuucucuuugcugaggaugugagaggucgcuucagguuccugccuugacuacucugcagugaacuauaaugaacuagaacccagagucgggaucuuaaucauuucuccccuagguugcuuuuuacaugggacauuuuaucacagcaacagaaauguugguauauauguauguguuuauuauuccuuucuaauacaaucuuaggcuuccccucuucuguaacaacuaccugcaugauaucagaaauggcugauuucugugucucuuuacuaaaagucauuuaaacucuaccucuugcuaucuguagaugaucugugaggaugucuuauaagugugaaaguguuuuucaggguuuuugucaaaaaguauaguuucccguaucuuagaguuaagugauuacagaugauacuaaauuacauauguugauuuuugaccauuaaaugugccaugcaaagaaagagaaagaagguauauacauaugagacugucuuaguguuguguuguuguuacuaagcagugauugcauuugggagucccucaggcaggcaagcacagugcuggggcaguagcugaaagcuuaugucugauucacagccacgagaaagagagacagcuaacugagaauagcuugaacuuuugaaaccucaaagccagugaaacaccuccuucagcaaggccacaccuucuaaccuaaccaaacaguucaacuggggaccaaguguucaaauaaaugagccuauggggccauuuccagagacauaagacuaauucugcaugcgacuucauaacaagauuauauaaaacuaauucuauaugugauuucauagcaagauuguauaagaaccauuagagcuuuuguagucagaaagcugauuuuucagagggaaaagauuagauucacuugggaauuuucaaaaugggaaacauuuaagaauauaguggaagaaaggguuggauauguagucacaacagauuguuuagcauacaugauauccuggaauugacacuauccuggcauuaaaaaaaaaaaguacaucaguguagcucaugguuuguggucucuuaucuaccaugaagaaguuugaggcaccuccuguagcagagcacaggagugggaggaauauuauuuagauugcaauuuacauuuugugaauaauauggaagcugauguagccaaguguuaacaaaauguggcauuaaagaaauacuugguuugcuucacuuuucaguauuuucuagucauucuacaaugaaaauguuuuguauguuuagaaaauaguauaaguaauuauucuuuuaaagaaguauuuuagcugggcagugguagcauacacgccuuuaaucccagcacucaggaggcagaggcagguggaucuuugugaauuugaggccaguguggucuacagagaaaguuccagaacagccagggccacacagugaaaccuugcuuggaaaaacaaauaggcaaacaaaagaauauuuuauuuuauuuugugcuuuuaauacuguaaagauguuugguguucacuuaggguuaccugaauggcaucccuaaacauuuucauagcugauuuguuuuuacuucuacuucacuucagauuggcccaagaaagagaagacgcaaaagcaaagaaagaaaaaucaacaacaggcaaccccaccuuauuggaaaagaugggagcaguggauuuccauaugaaggcugugccuggaacagaaguaccagggcauaaagugaguccuucaguagaccgugcccgucgugucuccucggaccucauauuuguaguugugacagccaacgcagaugcuuuuucuccacuuuggagcagucggccuauagguuggggguuuugccuauuugauuuucauuuucagccugcguuguaaguauucagucagcacaauucccccaccauuuuauauauagagaaauccaaauuagguggagacucuuccuaaggacauaggugucugauggacagacaggacccaaguuugcuauuuauuuucucacuugcuucagcacuauuuguuuuuauuguuacuguuuuaggauuuuauacaugcauaugauauauuuugaucaaauccauuuccuuuuccuuccccucuaauuucucuguauucccucccaccacuacuuuuccucucaacuuaaugucuuuucucucucucucucucucucucucucucucucaacucaacucaacucaacucaacucacugacuccgcuuaguacugaucuguauguacauagguucaggaccaucuacuagagccuuugaguugccaguuccagaaggaaacucaacucuucucucccaggagcuaucaguugccaguagcucucggcaggggugggacuucuagagcucuuaucccaucugugcugggcuuuuggcuggcuugaugguguuauaucugccaaggauggccuugaacuuuugauccuccugacuaccucuuaccuaacaaccucuuaggugcugggauuacaggugugucccaaccguauccaguucuuaagguuccggaauagaagucagggcuucgcacaugcuagccaaacaccuuaccaacuuggguauauaugaggcugugguugcauuuuuaauagcuguauauguguauguguaauguacuaucuaugauauaguuggaauuuucuuuuuuuuuuguuuccuuauauacuucucuucuuuaauaccuuuuauuaucagaaaacuaaguuccacuuuaauaguaguccauugugagcucaacauuuuaaaaaguuacauuuauguauuauuuugcuuauauuugugauaaucauaaguucucucucucucuuuuuuuaaucuuuuagaauuggguugugaguaaguuuggaagagucuuaccuguucuucaccuuaagaaucaacaaaaacauaaaauauccuuugguuggcauuucacaguaacuauuauuucccagagugauggcagaauagaauagcuuuagaauuuuacugccucuaucaauaaaguuuuaauuguuuaaccuuucucugcaagguuagcucuaagucaucuauauguagaaagcacagugagaauaaugggugauaugaaguuuuauguaguugggugguacaaauuaugaaugccaagaaaacauugucauuuguuaauacaaaaaucuaugauaagcuggccaugguggugaauaccuuuaaucccagcacuugggaagcugagacagacagaucucuuugaguuuaagucuacucugauuuacauggcaaguuccaggccaacuggcacuaugaacuaagauccugucucaaaaaacaaaaccuuacuauauagggauuuacaaggcauugcuaaugaaguauuucgagaauaaaaaacgaggcuauuguuaaagaaaacuuaggagaaauugauagaaaacugauaguguaaauuaguucuaaaaagaagauacuagguacaauuaggcugacugauaagcaagaaauaguguauggcaaaauaauauggaauccaaagugagaaaauucuaauguuuguuccacaaggucaguaaucugagacuuugaaaaccuggccagaggguguguauguaucaaagagauugcuguaauguuuaucauccaaguuacuucucucaucugacagugguggugcuugauuuuagcuuuggauuuguuauaguucaccuucauaaagccuagaggcuuaccauguggaaugcucauuuguuugaugggaaauugaaggaagauagaauaaagggcuuauucaaggcuaaacagcuuuccuguuucauaagauugguagguuucccuaacaccugcugcucuugcuuuguccuugacugaguaacauuaugaaauaugauccaucaaaauacugccacaauauaaaaaagauuccagagaauuugacagaaaccacucccauagcugaacucacuugggaauuggaaggaggcaaugacccuaugaguaagaaacgucgaggagaguucucugacuuucauaucccuccucaaaaggucaagaaagugcagaagagcaaugaucccauggaguccaagguuucuaauauuggucuaaggacuaaucagguaauggagaagaacaaaucaacacauccugugacugcacacgggacagccccuaguacuguuaauccuucuaaacaacuccuuguguccaguucugguacucagaaaccuaaacaugugguuuuucauaauucugacuuugaaauuaucuggaauaaaaguagcaugucugaugaugauguugacucggaagaugaauuaaaaaugaugauugcaaaagaggaaaacagagagaaaccugggcauuccucagucaaugagucugaacaugauacuuuugaaguuguuagggaugauuucaaaucaaauauucacaagcuuucuucuucaguaagccuaggaaauaaccaugaauaugauucaagugauacagaugaaauuauugcaaugaaaacaaaaaaugcuaaggucaaaaacagugcagaaucuucacaaccagaaaggacuguaagcaagaaaaguucuuuucaaaagauagaaccuucuaaugacuguauaaaaguacaaggaauuaacagcaacaaagaaucagcccugugucauggaguaaaguuuguaaaucccaaauuuccaccugacuccaguggcagugacagugaagaguccgaagaagaugaagaauauaaagucuugauggaaaacuguccccgugugagucucacuuuggcugacuuggagcaguuggcuggcagucaucggaaguuuccaggaaaagacagugagacuaaugguccacaaaaugacagucacugcaaauuugacacaaccuccaagaaucccaagacuucuggugaccuguacaauggcagacaacagugcauucuuccugaggagauuguggccucccuuuuagaggacgagaauacuuacagcaaacaaaaaucggaagaagauaucuuaaagccaaaauuccaggccuucaagggaauaggcugucucuaugcaaaggagucaguagacaaaacuuugaaagagaauauugccuuuaauacuggcggugggcaucacaguuccuuaaaacaugaagaucacaauagaaguuugauggaaaauggaucuaaguguguuaauggcucaucaagcaaacugacuucaugccaaccugcaaagaaggugaaugacccgaaccacauucagccuccaaaaagacaguguacuuuugagaaccagaaccauaaaguaauguccucuacuaguugugacaagggaaguacaaauccucucccagguccguugccauugaaagcuaaaacaucccugcaucuuagugccaacagucacaagguagacucugauggagacgcuugccauuggccugaaaguagaaaagcuuuagagaaagagaggaccaauuuaagcaaccucgaaucucuugagaaaucaucaaaggugucucccagggaagacccucagaaaagcccagcugguuucucacuuucugauaguaaugcauccuguauaaaugcuaaggauaaacaagcugaagacaaccagaagcgauuggccgccuuggcagcauggcagaaagccagggaaguacagaaaaaacuggugcauagugcccuggcaaauuuggugagugcauuuucauucuacagaucuaauaagaguguucucaagguccagguucuucuugucauguagguggguggagcucauguccucuucacagucacuacuuuucacuugugcuauugagccuauacuaaacaguugcaguuaucuauaauuuaucaccucauuaagaaacuaauuugugcuggaugugguggcacacgccuuuaaucccagcacuugggaggcagaggcaggcauauuucugaguucgaggccagccuggucuacagagugaguuccaggacagccaggacuauacagagaaacccugucuggaaaaaaaaccaaaaaaaaaaaaaaaaaaaaaaaaagaaaaagaaagaaagaaagaaagaaaaagaaacuaauuuguauagugauuacagcaagaguaguguaaaccuugauggcauuuacuguagugagucuuuguucauuccuccagcagcacagaauaauggcuaaguacugagaccaaugcagcuauugaugcauuguauggcaagcaggcagucacagucucuuagaacaccaaagaaguuagguagccucaacccauacagaguaacaugaagggauuagaaggaauuagacugauguagguaggcagcaagggagaggaaagaucuuacuaaaaaaggagccaauuugucuaaaaguaaauuguuucagugacacuaguguuuauagacagugucaaggcaaaaaaugaagcagcaguaauuggaaaggauggguuauacagauacugcagggagugggacuuuuuuccuaaagcugugaaagacugaagaacuucaaucaaggcauugaagauuaguuguguaaauuuugaaaugagaauuaucacauuacaauauauagaucauccagcccuaauaguuuaauacacaacaaacacugucugaggccuacagugucuaaaucuuuauagauaaaauuuguuuuaagagauccuucaggccauggcuuaaaaaauaaauauaauggggucaggucuggaagaaaagagaaccuuucagaugucaagguccacaaccacggcaguggugguucuuaaaaauacugaggucaaguugauuguuacuggauacagagagaaaggaggccugaggcuguuuuggaaacacagcagaugauaauguuauucccuaaagaaagaaaagaaggauaggaguugggagaagaagaugguggguauggacauagauauacaguuggcugucaugaaauguaaugcugcuuguguuucacuaggauggucauccagaggacaaaaaaacacacauugucuuugcuucugauaaugaaagugaaacggaagagacauccacucaggagcaaagcuguccagaaaaggagcugaugaaaguaaggccuuccaaacauuaaucuacuuuguagaaucccucuguuuugcuuuucuuuuugugaugaggaugcuguguagcccaggcugccuuuaaacuuugaaaacuucuguauccaucugguacuacaguauguaccuaaccaagagcuccacacaacuacuacauguguaaaauccuagggugagaaccagaguugcccaaucuauaauacccugagaugucagggcucuuggagauuuucucacccaugaaccuguuuguuaccucauauguaaacucacaucaguauucaugcuagacuauaagaaguauccuugcauauaauaauuccuuuaaucaaaguggcaauaggggguuuucauuaauaguggauuaaugauccaggaauccaguuaacuacuccuaaguugagaguacuacuccuggcccaccacauauuuguuccucuggaugcauuuggguuguugguuuuuaaguguggaguaagaacuuuaugaagaaauuggugauugccugccuugguuaaugcccaaacuaauguuuuucucugcauggcaggaaucugugaguaaaucgccugggaagcuguuugacagcagugaugaugaagacucagauuccaaggaggacagcaccagguucagcauuaaaccucaguuugagggcagagcuggccagaagguuagccaauaaccaauacaguuuugagaacuuugguucucuaguauuugucuguuucugucaguuauggguagcaacuuaugaaguuaauguguguaaaguacagggucuuucuucaguauuuacuacuaaaucaaagacugaagcaaaugucgcauuaguagucauuaaaauugauucacugguugucaguuuuaaacuuagcauguaaucuagauaacacauuuacaguguuaagaaauaucagagucuguaaucacuuuagcucuauauuuuuuguuacauguuaagacuaaaaguagaaacaguugcagcaggucuaaguuuugaaguuaguccuaaaaucuagcuuaagaaaggguaguucuagggugggguauuuauugugggagugaauucucucuuaacccuuacugguucauaggcaaugcauuuaugcauaugauaauacgaauuucagggugugaggagguacacuuagagacuuuuuuaaaaugagcuuaugacaauguuuuuuuuuuuguguagcuuauggaucugcagucucaguuuggaagugaugagagauuccgcauggacucuagauuuuuagagagugacagugaggacgaaaagaaagguaacuauuuuauuguucaaacaauguuaaagcuagugauguaagaagucaccugguguuucuucuucacauaacacaggaagaaacuguacccuaaaauaaauggaauugaauuuauaguagccagauguuuauuaaugauuaaguucuuuagauauauuuuuaguauaacuuaguuauacuaaauuagaaaccauagccgaugucuaauuuacauuuaauaguaagggccuuugucuuccucuggugaaugcccugggugcuuguuugggauggguugguugguuuuaggaugcugguucauuuguuguucccacuaugcauaggguucccacuauucaguggccaugcugguaucaaacuugugauccuccugccucagacuccugcuuagauuacagcaugcaccauaacucccagcuagaugcuuuuauuuucuuaacauauauuauuucauagugagauuaugucauagugagagagugugugugaucacacuugugccacacugugcauguggaagucagagggaaaacuuacugguguugguucucuuauuccucuauguuuauucugggccccaaaucaaguugcuagucuuggaggcaggcaccuucauccuuugagccaucuugccagcccaguuuguuuguuuguuuguuuuuuauuuuuuuuuuuguuuuuuuuguuuuuaauccauuuucuugcauucguuauuauuugggugucccuaacaguaaagaugucauuggcaguauccuaauucuacuuccuggagauuuuucacaguaguaaguccaaauguauccauaagcugugcccucacuuggcuaucaugagugagucucccuucccugggcacuucccauucccuucacagucgcagaacuugagucuuugugagcucucuguuucucugcuuuuugaguaaaucugaugugcaucucuuucguguuuuguuuuaaaacauuucuuuguccagaugaauagucacauuuugaaccucagaaaaugugcaggcuuuucuguagagaacauagaucagauuaauaauucuagauucuguuuugguaauuuccugcacuaaucugaaagagucuugauaguuuuaacuuuuuuuuuuuuuuuaaagauuuauuuuauuuauaugaguacacgguagcugucuucagacacaccagaagagggcgucagaucccccuacagaugguugucagccaccaugugguugcugggaauugaacauaggaccucuggaagagcagucagugcucuuaaccgcugagccaucucuccagcccccaguuuuaacuuuuuaugcugcuuuuaacuaaacuagcuguugaacuuugguucucuaguauuugucuguuucugucaguuauggguagcaacuuauggaguugauguguguaaaguacagggucuuucuucaguauuuacuacuaaaucaaagacugaagcaaaugucacauuaguagucauuaaaauugauucacugguugucaguuuuaaacuuagcauguaaucuagauaacgcauuuacaguguuaagaaauaucagaguuuguaaucacuuuagcucuacauauuuuuguuaaauguguauuauauuuuuuagucuuuauaauuuuuagacuugccaccaaagacauuauuaaauuuagauuuuauuuucucaguugcaaauagaaguuggguauuucauuugcuagucaugugauuucuaaguuuuuguggcaagaagucuuagagagagguacauuaacaaauacaagguuaaacuugucauucaguguacuuuugaauauguuuggaugcaugcuugauugagaauucaugagcagugcuugucaacagauuacuaguuauucuucuuccccagagcuaaaugaagauaaagugaaugaagacgagcuugcugcagaaaaaaagaaaacccugaauguugugcaaaguguuuugaacaucaaugugaacaacccgacgaacaaaggaucaguggcugcuaagaaauuuaaguauggcuuauggcaugucgcauucaugauguuuuugccauaaaugccucgugaacuuaauuuaaaacuaauguuuuguguuguuuuguucuugagaugauaguggucuaacuuagggccuuguauuuucuagucaguugcuuuuuuccugagcuauacccccagcccagcugaguccuucauaaacuacuggagagagcaguuguugacaugucagacuucaaaaaaguucuuuucuuuaacccaguuauucacuguaagaaauuuuaaguccaagugugguaguuaccaguuuuauuuuuuuucucaguauuugggaggcuaagacagacugaucuuuugaguucaaggccagcuuguucuacagagcagguuccaggacagccaaagcuauacagagacaccuugucucacaaagcaaacaaauuuuaaaaaaaagaaagaaagaaagggagggagggagguagggagagagaaagggagagagggggggggagaaagagagagagagagagagagaacuaauucucaguaguuuguguauagcauucaugaugucauagcaacauugcuuuacugguuaaccaguuggaagugacuuuagauauuaacuauccaauuauuaagcuauacaaauauuauuaugggcauuuucaaaugaguacuuuaaagacauuaguuucaguacucaaccuguagaucauaaccccuuuggugggucacacaucagauauccugcauaccagauauuuacauuaugauucauaauaguagcaacauuagcuaugaaguaguaaggaaauaguucuaugguuggggucaccacaacaugaggaacuuuuuuuuuuuaaauauguauuuauuauauguaaguauaccguagcuucagacacuccagaaaagagagucagaucucaucacggaugguugugagccaccaugugguugcugggaucugaacucaggaccuuuggaagagcaguuggugcucucaaccacugagccaucucaccagcccugaggaacuaucuuaaaaggucacacacagcauuaggaagguuggaccgcuggauuaguguaacuucuagauaccauggauccagcuucuaauugguugucagcaugugauuaguuuucucuucuguaccucauguaaacuugucuuacccuuugagauuuauuuucugcaagcuguggaaagcaaagguacuucaucuauauaugccucuauuuguucaaaacauuuuucccuuauauauaguuauauaugguuuggaacugcucaggguggucccaaauaucuugccaucucugcaugaguucugagauuacaaguguguacccaugacauccagcuuuaagaugauuugcuuaaaugugugcacgcacgugcgcacacacacaaacacacacacaguaaucagaagguagcuuucgauuccuucuuccuucccaccauguggguccugaggcuugaacucaggucaucauaguaguagguaccuuguaagacaauuuuuuuuucuuuaauuuuaauuauaauuuugagacugggucccuauguaguccugacuggcucagaauucgcagaaauaugccugccucugccuccugaguacuguugggguuacuccuggguguaauuuuuaagguuaaaaaggauccaggaauacucaaauggguagauuuaaaaguuuauaacaagaugacaauucuuuuugaugaacauuuagccuuuuuuuuuuuugccccugucuuaguuuacuugcaaguugcugguacaaaauaauccuagaaaaaguugcuuaagggaaaaggggauuauuucaauucaauuugagaucacaaucaaucaugguagaaaaaucagaggcagaaguuugaaaaacuggcugacucacccauagucagaaacagagcaaugagugcugcacucuuucagucagcuaacguucuccacucuguagggugugaugguguccacacgagugagucucucacccaauuaauguaaucaaaauaauuguccacuaacaugcccacagcucagucuaauuuauagacauuccuucccucagacucucugaaggugauucuacguugugucaagcuaacaauuuaacccucagagccccuaaauuagucuuuauagugacaguuuaugaauugccauuaauguuucaauucgugucuuccaaucuuuauuuguucuacacagggauaucguacauuaugacccaacaaagcaugaccaugccauuuaugaaagaaaacaagaagauaaagaaaaagaaagguaaauuggagucuguuuuccauucaaagucuacuuaagcugcugaguaacuuuaauaagcuauauaguaacucuuuuuacauaagugaaguuccuuagcuaugugaaggccuuuauccaagaauuuuguuuuauuuuuaaaacugaagucuguagauuuuucuauaagggaguaauuauuaaugaaauuaggcuuugcaggucagauagguucuguuauaaauauuucucucuacuuugguaguagaaaagcauguagacauugaaauuugugucauauguguguaacuuauguguauggguguccugccugcaguacaucuaugcaucauaugcacaccuggugccugugaagccagaagagaguguugggucccaggaacugaaguuacauacaaacugaaguuuauagacaguugugagcugucauguggauccugggaauugaaccuaaguccucuggaagaauagucaauucccuuaucagcugugccagcucacauauauaauuuuugcauguuauuuuuuuucaucaauuacuccagccuaucaaagccauucuuggcaacaggagagaugguucaguguuuuagagcacuuguugcucuuuccaauguaccagguuugauucccacaaggcagcucauuacugucuguaacucuaguuccaggguacacugugcugucuuuugauguuugcacuuaggaaccuuuuuuuuuuuuuuuuuugguuuuugcagacaggguuucucuguguagcccuggguguccuggaacucacucuguauaccagguuggccuugaacucaaaaauccaccugccucugccuccuaagugcuggaauuaaaggcgugcgccaccacugcccagcuuaggaaccauuuguuaaauuucaugucauuugccuuuugaagauguaagaauuaucaaacccauggcugguuccuguaaaaagaaagaaaagaaaacucucucccucuuauuuuuacucuuccucuuaacauuucacuguaacaagaaaagaaaaaaccagaaaauaucucuagugguuuggaugucucuucagcuagauuuccaugcuauuuagguaugugcucuauuuucuacguuaccacagguaucagaguuucuagaauuccuccucuaauucccaauacaauuucccucacuuuaccagcccucauguaucacuuucuuaaaggccaugugguuucaacuaacagcuucaagaccuuucaggguuuugccaugacccuggucuuagaaauuacaugcuagugauagcaaaguugagucugugcuccaggaauggaaaacuuacuuccaacucuuaaaaauaugaaggacaaauuuaaaacuuaccauacgguaguucagcuaguaugggaagaggugaugaucccuccaagguaacagugucuuucuucuagacauaauuggacuaauagacaugaacucaagguguguggcaacacucacaaugccuccaccaguucaagucagauggugucccagccugagagggagaugugggcaugaacugccaccucuaaccaaguagcuaucugcaguugauaccuguuaaccaaggaaaaauccauuuuuuccaauggugucucacuggguauauuaaccacacuucagggcagaccccauauccaagaguaguuggccaaaacaaaacaaacucaauaguauuuuuguaauuuugcuuuuugugugugcuuugaauguguggggguuuuuuauuuuuuauguucuuguuugcuuaaagagaaaaggaguauaaaguuggguggggagaaacuuaagaauuggggaaaacgaaaacaugaucagaauauauuuaugaaaaaaaauuuuuuucgcuaggcaugccuuaaaucucagcacuugggaggcaaaggcaguuggcuguaugugaguccaaagucaguguagucuacagagcaacuacacagagaaacccugucuugaaaaaaaccaaagacccaaaaaaauaaccaaaaauuuuuuuucuuaaagauuuauuuauuauuuguaaguacacuguagcugucuucagacaccccagaagaaggcaucaguucccguuauggaugguugugagccaucaugugauugcugagauuucaauucacgaccuucagaagaccaguugacgcuuuuaguguucucauguucauuuuuauuuuaaauaguacauuaaaaauuuuugcuuuuucuuauguauacuacaugaaauagauucuuaccugguaaacauuuuacucuauuagcuaaaaccuaaauauuguaaacauguuguaucuaagaacaaaauauauucauuucuaaaauauaucaauauauaaugaugacaaucgaaaaauauuugcaaaagauaguaauagacuuaucaaacuuacaauucaccuuuaaaagauuuuuaguugauuucuucuccauugauuuaauaaaaauugcagaaguauaaaacuuaaaauaaccauagaagccaccugguuuaacacauucauuuugcagaugagaauacacucauaaaagcugaaugauaauuuagucccuacauuuuaguuuacagagugagaggaaagugcucauguguaguauuugcaucuaccagagauaauguguguaaaagaaaaaucuuucuguucaagauugaaggauaaaguuacaaguguguaaguaguuuacccuuccugauguugagacuuuucagagcuugucuuuguuauguucguguccguaugucuuucaguaaggcaacacggaagaagaaaaaggaagaagcagagaagcugccugagguaucccaagacauguauuauaacauugcugcagauuugaaagaaauauuccaaaguaugagcaacacagaugaaaaggaagaagaugugcccaggacugaggcuggugcuagagaggggacuggaaaaaucaggaacgccgagacacuggcaugugagcccgagcaaaccacuggcuuuacauucucuuuuuuugauucagccacuaaagaugaaaaggaugguauguuuuuuuuucuacuuuuuuauuucaggcaauuucaacuugguuaaacuuacaguaaauuaauggauuuuguguugccucaguaaaggauccuuuguccagucugcauaaacaaugagaaucaguguguccugauuauaaaugugauguuccuacaggugugaaaagcaguuuuugcuuuagaggcagcagacugcucaagcuagcugcuguaugaguagaggcuagacauuaaugccacagguuuuuuguuuacauagaaacagucaggaacaaguaaacuacauuuaaaucaugguucuuauuucagcuggaaauguuggggccuacaggaaggaagaaaaagauagccuuuuuaguuuuauacaauuacaccauugucaucaauaugccauuuauuucaaagcuuauuguuuuagauuugacagaauguagagaaaaguguaaaagcaaguccuacaauuuuauauccaauuucaggauauccaucccuaacaaguuccauagauuuaaaaauuaaaaaaauguaaaaucuucccauuuucuuucuuuaaaauuuuaaagagagagagagagagagaaagagagagagagagagagagagagagagagugucuaaaugcccucuagggcuagaauaggggguaggaucccuuggagcaggaguuacaggcagcuauagcugugaacugucugauauggguuaugcauaccaaauucaggucuucuuaaagaucagaaaguacucuuaaacacuaagccaucucucuagccuuucuuuuuuccuuugaagacagggucuuacuguguaucccaggguaccauggaacuuaauauguagcucaaacuggccucaaacuuaggguuuuuuuuuuuuccucuugugugccacaccugauuaagacuucguuuagaagacuguuccuuaccuguauucaagguguauguccaacauugugggaguuuccuauaaaaggcaagaugacucuaucuagcaucagauguacacugcuaacuucagugaugugcuuuaaagaugcgcauuuaaaacagagugcauggggcuuagagguagcccagcaguuaggaacauguuuuauucuugcagacuacccagguuugguuccagcacccacauuagguugcucaugaccuccuguaacuccaucuccaaggggauccaauucuuuagcucugagcgcauguauacucacuggcacauguacagauuuaauacaauuuaaaagcacuauguguuuacagauacaugccuacuuucagcacugggcuacuccuaaaauagcuacagaaacuauaguagcuuuuccaaaacauaaauaagauguaugcuguguucuacuugauguuuuucugugcauuuaguuugacugacaacuaaauggaauaugaacucaaauacuguaacugugagugccaagugugagaaguaaagugggccuauguuuagucuuagauacagucuauuuuuuaagaagcuggaaacuuggagacucaugagugaucaugcagacaaaucucacugcaguucuagaaagcaguuuugagagucgaaaacaaaaacauaaacaugaguuccuuuucuuguauaugaauaagcaggaaaagacucagguuucagugcaucuuaaguuguaggccucuuuuuuucucucucucuuuuuuuugguuuuucgagacaggguuucucuguguagcccuggcuguccuggaacucgcucuguagacuaggcuggccucgaacucagaaauccgccugccucugccuuccaagugcugggauuaaaggcaugaaccaccacgcccggcuuuguuuuuuuuucuuuuuuuuuuaaauuuuauuuauuuauuuuuuuaauguuuuuuugagacagggucuuuacauagcacuaguuguucuggaacucauuauguagaccacucuggccucaaacucacagagauucacuugacugugccucccaagugcuaagacuaaagguguaugccccaugccuggcacuauagacuucuuuuaacagcacuuaggcagugguuaccuguucuuugaaaauuauacuacucaucuauaaaucuuuagcuuuuagcucuuuuuauaauuuuauauuccucaugugaugacucuaaacaguagcuuuuaguauuuuaaaauugaaaaagauaagcugggugugguggcgcaugccuuuaaucccagcacucaggaggcagaggcagguggauuucuguguucgagaccauccuggucuauagagugaguuccaggacagccagggcuacacagucugucucaaaaaaaaaaaaaaguugaaaaagauaauguuacuuauuuuaggaaguacauccacaggucagugguagcguauuugccucucauuuggauuugaacuccaaaauuggaggaaaaaagugaugguaucugguuuuaacauauuaaaauuuagucauguuuacauaguacagguaauaauuuuacuguguucauaaauacgugguugcucagccauaauugcauuaccuuuuauugucauaauaauauagccaccuauagaaucgaacuagugaaacaugggaagauagucuguccaaaugauccccgauuccaagacaguaguucagaagaagaagauauugcugaagaagcagaucauagcaagccaagcccuggguaagcuguuuauguguaagcaugugucgugguuuauaaaguuagagucaggcaugcuucaguagcauuaugcaaguaucuggaacaaauuuuaucaguuucuguucagaauucuuuuuuuuuuaagauuuauuuauuuuauguauauaaguucacgauagcugucucagacacaccagaagagggugucagaucccauuacagaugguugugagccaccaugugguugcuaggacuucuugaagaguagucagugcucuuaaccgcugagccaucucuccagcucuuaaccuuuuuuuuuaacagugauuuucaggcaacugguggcaggugaagugugugccagcaguaaggcugaugguaacacuccugguuuggaaaucagaugcucuagcugaguuaggugccagcuagagaacacuggcaaacaggguaacagugggaaugaguauugacaucuagaguacauacuuaauuccucaauaucaaaacuuuagauggaggaugggguguggucauuuuauaacaugagcaaagugcagagcaacuuuuuaaaaggaacauuuuacaauuucacuauuauuuuuccuguuuuuauuuugcuuguugccuggguuucuuguuuuuguuuuagaccagacuuauauugccuaaacuucucuugaacuccuuauauagcuaaggcugccuggaauuccucauccuucugccucugcuuuccaaauuauaagcacacacugucacaccagcuguaauaaucuucuuaaauauugaaaguaauuucugcccuuucucccucguguuuucagagaagcgguuccugagaaugaggccauuagauuuuucuuuuucucugagaaugacgacagacuucgugguagguccauucuuccauucaguggugugggacaaggaagaguagugcaacucuuauguacuauguacuucacacaguagcuaugucuggaaauuuuggccacuucuguaaugugauuuauucccauccauuauaaaguacauucugagggccaagugugccucugccagcauguucauugcuuguucauuauuauagucaaccacaucuuauuuugguauaaggacuugcuuagaugcuaaaauacaagaguguucacugccuuagaagucuacaugaaaucucugaggcugaugaugaacuauucagauuguucauuuuaauaguaaguaauuggcuaccucaugcuucuguuuuucccauagguucuaacuuauucuggagugguaugggagguaguauuagcagaaauucuugggaagcccgaacaaguagucuccuuuuggugaguuacguuucuccguauugauuuccuccaaaucaagauaugauggcauuaguguuacucuucccuaguauaacaacaauaagaaacaagauaucauauuacaaaaugauaacagcugagaacaugacuuaacucuuagaauuacacuacuaaaaagaacuuagagcuuguuuguuccaacuaugacauguucugucugaaaaauuagaugcuguggauagauuucuuuauuuugaauggggagcuuauuaaguauauagaaagccuggaaggaaggaaggaaggaaggaaggaaggaaggaaggaaggaagggagggcagauugacuugacugacuuaauucaucaaaucauguacucaaaauuuuccagcagaaacagaguagaaagaaccuuuaagguagucagcuggaguucucaguuaaguuuucuguccauaccugagccucccauagcuaagcuuccagcuucucuuccccacuacagacacuuaauccuagaauaaacauaguaacaucugcuggaaauggcucacuuucucgcuguucucaagggcacaguuuuacucuugagcugucuugauauuccuuccucccugccacacaguccgugagucaguccagccccagacaaggguucuuagaggauacuuaauaaaaacauauuuaggugcacagugagaguaguaggagagucucugcuuccagggccaguuuuucagugaacucccaacaggacaugacaguauaccgauaugggguacguuacacaaguauaugucaaggcacuaaagacuggcucauuugagugacuggucugugucuagccagucuacuaagaaacagguaaugagguuuuucaaagccuaaguuacaguucccuaaccauauaaaaccaaaaacugaauagacucuguagugagaauuuuggucucuuugaaaaacacagaaauauuaugggaaucuuuuaauuuuaaucucaaguaugggaauaaagugcuacuucaggcuuuccagagcagcuaugauuuaccuagugcucaagcagggagcaagugugguuucugugauugugugacaauuggaauucuggggacucuucagagaguauauaugcuagggccccaagagagaggguagguuagugguuuguggcuauugguugcugauagcugugguuaaguauucagugcacagugaagaaaccagaaaaaauuagauauccugauagcaaaguucaaaguugccucaaggaacuugacuccccaaucagcaggaaguagucuaaccguaacaucaaccaucuccccuucuauccuuuuuucucuccuauguaguguuagggggucgaaaggguggaagaggaggcugggugaaagggagaaggguggaagaggaaaagaacccacaagguagccaaggucugacuauagucggugcaucccagaaguguuuguagaauggguuucuacgacuuuaaguauacuuuguugacugugcgaaauuuguguuuauuguugauaaaagcuucuuauuuuaugguuuuuuaggaaugucggaagaaacauaaagaagccaaaaggaaggugaaagcaaauuaaccauugucagcuuugguuuuggaauugaaugugcagacugcucaccagcccuugaaagaaauuaacccagaaaagcauucacugacaaagaagauauuucauaguagaaaaauauucaaaccuggaugauaauguaucauucugaugacuauuucuguggaauucguauacauucccuccuugaugacuguguuaaaauuaacugagucaguugugacacacaguauagccucagcacuuuagaaggggaagugggaggaucauuugagcccagaauuugagaucacacugagcaacaccccaccucagaacagcauccauucuuguucuucacuccugacaggaggcuuacaugaaaccuuguuuaauaaaugguuugauguauuuguuuaaguauuucugacuaugcuaaauauucuauaccucuaauuuaucuuuuuaaacucaaguacaaauuaacuuugaguucuguauauacagauguaaguuucugauguaauuucugaagacaaaauagaacuuucuaauaaaugguucauaauauuuguguuuauuccuaauuaaauacucuuuaccuucau

SEQ ID NO: 7033 - RNA, 354 nt, Mus musculus
cuuuuuuuuugucaacuucaagaugagccugcugaaacacgaauauuccggucacaacagaaaguaacuucuggggcuuuucuucuucucagucucugauuucccaacaauguuuagccaaauaacagaagcaauacaauaguaauugagcuuacuauugucaauggcacucucaucacgguucucacagaccgaauaagguucauuaguugagauuuaauuccugacuccucuccgaauccacuaauucccuggucuguuccccagccaauguucuugaggaagugcuccuccugcagcacagagaugcacagcagggccgcuugcaucagggaguacagcgugaaggccaua

SEQ ID NO: 7034 - RNA, 354 nt, Mus musculus
uauggccuucacgcuguacucccugaugcaagcggcccugcugugcaucucugugcugcaggaggagcacuuccucaagaacauuggcuggggaacagaccagggaauuaguggauucggagaggagucaggaauuaaaucucaacuaaugaaccuuauucggucugugagaaccgugaugagagugccauugacaauaguaagcucaauuacuauuguauugcuucuguuauuuggcuaaacauuguugggaaaucagagacugagaagaagaaaagccccagaaguuacuuucuguugugaccggaauauucguguuucagcaggcucaucuugaaguugacaaaaaaaaag

SEQ ID NO: 7035 - RNA, 14180 nt, Mus musculus
cggggacguggcugggaaccagggcguaucuggggaccagcccgcgaagcucugaagcuuggguuaggggcggcaggaggcggggugaguuugggccccgccccggagggcaguggcaaaaguuugccuucggauucucuggggcagagucugggagaacaaguucaggggcaggcgacaagguccgggugcugagcaagguggcuggacaagccuagcgggagagaaaccugaggccacgagcgaccuccggaggagccccuagacgggagucuuagcugagacacggcagcaugcaaccagcccagaugcgccuugcagaacgaggugagcggcgggaccggaucccgggguugcacagaccagagucgcggguugagcgccuggggguucacccgaacccccuuuuuggauaaaauuucaaccaagucggggcaccagagugacuugggcucgcgagugccucgcuucggccacccccuccuguucauaucccggagaacaggacauaaccgccuguuggagcugguggagagguauaggguuccuuuaaauaacaaccagggcuuucuaaauguguuuguaaacucggagcagagugagcaggcuguccaagggaaagauucuugcuuuacuuggcuaauuaagaaguuagacaaucuuaggagaagaaaaccugggcacugggaacggcuguggguuuucccucugggagaaagcaaaugauucuuuuaaguuuuauuagugacaaaauuccaguuuucuuagcacuucucaaacuaggcaauuaggagugucaggccuggagcuagaagacaaggugccagcaaagugauaaugagagagaagauuggugugucauauguucuuaacugaaauagaagaaagggaagggugaccauuaaccaugugccuguacauggucucugcgucccugucucuccagccuuuaacaauccugacaccauguuccuuagauuugauguaaaaggggguuucucgucagcuguuuaaagggaauccuuugcuuuaaacaaacaccucuucuucuugacacccccuccuccaaagccuccagagucacucauucuaaggucugcagccagaagucucugguauugcauaucaccaccuacaaaaauguaucuauucaaaguuccauccuuuauagacgaaaaccaagcagacagggagggccaagagaauauaauuccuagaaaguggagcaagggguugcauaccucagguaaaggccuggcaaguuguggcuguggucagggcuguuugguugaggugguggugguggugguggugguggugguggugguggugguggugguggugguggugguggugugugugccugugcgcaggcgcucuguuuggguagcuguggaggaaucuagaucuguaagcuucuuaagggggugcagagcucagugcuugggggaguauuguguggccauauaccuucacaucagaucuuuccaucagcagacuggcagaugcucucaucuggucagugucagucugcccacauacaucagagcuugcccuuaggaagcccccacuggcauuuggggagauugacgucauaaccacuuagcauuuccccgaagccauuugcucuuuacacacacacacacacacacacacacagcuacacacauacaaacacacacacacacacaugcaugcacaugcacaugcacauacacacacacacacaccauaccgagacccuccugguucucuaccauauuuggaugaaggaacucccauuuccugcaaagcuuuacguacugacugaccugauacccugcuucccaugagucagggacuggucccuuuucuagaaagcaugauccuuuguuacacagauuucuuccucagugccuacaguuuguggguauauaucucuauuacaagaguaauaaacauuuugaguguggcauaauuuugaaaacgccgggguccccuugugguagcugaaucccuccuuuuccaucaaagucugaaggccacucuugagcaagcuguuugugugagcugggaagugguguugggguuccuugaauccugucgucacgucuacccucacgauuccauguugaucaauuuuggaucuguuucuuccgcacaagugcuuggaagaggugaucagcaggcugacugugacccucgggucuuaauccuucuauucccccccaucuuuuagaguuaucuaaacauuccacccgagcucccaggcugguauugggaugccaguagcuacaagcaauuaggcuguaaagaaaccaagaggcucuuagcaccuccuaguuaagggaccuaugacaagaggccaacucauaaaaaccucaucccugaaggauggacugggcagauccuucacacccagccuacccaggcucugccacuaagaaccucagcuucccccugugugcauucagaagucacacacuaucguggggcuagaugugacaugaagugaccaggauggacuuccccagcaagacaccucaugcuugcacauaucauuaacuuccugauggaagugauuuccacaaauccacauucuuuuucuggaaagcuuggcaguaaguugguccccugucauugccgggaacagggagaauuugagaagccugaccagcaggcaaaggggaagacaaauauaaaacaaaauuagaucuugcauccacgauucgaugccuuucuacagacaagucugacgugcaagauguucacagggcacccaguguucuugggauauaaccuccauaucugggguuucuuggaccacauccagauuuguauaucgucuuguuugcuaaugagaaggacauguucggcagacagcaggacauggaaagccccaccaggcagaggcacucguguccaugccugaaggaaggaaaggaggagaaacggggagccuuccccggcuuucaucugcaaccuucgucucacagggugcuccacugaugacccuagcucagcaugcccaguguggggggcugugugagugaagccuuccuucugcccugaacagucucuggaggcagagugaggucuagacagaaaagcugagugagaggacucaggagcaaaggaacucuccaggagugggagccauggacuggcccucugguuauaucauuucuugguucuuuuaaaugaaaaaaaaaaaaaaaccccaaaaaaaaaaaaaaaaaccaaaaaaaaacccuccagcuuuccaagaaacguugcucacugucaaaaacuggaugcuuuaauucgauucagagaaugaggucauugacgucucuggaaggaguccuuccucuaacgaagagagaugucuuuuucucugagauuuuugagaaagaggcaaggaggaaaauaaaaaagaggagagggggagagagggaaggggagggagaaggagggggcacacuagauagcagagauauuuucccuccuuuuccuucuuuuuauaguuuguuuacucuuuaaaccaacauauggagaaagugagucgcuaguguagaaggcacaucuggaaucuaucggaccccucucccaggcucgcuuuuccccaagggacgcugcuuuuggaucgggggagggcaggcaugccuaauauuggcggguucucguguagggucacccaccacugagccauuuggucaagggcucuccuuccuucuuggcaaaaagaaaauauguuuggugucagauuguuucaaggaaagcugugcgaucccaguguggugaggccaaagugagaaguuucaggugaugggggauggggacagggggugggggagggcagcucggaugugaacaguggcucccauuaaaugcagagugccugaggacuccaguccaauccccaucagaucagagcggugcaggagaagggaggaggggucugcugggggugucagagugcuugcuaaccaaaccuuggggguacugaugaacaccggcaaggggcugccuacaaaccugugcugaagagaccaguacugcugagggagcccuccacucuagagcucagugggaccuaucuguccccagaacaugccucagauuuuggaagacacauaaacuagucucuguguggccacaaucucaacauuagacuucuuuuuuaaaaaauuguauguguguguguguguguguguguuaggggcacuucucucuguguguaugugugcgugcauauacauuuguuugaguaaggggcacgugugugugugcaugcguguaugggaaugcagcugcuuauguagauuggcacguguauggagguuagaagacaaccucaggaaucaguccuugccuuuguuugagacaggguuuccuuuguuagucauuguguuguacaccaggguagcuggcccagccucuggcaaaucugggcauccuucugccucugccucccauauugugugggagugcagggauuacagaaguuuacuggcaugccuggcuuuacaugccaccugggaauucaaaccuaggcucucagggucuacagaagggcuuugcugucugagccaucuccccuacccauagcucccuucuguuccaaaggaaauggaucagcaguccaacuuacaaugucguugccagacuucauuccuuucccaacgcccaaugcaaaacugccuacugcaucucccuugccuucagugggaacaccuugacaccccuccaccccccaccccccacacacaaaagccuauuuuauaggccuaacuggacagcuacugucagagagaccagugcuucugggucaugguuacaguccacccauugcaccaaugugccccuuagaaagcaagagugaccugcaaagaugcagguaccuguucaccaaaagaaugugugagaaacaacccuugucugugauagaucagacccauagagggcgcugugcagagauggguaaagagcaagguggguucgaccugcauccacaagugugguuaggugccucaugcagggugugccauggguucauuuacauacugaaagaaacaauaaauucacuugggugagaaacccaaacaguggacacaugcugggugacaguagugaccagcagagaccccugguggccuguugcugaucugagugcugguucuaagaguguuugguugucuguguggugaggcaggcugacuuccuggugcaucauucauuuggugacagaaccgaaacaccaaaccuagcccuaagcagagcucacugacaccugugacugaggcguucuuuagcucagugggaccuaucugaccuauucuaaacagagcgaaggacuccugugaccugccucugaccacgcagcgacaggacuuacuuagcucucaggauguaaccagcuuuacaaucgugauaaaccagagaaaauagguguuuagagagccagacagcuucaagaugcaaaugcagagagccagaauggaaucuaacaaaagaugcucuauaaaaucuccacugcuugagagaugaguuuuaauuaagaggaaccaugguccaggcuuuagcagcacaguaggcuagcuugcaggcacuuggccucugcgaguccuggcacguccacuaucauuuucaucguggauauuuaauugcuggugucugcuucucucuucaccuguuuuucuuucacucugcucagucuucuucuaugcaggaagaaaauuuuuaaaaagauccacuccugaacagugucccugccuuucuucaccuucugcucccccuggaacagugguccccaaccuuccuaaugccucggccauuuaauuuaacacaguuccucguguuguggugauccccccccaccacuguaaagucauuuuccuugauauuucauaacugucauuucacugcuguuagggaaucauaauaugcacguuuucuaagacaggaauuugccaaagggucacaauccaccgcuugagaucagauccgccugauuggagggacucucuucccuucugcucccgcuggaggcaaaagcucaaacucuccagggaggggcgggguguguccagugcugugggaggcugggcaagcgagacacuggaaacaaucugcguugguacgugcauggcacgagggcuggggagauggcucagugggaaaagugcucaccucuugagcaggaggaccuggauucaauucuccaagcuccugugaaaaagcagggugugguggugcauguguguaaucccaacucuggggaagcagagacaggagcaacccuggggcacgcuggccagccagacaagucuacugggcaaguuucaggccagcgagagacccugccucaaaacacacgaaugacaagcacagcuauaacaaacccaagguaggcagcauccgaggagcaacacccgagacugacucguggcuuccacacgggcacaugugcacacaugugcacacaaaggcuaaccuaaguacacucguuuuccccagaacaagaaaccuggagggaaaccucaauucucaccaguguugugagcuaucuugucuaucuguucucaggacugaaaccccugauggcagagcagacagccgcucagggcuauuugaaaacaaaccugggcaucuacacagcguagcaugggguggguccuccaccaucuguaagagcccagacccacucuguaaguaaggaaggccagcugcuguguaaggggacagccccugaggacaugaggauggacacugaucuuccggauggcuuuuccugccuuuggcgucuaaucuugacuaucaacuugaggacauguagaaucagcaugaaaacaaaacagaucugggcaggagcuacuuuguagaucagguuaauugaaauggaugggcagaaccaucccauagggugggguccuggacugaauaaaaaacagagaaugagggacuggugagauggcucagugguuaagagcacuggcugcucuuucagagguccugaguucaauucccagcaaccacaugguggcucacaaccaucaagagggggaucuggugcccucuucaggcaggcggauguauaugcagcagagcacucauacacuaaauaaguaaaauuuaaaaaacaacaacaaaaacgaggccagcugaccgccaacaaucucucugcuuccggacuguggacacgaugugaccagccgccuccagcuuccgcacauggcacaugucuuccccacugugguagacugcauccuugaaccgggagccagauaaaccccucuuuuccuacguugcuuuuguuggguauguuguugcaucucugaaaacuggcugcuuacugaaaacuggcugcuuacaauuccuagucuccuaacgagagcuuucgcuaugcuuuucuuaaagugauggcgacccugacgaaaagucaugggagcuggccugacccuagauggugccacaagaugagcagaauguggauugggguuugacagacagaugagauuuaaacuaaaaucaggaggugugggcugcgugcgaguguauacagcucaguuagcaguucgcuuaucagcugagaggcuuugaguucaaugcccuccccccaccccacccccacacugcaugaaacagcauggugguuugagcauguaauuucagcaguuaggaggcagaggcaggagggucagaaauucaagaucauuguagcaacuuccaggucagguuagguuacaugauacuccaugaugaugaugaugaugaugaugaugaugaugggaggaggagcaggaggaggaggaggaggaaaaagagacuuguagaauuguccugccugccucaggaagaacuuuuagaagcccaguguggagcuugguugggugugagagggggcucaaugggugccagggguccugagcaugugagcccccucuguaucaccaguaucucauccucagaaucacucugggauucugggaaaucuagaauagcagaugccugcgaggggccaggaaucuaggagauuccucugccaagaagcuacaggccuccucuuuccaaugucaccaaugcuaagcucccccacccccccagugauggaaaaagaagaggcuuacacuaaacccacugcucccaggggguaucucaggggugcagagucucccgggagucacuuucucuucucagcccuauaguaccaucuauagaggaacccuugguauccuucagggauugaagucccuguugggagaagcuccugcuggugggugggccccacgguguuggcccaugugucuaggaaccaaauguaggccuggagcuuaaacacugugaguaaauccucagcggggacgcagagucggcuauuuucagcucgccucacuuggaccucaucagauauuuaagaauccaguaacuuuaauuuaaacuaagugagcauagagagcggguggccaugcugugaucaucaccgacgguaugcaccugucaccacgccacacccacaaagauguacaaguaggugugucaacgacaguaaaaaaauaaacggucagcccgugcccaucaaacacugccuucacaacugcucggcagagcaccagagucucggaggugaauagagaugagacguaagccagguuaacucauccacgggccagugggcaggccuggugacacggcucauuauuggugaagugcuugccaugcaagcaugagugaaaacuugaguucaggaccccccagcacccagguagaaagcuagguuugguguaugcaucuguaauccuagugccgugggcaaguagacuggaggauucccuggagcucaguggccagccaauguggcugcauggaugugcuucagguucagucacacacaugggaaugcaugugcaugcauuugcaucacagacgcacaugcuuauucucuuucuuacaugcacccacacaugcacgcacacauacacacagacacaugcaugcacacaagacacauguaugcacacacagaugcaugcacacagacacagacauauguaugaacacagacucagacacaugcaugcacacacacauaggcacaugcaugcacacaugcacauagacacaugccugcacacauacacaugcauacacacaugcaugcacacacagagacacuuaaguuuucagggucugauguuugcacucaaggccuucacagccaaguauggccuucuagucccaggcauuguaaauaugcuauuuuauacuccuggcccagacuucuuccuuucaagccacacucaaaguucacgucauuacccuucccuucccuuucuuccuuuaaccucaguggccgcugcuuccaggacaguucgaguuccuuccucucugagcucugcucagugcaguggccgcaggguucuugcccaggcucaggcugcucuuccugcccucccucuguggucaaacuguagggcugucugccaggugggccaaaggcccauccagaccccaaaggaaucagcccaaggaagucgggugcuucucacggugcugcuccaaaccucauccuggaggacccagaagucucucagauaccacuuuuccuacuguguucugguuuuccucaccucuccuuucuucccuuucauccuccucuccuuccucuccuuccuuccuuccuuccuuccuucuaacccucccucccucacuuuuccucauccugagaaaaaucugauucccucuacagcugggaauacuggcuuaccagcucccacguggugggugagaaguaacgcaguauuuccuggugccuggagauuuccaaguggaagcuugcucguuucugcugcaguuacaggauucacagauucgcacucugagguuucuucucuggcagcuccaggccccuaacagcuuucccugguuucuaucuuagagacuuggccuauguuccaagcacucccugcacaucagcccuccacacgcguuagcauuuuccacacgugggguugcugaauggugaucacuugcucuaaagcuccuucuacuuucaucuccuuacagagccuauuuucaacacucuucccgcagucgggccugcacgccuucaggaacccaccaccacucucccaauuguucccugaaaugaacguuccuggcgcgcccucucguggacuguugaaguaaccaucugucucuaggaagccauggcaaccacgcaugcgcagggccaccagccagucuugggaaaugacacucuccgggaacauuacgauuacguggggaaacuggcaggcaggcugcgggaccccccugaggguggcacccucaucaccaccauccucuucuuggucaccuguagcuucaucgucuuggagaaccugaugguuuugauugccaucuggaaaaacaauaaauuucacaaccgcauguacuuuuucaucggcaacuuggcucucugcgaccugcuggccggcauagcauacaaggucaauauucuuauguccggcaggaagacguucagucugucuccaacagugugguuccucagggagggcaguauguucguagcccugggcgcauccaccugcagcuuacuggccauugccauugagcgacaccugaccaugaucaagaugaggccauaugaugccaacaagaagcaccgcguguuccuucugauugggaugugcuggcuaauugccuucucgcugggugcccugccaauccugggcuggaacugccuggagaacuuucccgacugcucuaccaucuugccccucuacuccaagaaauacaucgccuuccucaucaguaucuucaccgccauucuggugaccaucgucaucuuguaugcgcgcaucuacugccuggucaaguccagcagccgcaggguggccaaccacaacucugagagauccauggcccuucugcggaccguagugauuguggugaguguguucauugccuguugguccccacuuuuuauccucuuccucaucgacguggccugcagggcaaaggagugcuccauccucuucaagagucagugguucaucaugcuggcuguccucaacucggccaugaacccugucaucuacacgcuggccagcaaagagaugaggcgcgccuucuuccgguuggugugcggcugucuagucaagggcaaggggacccaggccucacccaugcagccugcccucgacccaagcagaaguaagucaagcuccaguaacaacagcagccacucuccgaaggucaaggaagaccugccccgcguggcuacuucuuccugcaucauugacaaaaacaggucguuucagaacgggguccucugcaagugacggucucaacagggcaagcucugcagccacaccuauuuauugcaugcaucacuuccacguggggccuuaagagaucuuaacucuggaggucugcuugcuguggccagacugugugguaucuccugaggaggagacccaaggagucaccaacgcauuucagccuggacuuggaugugacuuaucuguugcgggcuccauccuucugaauguaccaagcugcugacacggugcacugccuucggaugccgcuaccccugguccagggaaggcagguggugaugugcuaugcacaugcacauugggaugaugucucccugcguucacacuacauuuauuuuccauagaaugggugcucauguguguguguguguguguguguguucguugcuguguuguacaggauguauacgauugauuuucccagguggaacccauuacaaagugucagucuuccacacaucauugguccaaaccugcccacacugcugucccagguucagcaugugauaaggucauguccccuucccagugcccuugcacugguguucuaacucauagcugugaaaaguuacuaaaguauucuguauucucaaaagccucacccaagagcagcccaggugugugggucuuacccuuacauuccugcaccccuccucccucuugggucccuugcguaagcuuagguacaccuaagagccaaauuaugcgaucauugaggcauuucugaaagccacagaaaagccagccgggaucucucggaaugcaggcaccacuaaaggaagaacuccuaaggagaggcaaggugcucuccacugugggcaaucuuucuaggggacugcagucugucugcugcauguagagaguuuccagcagugacguucacaagccagcccuucaucuguaugguccugaguucaagucuauagagagaagcuugaggcugcuuguccccuuugcugucacccuuugcuggcaaggagcuggagcugucagcaaagcuucucaacucccucaguuauggacccuguccaggacuauucagugagaggauuccgccaggcugggaggcgugauguaguuauuugugugcucuuuagagagaaccauuccaauucccauaugauggacacuccagccacucuccuccgcuuggaccugcguucauuuguccauccuguaaagaaaaugcguagaagacaccucugaacauccccuccccaaggauuccgcccacagggcacacagaugaaaggugggugcguuggagaguggccagcauccaugcucccagaacagccuucggaaagacucucauuugaggaaacgucaugucaaggcuccccauaaguugauuagucucagagacuguugccuuaugaacccuggaagagcagccuuuacacacucaugggccuuuuuaaaacugauuuuuuuuucccucuuggugguuaccugauggcauuugcucuuguuuagggacauuuuucugggccuuagguaacccuggucugacuaacuaaagacuuccccucaugucacuccugguguauauaggucacugccaagaaguucugcuccaucauuggccuugcccuucucuaugucaccaagaaaaugucaccguguugacaaaacccauggcauuucuggaaaaggaaagcauacaagugcuggguuaagggaaaaauaaauagcagagcaguguguaggggaguugagguggaaagagaacagggcuugugggcacgcucuuucaugauugcaaggcuuugaggccgugggucuaggucacugauauuaaucacacauuguacaggauucuggcuucuccauuuccuccugugucugcuuucacacaacagcccuuguggagggccaggcccaccauccccagcuaggaggugacauuuguagcaugacagacugccaagcaacugaaaauaaaaauacacuaaaacccaauugcgcucacuugauguaugcccaguggauccgucgaccgugaugccagugugcacaccuuucccuagcuagccuccgagacagcacugagacaucgggugcauccaacccucacccugaaggucaaaggucggaaaccagugacaccagagacccuggggcucgcccaagguagugagcaaccuuggcuacuugcaguuuauguuuguuaauaauaaauaaaaccaaaagccuguauaaaaacccauccuggaggccugugugguauguucuauuguuuuggaauagacacucgggggguguagugggguggucuugcuucucucccuagaaccugaucucacagcauuacaggcauaaacuacauuugaugcccaaucacuaagucccuuuuaucccccagggccaucuuguagaugauguuagauugaagcuuuagcguacuggaugcuacugauacaggucuggguagaugcuguuuuacuggugguggugguggugguggugguagcgguggugaguguguguaugugugugcccacccauguacacuauugugcaugcaggagaggccagagguuaauguuggaucucucucucucucucuaugcucuccaucuugguuuuuuuguuguuguuuuguuguuguuguuguuguuuuguuguuuguuuuuuugagacaccauuucucacugaacccgaagcugccagcuuuggcuagauugacugaccaacaauuccccccaggaccuguguuccuccugucaugguuauaggcacaaacugcccucuguggcauuuacguaggcacagggcaucccaggggagccauuucccagcagauccuaugauuugaagaaugguaauagccccucuguagggaagaaauuauaaaauaaaaaugucauccaacca

SEQ ID NO: 7036 - RNA, 5497 nt, Mus musculus
ucuuuuucaaguauguuuauuuuccccagggguaaaaauaaucaagucaaauuaauuucaacaauggugauauaaaugcaauauacaaacuuuauuuaacaaaacagguaaaauaaaacaggcauuuauauuaagaaaaaacuacaagaaacuaucuugaacaacuuaaaacaacccuacuugcaguugcauuugacugagcucuguugcugugaagaauacagcgcaugcacagguauggaugaaagguuuguacacuuuucaaguauucacugaauacuaccuuauauacacauauacauuaaauuugaaaaagauuagaugaucccagcugcacuucauuuuuguuguucuuuuggaagaggucgucuaaagagaagaauaugcgguucuguggaaagaaaauauuaaguuccaugucacuauuugaaguauucaaaaugaauugucgguguaauaaauaguaaaugcggacaaacucguauaauagcauuguucuaccauuuuauccuuugaccgacucuggaaaauaauuucuaccugcaaaaucauuuucagugaagagaaauguaaucucuuugaaaaaagaacagcuaauucaagucagcugcuggaucucaggcuaauucacauccaaauaaauaaauugaugccauacacacuuagcuaagaaaggguuguucuagucaaaccagaucucuggggggugaggggggggggugggggcuuaaaagauuaaacucagagaguccacccaaagcuuccucauucaacgggaugaaggccagcaucuauagcacuucugcuuuccuauugauaggaaggauuucugagcuccuaaagauaugugccauaauuccaaggaagacuccaguuuaacaaugccaccuuuuaaguauaaaaagguagcaacaauuucuauauaugugcaggauuuuggcaccuguuuuauacuaagugagucacuuuugcagguagaaggaacaacaucacuuuccuuuacagcaaagcuuaccuggcucaugaaucauguaaugaacccauccuagacucuguuggacaccaagucuccuccacuccucuucggacaucagaugaguuuuggguacuuguuuagagaguucucuggguaacaugacaugccuauuaaaauauucagccaaagauuagugccaucuuucccaccaacaucacuuuauacaggaaccuuaccuuugagauacuugaaauugugaaggguuuuuauccucaaaacaaacuaaauucucuaaagcaacucuacacuacaauauuaucuguaucgaucuauacuuauagcauauacuucuggcuuuugaugguuuauguuaaaguauuaggccaauauaaguugcacaaaaaugaaaggcauuuuauucuguagggguaaauuucuagcagaauacuuguuauugagcuaucuucuaggaauaggaccuuaaaaucuaaaaagucaugaagcaacucuuggucuauaggauauagguagaaaauauucauguacuggaaaguauacucaaagagcaagaccauacccaaguaaaaaaauauucucuccuguuaaauagacuggugguauuaggauagcuagaacagcaagagaaagucagaggcagucuaaaagggaguuauauguaacuuauauguaagaguaaggagccuagucccagaauuaguugucaccucaaccugagauuacuaaacuuuuaguacuggggcuuggaggggggggaaccaaacuaaguuaauguguucccuguuauucaauacuaaaucuguaguacuuguauauauuccaguuugcuucacgcuccaaauuaaaagcaaaaauaugccuuuggaacuucaugugaccguugguuucccaguaaagugcauuuccagaacguuaggaagcacuuaagucuuuaguaucaagccauuaucaacacaauuuuuccuuucuguggaaaacccacacuaaucuuuuuuuccccccaaagacaggguuucucuguauagcccuggcuguccuggaacucacuuuguagacuaggcuggccucgaauucagaaauacgccugccucugugcugggauuaaaggcgugcgccaccacaccgggcucccccccaccccccaguaaucuuuuuuuccuacuaauggaucuaacauauaauuuaaugaacaauuaagcuaaaccaguaauguauaaguauuauacagaaaucuuagaaucucauggagacuuagccauaucuaucacuaaugacucagcuguuucuuugagacccgcccccacuccuuaucaugcugcaguggaaacuggccucaaacuaucuuuuugccuuaggcucccaagugcuacaauuacagaauuggguacaacauccauccagguguuucuuucuaaugaauugaccauuagacuuacaaauuucugcaauggccaacagaccauagaaagauauuucuuuaggcuccugcuugaaaccaacagcuucaguaaacugcggccuugauucagggccaaaacaaacaaacacaauuuuaacacauauauacacaagcaaauuuguacccuagccugcauaaagcauugucaccacaaaguaucucuaaauuucagccucacuuuaauuaccccugguuuuaacuuuacacaaaguuagcaauuaacauuuuuugaccaguauaagucaagucugagauggaggugcaaauucagcucuggacuuuuggaauugggauagugcaguccauaguccacucuaagcaccaaacugcccauaacagguuuuaagcuguggauuugagcgcagauaauccuuaaccagcuuuaccacaaggccgaugacuacgugccaucacugccauuuccaggcacauauuaaauaaauauucuuacccacacaaguuaccacucauucuugaaauacugcuuaauguuuuuguuacuguuacugcuuugcugcuauauaucauaguggaggaaggaaggauugccaaguuucagggcaccuauuugaguucagagagacuuccaauaaucaagacuguacaaaauaacccaugaccuuaucuuuccacugauaucagucuuuguuguuguuucugggguuuuuuuccccguuuuuuuuuuuuuuuuuuuuugagacaggguuucucuguauaguccuggcuguccuggaacucacucugggaucaggguggccuugaacucagaaaucugccuaccccugccucccaagugcugggauuaaaggcgugcaccaccacuaccgcccggccacugauaugccuuaagugacagacauuaugcuugucaauuagcuuucacaaacaguacugucucuacaaggcauucagauacaaggagccucaaguaucuccuaccugauaagucaugucaagaggcugcacuucauauggggucauuuauaauguacaugauuuuauuuguauauuacuacugaucauguaccaggaaaacuauucucagaacccaguuuuuguuggaauacaaaaagugcaauauaugacucaagugcaaagaaauccuccauuuuauuucuguaaggacaggcugggccugaugacacacaggucccuccccggacuaguaaggcagaugcagcuagagcugucuacauggaguuccaggacacccuggguuauggagacucccucaaaaaugcccaaaaggacucccaugauauuugaggagcagucuacucuguuccuaguaaucaccccuucacaaaaucacuaaguuuugaacuuuauccaacacacauaguucuacuauaaacaaaacacccuagacucacaccucugugucauaucaccaguacacagucccugucaagagcaccucucuaauucuuuuguaaagguuggucaguuaagcucaagcuaguguggcaacacacccaccaucucagcaacugcuaaggcagaacagcaagcuuaaacacuucauguuucaaaauaaaacacuuuuuuugaccucuggauuccaguggguaauaaacuagcuccuacuuuauauuggaguaaaauacuuaagacagaccagcaguugcuccccaaaacacgcacaacuuauauacuccaaguuuagaaacuaaaacuaucucacuuugacaacuaaagaaauguauauaaacccauaugcuaaacauuuccauccaaauaauuauuugccuaauuuagaaagacaguacaauuacuuucggucauuuuuggauauuuccaaaccaaguucugaguuacuauaacgaccaaauauuaagccaauuaucacaugguuaccauugugaaguuuguaauuacuauguaaagacuguuauguauuuaaauuuuuuaguaagggggaaaaaaaaaacccaugagacuucccuacuuaagaacauucaaguuuauagcauuagugcaucgucaaacagccuggaaaaaguuuucuggcugugaagacuucuacacuagcggacugagagaaugggggguggggcggugaagccacucuuuuaaaaagugucucaucccucaaacagcauucuggacacuaaccuaaaagggcagcaaacagaaaacaaggucacuauuugcccaagggaggaacagguuuuacccaccuggaguccuugacugugucccagaaugcaacgcucuaaucccaacccagaagaacccagcgacggaaaggccuuugaaaccacaccccaagucauaagggauacaauaaaguuaacuacaauccucccuuacuuuccacaaucccauuugcuaauuauauuaacguagguacuaccuuccugcgcaucucaggauuuaaaacucaaaacuuccucaaaagccccaaacguggccaauauggacuagcaguugaagguaacguagccaccaccaccccaauccuuccgaaggcaaucucgaguuuucaauuugaucuugaagcccuuuaacaacgccccguguuacagcgucuggagccguuacccaucagacacucgauaaugcccgucgggugcguuuccggggacuuccccucccggccaguccgggccagugcgguuugcggucgugaacucccagacuaggcgcugcccacccaucuaacgacuccccaucuccugcgauccccgcaacacuacacaaagcaaggcugcccggacggacggaggccucuaaggggguccgagucccgaccaccaggucugaccucccagcgcggcccuccuccgcaggcgcuccucaccgguacucguagugcucaucgaaguacuugucugaguaguagaucugcuugugggccauccugccggcgcgcagaggaguaagcgggaucaggaaaccgggcgcaaggggcucuacguccgccuagggccgacgcaacgacucgaaugaggccaacgaccgcaggcccaacgcucuggauuugaauccgacagcccuccgccgauugggcgaagccaccaaccaaucacgcuccgcgcaga

SEQ ID NO: 7037 - RNA, 2069 nt, Mus musculus
ugaguuuuucuggacaaaaucauucucugaaucccgcuaugggcaguugauuccuccaauuaguaacuguaguaaguacugaacaccggaguugaacuuucccacucuaccccacuuccuaccacagcgcuguuucacggcaaucgcuggucccucugugcucuaccccuucauguuuaaagccuuugaacacggcucucucauagguugaacauucuucuccucaccauucucuuuuccugccccucccugcuccugucaguucccuugauuaccacagaugauuauaugauuucuaaaauaccaaagaaaaaggaaugauaaccaacaaaccccgcaugugcccacuaccuuguuccaagaacucuuagaauuugucuaagcaugucuuggccacucccuuauggagugucauguuaaaauaacuaguguuuuguccguccgaccucacucaugcaaucccugagucacuuacacaacuuguccacaggcgacacuacuucuaggcugcuccucauucuacaacacagcagcuugcaucuacagagccuuacucucauacacuguuaggagcagacauguggcuagaccugcuugcuugucuggcaccuaauggcaccacugaauccauccccucaucuggaccucuaaauuguacaguugaaaaaguugaacuuauauaaacuucacagcaacaaaccaaaggggccggaagcuuaguacaucauuugaaugcuugcucuguagucacgaggauccuagcacccguguaccaagccaggcaccgugugcacaccuguaaucacagcucuacgggaucagagaggagaugacugaggcuuggccauuucuagucuagcugagaaggaaagagccccagguucugggagaaacccugauucaaaaggagugcacaggacagagugauggagacuauccaaccuccucuucuggccgccaugaguacacgugugaucuacuugcacauccacagagcuggcacaggagaguccauuugcacugacuauacccuguccagaguggugucugcggucguuugaaugagaaaggcuccuacagacuuacauauuugaauguuuggucccagcuaaagaaaguuguuuaggaaggauuaggugguguggccuuucugaagaacaugucacuggggugggcccgagguuucaaaagcccgcggcagauccagugucgcucuuucugccuacugcccguggaacaggacauaaagcucccagccacugcuccacaccaugcuaugucugucucucccccauccacccacacaagggagauccacgcaggcagaauacagcgagacccugagaaaauagcaccuugcauggagauuuucuguccuggaaucucgacaucauacaaggguuaacugggccggcaaauggucagccaguaggagcacuugcccuucagccugacaagaugagcuccgcccuagaccccacaguaggauaacuggggacaccuuuuagcuuuaaauaagaugguucuugauucuuuuuguuuggguuuuccaagauaggguuucuccauauagcccuggccauucuggaacucgguuauuaauccuuauagaucauauuuaaauauauuugagacaagacucucagcauguuguccuggcuggcugagacucccucccgacucaucugcguuuguuuccgucuguggggcgaguagccucugcucuucugcaccaugucacccagcagaagagacuguucuguucuaauggaccugggacagaguggccucuggggagcaguucugagcccuugcugaggugacaggugcccaccugagaacacgacgggucuggaggauggcuuggcgugcgaggcgugcugcugcugcugcugcuucuccagcgcggccagcaugccccccagguccagcugcacugggaccuggcucuucuucccacuuguuuuaaauucauucuacaaagcacagauuuacaaguuuacuccuaauacuguauuuuuuacaccaagauuuacauuuucaaaaaauaaaaagauaaaaugaacaca

SEQ ID NO: 7038 - RNA, 109896 nt, Mus musculus
ggaggggaggaggcgggaagggagggagaggggguggggccugcacgcuagccccgcgcccuccuuccccacgccggccuccgcucccucucgcgccgcagcaucuccgcgcgucucccggccuccccgacucaagcuccuggcgccguucgccucugucgucgcugccaccaacgccgccgccauucuuggcgcggagcuggccuggccagcccccgccgagagccuccgcgggucggacgcgcgcuccagguaagcgacugggccggcgcgggaggagcgcgcgcgggguugggcaggugcgcggagcgcggcgagcccccgcgguaaaccuaggaacccuguuggagccucuccugcgacccccucggggcucccaggaucccucuccgagcuucuuccccagguucucccacaccgcuaggaccuagucugcauucccaccuggaugcccccggacucccucugcguucgcaucaggauccuuuggguccccucugagucccauccggauuccucaccccccucuacauuuccaccgcguuuuccagacccucucugcaguuccaccccagcccggaucucucuccggcgucccuucccuagcucccgccaggcccuggcaggcagguggcuggagcagggacacgggacaggcagcggaugcgacuugaccagccaggcccugcacgcugggacccccgggugcugacuccuugaucggugccucccaggucaggcccggugcccguagccgggcucccagccccggccuaaccagcuucuauuucggucucccaggccuuggcucgggugcaccggauguggcgcggugcacucagacaggugcggccgcggugagguugccaccgccgggcagugggcacugcaaggcgguggcuuccuggaagauucgggcugcguuauucuagaaccgcccggaaccaccaccagcuuuagcucgagcugcaccuguugcuggcgcccgaugauuugcagggggcugguucuguuggggcucagccaguuauggcuuggggaaaaaaaucagccaaaaaacaaaacagcgcugagcacguagcugcccucuauauguuuucuguuuagucucucugugggugaauguggaguuuuggcuuucaaugaagcauguggugaaggccugccccuacauacugggucauuugccacaugaacuuguccugcuuuuguuuugaaaacccucacuguguggagcacagcccaggcccguggguggcccaaccucucacuggacugggggccuguagccagccaucugacccagcugugggucuaccaggcgcuaccaaacggaaguuuccuucccaggagggugaagugacaccagcggucugucacuucauaugugccccuggcgucugacuugucucuugucugcccaggcaggcaggguuauuugggaauguuuacagugucccagaagcaggcagucuugggcagagguggggguagaucccgguagcgacuauaauggccugauugucauuuugaccguugcugucugugugcaucacgucagagcgaucaucuguugagaagcggaauggauagaauagugagcagggauguuggugugggcaaagcuugucuuuccugaccauaagacucaguuaggucuggcugguccacacagcaaguaaaccaaagaaacagacacacguugccuauaccaguuguggcauugccguucuugcacgauggaugugcgaccuggagccagggcaagagucagaggcugccuuccugugaugggcuuguuuaagucuguccuuugaaauggagcugcgaagucccucugucuauagacuccaaugacuucuggcugucauugugugccuuacagagacuccuccccagugguuggagucuuggcagguggcugccugcccuggacugagggaugaggugccugguguggaccgugcugccucaggaauccagggggucuggggccagggcagugugucuggugacaucauccacuuguggacaguugcuucucuaggcugucuuuuauggacaguguccaaggaggccuuucccaccccaggcaugguguguggugggccagggcuaugggaaugggugcuaauggacagcaugaucaauaaugcaucucaaagaucaaugguuuucuuuagccauuugagguguuucuagagggagccugcccugggagggcuaggaaggcugaggagggggacaguuuccuuugauucgauuauguuuagggugagcuuagagccagggacccuggguuugagcccuccagaacaucuucacuauaccagaagaggauuuggaauuuccucauuguuguuguuuaaagcaaacuguucccucgaguuuggaaaagaucucccucaggcucucuguucccuaggcacccagagagccauagcaugagcuugguggucaugccaagguggucuuggggggaaaaaaacccugcugcuagaauuagccaacagggggcagauccccucccuuucuuccucccuucuucccucccucccuccuucagauggagcccagguugcucucugaccuccuguaucagccuccugagugcugggauuacaggugugggccaccacuacccaguuuacaucucuccaauggugccggucccagaagguccacuagauggugaaagguacuggugagagguacccaugggguuuacccaggcugagggggaggguccuuuugguucucuuggcuaagagccaucccacucuuggcagcugcaguaugagcaacccaucucugcaaucucaguugaagacguggcugucccugggugacuugggguguggcccagagcuaggcuggucaggcaaggucuuaugcacgugucggggagagguuugcuggaccacggugcaauucucuugucuggaggacaugcagaaagagguggcaaucuuguaggagguacagguuaaccuggucugucaaggggugaccggaagaaacauagaaagaaguggcaauuuguuaggagauaugaguuucccuugucuuucuaggggugagcugcugggccuuccccagaacagauaccaaggaaggggauuugggggaagagccagguguggcuguuuugcucuugggaccuugcuuuccagcugugcucuuuccugagucccuuuugugcucaccugggaugccacaucauggcacaucuguugcugcugacccaggccuggacagcagccguacuuucuuuauuucuugcagggggcuuguaauuugguuuaaacucucacacacugcccgugagagcccggguugcguauuuuuucugaauggcuucuggaaggcacuuguagauugcaggcauccugaagccucuaacaggagucccugacagagcuaggccgugagacagacauuugcuacaugaacaaugguaugguacgagggacuuuuuuuaaugaccaccaugugguuguuguuaccaggggugcacagggugcuaaaggaugcuugggaucugcguugucggaucagggaggggucugggugagcgucccugagcucauuacucuuuuucuggcuucuguuguguaccauugaaaguacuccauaauuaaaaguuaauaguugagggccaaguggauugcuuacaugaagcagcugcguaaggguuuacucgaaacuuccaaccuuccgugcagugcauugagucauccuguuuacacaagugggcacuuaugcauggaaguggucuccuacgugaauauagacagcaccguugugucuucgaggaugccccccagagguugaguagguaauggugguaggggggcaucucauggaccagggucaggcacguugaaguuagugggaaugugggcacaggggugacugucugcauguaugugccaaugugugugaguaacggagucagcguguaagucugugaugguugugugaagauaucagauggacaggguaaaaguggaagccugugaauuguugugugucuguguguguguuaggggacgugugagcaugugugcaaacuuguagugugacuugugguguggaaacaucuucuauguuucuuuggccacuuuguguugccaaaccucauuacugugguguuuggggucauuuuuaacuaaaguaaggcguagcugaacuguccugugggguggaguugaucugggcacugaugaacgugaguaaccauuggcaagugggacacacuguguggauacucuggagaaaaggaaggcagacagugccggugggguggaauuguguguaauuuaaaccuuaugaauuauuuauuucuggaauuuuuuuauucaguauuuuuggacuguaauugacuggaaaccgaaccuuuagaaagcaaaagaugaaggauguacuguucuguggaucuccguugugugucugugcuuugccucugcacugggggcucuggaggcuuaugugagucuugggugccagugcucggagcucuuuaaggcugaagggcgcuuuuuggguuggcaguacugugguugguuugcucaucucucgguagauguuuggauuguuuccuguuaaaggguuaggagcuagaacuuugcaacagaagggcagauaaccugcaaauagaagcacauggccagccagccagugucauuagucacugaaagauacaagccaagacccagcucuuacugcacuagaauggcguugauacaagggguugggagauagcaccuguuguuaaggacuuagagaaaguggaacccugggguugcggagaggggaagaugguguuuggggaaacaguauggaaguuucuuggaaagauaaacacagauccagguuccuugugauccagcuauuccacuuuuauacccauaccuaaaaggaucggaaguagggacuaaacaaaagccucccaccaccauuuauagcaccguucacaagacagcagauguggaaacagccuagcuuguccaucaguggaugaagugggugagccagaugugccgugugcaggcauggaauaauacucagccguagaaaggacuggaacacugauacauguucgaaccuuaaaauaauagaaccuugaaacacugggcuaaguaaaaguagccacagcuaagacaaugugacucaagaaucuuguguacaaaaugucaguacaggaggcccagcuggagugccagaaacaucaucagucaccgggggucgggagagggauggggugggacugcuugguuuuauagggcuucuaguuuucuuuuguuuuguuuuuuuuuuuuguuuuuuuuuuuuuuuuagugcuguggauuugaugcccucccccaccuccacccucauuuuguaugcuaggugauaaaacauaauagcugauaaugguuguugugauguugugauugcaucacaagaugcuauuaaaggauaauguguguguguguguguguguguguguguguguguguguguguguguguuuugcauggugcaugucccucugcaugcuucucuggaagccagcacaggauguuuucuuuugucccucuuugcauucuucucuugagacugagccugucucuaaaccagaagcccaccacuuuggauagcuggcuggccagcaaguucucaggauucccaugucgacagcccccagccuuucccauuucaaaguccaguccucugauuugcagaacaagcacucucacccgcuaagcuaccucugcagcucccuaaguauacuuggucacaguaaauaauauacagaaguacccugugccuucuuagacaaaucuuacugggguuguauauuuucuccuguagacuggucacucaccaggggaggaaucucaggguuuugugauguguguguguguguguguguguguguguguguguguguggccuuuugaagaaccugguagcauuuuuaaugacaauuguguggguuuuuucaucccccccauaaaggagaugcagcaauugauacguacucacuuggcuuguugacacucgcuguugucagucuaacuguaaguuauucuagugggauguugcaguaagggggagauucuaguucugagucuccccuuaauaucuguuucguuuguguguuuguugaggcaagcuuucuuuguguagcccucacuguccuggaauucacucuguagaccaggcuggccucgaacacacaaagaucugaguacugggauuagagguguauggcaccgccuggcuuucuuguucauguuaaaacuggaucauuugucuuauuugggucguaagaguucugguuccaaauuagaaucugucagauauuuguauuauaaauauuuuuuccaucuuugcauuuuuaucuuauuagugauaccuuucaaagggcagacugcccaacucacuaacuuuuuauuucuuuuuaaggaaggcucucaugaagcccaagcuggcuuugaacucacuuuguagcugaggauggcugugggcucuugacccugcugucuucaucucccgaaugccaggguuauaugugugcaccucuaggccuggcuucaauguauuguuuuuagauggggguguuagugugguuuuccuuugcucgaggucccucagaggccuaggggugcauuggaauuccuagaacuggaguuagagguggucgugagcugccugggaaucuggguccucugcaggagcagcaaguguccuuaaccacuggccauucccccuuggaccuucuauguugcuaucuggaacccacggggaaggcucaggcagacauuuaauuuguuguuaaauaugguguuaguggaauauuuuagcccaagcuuuuagaguuguaguguguuggugucacaugaccagcagccuccuuggggagggcagggcucauuuggcuucugcuuccagguuacaguccuuuggaggaaaaguuggcaggagcugaagcaggaggcaugguaugacgugcugguaugcucagccaguuuucuuauacagcccaggaccacuuacagaggaaauggugcuguccauagacccucucacaucaaucagcaaucaagauaaauccuuacagacgugcccaugggccgaucuguccugaguuugaaccuaggacuuuuuaaccugcuugacagucacuguaacaccacgcuuaugucuggccuucuuucuaguccuauguuuggagacaaggucucccuaaguugcuugaacuguuguucuugaaccucugauccuccugagaaguuggaguuacaggccugguauuuguauuaccuacucuuuuuagcuauuauauaguaucucuuauacaugauggaugaauuuuaggauuccaugggugucagaaauuaccauaguacauaucuauaaguguauuuuuuauguacauaccuaugaaaauguuuucuuacauuagacacaguuagaguugaacaaaauuaauaauaaaaucgacccaguuucagcaccgcaccguauuggcaguuaugagaaugugguucuugccuuucucaaggcggcuuauuguacuuucauguagaaggaacacacucagccauauccugaccacagguguaaccgcagcauccaagaaaccgaggcagggagauggcugugaguucuggcacauuacugcuggugaggagcauuccugaguuaaggcacggggcagcuggaguaguuagucgguagcugaagcaacugcagagugccuagcaggaggaugcuguauacaguguggauacgcugcacaaaggaauguggccccugcgcugagagcagccuaugcuauaaugagcucuuuuuuaaaaaaagauuuauuuauuuauuuauuaucuguaaguacacugucacugucuuuagacacuccagaagagggagucagaucucguuagggaugguugugagccaccaugugguugcugggauuugaacuccggaccuucggaagagcagucgggugcucuuacccacugagccaucucaccagcccgcugaugagcucuuuauucuggaauuuuccauggcguauuucuggacucugguugaagguggauaacggaaacugcgggaaccagaaccacaguuaagagacaguucuaaauugccagguuuaagauuuauagcacucuucauggggcaaauguuuuugcgggcucaauaucuuuuuuuuucucucucuucaaaguauggguguauuagugaagccaccagagucugagguuuucuucuuggugaggcuuuuaauaaugacauugauuucuugcucuuaagauggucuguuucugcuagguuggguucugauaauuuagaugauuuauugugauaaaaugugaggacaguaccuucuacccugugaaaguuccguucugggaguuuuagucagugccugucagcauggagucgucacccgauucccagaauuccaugcuuucuugggccuguuugaagucagauccuagccuagcacuggcugccagggcugguuuucuguucuuacagagguuuccagggugucaggugaacacgucuggcaguuguggcacggagucuggcgccugccacuccuacacuuaccuuagcagugacugaggugaucggguccauggguagaaagacuagcaagauagcucagugguaaaagcccuugccaugcaggacaugaugacccgaguuccaucccuggaacccagagugguuagagaauugacuccugacaucccuugaucaucccuuggucaucguggggcacaacacgugugcugaugcacacacacacacacagaaacacacacacacacacacacacaaacacaaauaaauaaauaaauaaauacauucuuuuuaaaagacuucauuucugagcacugacuuguaagggagggaucagaagugggcaucagggacagguaagaauggucccgugguucaugguggcuugugugugugacacgcccaggagcuuuuugcccauucugugggauccccaccacaccccucaaccuggcccagcucuuccccacccuuuacagcugaagaccuugacagcacaggaaacuuauucuuggggccccuccgccaggaaguagagacgcuaagguuuucacuaggaugccgaggccccgugugcaagcaugccguccauguguggugucauuccucaguugccauuuuuugagacgaggucucucacuggccagggggcuugcuagauuagaccagagugacuggccagcuagccugaaggauccaucucggcccacuuccucauugcuagguucacaagcacaugccaccaugcccagccuuuugugacacggguucuggggauggcacuuagguccuuguguuuacaaagcgagcauuuccccaaccaucuccacaggccccucccuccauugcauuuuacuuaaaaguuuucauccuguguuaaaaacccugccucggcgugguguggauagguucugcaggaguuagugugcguccucuggguacaagucucugauuccuguguaaacucgcugugaucaagcuccuuccccuggcuuacuccucaucuggcuuauccuugggcccucaggugccucagacacccagagccaacagcagcauuggagcuauugcagacuugugcuuggaucacgcuccagaaacugggucacagcagagcucugagcaggcggaauuggaucucugcuuguguuugaaggcagagggcagccagcggcuuggguuucaaguguggaaucuggagaaaucaccagcucccuccuccugcuucugugagccccuagcuuugucugucaugucuggcaaggaaaagaucauccauccccagggcgcugucaggcuggcuugcuuuacccacugcugggcccaaccagggagguggucagagccaaucuuuaaaguagauacccaucucggaagagccuguggggagucacagauucccauuuauauacaaaguaacaucucugugacucugugacguggacguggauuuuauuucagcaggaaaaaaacuguugugugaaaugagcagucauuucugcagagcuuagaagacacagcccagacaucucccuauggaaaugguggggggacucaggcuggggaggggcuccgugugagcuggaagacuuugaguuugaucccuagaaccuacauuaaaaguuccccuugaggagcuguagaugcaggggggcuagggggugugugucucacuggccagccagccuagccuaaaagcugaguuccaggucgcagugagauacuuuguuuccaaacacagucugaacgaucugggaauuuagauggcuuagccagcaaagguacuuacuaccaggcccagugacuugugucccaucccuaggacccacaugguggaagaagagaaguaacuucugacccaucuccucugauguccacacacuaguagauaaaaguguagaauaaauuuuauuaauucauuaauuaaaaggugauggagacggaggaaugacaccuguacuggcugguuuugugugucaaccugacacaaacuggaguuauuacagagaaaggagccucccuugaggaaaugccuccaugagauacagcuguaaggcauuuucucaauuagugaucaagaggggagggcccaacccauugugggugguaccaucccugggcugguagucuuggguucuauaagaaagcaagcugagcaagccaggggaagcaaaccaguaagcagcaccccuccauggccucugcaucagcuccugccuccagguuccugcccugugugaguuccuguccugacuucuuuggugaugaacagcaauguggaaguguaagcugaauaaacccuucccucccccucuugcuucuuggucaugauguuugugcaggaauagaaacccugacuaagacaacaccuaaguugaccuuuaaauccccucuuuccccagugcacgcacaugcaugugcacacacacauacacacaugugcaaacaugagauggggggaagaagugauggugcacagagggcucgggugugcgcucuccucuguuuugggggacagccagcagagacccugucuccagaguaacugcuggugucacuaggguguuugugccuggaucguuugggucugggcuauucugaaucauuuucucacacuuacguuauaacugcuaaagauggaacgaggcuuuccguucaccagccugggugcugcgcucccuggugucacccuucccuacgcaaugugccgaggaccucuuuguugcuucaggacacagagcguggcucugugucacauaaggcauuuguacuggcuccuccccugcguacuaaguggaagggguauauccucacaggggcgaucugcagugcuggagauccugucuuccaggcacaguggggggcuacaggcauuugcugcugcaucuggcuucuccuaugggugcuagggcaccuagaccaggcccucaugcaugagcuucaggcaguuuaccaaccgagccgucucuccagcccacugcuuguucagagcugacaugaagggcagauuucauggucaagagaccuugucuuuaugguuguccucuaccugaagagugacuggguguggcugcuucucagccucuccucuguagaccugucccaggggaaccaugacaccaggcaggcucauguggccugcaaacaauggugcuuguugaccacugacugucugucauaagcucaugggagacgugguccccgaccuggaaggggcaugcucuuuuugcugccuucucaagcauagugaaacugucauucaacccauaggcucugauggcuuuacguugaguccccuggcccuucaucaaagugcugccugcccagucuuugaauccagggauguagcucagcaggaaagagcacuugcugcucuugccgaguucuguuucuugcaccccaaguuggguggcucacaacauccugugugaugguuugcauaugcuugacccagcgaguggcacuauuaggagguguggccuugcuggagcagguguggccuuguuggagugggugugucacuguggaugugggcuuuaagauccucauccuagcugccuggaagccaguauucugcuagcagccuucagaugaagauguggaacucucagcucugccuacaccaugccugccuggaugcugccaugcuccuaccuugaugauaauagacugaaccucugaaccuuuaagccagccccaguuaaauguuguccuuguaagacuugccuugguuacggugucuguucacagaagucaaacccuaagacagcagccuguaacuccagcuccaggauauauauacccucuucuaaccuugaaaugcacccacacauaugugcacauacccguacauacaaaucauuaauuuaaaacuaaacauaaaaccuaaauaaggaggcaggggcaggacagcaauagguuguggaaauccugcuaaugucugcucaucucuugucuucaccugccuaucuucuuucuccgaccagauguuuguagauuuacccucagaguacagcugguaucacggccaaauuuugccgugcauaaacacagcccgugugagguaccuagauucaaggugagcauugccagguugcuugggcugaccucacuaccuacaguucuggagguuggauuuuucuguguaacuagaacuagccuggauugcauaauauccugcccugccuccgcagugcugggauugcgugugugugccccacuauguauuucaaaucugauggcacuucccugaugugucuacggggcaucugucagccuguguacuuugcugaguacacaaaaugcuuucgcucaccuugcugucucuuuuaaguugagggaggucccuaaccaaaaucucugaaguaccccgacuucugaaacuuacuagugucugcaugacagcacaaacagcccacagcagagaacccagaugugugcuuaaagugcauuuuauguucagguauuguuccauccacauuucauuaaggggaugugguggugugguucacaguagaaagacuuaucugaaaucugaagcaaaccccaguguguauguguguguggaaacagagucagccuuaguuuucauuccucgggugccauccaucgugaguugugaguuucuugagucuuagccuccccagggagagacugauucaguuuggugaggauagcuacccagcacugccauggccacuuucauccgucuguccuagccuugccuggugucucaguuucucuuccuguuguguucagauacuccaacaaaagcaacuugagggagcuggagagauggcucagcgauugagagcacugacuguucuuccagagguccugaguucaauucccagcaaccacaugguggcucacaaccaucuguaaugggaucugaugccuucuucuggugugucugaagauagcuacaguauacucauaaguaaaauaaaucuuuuuuuagaaagcaacuaauggauggguuuauuuuagcuuaccuuucgagguauaguucauuauggugacaaauuuggggugagaggcgcuucaaauauugggucacaucauagccacaaucagaacagagacuuauuaguucucagcucacugucuccauuuuauacagaccagggggugcaccccugcccccauuaagauggucuugcccauucaauuaauguaaucaagauaacucccacacagucucacacagagaucugucuccucugcuuggucaaguggcccacacuaaccaucugacgugguggcucuuggguucuaaagcagaaacgaacuguuuguguucucggcacagagaguugaguguagugauaugugggaugucacuugcccagccuucauaacugagaccagaguagaggcagcagcucuccaugggaaggaagaggaaggugcugugcacagaugcugggcgggggagguguggggcgugagcacgcaggagaccuucugcaggcugcagggaagguagccauuuuugcaucaugcuacaugcgaacacugacuucaaaggcagcgaucccuuuccuuuaagagucucccgugaccacuguggcagaacaugccaacucaagggucacgugaucggucauugccauuguaguucugcaggcgaggguaagguucgagcagagcagcgaacuguccugucugccaucgucacacggcuucagauaacgcaggcugacuaaaucacugccgucucugccuugucacauggccaccucuucugugucucuucuuuuguauauaauaaggaugcuugucuggccuugagacccacccacuuugagaucuuucacagaggccuuucguaagguuauacucacucaugaucgugggccuuuuggggcuggacuucagguggguagccugggaagugggaacagggccuagcgcaaguccugguagguagucgacccacccugggauucuuuccaguggaguuuuaucugcaggaaaauggaaacugcagcuccucuugccagagugugaagcuguggaaacaaaauuaaaaaaauaaauaaauaaaaacugaggucagcuuuucucuccgcugauggggucucugcagaguccucgugggauccagugugaacaggaagcuagaggcacugagucacgucuccuuuauuuuuaugguguuuuuauuguuuuagaaaagggagaaagaaagcuaagagcuuccuccuugaucuggguccuugccauuaacagcuugcuuuucugacacuuuccccacuuugcuaccauuuucagacaugugucugcuccugauugaugcacgcacgcgcacacacauguccccagguuccugcucaugcuguagugguuucugcagcuccuucuuucugcucacuacucuccuauagaugcguagguucugugucaugccgggcagcagcaccccagccuucagagggcguguugcacgcaccccacaucugcuggcucuuggugggugucuguccaaucugcuguuucccugacugcuuuucuugggugcauuuugcuccucaggcauugcugagcgagguuugcuguccccaugauauggggugucuccugggaaugguagagccuccuaaaguggcuucugugguaggguggguauuccugugccugcuuguuugugagcacgaguauacaugcuugggcaucggucaguguguaugcauguggauaccugccuccauguguguacacgugugugcaugcuuguagaccagugugugcauguacaugcaaaugugcaugccugugagcaccuguuugcacaugugcacauauguauaugcaugcacauguauggaaagcugcacucuggacucuggacucuucccuacauuuagcagacucuguucauuaggaggcucgcuaaacucauuuucuagaagucuguucuuggcucagagcuaaaaauccacccuugcuguucucuggcaaugcuagccuaucuggagugauagaggaugcaggggcauucagcaugaugucacagauugugucaucuguguuucuccaggagucagcuguucggcugucucguccccagucacacuggcugucacagccagaugcuguggauguucccagauaauuuccagccauuuccucucccaggggacuguccucucugcucauggggacuucccuacauagucacguucugcuccaaagggauccagagucaugguggccugggcaggcuuuaagguacagguagauggccugccuaggucauguagggccaagaggacaagaacagggaguuggccugcucgggaagccugucccaggcgcaggcagagcuccauguucauacccauaagucaccaggccagcaaggcauggaugaagguugcuggcuggcuacuugguggggucacccacuggggcucuuguaggcugagccucacacuuugccugaccguucacuucacugggacagcacccaguguuacauuuaggggacaauaacugccuccgguaaugagugacuccuuugcugcugcuuuaagggaauccuuuuguccuucuccagacugggcuucguuuuccugaccagcggcgccagggcuacacacaccgggggcauugagcagagagccacugacugagcucggcuauucuguuuccuuuugcugagggcaaauguugauguaaguugcagucuuuccuccuguugugagcugcugaaguuauccucuugcucccuggcgugcucuuaucugaccuuuauacuggaugguucauccaaccauaaauaaucccuuugaaacacagagggccuggugugcuggcaucugcagaagcucggagaggagcugccaggagagcaggcugagcacagggaggugcagggagggugccaggacugacggaggagggguucuuccgccuccuuuuccauugggccugagcugggggaagaguaauuagauaauaaugaaugagccagugagugggaggagcuggucuuggggacuggcagggaggacucaguguuaucagaguagagaggguuggggcucuucaccagggcugugaacagguggcucucagcaucaggcuuuugcucauagacuacagucagucuguguucugcauccuuuccgagucagguucacagacaaugccacagaacucuggggucuagaaggccuguccuaacccauaggcgccuuagggugcaggccucaggguuuucugugugaugguuuguaaaugcucggcccagggaguggcucuauuagaagguguggccuuguugaaguaagugugucacugugggugugggcuuuaagacccucauccuagcugccuggaagccaguauugugcuagcagccuucagaugaagauguagaacucucagcaucuccugcaucgugccugccugguugcugcuaugcucccgccuugaugauaaugaacugaaccucugaaccuguaagucagccccaauuaaaugcuguccuuuuaagaauugccuugguuauggugucuguucacagcaguaaacccuagacacccuguuuccuggucucuggggcuuccugucaaaccuuaacuuagcuguuucuuaggaagccaggucuuucuggguagcuugggguuagcugagguuuguggcuaaacugucuucugccugaagguucugagaagcuagcaagaucacuggggaucuugacucaauagguuuccucagugacaguggggguguuagugugacacaaccauuccccguucauaguguccuacccucagguccuaaagcaagagccgauguucuuggaauuacugacugguacuuacaaaggcgggauaccaccucugacuugaaaccagaaucgccagcuuuaacucuggcuuggcuucucacugaaggaagauuuacccacaaguauguggcaguuggagacaaucccaucucgaccauuuccuguucuucaagggucaggagaggccugagggccauggcuugaucacacacaugccugaaccuuugcccugaauuuaggaugcucugggaauuguccacuuuugaagguacaaaaguguagccauuugagaaggccacacaugguuccugaagcuccuugguuuccacggacagcuucagcgcaucggaucuugaagaaagaagagcagcuugaaauggggcucauuugccagacucuugcauugcuguaugcagagaaagauggcuggcgaccaggaguggggaggagcagaucuguuuaugcuuuuguguccugugucaucuugcagaugcucuuacuuggaugaaaaugcgagugauuucuuaacccacccucagaacugcaguagaagcggagauuccucagggcugacccugcccgagcacugaugcugcgggcugaguuuauccuauugacaccaggugucuagaagcugugguuucaucuggacauccuuggaguaagguuucuuggaaacgagugaggcacaguguggcagggacgaggggauagacacuuguguacagaaccuggugcccaugugacaccaauguggcuggagccauuggucccuguggaagccugaguauucuauggauguggaugugaagccccauuuuauuuguuuguuuuguuuauuuauuuuugccucuuuucugggugguagccaggaaggaccugaguaagaggauguggcucuguguguguguguguguauugucuaugcauguauauauguguuuuguguguguguuauauguguauaugcauguguauaugugguuuuauguauguggauguuauauguggauauagaggccugagguugcuucaagaaucauucuagaauucucuuccaccuuccuuguugaagcagggcguuucaggcaaacucagagugucugggacucuucaccugugucuucugaagacacagauuuacaagaauuagaauuacaagugggcugcaaugcccauccagcauuuacaugaacucuggggaucggaucuccagaccucaugcaugugcaacaaaccuuaagcccccuuguuggcucuuaggucugucguuuguaacugaaagcugggccuguagucucugcauggucauggucagcaacagcucaagguacagugccguugucuccacuuacagcagcugguauggcugaagauucacugauguauugagcuguauacccagcagcuguuuguuuguaguggauaugcaccuacaauagauuuuaagugugaaucggguacaguaagaguuuaacaacaagccugucugugcugcacaccugcaguacuaaugacuaggaugugugagaugggaggauggauggaugggaggauggaugggaggauggaugggaggauggauggaggauggaugggaggauggauggaggauggauggaugggaggaugagaugggaagaugaaaagggaagauggaugggaggaugaagugggaggauagauggaggauggaugggaggauugcaauuucagugccugccuaggcuacuuaggaugacucucucacugaaaagggcucuaauacauguguguuaacacuuguucacaaaucuccccccacacacauucucucugucuugaaaaauauaacuguacaguagagcugagcagucuuagcauaucuuauuucuuccuuuagguugaaaauacacacccuuucucuuaaaagcagcacuucccggugcuucucuuuggagacccaaauuccuacagcccacucuccaaugcuguagagucauugcuaaauagaauugggguuacuggaacucagggcuugugaugcucaggcagucaggcugauaacugagacaguguugaguggcuaauguauacaugguggauacagugggcaagaggaagcauagcccauuaggguggggcaaggugaugaagguguguguguguguguguguguguguguguguguguauguucucacgugcacacuacaaagaacaucgagcagcuacaaacuuagaacaaacccuguggauauuuuuggacugugauugaugguagguaagugaaacuguaagauugagugucgggugacagggcuauuguguggccaagaaugugagcugcacacccaggaccugggaugugcuguacugcacucugguugccuuucucucugggagaugaaaggcgugauuccuugaaauuccaaaggaguaaauggucuguccugaggucuccauuuucccaguauuuacaggauucaggcucucugccuuguguuuggaccucagucauguauggagcaaacauagguccugagcguuguguaaacacucugcucugcagcaugugauaucugcagagggucaucaggaacugcuccagaauuuucaacuauucuggaccccuuuaccacuucuucuuuauuauuacuggacaguuucauagaugucugugaaacuuuuuaguuguuucuacacuuuauuucuuaaucuguauauauuuuuauaauuuuuucuuuuauuauagugugcuuguguauauguaugcucauauaugugcagaugugugugcgugagagagagagugugugugcacauauggaggaaugauuuuucuuuucucuucuuuccuuuucuuuucuuuuuuugguauacauauugaaacccagucucucacagaaccuagagcuugccauuuuggauacauaggcauguggcccugaaugaauccuugauaccuaagaaccagauguggcaaccugugauccuagcucugguuguggagaugggaagauaugaggggugucucacuggcuaauauguccagccaguuaguaagagacccaucuaaaaacaaaaaugaauggguaaauauggacgccagcaagauggcuugguggguaaaaacgugggcugugcaaguccgaugggcugaguucacuucugagaaccccacacaucuauggcaagacggacaguagagacaggaggauuggugacuggcggcuuggaauauguagugggagagaaacaaccagagaggcucugccccaaaaggugaagggagagaccuccacaugggagccaugguagauacaugaccccacccccccaauaauaaauaauauuguauagagccaugaugcugaccuauauucucacgcauguaccugugagcaugaguauacacauauacaggugcacauacuacacacaugcacacacacacacacacacacacacgcacacacacauuuuuuaguuagagaagauccauuugugcuuuaaggucuuaucacaguuuauccauauaaguuuauuucuaagggugccaaaguguauuguucuggugacauucauaucccccagaauaaauguugaagaucuguccgucaaauacacggagucauuuuauucuuuuccaucgucucccuuuguuucugagauuaauagaccagaagugauuguuuugcugccaggguaacaucagccucguuguuuccccucccauuguugagaacagauuauaaacaauugucauuaguuacuucucucucauuguaugggauaggcuuuuucaaucagauugucagagaccuuucugaugucauuuucacuaugucuucaauuuccuuaguguuuauaguauccauggggcuauuugucaucuugggugaguuugaauugucuucaguuccuaaagaauugaguguuuucuuccaaaccaggcuuuucauguuuaugauuguuuacaggcuuuuucugucagagucuguggggucugugguggugacuccucucuuuuuguggauggugggaguuggacauuuguucacauacuguggguuuuaggacuagugcaguuagguauccuuugccucacacccagggggccgucuccaccaucuucuccucuccagggaauagccagcggggugugucagggugaacagcaaggcucugcagcccugguggcagguggugccaggacuagccaauuaacacacaagcaccccagugaccugcgcauccgcagugucuccagaagggccgcuugcuaccugggaacagucccaggggaucauugaguuggcuucaguccacagggagagggaacuuggaggccauggaacacggaugagcucgucccugcucugugagggcucugcgggugacuguuccaaggaacagauucauugcuguuccaucaaagccgcucacuggcuugcuuggaaagcccagacaagccugccaaauggaacgaggcaggagaggaggaaggaacaucacagggccgcggaaagaaggcuuauucuccagaaucuggcugggaguuagaagcuggaccaagauggaaaaaaacaaaauaacaaaaaaaaucaaagccgccuacagaaauagugcuugucuuuuuaaugacauuccaaacaaggauguuaaaaacagcuagccaagaaggcugacagaguggcucagaggguagagugcuugccuagcaggcacaaggaguaggguuuagucccccagugcugugugaaaggggugugguggcucacaccugcaaucccaggauucuggaggaggggaagacacaaggaccagggaguugacaauaaccuccaaccauagagugagugugagugugagcgcagucugucuuaggacacaagccagcugugccuacgcaggccagaacgccugcauuugccucugccaucccugcacacggguagugcaucugacgguucugugcacggaagaagauccuucacguuccuugaaauaagucaaccagccuauaucuuugaaguugaacacuuagcuuaggggcuggagagauggcucagcaguuaagaauacgguggcuguucuuucagaggacccagauucuagucccaccacccaccugguggcucacaacccucuaauuccauucccagggcauccagugcccucuucuggccucguuagguaggcaugcacgugguauacagacacacacugccagaacacccacauagauaaaauaauaaaauaauuuuuuaaaauauguagcuuaaaccuuaaaucuuguuguaaauuagauucuuagccacaaaaguuuauacauauauauguacauauacccuauguauauauguauauauacccuauguaaauauaaauaugugugugugugcgugcgcacgugcgagugcguguaaccauugcaaagauaccuaaguauggcuuucuaagcagcagcccuagauguacuaugccucaucucugguuaauaauaaaacaugaguuugacuuuguuaaaaacacauggcucacccugaaauucuuuuccugcaguguuaguccaggagguccugagggugagacuccuugggcugcguuggcagcucugguggugccaccacagccucucuguccuuugcuuuugcuaggugggguugaagaugauugacuguguccuucuguagggcacauugucauuguccccguuugcccuguuuggaugauggaagauguagauuuaguaauuccucaggcaaguaauuuugcuucauuugauuaaaaaaaaaaacugugucaugcugggcuuucaaacauaaugaccuuuaaggaauagaaagaagguugguucuggagaaauggcuccgugauuaagugcacuggcugcucuuguagaggcuggaguucgguucccaauacccaaacgacagccugugacucuggugccaguggaucugaugcugcacauggcuugcauauauacauauaaagcaucuuugaaagagcggggaagguuuucaaaaugcagaggauuuggaaagucccaucacagaggggagcaggggcugcggggaggggaccccaggcuaccgucaagcaccaacuugaaguaacaaugaguuguggaacaagcaggcagaacacagugauugcccuggccugugcuauccccaaaauggccucugugccugcugucccuugcuguugagucuugggcugcugucagccuucugcagcugucugcugccacuuuguauuaguguggcuuuugccagugugugacauggugucagcagucugcucaggugaggacaugagcuacagcucugucccaggugcuugacagcucaugguggcuggaaggcaauguucuagggccuaaccuccacuguggucauaugcagacaaggguuucuaagaaccaugucuuuccuccucucauaaaguaauucauuguuuuuguuugcggagacagagucaaacuggccucagaauauaauuagguauauuguauccagacauuuuguguuaaaauaacaaugaccaagacacugaagaggugacugaguuuguggcuaaaguucuugcaaucuggguuugggaccccagauguaaacucccaaugagauggugacuugccuauaguuccacucauggaagguggagaugugggaucccuaaaagcaaggugguuagggagacugcuguauugaugcguucugggcuugaucuagagaccuugccucagugagagugauugaggaugagacuagacauuacuuugggcuuccacgugaacauucacuugcauuuugugugucuugagacagaaacugaagggcugaaaaaggacaucaggugaguugcuugggugugugcaguuguccaucugugucuaaggggauaggauggguucuagaacccucaccacagaugccaggauucguagaugcaagguuuuugguucuuucuuucuuucuuucuuucuuucuuucuuucuuucuuucuuucuuucuuucuuucuuucuuucuuucuuucuuucuuucuuucuuucuuuuuuccauaaggguauggugcuuguucacagcggugagcauccuuguauacaccagccaccucuaggugccucacaguuccaagaugauauaugugccaugucagugcauauaaggaauagggacaaugacaaagggcaaagacugcauaugcacagagcuccgucuugugaauguacaugggacccaugugugcagagguccacaugagucuggguugugggcauggagggaccaggagccccagggaugcugaaucaucuguaacuaucagaugcugugcuuugucuuucuggacucugagggaucccccugaaucaucuugguucuggaguguugggcaguuagagcagggugguacugggggcaacacgugcuuagauccacacuugguaccaggaagaggcagagauggugcuguuccagaagagugcccucgggggcucugcuuaaggaaacuccagccccggcaaccaggagaaccucagcucaccuucaucuggaggcugagagcugggaaguuaauaucagcuucccuccagggggcuggugacauuuuaguuucugcucugguggcuugugaaagaguaacgaaggcccuucuagggucugcccccuggagcuuuggacuuaaaaaccucugguuauauaguaacgggagcgcuaggaagggaguggcauccucccaagaagguucugcagccgagucugcuucacauuugggcucaugcucagcucucauucucucuguauuuacaggcauugcaugcuggguacugauugcagaggaaggcaguggcaaagggcuuaaggaagugcacgcugaacagaggugcucucgagcagggcgggugcuaccagguugauugacaccuuacuaccacacacacacacacacacacacacacacacacacacacacuguguucuaagcaguggaguacuagugagguacugggugggcuccuggguacuugcacaucugcgagggcaacugugcacgugcucaugugaucuuugaguacuggugugucugagcacgugcacacaucuagcagaugcuguuguagguguagugucaggccaacacccagggucuuccugcugccuugugguagcuccgggaaaugaaggccccaggcaguuccaguucaugucccugccccaggcuugcagagguguuuugucagcccugaagagaacccacaucgacagaaaugaaaaugaacucacauugcggugagaugaacucaggugauuuuccuaguuuguuuguuuguuugaaguagaacguguguguguguguguguguguguguguguguguguaucaugugcauguuugugugcaggcacacaugagugcauuugcauacauggaggccacaucauagccuugacuuauucuucagaugccuccuaguugauuuuuguaaagaucucccgcuggcccggaacaugcugauucagcugugagucccccaggagucucccggcuuuccagugcugggauuaaaagcacacaucacguuuccagcuuuuuacuggguucugggggcuuaggcucagguccacauguuugcaaggccuuaucaacugagccaucuccucagccccugagucaggaaaugguuuugaacuuccuguucucuuuagaugucuggcccauuggugcaugccccugacacagugccacgggcuggcgagucccacguuuauaugggugcacucuuaaaagucaggcucagaccgagagaucauugacucugcugagauucucagaucuuggguucuugcugucaugggccugguuagcuccucacucuucuuucuccugccccacuccaaccccagaaauucaggacaacucccaacucuccuuccauucaugguuuccccccaagucaucccguuuccuaaccucacuauugugucccuucccuucuucuagucucagacuuuggaauaaguaaccuuuaaguugguguucgaucaaggggcuccgggcugugugccaauccguaagucacauaccacggacaucaacauugacuguccucuguggauguacaaaugguuccagggcaguggaaagguaacccuugcccucccaugggaagagccgaccuguguccauaggaaauccaucccaaugucccuugacuuccuauagcuuuuuguuauggagaagaaauucacauaacauaauaggaugcuguacagggacauucugguacuguguucuuuggcuugggaaguauugcagccccccagaacuucccguccucaccaaaucaguuuaaugaguuguuaggagcuguuacuacgcacagccuucuggaguuuguccaguuauuagcuugucauucagaaaauccuuuggcuacagaacccuagugucuuaugauacaguuuccaccaacgugguacucuucuaaugguggauaaaacuuauuagagauuuauucuggcagucugcuauggugaugggcuauuuuauaugcuuggaucauucuugcuucugcuuaguuguaugaucaugucgcuauauaaugccuuugagggcucuaguauuuuuuugauuuguacaaguucaaguaaaaaacaaggcucugaguuuucagcuugguggcagagggcuugcuuagugugcuugagaggcugggcgucaucuucccccaacaaaacuauauauuuaaaaaauggggguuuaauaagaagacuuggucagaggauguaaaggccaguccacccuuuggccaugaggaucugguauccccaggguuacaccggugggagggugagaguccugaagaacauagauugcagagaagggcuagguguggcauaggaaugaacaugucccaggagugucccaagaguggcuugggaacuaugggaucuaagaauggagggaagccuuagguuuggugcccagggucuguuugaaugacagcuugcuuggggguaguaagccagaccuggagaccucugugcuuggccuugucuggguagauuggcaucaugaauccugguguugggaagggguuucuuugcaguggccuuucuggaacccaguauggguucuccaggagcucaggacuuaugugaagccaguguggucaccauuguuacccucaguccuucagaguggggguauaguguuaaaggcuugcuggccuggacuguccauucacccagaugggccugacacacuuugccaggucuuccuacugggggaaccccaucucugcuuccaguuguguccucugagcuggccaguaaccaagagaauccugcuagagagagagagagagagaaagagagagagagagagagagagagagagagagagagagagagaacgaacuuuaagucacaggaggcuugggauggagcacccauggguaccaggaccucuugggguuguuaguaacagggcucuuccauugauguccuugaguuucuaacagugcaucccuccuggaauuaccuucuuuuguaagaaacacaaagugcucuucagcagucauugaacuuuauacuggaugcuucucccuggaagaacagcuccucaggagcggcccgggaggccucugcagcauagaccugagauccauuaggaauguacuuuccugggcuccccucagcucuguagaacgaacacaggguucccacuggggccugaggaucugguuuuucauucacccguggcaguuccucucugugaaaaccacugccugaggcucuuggggucuccaggaaguagcgguggcuaaggaugcauaucuuagagcugguggcugaguggguagggcuucugggagaagggccucuuacagugucuaugggugugugcauuuagagcauaugugucuauaucuaggcauaaguacaugugugcauguauguauauauauauauauauauauguguguguguguguguauauauauauauacacacacacacacacacacacacacauacauacacacacacauauauaugugcauguacagguugauugcucccuuuuaguggacuguggcauguaucugcuggaggaugcaagguaaaaaugucacuagcagagaggugaccaaguugucuucugacucccagacugaagccguggugugagagccuguggcuguuucccugacugucuccugacacucauucacgcucuccagucaggcauuccugaagcuggagcuucagaaagucccagucuggccaucaauguccagcccuaauucucucuugggcugcucgacguccacacagggugacugccuucuuccuuacagcugccuagaauacugacauuuggauaaacugucacuugcucuggucaccugcugguccuggaggcuguuuuccugacuuuggugugaugcagagaauguccuuugacacaucuuuugugucugagugggaagcggucuuggucauuuucuguuguguuaacuggguaauuuacgaagaagagugcuuuauccggcuuacaguuugaaguuaggauauccagagguggggugcuagcauccauugggcaucuuuugauguuuggguaucauggcaagggcaucacacagugagacagaucgagcauucgaggcauggguuucuuccucuucuuuaaagcuacuaauguuaucauggaggccaaauccucaugaccucaucuaauuaccuugcaaaagccccaccuccaaauaccggcagugcaggaauacagagauucagugucacccucuuaauacuggaacaguagggcugccaaauuucaacacagggaucugggagguacucuuucaguagcaggauauauggcaggaacuucccgacuguguugggaggucucugggccauccccaucccuggcccuggugaucccuguccaccuagaagugguaaugacaccuuguuuauuccucauguaguuaaugacaccaaacugucaacaucucugauuugcccucuacaguuuuaugcucugguuaggggcugugcagguuccaggagaccuuaugaaagguggcccuggcauuuucugccugcuguuucugugucuuuuguguauugcauaguaaaaccuuuccugcuuugauuuuuuuucuuuuuuuuuaagcccacaaguucgaguagucuugguuucaucccucccuauccucugcuuaaaaugguugacugugugcuaacacuggccuuucuuaacgugugguucuaguucagggcaugcauuggaaaugugcuaaaaugucauucuuuuuuaaagcuuuuuuaaauguuuccuuguuugugcaucacaacaugcauguggaagucagaggacagcuugugagagucaguuuucucuucccauuugugggucccaggaaucaaacucagaaugucauggggggggggggcggguggggagggagggaggaagcaccuuuacucacugagucaucuccuugaccuaaaaugccauuuuguauuuaucuauuuacuugcuuauuuauuuaauguuuauggguacacugucacugucuuuagacacaccagaagagggcaucggaugccauuacagaugguugugagccaccauguggaugcugggaauugaccuuaggaccucuggaagaguagucagugcucuuaaccucugagccauuucuccagccucaaaauguuaucuuucacagccugccccacuccacacacgcugauucuccuaguuugcgcuggggacacucugcugcucugcuuccuggcuagcucugagaaaauaagucagggcggggcagacacugccagcaccuuccuguucuugguggcaguugcccugugugguucaccuggcagaugugcugaugugccgcacaugacagcagacugcucucuugggcaguacuguuccugagucucaugcgcauauguuagugugugcgugucugauucacuuggguucugcucauccccccuuuccaauucuuguuucagacccugguaacaccacaggaacacagccaaguccugaauaccgacaugucugacagugcugaucccuaggugaguaaccaaauccacugccaaggaagauuccuugggagguggccccaugagucagcaguccgucuggucuauagcuggccccguggugcgauuagagaaccuagaaaagccugucugggugagggaugggggcauugaagguuccgcguggauggagggagaauggcugccagcaagaugcuucuggguaaagcauauugagauggugaauugcucacuuuucuguugaauucccaacaacagcaacuuaaggaaggagggaaggguucauucuggcucaguuuaggacaaagccugcaggggcagguggacagcaggagcuugagaccucggaucuggccacaucugcagugcagaagccgagggaaacaauguugcacuucagcuggccuucucuuuauucagccgggaaccccaccccacaggauagaacaacccauacucagggcuggucuuucagccucaguugaaccucucuggaaacauccucacagacauacccaccagugcgugcuuccguaggacucuaaaucccaucuguugacaagggaaauuuaccaucaaaacaccugagucagcaccagcuuccgggcaagacaggagggagcugggguugaguccuggcaugaguuaucuacccuuauacugcuccaccuaaaaaaauccccugggauuucaggagcaugcacugcgucucugaagguagccugucucccucccgagagagcuuccuugcuucucuccagugcucccagcuacugugugaccauggaguauuuaagucuguggagaugacaugccagcccuucauggacacucacuacacuagugugacuggacuggugaacaggcuguuguauaugggcccuguugcaagggcaguagcuaugccaucccgucucaguagcucccggagaguauugguacucuuuuugacaugugugaggaggaaacuccauauggugaaggcagcauccccagccauuuucucaggagugucuccagcuuugucugugaccuccucccuaccaauucgagucuccugucacugcuugccccaucccaggucccccaagugccugccacuuccuggcugaccaaaucauggaugcggagcagccagucaaaccccacaucuuccuccacagcaggggccuagaggcucugacugaagguuuauaggaacacaccugcauucagugggcuuucuuaacguggcuuuugucucccgccauaucucaagugucugagucuugucuggaagccccauucguuggguuggccggcuguuagcacagcacuugggcuuguggcucggaggcuuguccaagcgucugcuuucacaucauggauauagucgagcccuuaucugcuguuccacugugugcauguuuguucccugaaaucaacaaggagaaagaacacagcacagugaagcauuugaaaacaggacagagggcuuacacuagcacagcuuaguccuaucgcuaacuguucucgaaaucucagugugucuaauuuuuagaaaggaauuugcccuggguuucugugugcuugaaaaagcauggagcacccuccacgcugucugucaccccacagaggucuuggagggcagcuccccggaggauaaggggggcugccauaguuugcauauaaaagacugccuagaaaggagauacuuaggaauauuaagcuguauuuuguaggguuugcaucgagguggaagcuaaaauaaauuuucaggaucuuucccagcgugaaguggcccaugcgagcagcuuugccuucaguggguccucagaguggggacaaagcaggcauuguccuuacuguugccccugggggccccgucucuaugacgccaugguagaaaucuagccaagaauccaagaguggccucugggagaagcugguguguccaggcagggaaggcugcagccagaagguucugggaggccuggcuaacaagcuuuggggggugcuugggugucccuaggaucccucaguauucuguuaggaauucugagcauacgacagggcagauaucaggauuagggacaggccuugcuugguggcagguuacaaaguaaaccccaccugcaguucuguccuuagagccaugcucuugccuguguaugugguaaggggacacacagaguauggagguaaagagguuugagucuuccugcacuuuugaagcugcccaagcuuuacaauucugucuuuucugugcuccggcuaguucccccacaguucuguagcuuucuuguguuuuguuuguuuuauuuuguuuuuaagacagggucucacuauguagcccugucgguccuagaacucacuguguagaccaggcuggccuugaacucacagacccgccugccucugccucuugagugcugggauuaaagaugugagccacuaugcuuggcuucaucuuuucuuguuuuguuuuuaagauguguuuaauuaugaguuuguaucuguauguguguaugcuacaugugcgcaagugcccaaggaggucagaagaagguauuggauccucuggaccuggauuuacagguggcugugggcagccugcugugggugcugggaacuggaguccaguucucuacaagagcaagaaguauuccuaaucucugagccagcugucuauaaccucagcgccagccauuaggccuuaccaagcccauuguguguaugcugcagcacugcccaggugugcccagcccuggaguaggcuuagcugaguguaccuguccccuaagugugcccaccccugaguguaccugguacucaagcgugcuacccucaagugugcucaacugccucaggacugacaaguuuuauauaggggggauaccuuauuuuuagucagugucuaaaauauaagcuuugagcugggcuacuguagauuuaauuaaaugacaguaaaacgggagauaaguacuuccauauguuucaugggagggucucucugguccuuugaggcucugaccuggaauaaugcccaggcccaaggaaugaugccucgagcaucagggauccaguacaugcagagccaaaagcuccgagacccauuaauauucagaacucucaccucuguaacaucagccagacacuaggaccacaggguagaucaccagcaggcauuguaggagaaguguccaagauggcggguccucuggugucucagaagugacagaagaugaugcaguuuagugcuguccagccucuucaagcacagaggggccagcccugacuuaggccuuggccacagcaaaguauccauuuauagugacuggaagccuccaugcccucagcacacuuggaggcagacauugauauuagcagccccauaugggacauagugcucuccugggcuuuguaccuauaccacucaguuucacaaaugaguacuaugccuggcccaggugcaggagugugucuguuuaaagccaacgccugcuuugaagauucagcacccagaaggcuuugcacaaugcuccguucugaaguguauugaguacauguuagaaggguguauugggcauauuuguguacuggauuaaaugagauagaucauaugaaguacuuacucugcuacccuggccauccaugccauccguggugugugucaucugcugugugugucgaguagcaugguucuggagugcuguggcugccugggguuggaguuugcgcccaucccucugggguggggcaaguggauaaguacuauuauuacuguuuguaaggacagcuccuaagcagcuuucuguagggaacugugaggaucaccauggagaccauuuuucucuugaggcaccagcccugcccugccucagugagaccucgauuaccacugaaggcucagcauugugcaggcuuacuuugucuuuguuuucuuuuuuguuuuuguuuuuguuuuuuuauuuuuuguuuguuuuguuuuuguuuuuuugagacaggguuucucuguauagcccuggcuguccuggaucucacuuuguagaccaggcuggccuagagcucagaaauccaccugccucugccucccaagugcugggauuaaaggcaugcgccaccacgcccggcuugucuuuguuuucuauugggguaaagauauaguuaguguacauaggcuggugagauggcucaaugguuaagaauaccagccgcucuuccugagguccuggguucaagucccagcaaccacaugguggcucacaacuaucuguaaugggauccaaugcucucucuggcaaguagguggcauguagguugcaaguaggcaugcaugcagacagagcaugccuacauuaaaaaaauauacaguguacuuguuuguagcuaaucuuccacaucaugguuguguccugaaugcagugguggcuugcuuggccugcaugucaguguucaugugagccuaugccuuugugggaggagagccaccuaccucauaaauaccuguccccuacccaauaccacgugacuugcuuugaguggccugaguggaggggccgaggccugugcagcugggacccagcacagcucuaggaaaagaccuuaggcacucccacaucuggccaggcuauuaauaucccacaaagggcuccuuucucccuguggacagccugcguguggugaugcugucaugcacgugagcggagccuaugaagcgagccuugcggugaguggcuuucuagaggcaccguugaguuccuagcuaccagccugggccucacagauuucugccagccagaaauggauguggaugcuggcucccagaggacagguggaacugugggcccgaagguggucugcuguacagaggcuggcccuucccagcuauuuucuauucacacaacuguagaagaguucucuguagcaagaggacuuaagcaagcagcaaacauuaaacugcugggggaagacagaccccaggugggaucgcuaaggucaagugggaagagacgguauaugggugcauggagagaucugacaucauauuuaaaaggacgggccguuaggacacaggcuaugugucuccucucuuguggucuuccuaugcagagcuggucccacaggaauacccccuagcugagcccuucugaguauccucugagcuggacauaaggguugggacuuggaugagaagcccaccccaaauaaacugugucugcugucuuccuccucccgauguugccucauguuuagaaguugcggccaucaugauccuagauggugcguguuuuccugaaccagggggacugcucguuugugcagauaaugcagaccccugagaacacuauagacugauaucuucucuuccucuggguggugcaggcaacauaugggaggcacaccagacuccgagacccacacucagccauugugugucuuugcucuuauggcuuucugcagauggauuguauaacucuccugacccuagugugugaauagcucuugugagugugagcagauuaaaggucuuuuaauggggagcucauuugggcuuaucugggaggaccugaaugcagcaacaggcacacuuuuaggagaaggagagagagacagagagagagacacacacacacauagagaaagagacagagagaccgggggggggugggggguggggggggggagggcggcguucggugagacauugcucugaaugacuggaagguauucugacuuguguguguguguguguguguguguguguuguccgcaccaggacaugguuuugccauacagucuuguggaggucuaacugaagacucagaguaggucagagccuuugccuugcaucuuaaugaaacagggucucauuuacuuguuuguuuccuuugugugugccacacucuaaccucugaucuucugaggcuccuccuauauccuccucccaucugauuggaggagaauugggguuacagauagauacuacuauauuuggcuuuauuuggguucuggggacucaaacccaggucuucuugcuggcguagugagcacuuuauccacugagccaucuccccagcccucgauggggcucugaugagaucuaaagacuaagacagaaggccuucccuuggugguccuuaguaggaagaaaugccugcagguuaucuggaaucuaagaggucuucaguugcagauuauagaucaaaggcuucuuagucucaggggccaggucaguucugcucuucaaagaaccuggggugccaagagccccauaagcuaggacccuuuguagccaccgcacccagggagagccuggauauaauuuuuuggggucuguggaggcagcaggguccuugacuuuggcccagugacauugacauaaggcuuccauccucuagagauaugggagucaguuccuguuguuuuaagccucugggcuuuaguaauuggugagaacagcuacagggaaacaggaagucaggauaaacagcgcugccacagauacccucagcugcagcagagcugucugucauucagaggccuugaccucaggguggggcacugcugggucacaggguguguggcucuuggcuuugguagaacuugcuggccuaguuuuggaaaggaucuugguaggggaucccgcucucaguucccucccucugcaguggcaagugucugcuggagaucgaugcuguggucacauugccugucccugagcccuggugagcaguuccagccuggcuguacucuuuacuaccacuucuguuggguugucugcuccucuugcucaucagcaggggcugaguguuccagaucuuucugcuuuaaaacacugauucccaauucuucauuuuuucuacguguggagguggggagcggggauacaugccccaaggcacauuuguggagcucagaggacagcuuaagagaguccguucucuccuauauguggacucauucuggagacggaacucgcucugccgccuugccuggcuaagccucuagcugcuucccaacucugucuuuugcuggcugcuuuuaauagagucucauuugucagccagaugaaacguguacguacgugcuugggucuuuuucuuugcucuuaagcuuugugguggcgguguuaagacacaguggcugugcuggaguuuuauucugugagucugaauugccuugcauggguuaagggaaggcuuugggggugaguuagagcacauauguggggguggggguaacaaccaaaaauuauuaacagagcuugguagacaccuuuacccacaaaaccaucucuggcccuaaaagguguuuuagaaggaggauggaguccagucuuggguccuugcaguguguuggcaccaggcgacaaccauucauguuugguuuugauccaugacuugaacgucagcucagcggccucucacguguucuucauaagaggacauuccacugcuccccgguggccugguggccuuuucccauccugagucacuuuggugacaguuguguggagugugcugacagcaaugaaggaguccccgcucugugcccucccugcacagugaggagaggagaucccucuaaugugugugggaugacacauguucccucuguagaggauacacaguagcugugcugaaggggcucugcgaggaagaccaggaagagagggagagcacacagagaaaguaacucuguguuaccaguggauucuagaagcccauaaaacuaaaacugagggacuggagagauggcucagcgguuaagagcacuaacugcucuuccagagguccugaguuuaaaucccagcaaccacaugguggcucacaaccaucuguaaugagaucugaugcccucuucuggugugucugaagcucaguuagaggaaugcuuaccuagcauguuggaagaagcccugggcuugaucuccagcacugcauaacacuaggcaugaugggacacaccuguaaucucuggaggcucgggaguucagagucaguucuuagcuacacgcugguuugaggccgggcugggcucagugagauccuguuucaaaaacaaacagaaacaacaaaaagcccaacuaugaaauuagugaagucagagugugagccugcgggcaccacaguuguucugugcccauguccauguguuaggaugugugucgccaugucccagguuugugugccugaccuugaauuuccggccugggucuuccugaguauugccccuagauggugccugcugcucuggugugcugucccccauggcuucugaaaacucucuguguggcugagcuugcuaggccccgccacugcugggagcaggaugaggucaggccuguguuucccaguaugugacccggccacacccaagcuguggguggagguauggaguguugcaggugccugaccccacacaggauuaacacccugccuuccccccacccccaucugcaaguuaggugugggaugaggucggccacagugccacugggccgggucuaucuaaccauuugcugguccccggcacgccgguccuucucaggcagcagcugcuggcccggcugcuucaugguggcagugauauugcuagacccuggcucucccugguugcagggaugaacaccaucuucccgacgcccagcauucugcaggaacagcagcuguggcauugcuuugaggucagugagaaagauggaugacacacgucuaaggagcagguagacugagggucagggcuuaggggaagauggauguaggaaugagcccuggauuugggggguggggggaggcagaugaacagagugucuggaugugccagcaagacucuaagcgucuagugggugucagggcauuuccuucagcuccuccacagccugggacacagacucccaucucuuuccagggcuucucauuuugugggguuugcccuggggcaggagguggggguucacgcuccagcuguuaccuggcaagucugaccaggaagugguggggaguuucccagcaggcugcaggugggccuucuagacugugagucuuggucugggguaagcagcuuccuggggguaggggaagugacugggcaggugaugugugggccugccugccugccugccugccugccugccugcucuucugauucugggucuuggguuuuugugggcuuaggccuuuuccugcaugcuggggucuauugaacggcugucucuucaagcuuccccugagcagcagguggggaguuggccuccgcuauacucuuuauuucuuuaaugacuuucugauccccuccugcugagcaucugagcucugugaugcuguugcugucuccucuugguuuccacauucuuuuugugcuccugugauauaagggaccagcuccacaccaugccugcagaggugcuugaguugagucaggcaggaaaaccaucaaggcgaggcuaaggugcugcaccccuucccuugcuaggccuucaugguuguccaagccccuccuauugcucuaccuacuggccuugccacaggcaguuggacaacagagucucuugggucugagaguguggccugagcccuggaaagagaggacacuggguauuaggguugggaggggacacacuuacagccucccucacagacuugcuggguguugauccacacaccaugcugugugggaugcuggugugcuaaagacauaauggcacucagagaagcuuuuugaaguggcugggggugggggggcugagaggggcuaucaguccuguuuuaggcgucccugugccgcugcugugacuggucucaugaucacugcagagaagacgggacacacggcccuuccuccagucgccugccugucugucaucgacagugaccgcucccuguccuuuucaucugagacugacauuuaauagaucagaagcaaagcgauccagcugcuguugggagcaggaaugaggggcaggcagcugagcagcccagccccaguccuaaaagaagccaguauuguccagugcucugcuggugcaggcugggaguggggguuggagcccugaggaggagcugccaggcagggggauggguccucugcccucucuuuccuguucuugggaacauccaacaugucacuuggauaugaccugccauacaccucagccuaggccuggcuuuuacagucauccgucaugucuagaggucaggcccugcagagccgucaccaaucaccaguguugucugcugugcagaauugcagcgggcccgcuggcaugaaggagaacacucccuacugaguccugcauguguggcgggagaggggccuguccgccgauacgcugaugggguuuagggcauuucuuucagcaugguggcauguggggugguuggaccagugccuuacaggcguugacugggagcugaggaagcaguuugccgugggagguggcugcuguucuuagaaggcuguacuguugugaguggcgaaagcaggcugcugaucggggagacaacuuuuggaagcuugcacacagcaagcaaaucuccacacugcuuugucacugggggaaaacaguaucagaauagagaacucccagagucauugugggcuggcugaccccuguuggcucaggucuucaacucaggauugacccaagccagcucaaccuccagcauccaaauaggacugacuaucucuuguuucacccaggcacacaucuuaccccccaccccaggcguguuuccgugucucacccccugcuugauuccacauggguaacucugguccccugcuggcauuuggugaacugcccaagcgcagcagguacccauaugugcaggugggugugagcagguucugcacaugauacuggggagcuggcauggaaaacuccuuuuuuucagaucauuuccccacccccacccccacaccccacaccccacaucucccacuccauccccgacagccugguggcuuuacaaggagaaggccagacugagagaguugaggugaagagaaacaaacagaugugaguauuuaugcauauaagcgggugugcgugcaugcccugucauguauguagaggccagaguauauauagccuuaugucgggucucaaccuuucacgggagacagaucaggcagccaacugugcugcuguaagguacagagcugagauuauaaucucaaggugauguuccgucguuuaucuuuuuauuacguguguguguguguguguguguguguguguguguguguguguauguguguguguuugguguguguguuuguucauauggaagcuaaaggcuaguuuuggccagugaauuccugagauccaccugucuccaucuccugaccgcuggggcuauaugcauaugucaccuguuugacucguuuacgugagugcuggggaccccaacuugggucuucuugcuugugcagcaaagucuucuacaaaaugagcuaucuccugagucccgauauuuuaggcauuguuaugcauacacugaagaagaauggagagagagauauguggagagacuugugcagagcaaggcacaggggauaauagagggagguuuccugucagccgucugggggccucguguucuccucagaaauucugagcaguugauggauugacagucccaagcccucauguguuggagccuguguaugggcagucucuggcgaguagcugugggucugagagcuagaagauuuuugcuccugacucugguggccagaggugugugguugaaggugcucaaguuguaagugcauuccucuaggcuuuagcugccagugcuggcacugggcagauaguauaacccuccgcucuuagcaaugguguguggcagcagcagucauugcaagccagcguccuaacucugaaugaaaccuagggugucucuaggucuugguagcucuugcaagucuguggccaaggcucuccgcugggugugguggcccacacauuaucccaccauacacucaagaguuagaggcaggugaucucugugaguuugcggccagccugaucuacauagaguuccaugucaggcagaacuaagcaguaagacccugucucaaaccagcuuucagagcuuuaccguccuugucuucuuugucacuggccacuaacccugcagccagagagagagagacagagacacagagagagacagacagaaugacugacuggcucuuagagucucagucugguguguguauucaugcauacaagcggguauacgugcaugccaugucauguauguagaggcagggguacagccuugugucgggucucaccuuucacuuuguuugagacaggguuucuguuguuuguuucugcguaccggaggcuaacuggucagugacuuuacuagggauuaaccugucucugccucccauuucacuguaggaguucugggauuacauucuguagguucugaggcuaugaaugcaagcccucauauuuugcacaccgagucgccaucucccaaccccuuccgccgccaucuugguguuccggcugcugcugguggcuucgccaccgacacagcuguugcugcuccguuguguucucccuuggugccccuggcucagcccccucugucuaugaugagaaucugaaguaggcuaaggucacugaaggaggcuuucauuagggcuaaaguuacaacaccagaguaaggggucuccugacuaacuugagaagugagccagucagccuggucacauggcuaggaggugugugccaauuuugacacaaccccucauacacaugaaagauuguguuugcuccagugauaggccuucugggcaggugugcucucucucguccaagugaaacuaucugcuugauaagcuggguauuguucgggcuugugaugcucuggagggcuacauucccaggcuggugcaggcucuaucuggaaugguugugacugaaacaugcuguuuccaguccugguuacaguggucuucugcagcugcuggagugucuucagggugacuuagaaguguucagaauagccuggcugucugucaugagggcaaccuagcuguuucuugggccuguggugugguucccuguucaucgccugucaaaggccuacuccuagcaguuuuaaucaauuccagacugaauccgaaggauguuuacaguaaaggcucggggagagcccaacccagaucucaaaauuuuaguagcauuuaacggugcuuaauauaguguacccaguuaugcagaguggagccuaacuuuuccucuccaguucaucggggagagagcuggguccccugaucuggaauggggagagaggcggguccccugaucugggaugcggagagaggcagguccccugaucuggaaugagaaaccaacauaaccacaggcuuguccuuggugggugugccagcuagcuaguggcaacaucugugucucugaugagggugacuuaaggagccacacaccgauguaagauguauuaugugacaugcuuuuggacuaaacaggaugaguuaaugcuugugaguggcgccaaaauggggggcagggggggucacgcggugagccugguugugggccagccgguuuucauuuggcuacagcucguacaguagauucuucgcuagucuuuuuuuuuuuuuuuuucuuuuuagguuuuguuuuguucuaagaaaaacacacacaauuuugaaaauagacacccacucuugcuuuuuaagguaaacagauugcugcaugguauccuggggucugccgagcuagauagucugaguucugcauauucgggcacuugggugggacuuacagguguugggagacaugggacucugugcuaguaaggaaaagccuucaagguuuuuuuguuuuguuuuguuuauguuaagccacuaaucucagaagaaauacucugugggugaguuguucucugaacauuacugcugaggucuggcccaggguccuaucgggccauguaaaggaaaccugucuguuucuauggaggguuuccucggccccacacuccaauggcuagggguccgggaaguuuuaaggcuuugggugacugauaaaacuguguccccugggacaagaagguggcccuuggcugugccugguggacaguggccugcauagcauggguccugggcaggguggucuccucuccucaggucuaauccccggccucuaaggcagccuuucuccuugaguagcucgccccacaucccugaaucagccuauauaggaaaacaaucaggcccacauuguagaacagcccugcuauuuacaggacagagaauggggacaggcuugucccacgaccugcagaaaaggcucaccacagagccuugucucccuguugaagggugccuuguuguagcaagaguggacccagcccccugcagcacguccccccucaccccaucccagacuguacccccaacucaugacagagacccuauggucaagacagacaucucagccgggcagaggccccacuugaagguagaguggcuggaccagaaaaguccugagggccgaggugcaagcuagcagccaggaagacagagcagggcugggaguccagcugcagaaagguaugccgggcuaagguuggggccagguguucucgcuugccuuugcagauggcucagggcuaagugggauauucugaaagugcgccuuccaggagugcagguggcuggaucccaggaauggagaaaaagguacuuagguggaggggggagggucggucugagcauguggcuguccuauaccuugaaggcaguaggcauggcccagcuacagagccaaucccuaacuccccgguugguccguacuacccggccugggguuaacucuggguccuucccguagguggcugguugguauguauccacacgcugaugcuggccgggucacacucuucuuugugguuugaacucauuuaucucagguuucugucucacagacacucuguggggagggagugguggccuagagcagcuggcuugcugccuguggguguggcccuggcagggacuugccuggccccacagcccagggaaggaaggcccugguuuaugcuucagcagauccacagauacguguaggauagcacagcugggguggccucaugucgcuagggucugucaauccgaggacuuugacggcccaugaguguguggaagccagaggccugcgaaggauguuguucuaugauggggacagagaggggccuuaauuacaagccaggaccaaauugaccaugucugcccuggagcucccagaaucagaagcccuggaaucagagcccagagacuucccaagaauggggguuucucggaggugggggaugggauggguggugacacuuccaaagucaaagauuugugguccgacugcauuuuccugcgacuucucauguucuccagggucccgagauucauacucagcccacaguugcucacacuccuagaccugccccccuuuucucuacuugacucuaguggggcucccaccucccaccaugcuauggcagguuuacugagagggguccuaaagcagccccguugaacacagcagacucaggcagggguaguauggacguccccuuauuaaaauaccaacccauggcuucccagcaggaacaggcuucaccggaaagagcagcaaaccaguuauucccaccauggguaucuucccgaaggcuggcagcugcccucaaagcaggagcgcaggcuuaccuuaacugccccugucagucuguugucccucacugggccacagggagucuguggaugaauggauggacauugggagccguaauccauagccucguuaacccugaauuucagaagaagucagaagagacauuggcaaaggaaaaaggaucgauuuacaguuuagccugacuagagaaagaaagaagcaguguguagcuuauaaugucuaaaaaccaggggcuaaagcccaggucugcagacugagccgugagagagcuuaagggacuuuccuacagcggggucagcucgguucaaccaagcaaaccaccaaccaucucugucccagccagugggacugaucacaaguuaggcuguuaacagacaccuuuauuuacuuacuugucuuuuuaaugaguuuauauauauuuuuuuuuuuuuaauuuaauuuaauuuuuuuuauuuuuauuuuugguuuuucgagacaggguuucucuguauagcccuggcuguccuggaacucacuuuguagaccaggcuggccucgaacucagaaauccgccugccucugccucccgagggcugggauuaaaggcguucagcaccacugcccggcuuuuaaugaguuuaugaaguaacacauuuccuuacggcauuguauccuugguuuugcuugguaucucagcauaccuuguucucugccuccugauguaccccagccccccacuacucccccaucugcuuccaaaccaccuguguuccauuccccgccccucccuucucccuugaagucuuuuuuuuccccaucauggauucucuucuucuuccuggcuucuccccauacuuauucccaguuaaauauaugcauuuaacaaucagacacuaggcugagcuguucgagaaauacagagagaguuuguuuuguuguuguuguuguuguuuucaauuuggccgaggaaaacaggguuggcauucugucucaaugauucccauuuaugaaagaaaggagucuccauaaguuuuaugggauggcaaguggaaaaucccuaccugucccgggcccugcagacuuccuuccuguguccacuccuuugauggaugucggacgcagguuuuucaacuucaagucggcuccugcaggacugucaaacauacuaauuuugaaaaugaagaaaaagguggggaauaagcgucuccugugucaccggaacuccagccccuuuucucaguuuuggauuuuagugacagaugugcuauuucuggggaucugcaggggacugaauaaaugucccuccagacauccauaucagagccugugacuguuaggugacauggugaggggccuagcagaagcugucaugaucugaugucccugcuaauucagaugacccagaauguaaucaucagagucauggcaggagguggagcuccuugcugcuggggaagcggguggggaagagcccuccacuuuccaggcccuggucucuggggccugugaaguaaacagauaagagacggaucaagaggagacaagcuggcugacuuuaacaucuuccuucguguguauuuggcacccgacagaagagaagucagacccagaagaugcagaucgggggcuucaaauccauuuaaauaaguggugauaaaucacugggaagagaugagacaaaagagggcaggggugggggugugacuucuguaacagugaccuagaaaugugggaugggaggguaaguuccuugaagccucaucugcucuuccuggugugggauagacaguaccuggacuaaugaaaauugaugucagagccugaggaccuugcagcuccaacaagccagggacagccaccuguccucagugagccaauuaaaaaguaaacaguggugaaaagcagaaaagggagguuuauucaaugggcucacccugggaagacaagaaaucaggcccacccauacacaccagggccuccagugguucacccccaccacagacacaccaggaucauccucagggcuccgaggguccacaugcuaagcuguccaggucacguggucaggcaguauuucagcucuagucucuucggcggcaaggucuucugacaaguuauggagcugucuugagaucuuuucccugggagagaguuccucuggcuugucuuucucucagucugagauuacugggggagauuccauuuuccuggguccauuguuucaauagccugauagccagaggcaccgggugucuuuacaauaucuucauuccugccaggacuuugcaaaguccuuaccugccuucagaucucagcaguccuggugacagagcccuccuuggccugggacacugggcucccucccacuugcuggugguggcaguggagggagcucgguggugagggaagccuacugaguggagaagcccaauccaggagcuuggaucagcagccaugagcuuucagccagcuguucuguaauguaucuauauuguuucauaccauuuggaguccguuucaacaacguccuagggagacauccgugcucccuaaaaugauguagucuucagggguggggggauugggggccauugagagacaggcaaggucugugauggcccugccgggcagggaugcaggaacucugucucugccaguguuggugaaggaacagcaagguaagggaguauggugggcguuaccaggccuugguauucccaaagggaaguuccugugagggaugggcacagauagauguggcuaggcuagaaggcagaucagagucucagcugcucaaagagcuaaggaagaaucauuugagccuaguaguucagggcugucuugggcaacagagcaagacuucuccccaucccccacccccaagacaagacaaaaugaaccaaaaggauaggcuauauuggucagccacaaaaugggccggucuuuguucugcacuaccacagcccuggggaccugucuggggugugugcucuuggugugagucuacuaugaguuuagaacuaggcaagcagccacaggcucugggcuggcagaacauagaggucagcaggaacagagcuuaaaacuaaccauuuuccuggugcuucuguugggcgcguccaggaaguggaaccagccagcuaggagagguucuguaaagcuuacuggccugguuguguucucuggguggcagcgguuucagguacagggcucuuaaggugccaaggaccugggggacaggcaggaaggugauuccugguacucuucucagagugucaucggggcacaugcucacaggcuggucuggcaagcauggauccuguagacuagucccaagcccaaagugauucuguugcugaccacucuucacccaggccucucccucugugacuucccugccucuccuggccaccucugugucaguuuucugccuacccacuguuucuggaagccucuuccuagugcuugaaggcuucuguccuaguuacugaggggcuuagagaccauggccggaagcaccgcugacaguuuacauuguauccaaacgucugcuucagacaaagcaagacagccuggagugcugaagguuuuugaaaccucaaagcccaccccagcaacacaccugcuccaacaaggggcaagcauucaaauaaugagccuguggaagccauuuucauucagaucaccacacuugggcuaccacucagggcuuggagcaucaucucagcuuaaauguuugcaggcauuugagcauuguggucggggugauacgugagguuucagguccacuuguguccuggcgcccuggccagugaauccuuuccucuguggauagucuuagguaguguguaaucccuucuuuuuucuuuuugugaggcagggacaccuuguagccuaggcuguccauaacucuugcuccuccugucuccagcgcugcaauuccaggugaacaccgccauguaugguuuauacagugcuggcugggguugaauucaggacuucauguacacuaagcaagcccccugccaacagagcuaccucuccaagaccccauuuuucuuuugguugagauagggucuuguuguguugccuugacuggaccuagaacucacggcucaagugguccugccgccucagacccugaacagccaggacugaagugaauugaagauccauugaccugaacgucucugaaagugagagacuuggugguuuuguguguccauuugacacaagcuagaguuaucacagagaaaggagccucucuugaggaaaugccuccaugagauccagcuguaaggcauuuucucaguuagugaucaagggugggagggcccauuguggguggugccauccuuggguucuauaagaaagcaagcugagcaagccaguaagcagcaccccuccauggcuuuugcacccacuccugccuccaagcuccugcccugugugaguuccuguccugacuuccauuggugaugaaccgcaauguggaaguguaagcugaauaaacccuucccuccccaacuugcuucguggucaugauguuuugugcaggaauagaaacccugacuaagaccgaggcugaccuaagucagagcagugguggcggaugaaggcaggugaccaggcaggcagucggcaguggcugucagugcuggagugaugcuugugggcuucaguccuugccuccuugagaggucacucccugggguuggggugcagaucuccugggccucugugucagcacaaaagggcaacucugcuccccaggugcacaugggucggucggacugagccacucugcccggcucugacugccacaggcuggcugugugccacucugaucucucugugugucuuucacuuuuccuuucuagagauagauuucugggugagcagaugcugcugagagauguaauucccucgagccccaaagacaaccucuucccgucuuaaacugguucagcauggggggugggggcguuccccagucauuguagacaaaacaaaauguccuccuaagaauugaccuuuuuggguuuuuuuuuaaaagacuuacuuuucuguacaugugugcacaugccugcaugugugugugcgcgcgccuguguuuauuggaacuggguccccuguaagaucagcaggcgcuuuuagccacugagcccucuuuuccaguuggagaguugguuuuuaaguugcuuccccuucagucaugucuagacuguugacaucuugugcauuguugucauacauagaacuugcacccaagaaccacaggaccuagugagcuagguaaagucucauugaguucuaagugagcuuagagguuuuuuguuuguuuugaaacagggucucacuggagagccuuagcuggccuagaacucacuuuguagaccaaccuggccucaaacucauagagauuugccugucucugccucccaaguacuagggagcuuauggauuuuuauugggccacauuuauugcuaccugggacccauguggaucagcaggugaauuaagccacucgaaguaguccauuucaauaacuuuacuacaacccggugguggccagguaauccaggcucagguugcugcugcuacacuuggucuaacugugccucuggguguggagggagauaaugaacuucggagcagaggcgugaagauggaggccagaacggaacagcacagcugugaagauaucaggcaggggccuaaggugcuaagugcuugugagggcacagaucuuaaaugaggcugaaucucuacgggugucaggaaugcccuucggggauacugagucaggaugcaucagaagagaaggugccaaggugagaaguagccguggcuacuugauacuaaggucuauugaccccggggggggggggggugcaaaucggaugaugcuuaaauucucuuuaaauuccuaacuuccagaacugaacucaggucauuccacucaugugcaaguaaccacacccagaucagccuaggggcgucccgugugagacccacuuacagcucaaaagcaggagcugcugccuaccccuucaggugugggucuguauggagcugcccggcccagccuccaggcuucacccucaggggugugauuauggcagaguagcucugcauuuaagcgcucuccuauuguuuugcauuuaauacuguauuguguuugucuguacuugcugagaacugcuggcaugcauggcuuaaugcugccuguguugcacaccuggcuccuguuauuugcuuaacccuuccugaugggcgagcuuaugcuaggagaucauuuuugcuuugaagccaccuuagagauaaauaucuccaagcuggcaucuccuugaacuugagggauugcauggcauuaacugucaggccccagaucccugcucuucucuggaagcugcauccagaggguacacaggcaccuuugcuucuugguggagguaagaugaaguuggguacggcuaauggauggacuggguagggcugggcaggacuugccggcuggggcaauguugcuacaaaacuuccccuccuuacgaaauucugugaugcacucacucccugugcugaaauccccuucccaugacugaacuguucccugcgccugugucacuugaguuuccccugugucaugucacucccuggccccuccccaaaggcuguccaaauuaugucuuucccaccuguuuuugguggagaucaguuuuaguuggccuugggacagggaagcccaccaugaucaaccuacuuauggagaacucagcgucuguguggaacccgcauacccccacccacccaggcuucaucuucuuggguugcuaaugugaugcagcauauaccgggccaguaguggaaggcguaaggacacgugugugcacaugcagcccagacucagcaguuucuucgugugucuuugugugaguucauguucacauguaggugggcacacuuaagugugcaaguuuagugugcaaguauggaagcccgagaggcccauaugagggucugcucuugcaacaucacacguaggcuuucacgugggcucuauggauugaauguaaguccucagguuuggauggcaagcacuuaacccgcugagcuaccucugcgagcccugacuuucucugccuuuaaacacacguaugccuaacaaacaguccugacaccaugggagccccuguaguuccaagaauggagccucuucaucuugcacagcugcccccggucugcauuguuuggggccuuaagccuguuacuugcacucucuucugccuguggauagggggagaagacagaaugggacugguggauacaugugaggugucgucuuucauuaggacaccucaccacagucgucaguguggaaggaccuggagugucccaggccucuggagugucccaggccaccugggugcugagcucacuugaggacaaauuguugucuugaggcagagauuauuugcacccuggauuaucauggugaaagaauguucuagaaucuuggcuuuuccaggugaugcagauuccugggaauucuaagguucacugcucuaggcuuggcaggaggcagaucugaauguccagucagcauucuuucccuguacuuggggaugaguccaucuccuuccuguggccccaagagacgcagcaguggccauaucccucugcaggugcauuacugugucuggugacagugacucaccagcucucccuuguucccugugacugacccaccaugcuucacuaucugaaucaucuaggaauugacacagcacagaacaggaggccucucaccuacucuggcaugccuggcugcuugcaggaccauccuguaugaggcucaccagacucaucagguacucagggccagggucuuuaagucaacccagagcuguaggaccuggguuucccaauccauggagaucuaggcugucaggagcagaauggcucucguuagcuggucagugaggcuccaguugcuccuucccugcuuguaaugcacagagcaaucugauuucugggauuccuuuggucuaaugauaguggguucucccuggguccauuucuauuggaagauggguucuugggucccgcccacugccucagggacacggugaaugcuguucugauaggagccaucuuuaugucuuuauggaucauuuccugccuccagugacuucagguauguguaacagaauucgagggccgcuccaggucauggacucauccaaagugguuuccggaugcuugugucacgcuagagagugguucucaaccugugggucagauacacuguauaacagauaguuacaguuaugaaguagcaaugaaaucauuuuaugauugcaggggggugucaccacaacaugaggaacuguauuaaagagucacagcauuaggaagguugagaaccauggcccuaaaggaagucaggaaaaaaaagcucccgugaguugagagaccggguaaagugaguuuggggauaguuuauaauuuauggauaacagcaaacaagucucuggaguguucuuguguguguacuaccaggcacaugcauguacaagccugugugccacaacacuugugucaaaggacuugaugacaggcacucauucuugcugagucaucuugauagccuguuacaucuugcccgagggccauuuugguauuuggagacuggaaguucauagagauucuggcuggaaaaaacaaaccaaccaacccauggcaacaguugaaccauaacugucuugggucaaaugaaaccccgacacccucacagccaugugugagguagccguuucaucucauggcucgcccucagguguucagccuacccauccacagugacuacaugcugagcggcgguuaaaagcauuggcugcuuugguuccacugugguuaagaagcagagacagggcagugguggcgcacgccuuuaaucccagcagucaggaagcagaggcagguggaucucucuggaguucgaggccagccugaucuacagagugaguucuggguuagccagggcuccacagggaaacccugucuugaaaaaacaaauuaaaaacaaaacaaaagaagcagggauacguuuuauccugaggcugaggcagggagagcuuagguuuaggauucagaggccaggccuggugacacaguaaaaccuagcugaaaaagaaaaagagagagaagagagagagagagagagagagagagagagaguuaacagauccuuaagaugcagugaaguugcuuagguaugguuugggagguuucuggaggaaggcagggaucuguugauagucagggugacccacacagugugacaauugacaguuggcaguuagacaaacuggaaacccugaugagacaaacuaggggagcuugcuuacugggccgugcauacagagaacaggcagccccucccguggguguaccacauccucagaaaggagugaggagauaaccgcccacugaccugggcccugucugccgaaucaugauuaugacccuugugagcuggcccugccuuguaauuuugcuguacauuucugaggaguugcuauagaugaaaggaauccgcuagggcagcauuuuguggucuggggacuuagaaaacaaauccugguuggccgcggcccugcccucucuggcuuugugcgcucauccaucgccuaugcaugaacuggguuugagagcugcagggcagaaggacccccagcccacaggcagagcugcugccuugcucuucuggucccuucccugugguggccuucugcugcauuccgccaguccaagugucuuccggugcucuguccaacccgugcuugccacggagagugauagauguucuggaauuuaauacgugccauccaggccuguggucauugcaagauuuagugguucaaaaucuuuguugcauauagggaagagcugcugagccaggggugggguggggggucucauguagccuacguuggccuugacguugcuguggagcugaugauaaccuugaacucugcucugcuuccuuuagacuccacagcuacaguuaugagccugcagccaucaccaaaaccgguuuuaaacaguguggguuucuuaucuuagacuucucgaaugcuagucagccauuccagccccugagcugcacacagccugagccccgacuggacccuuaaaaugcuccaggcucgcuuaaagccaagugcucugcucuuuuagcccguggcugagccaucucagggaagccuuugugacaggcuacguuuuaccaguagcaagauugccaguuaacacucaccagcuagcucuuccuuggacgccaugccugggauuaaguucuucacacagaucagccucagaaucucagaggugaggcagugguaacuucucagcuucccuuuucugaaggaagaaaauggcucagagaggcccagcaacuuccuuaagaccacccagcuuggaggcgccagucuuugagccgauaguuuuugaccauaggacccuuugauccaguuauugcugggaauauacccucucacccccacccucacucccaccccccacccccacccccacccccgagcugcuguccuagaaguaagaggcagggaggcuucuggcuucugaaauuggaaagcuugcucucuucuuaugagugucuuccuuccuucugcaagccacaggagcugcuuuguuaaggaggaggcuaagguggcaucuuaaacccacacaggaggguuccauggguagggugacuggggugggagacuaauuauaacuugugugguuuuuguguugaggaagcaggaaaaaaaaaaaaaaaacggucugagugaggggaagcuacaagcugaagacucagggucugggaggcugcugcagccagaagcugguugugacuugaauuuggagcuggcuagggccagagacuagacaaggacacuggagccuuggugggcaggaaguggguacagacagugaguccaagugucagagccagucggugucacagggacacagaaacccggaccacacugucagcccuggcugguccuucauucaggaagugacaagcguguggaagggaaucguuccauaucauaauucuaggccuucacuguguucucugagccuuuccgggccgugucaguuccuucccuuaucccccuaagcuguuuccuauccuaaccccaggagagaugcuaccccugggacaggagagacccuuugagugagucaccuuauaucauuugcagacugccauuggagauggcgugugauccagcgcgcuaggggagacgugagccugggcucaguuggcccugcuccagaagcuucccccuccaacacuuagccuccagcuguccacagccaagguuaucccucugccccaggcagcguggggucacugggcucagggagucuguuuggaggccucugucccagaugcugauggguacauacagaugccuggcccuacuccacaguggguacuuguuucuguuuagcuuuaaaacgacugcaaucuggacugugguggcgcacaccuuuaaucccagcacuugggaggcaggggcaggcagauuucagaguucgaggccagccuggucuacagagugaguuccaggacagccagggcuauacagagaaacccugucucaaaaaacaaacaaaaauugaucgcaagagauaagagaggggcugagguagaccuuagaggaggacugcugauccggugugaaccagccuccacguucugucucagaacuaacuaccuaaaaucaaccaagacucgggaugagcacccauuuaauucuuaugacuauguugucuguggguuucccuugguuuccuugggaagaugaagggggcacagaucugaaauuaggacugaugaacuggcuuggccagcaaaaggagcuugcugcccaucucaaugaccugaauuggauccccgggucccacaagguaggagagaaccugcuccuacaaguugcccuuggacuuccacaugugcuguaaugugaaugugcccacacauggacauaugcaauaaauaaagucuuauuuacuuuuuuaaacaucugaaaagaauaauacgacuugguuagacugguuucguuuuuguggcugguucucauguaguccaggcuggucuugaauccacucugcagccacagaugaucuugaauucuggauggagggcugggauuacaggcucacaccaccgugcccaguuuaugcggugcugaggauaggucccagggccuuuugcaugccaggcaagcuuucuaacugagccuagugauaaguuuucuaauguauggacucugcucucugcgauggggcaguaugcuuagacauggcugugguggcugaguguggcgacacacaccugaaaucuccagcacugggaagacugaggcaggaggauaucgaguuugaagcucguacggacuacuuagccugaccaaaauugcuuuuauuugucugucuguuuguuuguuuauauuuuaaugugaauugguguuuugccuguauauaugucuaugugagguugucagaucuugagcuauagacaguggugagccacccuguggguacuaggaauugaacucaggucuucuggaaaaacagccaguaguaguagccagugcucuaaaccucuccaagccaccucucuggccugauuuuuuuuuuuuuuuaaaggagaaggaaagaaaagagaagugguuauuuguggugucuguggugaggugagcaagcaagcgcaccagcugacccaggcuuccccuuugcuggcugcccagcaccucacuucuggugcagugaacaagccccgcaggaacuggauagagaggucaucugcuuggggcccuaaggaguuuguauuuagugccugucugaaacccaagcgccccgugaggguggaggacccaggggcuugacucuuagucucucauuacuuucagagaugucuuccugaagcuuccauucuaaaggugccaggaacaaccccagagacucacggcacagguaaaucauuccguguaugauuucuauguccaggucgguaagcgauaccuuguagaagccuccauugggucugguggacugucagguaucuuguuccuauaucuucauuggagccaagacugcugucccucagggcggcaccaggcuuugaugcuagacagugagguuccuagauggucuucccuucccugucuccauguccuccuccaacucccaucccucccaagugauggcugcuaaugguaugaugguucugugugcaccucacgugugcuugcucuacucuuuagggguauagcauagcauguguccaucaugucccuguguguauguguguguguguguguaccuguguguucauggcucuacaucugugugauaaguugucuauaugccuguguguccuacaucaccgugcuuaacugugugugauuguguguccugugccacuugugucccuguggguguguaucuguaugaugaccagcacuuccucucaugaacuugguguggaccaugccagccguacuacaccuuccugcagugaggcauagcacuugagagauggcucucuacacgggauuugggaugcauuuuaguuggacaaagcuaagagaaggaaccagaauaaguauaaaacuccucuucccucugcuucuucucacagccugccaaggcugugguaaaggaguagggcccuauugggaaugugcgagccaguuauacacauucaguuuccauggcuaucuggguguaauuugggcaggggccuuguaugugugaguccagucaugugcaugcaauggcuuaccuguggagauuagagcauaacuuucagaguugguucucucucuccaucauggguaccaaggauugugacccaaguccuuaagcuugcagaguggccugcgucaucucaguagccaaggccucauuauuccugaagaagucugcaguuggcgcugagguucugaguaucagcuuguuucuucuccuucuccuucuccuucuccuucuccuucuccuucuccuucuccuucuccuucuccuucuccuucuccuccuccuccuccuccuccuccucuuccuccuccuccuccucuuccuccuccuccuucuuccccucuuccucuuugaccaucuguuuuugaauuuuguuggucuaucagauguuucucauguuccuuagauuugaggaauucgaaaguacaggcaguuucgagcacucagagccacacuaaauaggaagaacccagcugggcaguaguggcgcaugccuuuaaucucagcacuugggaggaggagaaaucaaacagauuucugaguucgaggccagccugcucuacagagugaguuucaggacagccagggcuacacagagaaacucugucuugaaaaaagaaaaaaagcccuguccaucugaauuguagccccucucccucccaccccacagagagucucuguguagaucaacucuugcucucuauggugugggccauagcucccaugcucuauaccuuccguccaguacuguggagggaugugacagguacaagaaggcccaggcccacccacccugguugcugacugggugcaccugcuggccugcucucgugagggagucaguggcaaacacuguggagaguccuuguucucacaguucauagagcugagucccaaaaccaccagggagccagggagugucucuggcuuauuucuaucgugccuuccccccagacuccuuuguccuccaacagcaccagcauggcacugacuguuagagacuugggauauuaugugguguuugauuuuaaauuucuuuagaggaguuaggcaccacccacagagccuauugugcagcuaggaaacauuuuauaauaaaggaacauuaagaauucaaaugaggugcgcuguagcuucuguagcggaaauuuccuuauucucuugggcacuaaagcaccacugccagugacccccuggguaagcugucuccugguguauacagugcuggcuuccugggcuggguuucgauauuaauuggcucucugguuagaggcagcugccucuguucugcaggucgaagcuuagggcugagccaugcagguuccgugucuggggaaggccccucuuggcugcucguggugcuuuauugugucccaucuggugagaagggaaagggagacuguucuguggagcauccucaagagccuuccugaccucgugaccuugaagaggccccacccaccuccuuucaccaucauuccggggcucaggacuccacacagaaauuuagaguguccuaguaguucucacgguagcagcugaagguuucuuacccagggccagagggcugccaucuuaucccuggccagccgcucucaguacaggucugcgcgguccgcgggauccaggacuaauacccaggguccuggaggagaguaagaacuaguugggggccuguggggcuggaggaggagagaaugacucacaggucgccaaccuauacaaagaaaugguguugucaggauuuaagcagcaucauaacaaugacaugccuuugcccaggucucugcagcuggccggccacugguccuccacggaacccugcuucaugucuggcucucccugccuccuuagcgcacacccuguuuccguuacuguuccauuggcaccauggcggucacucuccguaccuggccacccagcgugacaccuacccaaugcucagguuuagggcaugagcugacugagcuaaggccaucugaggcuugccugccccuaugagguagcuugagauugaaugcugaccuagauggagauguccagcugcuccugcuagcuagcugggcuuugccaauguaacuacaguagggcacgucccugccaacuggaaaucuuggcucuggggauacucugaggccugggaacaccagagcugggacaacagcuuugugucaggcagccacuccggagcuccuggaccccuccugggacucuccagggacagguccucuggaauucagcagucaggcuggugacaguauuaccugggccagcaucguagaggugggauaccuggcuaguggcuggcagggugagguuggaaggccacacccggcugggagggaagguguggcugcacuguuuucuggaaccauagccaccagaguuucaccuccugucugagcaaacgagcagcuaggaauagacagagcaggcuccuguggccugugucuucagggguguggaguccagggaacaaucugccguaccacaaccacucaagauccccagguuguguuugcuguggugcucaggagggugccugaaagucuaucuuguccccacaggagcaccuaaugguacccucuuugugaucuauucccguuauuagaucccagugaggaaccguaagucuaagacacaguacguguauacacacacacacagagagagagagagagagagagagagagagagagaggugcauaccuaagugcauaucugcagauguacucacaaacauguagucaugcauguuuacacacaucugcagauacauagguaugugugcacauguguaugcaugcacuuacauuguuagaugucauguuacaugucauaugcauguuauacacagagauaacauuuaacuuggcacuugcaugugugcccauguacauauacauaacagacauggcaucugugcacacacaugggcauggguaugagcacagguaaacacaugucaaccagcaacacaugucgcugguugacaugcugacacagauguacacaaguucaugugcacaauguguguguguccacucauacacacacacaguacccucaaggccauuagcauucucaggccagagcaaggugaccaugcccuggcuggggucgguccugucuccaguugcagccccugcugagauuuccaggguuugcuggaggcagagaguugcccucugacagcccaggcagacugcagagggggcugcaguucuuucuccuggguuuagaguaggugaucagcccucuuaguguaguaauggggccuucaugacccugucuguaaugggaugucaggccuucuucuggagggccucaguugucgcaggggagaucucagcuuucccugggggaagggcgauguaucucuuuguuuaaauuuaaacaccgagagcaagguccugaacuuggcauuggauggagccguuccuggaaggcacuguggcagccugucuguguggguguggcaggcacauuguuucaagugaguuuuaaauuacaccaaacagugaguaguguagagaaaagaagaaaagucaagcccaacgccuuccuccccuuccucuacuucucugcucccccccuccccuccucccccuccucuacuucucugcucccuccccuccccuccuccuguucccaggggcuucuuuuaaagagcaccaggguguuggcaaggcuuuugcccucuagugucugcccauggaauaacugugcucugcauugugggguugggucugcagggcaggagccugcagcuguagugagcacagccuggcugaacuugcucugugcuucuguuaaggcagcccagggccccaguaaaccccacaguuccuacuuuuggucaagacuggcagaggaguuugcuggcugccacugaaggccagaagguggcauuggauuccccuggaacugaagucccagaugguugugagcugccgugugggugcugugaguggaagccagguuuucucaaucuacaagagcaacaacugcucuuaaccucugagccaucuccccagccccuaccaaugcguuuuauacagcugacauccaagggcagccccagccagaccacccugggcuggugaagaguuuugguuauuucagccacuuaaaaaaaaauguuucucuuaaaauuuguuuuagucuuguguccugacuuuuucacuccaggcacaagcugaggcucuugcucucugccccuugucaugcaccuccaccccucccccacccuccuaauaaauguauuccccaccccccacccccuuuggugacugaggcugcacugugggcccugguagcacauucugauuauauuuccacuaaggaccauucucucuuccccugggguucuaauugcuccauuuugaguguuugguaauucauucuuagcuguuggugcagcaucuuagccauguuaucaggccccagccucugagacuuuccuuuuugcagcugauagaaugagaaaaaaaaaaaaaacccuuauuauucuauguucacagaauggcuguuagaccuccagacaucuagucuugaguuucagauagcagcaucaagagcgagcuuagggguccaaaugcugguguuuuuuuuuuuuuuuuuuuuuauuauuguuguuagccuauuucauggaauuguuucuagugcuuuccacuuagauuucuuuaacuagaagcaggguaaguuacaaagguguugaacugggcguucugcccaccagugagagcucaggaucuguuaccuagaaggaggcaggaagucacagaagcaggaggaggccaggcuggguggcaggagauuugaggggaggggagagcuacugagcguggggaggggcaguuggaugaggaaggaggugcauccaagacaaguuugcagauuggguguccuuacuagccauggacccagccagagaguggggcugcagguaggugagugugcuuuaguggccagugccuuccuuguccucccguccacgugguugacuaaggagcugagggaguaguaggguuucauccugggucucggggauacaugugucuugugacacucucacagcucugagaaggaagacguuagguuucuaaaauccuguccugaugcucgugaacuuuaggggcagcccuucugcacccugcccggcauguccuuucauguuucucagccagaugggucucacuccuuguggugucuaugaaccaccuccuguccuuccgugcugugguggggcauccuaauuagcggcuugcguguccaucagcucacagguucagggcaccauguugggucugguguugggcaaagcccuucuggucuguuagccccugguucuggacucucuuucuugguaucuugcucggccccaccccacuucuuuuccagggcuuaauuaauuagcuuguuguuaaucaauuuuuguuaauuaacaaaauaauuaauuaaauccugagccaggaccucacuguggaaccacgguaggacugggacucacuguguagacuggagccugccucccccaccccaccccaccccccccaguguugcgauuauggccugggacuacauauagacuaaacuagcaaugaacucacagagcucccucugaccuaugguuaaaggccugugcuaccaccuauuaauuuuggaaucuguuuuguaucuuuaaauuuuauuucagucagggucuucuguagcccagacugaccucagacuacauagcuaaggcuagccccgaacuccucuuucuucugccuucaccugguggugcauugacauucuagguuuaugaagggcuggggauagaacuuuggggcuuugcgcaugugaagcaaacauucuaccaauagagauaaggaauguuuucuuuucuuuuuuuuuuuuuuuaaauaaucuauuuauuuauuacauguaaguacugucuucagacacaccagaggagggcgccagaucucauuagggaugguugugagccaccaugugguugcugggauuugaacucaggaccuucggaagagcagucagugcucuuaaccgcugagccaucucuccagcccaggaauguuuucuuauaaaaaauguucaagcaggaaugugaccugcaugaccuuggcuggcgacccuggcaggcguucagccuucucuguucacaccaacaucuacuuccaucagggggaugugaagaggaaagaaauauccaugucccaugcuaccugacccucgcagcuggaacaaaucagagggccuccugcgugucacagcucccuuguucugcucaucuccaguuucugcaacacccaggaucuucugggcuuagaccagugccaccugugccucuguaccuagagggugcuugagaucagagugguguugcuguccuggcuuuccuuagcugugaaugcucaguguuggagggaguuggucaccauggcuuggacccuagcaacccacagcccccuuccucacuguggcaggagaaugggcucuuacgcgacaggacgcagcacugugaacuugcucagcaaaacgcagaguucauaauugucggacucaccacugucuguuucccagucacugccucaguucuuggcuuccugcuuucugguuggaucaggguaggagucaccccuugugcuuggcugcugugaauuucuaggguaggacagggguccgucuggcuccuauucuguagaaccgcugucuauaauuggagucaccucuuugcaugucaccuguaucuccuuuugagcuauagcgauaguuaaggaaaauggugagcugaacuggcuuagaauaucccacuccuuggaggaaggagggguucgggcuaucuuuaggaagcuucuaaauccauugggauagaaaccagacagucggggcuggugagauggcucaguggguaagagcacccgacugcucuucugaagguccagaguucaaaucccagcaaccacaugguggcucacaaccauccguaaugagaucugaugcccucuucuggugucugaagacagcuacaguguacuuacauauaaucaauaaauaaauuauaaaaaaaaaaaaagagagaggaagauaaagaagagagggggcacuuucuauuuuaaaaaaaaaaaaaaaagaaaccagacagucuguccuuuaguaccggacagacuaagggacugaauagagaugcuggaagagccugcccugcccucugugggaggaaggguggggcaggggaggccuggcaaguggguagaugccaugccagcauugggcucacaucuggagacuguugugcucccuucagcuucuaguaaccacacccaaaggugaggcggaucuguguaucagggcagcuggugagugacucagcgcugagcucugcauccugggauccuggugugugcugggccucaggcuuggcuagggcaggugaggacagggacagaggcucaagggaccuggccacaaguccaucagacagcaaagccuggucuucuguuucuuguuuguggacaaaucagaguuaauugcuaguguuuccaugguaauuaacggcuuccuggugaggcaggaagagcucggguugccuccugggcuagcuaugacuuuugaugugacccacuacuccugcagaauggggcccugaggcuaugucuucauggguacggagguuagugugugcuuacauacuguauguauguaugugagcacaugcgugcauuuucgugcacauuuguguauggcuaugugcauucugugugucuacccaugcaugugcacccuuacauguauucccaggggagugcccuguaaccgcaaaccucugaugucugguaauauuccuggguuagcaugucagaaguugggaagugagcccuccagggaaacugagacccguacuguuccuuucaguuguggcaugucaccaagcaccuggcugucccucuagcuaguuauuuccaccuugguggguccauccaucuugguguguuuuagccuuguugucuucucucugugggaucugucugucuggcagccccacaaauccuggaugccuuccaugucccucagcaggcagguucagacaggauagacaguagaaagggauggaggggacugagaaccaucuggagccgcugggaccuauagucucguccuuuccuucuuuugcaggucagacgggaacaccggcagccuuggcaugacgucgugaagguggccauugcuaaccugacauguggggacucaggaaccccaccccuuaugggcuccagucugugcugcuggccccagcucuggggcucuaagagguccuugcugcuaccccacagcagccugcugccauccaugugugcccguugcugaaggccucgguggccccugcccaugaggaugugugcccccguuagggggcuguucuuggcccuggugguaguguugagaaccgcgguggcauuugcaccugugccucggcucaccugggaacauggagguaagugagugugagccaugagugagugugagugugggugcagcagcucuggagaguguggggucccugcuuuggaugcucuguggggucugucagggcaggcuuaagccgcugggaugucaaaggaugcugugugaccaggagaccccacagcaagcgccaagcuuagguuggacgguguaugugaccucaguggcucacggcuuacuuaaugcugacgacaucccagguacuuaugcugcacuguugagauuagcucagccucagagaggucuccaggcccgauuuccaggauggggacacacuggcugucccacauuccagggagggaacuuugugaagacagaagccgggaagcaaagugcacugagaauguccaacucugaagcuaccuggacacuccgggugcugacuuguaggcaaguucagaugaaguucauugaugggggagggggcagaaugcugagcucagcaucacagcaggaaccuccacacucaggaaguugaugcaggaggaucgugaguuccaggccagccugggccacggagagagacccugucuaagaagaccaguauuguguauguccugccuguguuaacauguucuuaaacuggugcagguacgaaaaagcaucacuugucucuggaaaucauugguaaugaguguaaauuuguuuuggagagagaugugucccccccacccccacccccaucaugacuuuucuuuuuuuaaagggggcaccggggaaagaacauaaacccugcacacacuaggcagauguucuaccaaugagcaucucagccccucguuccagaguuuucgguguugaggguuucagaguaaggcauuuacuucacgagugagaaaguucucagucauuacguauuuugagccuacagugggugguuaaagacacauuaaagagguagaguguaaaccaagugucuucgucaggguuuccacugcugagaacagacaccauggccaaggcaacucuuauaaaggacacuguuuaauuggggcuggcuuacagguuuagagauucagaccauuaucaucaaggcaggaagcauggcagcauccaggcaggcauggugcaggaggagcugagaguucuacgucuucaucugagggcaaacaagaaaagacugauuuccagggagcugggaaugauucucaaagcccaccuccacagugacauacuuccuccaacaaggacacaucuccuaauagugccacucccugggccaugcauauucaaaccaccacaccaagugucugugaugugcuagaagccccagcaugagagguuuggaucugggagacagaaaaggagaucaggaguauagccuggggaugcaugccauccucagggauccagccgugggcuagcuccucucuuguacuugguggcugcauugagguuaccuggggugggggggggggguccugaguucugcuccaugcuggagcagggugcacgcaggcucagcagugacuccugggcucuuccuuccccccucugcugccacagagguaggucuggugcaguuucacaagccaggcaucuuuaacuacucggccuugcugaugagugaggacaaagacacucuguauguaggcgcccgggaagcagucuuugcagugaaugcgcugaacaucucugagaagcaacaugagguagguuccauggccucccauccaugccccuggagacggggcugccuucgcuaccucuccauccccaggcugcacaggucuggcuaugucugaucuguguuggguaguauuccguguggucaccuuuaaaaggaggagagaguaauggaggcugaggacaucugaaauucauucugugcaugugucagacucucaaaggagaaaauuuaggucgagaagggucugaagagaugacucagcaguuaaaggcucauguugccaagccuaaugcucggaguucaaucccugccccacccccaacacacacacacacacacacacacacacacacacacacacacacacacagccuagaaagauaacaaacucccacaaguuguccccacacagccacuuacacaccaucacacauucacaucuacacauaauaaagacguaauugagcacaaggagauggcagcagcaucguggggguggggaguagguagggggagguggugaaggggaauugagguagcuuacacuaaucacuggaaacgucaaaaaaauguaauagaaagcuuuaaggcugauaaaaaagaacagauggaagcccccaguuuuggauagaauuuaauugacuauacuuucauuauguggggcuagggggucauaggacgacaaccuugggugucuuuccuugggugcuggccacuuuuaaaauuucauuuuuuuugagacguggucucucaaccagccuggagcuuguuaaguagacuggcauggcaucacugccuccccagugcacagugccacaccuagccuuuucacaugaauucuggggaucgaauucagguuucugugcuuccuggcaagcacccacugagccauucguuggucuccccagcccucugcugcuuuguccgaaguucagggcuguguuaucccugcuagacuggggaugauggucccagaacaugaggaagcccuaaggaugacucuggggucucagucccugccugcucccugaaccucuuccuagucugacuuuauucuggcugcaaaccagugagcuuugagcuguggugugccuucuguugcugucugcuuuauccagcaguuccuugggguggggguggggggaacuguggugaacuggcucugacacguuccucccucacagguauauuggaaggucucugaagacaaaaaauccaagugugcagagaaggggaaaucaaagcagguaauugaccgcacguacaaagagcccacgcacacaguucgcaguuauuuggaucuuuuccaguagcagucuucugcaugccuaccugguaucacgugagucuggugggcucgguccugcugucucaacccuaccagcaucaggauuggugcucucaggccagugcccugcauccuccgcacuggagaagccuguucucacggcuuggcauuaugacuacaggauguuguuucugcugcccacuaguaccugguguagaauuggccuccccuauauguuucuggccuucuugaaccagcugaggccuaagagguguuggggauuugaugggauuuguuauuguuggguuuauuuuuuguuguuguuggguuuuguuuuuuuguggguuguuuuuuuuuuuuuuccuguauuuuguugucagauaccaguaugcgcacucagggagacugagccuuguauccuuuuucucaggagcucugaguacccucuugugccugcccaccuggugucccaccagugucccagauguuuuuagaucacgaauguuuuuagaucacaggagccagguuguccccaauauuggucaugguggcucagcaguggcagaguuuaucagcuguuagcugauuucagaaacagggauuaaaacaaccacuaggagccgggcguggugguacacaccuuuaaucccagcacucuggaggcagaggcaggcggauuucugauuucgaggccagccuagucuacagagugaguuccaggacagccagggcuacagagagaaacccugucucggaaaacaaaaacaaaaaccaaccacuagguuaaacuuucuuggcuaaaugguaacugaacacuuuccccgucuuacuggucucuaacuguaguguucacucaggacccaaggcaggcaggcauuacgauaggcucccugcugcaggaaaucuguguagcggagugagcugaugccuugcaccacuggauguggggacccacagugaccuuggcauggagcccuccugugauacccuguccauuugaggguuguuggggaaaaaagcaacaacaacaacaacaacaacaaaaaccccuuucccaacuugagauaauuucaggccauagcccauagacucuaagugcuguucuccugaaauagcacaugggcuccaaauugccgucuuuguuuucccacugggcccucagggauacacagcuggcuguacucuuggguccagccucucucucaguuccugcuagucgcuauuucuaguucugugcugguggcaagaguauagggugggguccccaggaagguagaaggagccuguacaaugucuguuuuggcaauaugggcccccaaaaugaacgguguguguucagcaaggguaaauacauugccaucuguagugggcuccccaguacaauuugaggucagcucugguuuggucuuugcuuugcuuggucaccagauacaggcuggccaucuacuuagggauagagcuaaagucaugccuggcaccugcacugcauguggaccacagagauaaaguuuccguugcagagccuggcucauggugcagugugcccccucuaugggcauagacagaccaaaccugagcagaggagagaacaaggcagcaaaugacuggccuuuaccauguggauacaaggguucuuugaugggugccuguuaaugggguguuucccuugcagacggaaugccuaaacuacauucgaguacuacagccacuaagcagcacuucccucuaugugugugggaccaaugcguuccagcccaccugugaccaccugguaagaccacaacauaucccugugugaagugcucacguaccagccuggcuagcgacuaaagcagagccagccugucucagucaggcuuucuauuccugcacaaaacaucaugcaugacuaagaagcaagcuggggaggaaaggguuuacucagcuuacacuuccacauugcuauucaucaccaagggaagucaggacuggaacuuaaacaggucaggaagcaggagcugauguagaggccaugaaggaaugcugcuuacuggcuugcuuccccuggcuugcucaguuugcuuucuuauagaaccaagacuaccaucccagggauggcaccacccacaauggacccucccacccuugaucacuaacugagaaaaugccuuacagcuggaucucauggaggcauuuccucaagggaggcuccuuucucugugauaacuccagcuugugucaaguugacaugcaaaaccagacaguacacagccucuccuguucuuucugcaaacugcaaggacuaagaacuauacagucggauuucugacagcaacaauugccccguuccuccugaugaggguucugugagguccaugggaugaucuaugguagccaugagguagcuguacuuuccaaaaagaauaaauaccgagagaucgguguuagauacugaaacaucaaauuggaugugcaaaacauccagcagaaaucagggcaaucugauuaaggaagcuggcugggguucccagcagaguucuagucagagcaagaauguccauuugggugggacuuuuaaauaaaagaacaaacggcagcagagagaugccguugccuugggagcaucaggcauccaucaagaacugacuggggaaguugaggcagucagcuggagccaucucucuguagcugagaucccauggcugaccucccccgccauccccacccucacuccccaacccccccaccccgccacuguauugugagauaaauaacaguaagcucuucugcagaugguucacccccuagaugcucucaagggcacaguguuucucaagggcacaguguuucucaagggcacaguguuuuuacucugggguugcuugcucuucucucugucacagagucagggaccuuggaagacacugggaaaacaugcuugggucugaaauggaggaggggaaacccugcugccagaaccauuuucccccuugagcucacacagcacaagaaagcuuaccaauacgauguauauuacaggucacuuacuuacuuagcccuugcugugaccaaauacuugauaaaauaaguagcuuaaggggaaaagauuaucgaaggcaccucagccaaacagaaggcaucuuguggacaaguaaugcuggccuguaaacacccaggcgcacccccagaaacccgcuuucacgguaggucucacuucuacauccaccaccuggagagacacccaugagcccaugggugacauuuuacaaauaaaacgauaacaaauaugaaaacguaauagauggguuuccucucuucucugcugggcauagauccaaauuuugcaccaaaugccaaaaccuuggcucuucccaagccuuauauuguauaccugauggccacgaggcuagguguucaaggaaagguagcuagccuguucaaggaaagguuggucugcugagcacggggugagugaugccaugcagggcagggcagggcagcucaggaggcaggagaguaguucauugcucugcugcagccggcugcagaugacuggaaucccgggugggggaggcuucugaaaugaagagccucauucaccuaaacucagccagcugaaguuuaaagcuuguucccaguaagaguucaguuagaguugucuuaguuaggguuguacugcugugaacagacaccaugaccaaugcaaggcuuacaaaggacaacauuuaaucggggcuggcuuauagguucagagguucaguccauuaucauuaagguaggaacauggcggcagccaggcagugccuggugcaggcagagcugagaguucuacaucuucaucugaaggcugcuagcagaauacuggcuuccaggcagcuaggaugagggucuuauagcccauacccacagugacacaccuacuccaacagggccacaccuucuaauagugcuacucccugggcugagcauguacaaaccaucacaagaggcuuaccuagauugcaagagauguuugguuuugauccccaggaccacaauacacucaccacaugccuauacaccauacauacauacacacacauacauguaccauacauacaccauacguacauacacacacacaaacuccccucaguuggggauauaacuagauagaacagacucauuagaaauucucuuaggcagcuagguauggugggaaggcuccugaguaugaggucagccuagcuuacaagcucaaaaggaaaaaaaaaagagagagaauuaagaaacuaaauauuuguauagaugucugaggagagaggccacugcacagguuugacuggcuaaacuaacuguguacugggauacaaccaaaauucuaguguguguguguguguguguguguguguguguguguguguguguacacuugauaagugcgguccguggaucccauagccuuuagaagcauuucuccuaagaauggggacauuuuccugccaacugguuucaucauugcagauaaggaagcacagugauugccaguauccuccgccccucccaccuccccaguauccuccgccccucccgccuccccaguauccuccaccccucccgccuccccaguauccuccgccccucccgccuccccaguauccucugccccucccaccuccccaguauccucugccccucccaccuccccaguauccuccgccccucccaccuccccaguauccuccgccccucccgccuccccaguauccuccgccccucccgccuccccaguauccuccgccccucccgccuccccaguauccucugccccucccgccuccccaguauccuccgccccucccaccuccccaguauccuccgccccucccaccuccccaguauccuccgccccucccgccuccccaguauccuccgccccucccaccuccccaguauccuccgccccucccaccuccccaguauccuccgccccucccgccuccccaguauccucugccccucccaccuccccaguauccuccgccccucccucuuccccauagcuuagagcagggcacagccccaguggccuccgggcaucccugggaggugugacgacagaugggucuuaucaggugggucacacugucaccccagcucacacuuccuaaccugacugguggccuuuauuguuuuaacuggcccguuggucacugcagacacugugagguccugugugcuugcuggccucuggcuuccagccagcagucucuggcacagcuaggagcuccugacuguggugggcagccuugcuccuggccucuccaguaagcaaaguguaaagugauggccuacuuggauugucucagcaguccuggaguucugauaggcaguccuguggguggcuccugucccuuuaacggguugcaucugcugauuucuucuguguguguuuaaacgccucuuuuaaauccagaagugaaaauucuucaccuucguucugugggcauucccccccccccccacacacacacaguuugucacuugccauugaacugugucucauuuuuucccccacaugagaacauucugauucauuauguggugauguuugggugggucugauucuccuuggaugguguugguuucuuguuuaguuuuuuuuuuuuuuuuuuuugucagcuuggcagaagcuggacuucucugagaagagggaaccacaguugagagaauaacaccucauaagauaagauaggucuguagucaagugucuaggggcauuucacauuagugguugaugugggaagagccagcccacggagggguguauaagaaagcaggcugagcaagccacgaugagcaaaccagugagcagcauuccuccauggccucugccucaguuccugacucuagacugcugcugcuuugaguuccuggccugccuucccucauugguggacuguaaacugugagcugaaguaaaggcggccauuuaucacaacaauaagagagcuaagacacgugaaauagguuuccuugucagguggaaagagguuaucccaagauuguguuaccugcugacccucaugagcacacugugccagaagcauggacaaacacauuuguuguguccucgcacagugccagaauuuauucagcaacaauaaauucccaacgauuagcaguuuaguaacaucagguuaucacuuaauccugcuucccucagugaucaggccgagcaaggcaaaugcagauucuuuauucccgucuuuuuguuuguuugauaaccauauuucucuguguagcccuggcuguccuggaacuuacuuuguagaccagacuggccucagacucagagaucugccucccaagugcugagauuuaaagcguucgacaccaugcccugcucuuaccugaaucuuaauuaguaacguuaacuguccaaccacacagcacagagaaaauauguguauauggcauguauaugguuauagagggaauacagguuaaagucgcuugagguuucagaccugggcucagagaaucugcacugauuucaaaccagaccagugcugcgagggagccgcugcagucagguguuagagagcuagacaccuccgagaagcuggaagcuagagucucccaaggcagaagcaugucucugcugaacaaaccagguagcaacugauaguuucguguggggcuguccaucauaguguugggugucuaucacuuuaaggagacaaggugaggauguuacaccuaggucuauuaauucguaggccuggcuuccuaggccuuuuucguacaacugugugcccugacacacucagcuuguaugaauucauccaaugguggcuccccuuucuguucccaggaguaaaccguuuauccaucuguuuggaguggauggugcauggcagacaguguagcuugcagguccacccagggccuacucauccuuuuccccaaaguggaaucaaaagcugcuuguaaaacagacucuccuaaggcaaggcacagccuggagaccguuuuauacaauauggggcagcuuagagccaggcacagccugaucccggcaugaccuguguuguggugagcuugcuuuaguagaauggcuucuucaggagcugcuggugguggaugagcgggggugaggguucuguggguuguuuucauuggguuugugucgccuguuuugugaggacuguaguugagcaagcaacaacugacccugcauaucucaggcugucacacacaugagauguccuucagcugucaacggucccagggugggacccacauggaucagggcccacuuaccccacacucuggucuucugaagugaaagaaucuguaccuuuaagugauacagggacagguccucagcaccgagaggucagauguuuucuuuuuauuccauuguagaacuugacauccuucaaguuucuggggaaaagugaagauggcaaaggaagaugccccuucgaccccgcccacagcuacacaucagucaugguuggugaguccugcgucugaggcucuuucacucucugaguuuaugguggcaugugauguugccaccugggacacucaggucuucccucuucagcccugccuuccuuggcaucaucuuggcacgagcucccuucagagaaggugagcgacuuguggcacagacuccucagugagagcuuucgcguuucccauucagagggagacucaggccccacccucugcagcagcauauggcuucuggcugucgguuuuugugcagcacacaaccuggauacuuguguggcucugugccucccgcugcgguccugcauaucugaggcuaggggucacacgcugucuuacagauaguucauguuggaaucucucagccagugugaagguucaagcuucacugucaauguauaacauucagugaacugugagauaguuaauacuauauuacaaaacaggcgucaugugugacacuccugcgcagucauaggcuaaaguauggguucugaguauauuaaaguagacgaggcuggaccaugcugccuggcaguguaggugccugcacaucuuuuuuuacuuacagugcuuuuuacuuaggauggcuucccugggugucaaauacugaggaguguacuugccauugcuauacugacuguggcaaauucucauuugugauuagcuauuacccuuuaaccugggaaaaaacaguuaaauuuggugacugauuguucugaugaaagaugcugauguaggaagcaggaaugcaugucagagaagacgaggaccccccccccccgccauccuauaaggaauuaaugaggguauaaaugaauuaugguagccugguaugggugugauagccuagcagagguggaacuaugaggcuugcuuacaguccagccugggcuaaugucagaacuuguguuaaacaguugucccuagucucugacagaggcugaagcucugauuggaucuucucuacucccucuccuccaccacagggggcgagcucuacucugggacguccuauaauuucuugggcagugaacccaucaucucucgaaacucuucccacagucccuugaggacggaguaugccaucccguggcugaacgguaagugugugcugccagccuugugggucuaccauuuuauucuuccucuagcuguccccaggucacaggagccgggggaggcggggguggggugggggugggguggcggcugcucaugucagauccuaggcagugcucuuuggaacugcucaaggcccgcaccagaguagcugucuugcucacugcuaauagcauuguuuaaaucugauucucugacauaccccacccagccccacuuccaccccgucccccaaaugcaguuugggagacuuuaauaaaaugaagcucuaaugggaaguugagaauguagacacugaguuugggugucaucuuagauguggagacucuugggucuggccgggugguguugaaaugugucuuuacucccagacaagcauaucaggguguggaugaugggggcccuuugugggugucuuuuuuguggggaugcugaccagugaugcagggcuuuuucgaagccccuugaucuggagucagacccuggagucugagaucugagacagccaauuucuccuugggccuccccaggagucuggaaauccuucggguggcugauuuggcccuuguuuaaauuggcagauacucuagcaugccagaccaaccaccagcagagaggccucacccggcuuccucuguggcuaucuuggugaagcugaggaggguggcgggcguccucugggccuggaguucacaguguggcauacauacuguagacguccuagaagggaagcuuccaggcucuaaggcugcccuugccagccugcagcaccccagggagcagguagagagguggcuugguagcuccguguacagaaaccauccugugaugccaccccacagagccuagcuucgucuuugcugacgugauccagaaaagcccagaugguccggagggugaagaugacaaggucuacuucuuuuuuacggagguauccguggaguacgaauucgucuucaaguugaugaucccgcgaguugccagggugugcaaggugggugcugucucccuguucccacccacaguccugcaugaugccacuccaagauuccucucuggaaguguggccaucuccuauggguagagaccccugcggcaaaguuuaauguacaguugaggcacaguaagagaccagcaauaagaguuuuagagguaugugcaugguuucucuugagacccaaaguaggauugggaagauggcuuagugguuaaaaugcuuaccacggaaacaaaaggaccagcguucagaucuccagaaccuauagaugcugagcggauccucuguagaaaaguggagauagggccugcuaguggggcuguccucaucggcaagcucugaguuugauuaugagaccuugccucaaagaauaagguggaugguuccugacaucaacuucuggccuccagaugcacccacacacgaacacucauauagagacacaccgcacauacacacauacaugaaaggaaagaaacucaaagaggaaaaaauuagucagagugagcacuugugauauuuucagugugucacuaaucacagguaacugaaauugcagaaaaugcaaucacgcacacgggagccgccuuauuucuuuccagcccagaguggaguauaguuuguaacugucuguguugucucagucgucagcucccugaaaaugacuaggauugagcaggcaaagagggcacaaaaggagcucuuaguggaugaucauguguuugcccuaggauggucugcggggccagggucuguggugggaaggaggccucccaucacuuguuuaacuccugggucacagcugggaaugcugcaggagccaaagccaguggcacgcugaugugacacagauggggugguuuugcuugucauugaauguguuuggcucuuuucguauucugugauccugucccacauggaaguauugcuuugguuacauaacuugucuucaguauucuugggcuaggccgugguuggggacauauggacgccugcuucuguggcuagucaucuguccugccucuaccaugugcugucucuggaauuccagggcgaccagggcggccugcggacuuugcaaaaaaaguggaccuccuuccuaaaggccaggcugaucugcuccaagccagacaguggccuggucuucaacauacuucaggauguguuugugcugagggccccgggccucaaggagccuguguucuaugcggucuucaccccacagcugugaguucacuugugagucccuuggcaguuggggccuggucacccugacgaccuccugcccuccugacacucucacggauuccccuccacaggaacaaugugggucugucagcggugugcgccuacacacuggccacgguggaggcagucuucucccguggaaaguacaugcagagugccacaguggagcagucucacaccaagugggugcgcuacaauggcccagugcccacuccccgaccuggagcgguaagcagggucucgagcucuggggagggcucaucuucucuggaucucaaggccccccaagcaugagaccacacagauccuagugcaucccggcagaggguugcauggcaacaggaaucugggugcugggcugaguagcugccgggccuggggugaacagugaagcuguuccuuucugaucuccucuguguuggguagcaggccucacugcaugcugcccggacgagagagucuaccgccgggcuccuuugagaaguggacauugcacaauggcaggcuugcuucauuucccauuuccugcagacaaaaaaaaccuguuugucagccugggcugucuccugaggcagccuguccacuagauaacaggaaucauauucuuuccuccuagauacaguaaauuaguaaagaaaauucuaggguugccugcauauuguugccacgugguggauggguguggguauggaggggcuuggcucuugaagcucucccaggauggacuguucugugagugucuggccucgacaccugguuauucucauaacucauaauucagguguucaguaaaacauggcuagggagcugggaccaaaaaaaaaaaacucuuuacaacuuuuuuuucuuuugugcuacccagaaucuggcuuucucuccucucucuccucucucucucucucucucucucucucuuucucucucucucucucucucucucucucucucucucucucucucucucucucucucucucuuucucugugugugugugucuguauaacaauauuuaacaagcuuccuuuggcauacuuucuucucauagaaaagcugugaaaugagugcuuuuuaaucuggaaguuugcuaaguuuuuucauuggcuacuaauuccucuacugauccugagacaauuaugucccguggcuuuaaaagcacagcucuuugucucuggggaggucaccuuagccccuguuacucuuuggagaagugugaccauggcccuccagggcuucucuucugugugcucaguugaagcuaagugggcaugugaccgcggugcuuuuaccccacaguguaucgacagugaggcccgggcagccaacuacaccagcuccuugaaucucccagacaaaacacugcaguuuguaaaagaccacccuuugauggaugacucagugaccccgauagacaacagacccaagcugaucaaaaaagauguaaacuacacccagauagugguagacaggacccaggcccuggaugggacuuucuacgacgucauguucaucagcacagguggguuccuugguaagauugggaaauucacuuuuagccaucuauagguagguuuggucucuccagguaccaggaagguuugugacagcagaaaaggauuucugagguaucacagcaccugggauuaugagucucuguggccaucaggcaccuggggcacugguuacuaaugcaagucccaaccugucguaccugggcuggaguggaguuaaauagucccuguugucaugggacuagugggacuggccugguauuuccuaauugguagugggagacucugcccccuccuagguaggagccagguucuguccugccccgagcugccuuuggagaugcaacucucucucagaugucuucugggauggggauggaaaguuggagcauggcagcugccagagccccaggggcuacccuuagagcuucccagaugacuugaacauuuugcccucgucugccugccugggccccuaaccuccccuggaagaccaguaaagugcaacggccaccuuauacugaauguggcucaggugucaggguguaaccuuguuggugaaggucauuggaauccaccauaggacaggguuguccucuucugagugccccauugaggggauggcuugaguuauccacgagugugagugguugccgccaaggcuggagucucucuccuaguuucauuucuguugccgggcgugguggcgcacaccuuuaaucccagcacucgggaggcagaggcagguggauuucugaguucgaggccagccuggucuacaaaguaaguuccaggacagccagggcuacacagagaaacccugucuugaaaaaacaaaaacaaaaacaaaaacaaaaaaauuaaccagggugccacccugggccugucccucuagggccuccuugcucaccuguguucugaccuugcagaccggggagcucugcauaaagcagucauccucacaaaagaggugcaugucaucgaggagacccaacucuuccgggacucugaaccgguccuaacucugcugcuaucgucaaagaagguaauguggguuugguugguugguugguugguuuuaggggugggggucagguccaggcgcuugucucccuuguagcuucucuguggcuaggacuggcuaggaugggucucucaaggcuuggcagccucuggcccaggugaacuuggcguacacagcaugggaucugaggcuugggaggaggcaugggagagccaggggccuugauuguacuaagccacuggagcuuuugggaggucccuaaccuggggaaaugucugugccuugaaccugaaaaaaaaaugcagauugugcuggugggacaugacauuuugcuaauuuguaaggagaaauaacaggggcuggugagauggcucaaugguuaagagcauugacugcuccuccagagguccugaguucaaaucccagcaaccacaugguggcucauaaccaucuguaaugagaucugaugcccucuucuggugugucugaaaacaacuacaguguacuuacauguaauaaauaaauaaaucuuuuuuaaaaaaaaaaaaagagaacuaacaggucacccucuagagcuccugccauaccgcccugugcaucgggcagccuuugcagaggccucagucacgggggcucagcucugcacuguggcucccacgagccacggaaacacauagaugaccaaaccugcccucgaagccaugcuauguauugcccgaaguuuucauaaaaagcuccagccagaugguaguagugcaaaccuuugauccuggcacucgggagguggaggcagguagaucuuugugaguucaaggccagccugguauacauaguguguuucagggcagccagaacuauguagggagacccugucucaaaaaugaaugaaugaaugaaugaaugaaugaaugaaugaauagguauuuuuuaagccccuaaguggggugcaguaugguucauaccucuaguuccagaccuuagaacauuggaagcaggaagaucaggaguucaaggcuagucuuagccauauagcaaagucaaggccagccugagcuaagugagaccccauugcaaaaaauaaaacaagguauauaggagugaauagaaauggccuggguggggcuggagagauggcucagugguuaagagcagugacugcucuuccaaagguccugaguucaauucccagcaaccauuguggcucacaaccaucuggaauggcaucucugauggaugcccuguucagguguaucugaagacagcgacaguguacucuauaaauaaaauaagucuuaaaaaaaaaaaaaagccuggcagugaugguggcacaugccuuuaaucccagcacuugggaggcagaggcagacagguuucugaguucaaggccaaccuggucuacagagugaguuccagggcagccagggcuacacagagaaacccugucucaaaaaaccaaaaugaaaaaaagaaaagaaauggccugggagcugggcuugguccacuggcuggaacuuguuccuuguccucuggccuugggaagauguggacaccacauuuuacaucuaggauaaaacaaggaaguucagaacauggguugucuccaaauccugacuacacugccugcugucauguuacccugggcaucacuauaugguccucuuaagguggucucuguguguguaugcuuuucauuaaugugacuguuaagaggacaugugagccuccuaagugcugagggcuggcuuugagcagcacagaacccagggaaagcuaggagcaggaucagcugccaccugcccugcuucaugccugcuggccaaaggugcuccccuccccuugcuagggcucugcuguaccccccugagaagauggguccagggccacacuuuuggcuucaagugccagugcuagccucuugccucuacccuugucucugaugccuggcucugggacacugcugaacuguggccuggugugacuguccccguggacugcacaucugugggcccuguguuuccaauucaguucucuuuaaguagcuggccacagcaguuaccaaggguccaucagucucacuuacccgugugcugggcuucugcuagcaccagguacaaugcugguccuggcuugcacccaggaacauggcacgcuccuguccuggaagucagagcgauguugauaggcguggucacauuggcaggcuggauucagagaugacugauaaggauguguccuuaucacagguaccuacugucuggcucaagacaagacuggcauuuaaagguugugcccuguggauuccagcuguagugcugugucacuuacagaguccaggagagcaguggggggggggggggucacauuaggagugggaagcaacuggagagggcuuuuaugugguuuucucaagacacaaaugaaagucucuucacccaagauagagcaccaaggauagaccagucgagcucagugagccagugaguuuuggggagguagcuacagggaagaaggaacaggggauuauuuacaagcccgugggugguucggaggcagcugcauccauauaucucccuucacagcugguaggcagcucggcagggcagagucuccucucuaccgcaauugugugcugcuuauauaaccuuggggcagcgggcacuugugaaucuuaaaccucgucaggcuuccuaaauuuccuucacuuugagucuugugaggcucccucggcgcuccgggaggacguguuucgauugggcagacauagaaacagagcugucucuucugggaagaggagcugcuuugggcgugcagugugcuuagcccagcuacggaaggguggcgucagaucccaggcccugcaguuccuccacuggcguuugaauccuccugggacaggggacacccugcuuuuccaaacaagauuugugucuuaaugugcuuuucugucacugcgauaaaccacucugaccaaaagcagcuugcaggaggagaaaauuuccuucgguucacacuuccagguuguagucguugagggaagccagggcagaagcugaagcugaagcagagacugcggcgggggggggggggggggggggggcggaauggauuauuaagcuugcccgcuggcuucugcuuagcugcuaucuuauaaagucagggguggcaucacucacacuggguugcacccacccuaauuacuuagcaaauaagaaaauggcccacaggcugggcggugguggcgcacgcuuuuaaucccagcacuugggagggagaggcaggaggccagccuggucuacagaguaaguuccaggacaaccagggcuacacagaaaccuugucucagaaaagaaaaaagaaaaaaaaagaagaagaaaaugucccacggacauguccacaggcuaaucugauauaggcaguuccucagcugcaguugucugccccgcaaguguggcaaggugacaaugaaaacccaucaggacacugucauuuaggucuuagcggucgggccuuguggccuauucugagucagugaguccuucccuccaugcaguguuugacugugcugucuucccaggagcugguggagaagcuagcagccccucccagugccugaguccuccuuacacuugccauccgucucucauacacaggggaggaaguuugucuaugcaggcuccaacucuggagugguccaagcgccccuggcauucugcgaaaagcacgguagcugugaagacuguguguuagcacgggaccccuacugugccuggagcccagccaucaaggccuguguuacccugcaccaggaagaggccuccagcagguaugccuaaggauggggcugugugccuaugccccaugcacaagccauagaguaaugugcgccugcugucuucuaggggcuggauucaggacaugagcggugacacauccucaugccugggugaguggaucuccuuugcuucccaccccugggcuggcaaagcucccggggcgucaguuccaugguuuuccugugcggucugucuuccuuucuccucucugaacagaagucaagugucacgcagcagaccugugaccucuccuuguggugaaccugugaucuuucucugucccuuugguuacagaaagagggcucaaaggcacacaggguguaucgguucacuggaaagcacacccuggcccacaccaugcuccucuguucugcuuagcugggccccguaaacaaaacuggagccugcuaggaaugagagcgaaggagcccuuggguaugaccagauagcccuagccuaaaaacaauacucaggaacagugugggacagugucaugcuucaagaugaaaauccuacccuagaaagaagugccuuaaacgcuaaggagauggcucaguugguaggaucugaguucgauccccagaacccauguaacagcugggcauuggugguucaugcuugugauccuagccccaaggagggugaggcagguggaucccuggagcuugcuagccucacacagccuagccgacuuggcaaguaccagacaaaugagagacuccaucacagaaaaagacaaagaggguaacugcuaucugaggaugauacucagauuucuggccucuuucuauauaaacacacauguacguacacacacacacacacacacacacacacacacacacagagcaaauggcaucagauugccuucaggcauguguaaaugucacacaaauuucauguguagcuuucaguccccuuccaaagauaguugucucguuuuauauaugcaaauauuuccaagcccaaagcauuuuucaucuuccguauuucagacaaaagacacaguugugguuaguucugguguccucuuggggcacccccuccugauggcuggccaucaggaaacggcugugaccagagguaggcauagaaucuugccagaauucuagucugccuucccagccccguacccccuucucugacuagccacaucagaguaagaagagggucccugguugcuagcuggccugcuuuagccauuagcagaaguauuugucagcugacugggugccacugugagggagcugagccgugcccagccccuuccucagccugcugaccuuucuccagggccagggugagaacagaaauucucagagcugucgccaguuccuucaguguauggaagggggacggggugggggcugcucuagggucauggaugucuuuaccuugguccugaagauugcaccuggcuccaguggguggaagucucaugccguccuguggguauuaaccuguuuuuugaaagcagucgagcggucagacggaguuguugacggugagcacguuuauuuugauguuccagauaagaguaaagaaaguuucaaccagcauuuuuucaagcacggcggcacagcggaacucaaauguuuccaaaaguccaaccuagcccgggugguauggaaguuccagaauggcgaguugaaggccgcaagucccaaguacggcuuugugggcaggaagcaccugcucaucuucaaccugucggacggagacagcggcguguaccagugccugucagaggaaagggugaggaauaaaacggucucccagcugcuggccaagcacguucuggaagugaagaugguaccucggaccccccccucaccuaccucagaggaugcucagacagaagguaguaagaucacauccaaaaugccgguugcaucuacccagggguccucucccccuaccccggcucugugggcaaccucccccagagccgccacccuaccucccaaguccuccuccggcacauccugugaaccaaagauggucaucaacacggucccccagcuccacucagagaagacgguguaucucaaguccagugacaaccgccugcucaugucucuccuccucuucaucuuuguccucuuccucugccucuuuuccuacaacugcuacaagggcuaccugcccggacagugcuuaaaauuccgcucagcccugcugcuuggaaagaaaacacccaagucagacuucucugaccuggagcagagugugaaggagacacuggucgagccugggagcuucucccagcagaacggcgaccaccccaagccagcccuggauacgggcuaugaaacggagcaggacaccaucaccagcaaaguccccacggaucgugaggacucgcaacggaucgaugaacucucugcccgggacaaaccguuugaugucaagugugaacugaaguuugcagauucggaugcugacggggacugaggccagcgugucccagcccaugccccucugucuucguggagaguguuguguugagcccauucaguagccgagucuugucacucugugccagccucaguccugugucccuuuuucucuuggguugagccuguggcucauccccuuuguccuuuugggaagcaaguaucuauuccagucucaaguccugcaguugcuggagcgcuuacgcaccugagcccuuuguguccugggggagagauggccaccuccgugggcugcgaagagccaccccuuccucuuccgauucuccuagcagccacucagagauaauuuaauuccagauuggaaacgcccuuuuaguuuaucagauugguaacuuacauccugcugcccagauggcacggacaguuuucuuucacuuaauuauuauuuuuuuuuuaaggauuuucgcuccuauuguguugaugucuuaggucauuuucuuuuuuucuuucucuuuuuuuauuaccagaggagauguuuuaauauucaugagaagaggaacauuuucuagauuuuuuuguuguuauauauugagauauaaaauauggcuauguugcuuaagauucucagggauagacuuauuuuuguuaacuucauucuuuccugcuguuaggaacauaggccuaaaauugucucuugaguuugcucacccuuuuguuuugguaggguuuuuuuguuguugcuguuauuguuucuaguuuuuaaucuuauucauuuugaaggauuuuucuuucugaacuuuuuaaauuuuuauauuuuccugccauacaucuacaaaguggguuuugagugagggcagguggcccaguggcuuuggguggcgacugagcuggucccacgaggggaggaggguuuauauaccccaugacccugcggcuucuuggcgccuccugcccaugaggaucacauccugucucuccuugcuuccaucucucaucacugcccuuggacuuccgccuugacuguccaugaaagacagaaauggguuggguaguugggcucccaaccucggauggugaccgcaacaucccgugugggcggccggccgcuccugcagcccgacucuccugccagugucuuucaggaugucaacgggugguacgauucuggcauuuguuucucgcucaccguguguggaacacucauuccauguagagggugacgaacucuggauucccccccacccccaccccgugccguguagacacucaucuucugcaugacaugaucuaccauucgguguaaacauuuguguuuauaagauuuacuuuguuuuuauuuuucuacuuggaacuguacacauuugaaaaguacccaaauaaaccagaagcuuuaucguugacugggccagccuuugccuuaguguggaggcugggggcggugggguguccuccugucccucugugacggcccuggguggggguugguccugggaucuugucuguucucaucccauguguccgguuucuugcuuuaccuucuccgucaugggaaugguucugacgacuucuuccucagugccuucuuuuguguccucugucucacagccucaucuccuaaguccuucccuccuccuggcuccucucuauccugucugggcccugacucaucuucucccagaagcccucggccggccuuggccucggggcccaacagccguaagcaggucaccuuacugccacccuucuugagugaccaggcgcagaaggugcaggcgcuggggaccuucuaccucuucugccaggccacaggugaguugaggggccugaguguccauggcuguccccucgcucugcccuugcuccuagcugugccugagguucagcugucugugcugaucccgggaucaacugucaaccgugcaacgcuguugcuagggcugccgaaggggucauccagccucucgccguaaagguacagguguugggucuucugagcauguaggcugcugugcccaauguuguaugucagaaaacuggaccuacagggcagcagagaaccagaugaggccacgauuugcuaaccuggguuagguagggaauucaaggccaaccccaggcaacuuaugagaacccugucuuggaguuuuaaaauaggaauuaggauacauccagugguagaaugugugacuaauguguacaaggucccagccacagcauaaauaaauacauaaaugcgugaaguccauaagguggagguuuucucccucugcuggagacuaucacauaaggacauggacucuugaaagaugguaguuuacccaaaccauucuuuagcucagagauacccauagccccaucuuucccugugggcuuuggccucugcacagaagugaggaauagaguugauuucaagacaaagcaaauccgguuuaucuuaaaauugcuuuuuaauugucgaagcuauggagaucuugaaagugcuauguguuuuguuaaauuagcucuaggaucccaggggccuguguugucugcugugaaugcaacaugccguuggcagcuggaggccccguggaggcugugggaggugggcagagguugcugcagaccuacguacccugacaugucaucagugaauacaugggccuugauggcccuuuugaguugcugucuuaacucuggcugcccaggcugcugacccuggacaccugagcuucagccccccucuccaggucccugggucuccuggugugugucacggugcccagugauucccauuuugugcuugcugcuguggaccaagccuucaugucgacaccuguucuuguuccucaguaagauauuuuaagauagaucauuuauuuaugcauguguacaaaucugugagcguauaaaggggcagaagagacgccuugaagccagagucacacaugauuguacaucaccugguguagaugcugaggacugaacuuggguucaacuuggaaccugcgagagaagcaggugcucucaacugcugagccaucucagcacgucucuaaggggcaagccauuacauuuaggggaguguuuuccaguccccgguauuauuagcaaggcuuucacagguauggguccuccggugugggagagggugaaugacuggggccuuccuuaaggaagauaagacuucauuguuagaugcauagaaacuacaacaucgggcauuucaacaagggggaauucgaagccgggaguuguuugcuaaggugauggggaaccuaggagugagacaggaaggugggcuucuccaaagacugcuacaggaagccaccagcaugggcagaagcaaaauaaaaccucacucacacuugccaggccucugagguugggcaugaccugcaaggguagccuugccggcaauguuccuaccgccgcacuccucagguaccacgagagacaggagaugcgcuuuuugaacuuuuuagugaccuaagggaacacuggaagccagggacugaggagccauggcuggggacugugggggccggaagugugcagggugugaguggaaacugaaguggaagagugaguuccucucaugccccucagagcggacugagcccaggcuggggagacagcucacugauuaaaguccuuacugugggaguguaaggacugggguucucauccccagacccccaccuaagugcuggguaggcuuggugacccaccuguaauuccaucuuuagaaaguggugauggaauccccagagcaugcuagcuggcaggaugagccauuuagcagugcucuggguuugauugacagaaccugucaccucaagccuuugcaugcaucuacacacacacacacacacacacgcacgcacgcacgcacgcacgcacgcacgcacgcacgcacgcaccaagucucugucuugagcagacaugggaccaaacccuuacucucccuuaccuacuuucuccuguccuuuuuuccacaaacauuugaccacacccggggccugucuuuucaguccuguccuccaccaagacaaggcacuuuagggaaaggcaccgccagccuggugauggcugggugggcuuugguggugugaacaugccagggccucugcuaucuuugagcagguggcagguugggucggaguuggcagacaaucuuaucugaagcagaggccaugugguuuugaacucaacucccuguaaccuuucuacaaaaagcaguguaugucuuugaggucugcugaggaggccaaagcagcugucccaggugagaccccaguuggcucuccuagcccaaugacaugggcagggcagggcuaggugggcagagcaaguugggagccuugaccugcguuuuucucucuccuaaaacagcuguuuguaugauuuaugugaguggcuuggggcuagcugauuaaaggccuagugcgcuguuuuuagaacacaagacuuaaagagagggugaacagggacucuucagucccuuggcauguguccugguguccgcucuggcucugcuggugacucugagcuaucuugggggagccucaccccucuagaggguugauuagaggucagauagacagcaaggcuuguacucaggacuauucugcccacuccugcuuccacccaggaccuccauguccucuggauuggaugaguguuuucccaguguaugaggcaauucagacgcccuguucugcauacccaagugagaugaccagggaagacaugaaagcugccccaagcauggcuguggggaaggucaggcugccuacagccuagagcuugcaggaacucccguuuaguuccaggaaaggcagcaggauccggcacugacuuuuccuccagucuuugugcccgggucugcagcccagcacugagguccggccauacccagccagguggguggagggcuggagccgcugcacugucugaccuuacacugcaguugcuuccccgugugcugauaucacugggaggugcauguuuauucuguccugcugccagcugccaaagguuggcauauguacagcacaugccaugccaacacacaccacacugugacauacacuacaccacaccacacauaccacauauaccaggcaccacacauaacucccaccacauacucuccacacauagcccccaacaccacacauauaauuacccacugcacacacaacacauuuaucccacauuucacauaacccccaguaccacaugccacacguaccacaucuuacaugccacacaccaugcaccacauaucacaccauacaugcuuccuuuguguaccacauauauaacaucacacauaccacauacacacuccauaccauauaucaugcuacacauacauguacacacuacguacucaguccauaaacacugcacacaucacacaaaccccauguguagcacacagccacaccaccaccacaucucaccuauaccaaauaccuacaucacaagucacccacacuacaaauugcccacaccguaaaaguaccacccaaugccaugugcgcacaaacccuacaaacuuaagacacuuaccucaggugcuuuacgaacagcauaagcaaauugcuuuuaccaagcgggguuccuaagcaagcaccuguacauuuuuggguccccucauuuagucccuguuugggguauggauucggggggcccuaagagagcugaggaauugggguaguggggacaaugaaagcugcuuccuuuccgggccuccuggguucugggcagcuucaggaucugggcucaaagaaacuuuuggggcuccuuucuccuaaugggggccucugugguggccagguggguggggcugggaaaagggagucccugguaccucccuuucucaaggagggcaggggcacaccagaaagugguuucccauauccaugaccuuuaagaguguccucaaccauuggggcacuuccucauucugguucuucaggggguggguguguuaaagaucacaugacccuuauagugagaugcagaacuggguggggugugccuaggguuccugcugcuccaauuuaggaauccaucauaaaugcagacaaugaugucuugagagcaucagccucauccuugagcaguaucuuuaguccccccagaguccagagcccagcucccucauucccagggccuguuucaguucacaguccuaagaagccacugauggcuacaucgucaucucucaagacuuccaggugcagucccgauuaccugcaugaugaggugccugggggcagagacagagaaagggccucaagcuuagccuccccucacagguaacagacaugcuuguacuuggucuaaauuccaggcuggccagggccaaauaagaugccaucugaacuagcagcugucuggacuaauggcaugugacugaugggggaacucaugaaaucugaggcuacgguaugagagaaguuucuagaaguugagggaagcuuugaaagagcccuuguggccagagugcagacuuguggggacugugcagcccauggggauaggugggucagaauccuucccaggaggcuuaguagucacuaacuugaugucaggaagagcccagcccgugugcaugacuaaauaccugacaaaagcgagucaaggggagguuuuaauuaugguucacagucugagucuaugaggaaugcagcaggggcaugcaccuauagucaggaagcaguguugcucaguuuguguuucaacauccccuccucugggggcaucacuguguagccuuggcuggccuggaauuuucuagacuaccacgucuuccaguucccagaaauccuccugacucugcuuccugaaugcuaggauuaacggugugugccagccaccauggccaaccucacaggcaugccuagaggcacaucuccuaggugauuuuagagugucuugagcugacaauaucuaccaucacaugaagguauuugaggcagguggcacaagacagaaacaacuguuagcuucagugaaccccuagcuaggacaugggugaaagaacucugggaaaccuguggaugggacgugccugggcaacugugaugcauagguccaguucuggguccgccacccagugccagauggcacaguacugaggggguggcaccguccacugcuuuuaaugcuccuucucccucucuuugauuucugcacucagaaggaauuggauaguuaaagaaccaacagagaguaaguaccucuucaccucucucauguuuuacagugaugccacauuuaaguuuacaggugcuguggugugggguuuguggccaaugugaccuacauguuuucaccccccaccacaaacuugaucuacaaacaaacaacaaaagcccggaguuaguguuucauguucauuccuugguuguaauaccucaagaguuaguuguuccaguuggauuguagauugauacccaacugcagaggaauggcuaaaacaauaugguuccaugaaaggcacugaguugcaaaggaaaugcuuggcccuaagaucuacagguaacacccaagauccuaccagcucugaauccaaauccacaaagcugcuccuguccuggaucuacacaggcucuguugugucauuguuccuuaaacuguuucacagcuguuuaaguagugucggcauaguauuaaguacuguaagaaauguagaaaugauuccaagucuccaggaggagguacauguagguuuucugcaaacaugucauuugauguccucagggauccccugcagauacuaagggaugacuccaguugugcuccccaguugauggacaucuguauacagaugugugugcgugcauguggaugcguucauauacaccuaaauacauggaguugucggcggcuagaauugaaaacacuugaguagaaagcaaauuuaaguccgcagggcuuguccacuagucugcagccagguggguaggcacaggugcuuccggaacacgagacuggcauguuccugucuuauguauguuuguuuacuuuuuaauuuuuuaaguuaauuuauuuuagagacagaaccuuagcauggaucucuggcuagccuggaguuaugagacuuacucuauagcucagguuggccuugaacuuauggugguuaacccucugucucugccugcugaguaccgggacuacaggugugcuucaucgugcccacucaauucugucucaguggcauuuuucaauuauaaaaguaacacuuauuuauauuuguuauucauaagcucuuggaaauuuauuuuuaaaaauucaagggucuggagagaugcauggguaguuaagagcacuuguucuuggaaaggacauggguuugauucccagcacccgaauuguggcucaggaucccugcagcuccaguuccagagcaugccaugcugccuccucaugcagguggugcauugguaacaagccagcaaaacacccauacacauacaauaaaacccauccccaggcugggagguauuuuaguggacaaagcacaugcugugcggcauguacguaaugccuggcaggcaguugcaguagccuaccuauaaucccagcacucccaaggugggaaagggagauccuuggagcaugcuggcuagccagucuggcugauucaaugagcucauaguauacuugagacccugcuucaauauauauauauauacacagugccaagcaauaggcgaagacacaugguugacauccaucuccaagccccacauguaugaguugcauucuguuaacccucuggagccucaccaagcacuguaugaccuacauguuuuucaguuugcuuuuuucugaaaucaguuucucugagaggguucuccugacugucagucacuguaguggcuuccuaccauuuguaugugucgucgucguccccacccccgccccccggacauuuccugauuguuacuaacagaaacaagccuguggcccuccaguugcauuaccgcuuuggagccgucccugggaugguccaguuguauuucuacuugauccagugugagaggaaagccugggacaacagcacagggggucauugaugagggaaccagaugaugaugaauagaggguuggugaagugaggagacuccaggcccaaaguuauaaacuaaaaaucucuucaaaaguccagucuguggggcuggcaugcuguugguagaauggucacuuaguaugcaugaaguccuagguuagauccucaguacuccaucaacuuguucaggggugcaggccuagaaccccagcacgugggaggugaaggcaggaggaucacaagcgcaaggucaucuuuggcuacauaaaguucaaggauagcuugggcuacacugagguccugucuuagaaaagaaaaaaugcaaccugucaccuguaacugaguagugcuaacucccugccugguaccauuccuuccccagggcaaguucucccacccuuggccacccacacacccuggcaucauggcggggacaaugccaggugauuuuaagaguucccagguucugccuuggugguuguuauuuguuguuauuuuuuguuguuuuuccugcucaguguuuugagcccagguggagauugcuauuucuuuucuccccguuugaaugucucccaucaagcgugcgugugugcguguguguguguguguagauggcaugugaagguggcaggaccuggcuggcugguccuuccuguccagcucagcuugguacaucacauaccugguaacaguagcugacaaaauguagcaccacgaggcugguuuaaaccauugggccaucuucagccaagccccagguagggccagggagugaaccauuuaugaguguagcugcuuuguuuugccuucuccuugguggauggagggcagccugcccuugcauggccugaagcucuggggaucuagggugaagucugagacccagacuauacauacccauaagucagcacuaacagggaagugaccuguugccaucacagcugguuuuggcacugugaccagaacugaaccuuucuuuaugauucccuagaaaugacaacccucagacacucuauaaggaaucaagggucugagguuagcccagccucuugcuggcuugcaguguguguguguguguguguguguguguguguguguguguguguguguguguguggaggguggggguauucuguuuugggucacagaccuucucuucuauuggaugcccugccuuacccgcuugccaagaccuugugugucagacaaguugaagucacccauggugcccccuuggauggggugugaugguaauacuuugaacagugugguagaaacagguagccuuagucuugaagacagucucauuauguagagagaccucucucuugaacucacagaaauccaccugccucugccuccugaguguugguauuaaaggugugugccaccacacuuggcuagucuuuaucuuuucaauaauuacuguuuuaaaaaagaaaaaacaagggcuggugagauggcucaguggguaagagcacccgacugcucuuccgaagguccggaguucaaaucccagcaaccacaugguggcucacaaccaucuguaacaagaucugacgcccucuucuggagugucugaagacagcuacaguauacuuacauauaauaaauaaauaaaucuuaaaaaaaaaaaaaagaaaaaaaaaaaaagaaaaaacaaaccuaagaaccaggcauggugagguuauacauacauauaacccugacauuuggaagguggagccaggcuucucaggaguucaaagucaugugguuccaugcggcucaaaaacacccacagaaaggguaccacaucuccugauccucaguggguacuucacuggggggaggggugcacagugcgacaaggagccagagguugaggccaugcaagugugcuagaggucugguggagaggugaggucuaaagguggguguggugcuuuguggcuuagcucuuccaggagggaccugguacagagcuggaagcugucccaggucagugcuauuugggaccaggucuacuuggggccuucauuugcccagcucccuugagucuugaguggagauguggagauaguccaugugcccgcagguccagcagauauccgauucauuugggagaagaacaggcaugcccuggagacguguguaccuaugcagacccaugcacugcccgauggcagggcccaugcccucagcuggcuucgggacaccauccaagaaaccaccgaauacagcugcucuguccucuccucagcaggaaaccagacuucaaagguucacaucacugugaugagacacgguaagugugguccacucuggcagcaacacgucuaggggcugacuaucacuauuuagccuguagacacugauauguagcuucaguguccuauuugccuugugcuagggaagacgacuuaauuuuucacuguuauaugaauugaugugcacauaagcacuacacuuguauguauguauguaugcauauacaugcacacauaucauagaugucaugugguuacauguguaagaccacuuacacagcgcauauacuauacacugcuuaccucccacuuuccaauaugggggucugaauuuaugucacuagaaaaggcagcugagcugaggcugggaagaugaggcuauugauaaagugcuugccaugccagaugggugugaucuucagaacccaaggaaauaacugaguguggagucugugaggcucagugaguaaagguguucgcagagcugagugaccuaguuugaucccugagacucacguagcuggaacagagaacugacaccaaguuguucucugauugcccacacacaggugaacaugagugugcauucucaauagaagaaugugauaguauaaaaucugggugugaaugguaugugcuugcaauccuauugcuggggagacagaagcaggcagaucccagggcucacuggucuaacagccuagccaagucagcaggccucaggaugcagggagacccugucucaccagacaagguggacggcucuugagaaaugacaucugggauugaucucucaccuccacuauguaugugugugugcucggccucccacacccuuccuguuccacuucccaugugcuguaccuuugcugauuuccaguugugcgacacuuaguuaccauaacaacagcuacucacuugggcauuauccuucagcugccucucagaagagucaacgugucacuuuuggacggcuuuuugaggcaauggcucacgcugaagccuaaacuggcuuugcugugauccucccaccucugcuuccccagugcugggacaagaggcacacugcacacccgcuuugggaucacuugucacuuugagagcaguuaucuucauguuggaucaagggucugauuuccuggguguucuuuuauugagccgcugguuuuuaugcaaugucuuguggcaugccucauagaacuagcauggaaacaaccauuuugaaagcuuguaucccuugaguguuaguuugguugaguacacagacaguccugacacaccacucuggcaucugaggguaccauuugcuggugcugggcccuuuaccugaucccuccccccgacuuuuuuuaagagccucacuauguauccugucaccuguugccuuuuuuguucucacuggaagcuuguuuucucaagcaguuauaauucaaaauggcuugguuuuuuuuuuuuuucccacacuuucccaccagcacauuaacuagaaagccuuugcucuccugcuggggacauuuucuugacucuccaucaacucuucaggaucguuuccaagcuaugagaguugagccacuucccuaaggcaccaacuuuuccuuuccugucaucuuuuuuggggggugugguggguguucaagacaggguuucucuguguagcccuggcuguccugaaacucacucuuuagacuaggcuggccucgaacucagaaauccgccugccucugcuucucaagugcugggauuaaaggcgugcgccaccacugcccagcuccuaucauuuaacuuuucuacuuccucaugcauuuucucagucuuaccuuccaaacuaucagaucuuuuagaaucaaaguuuuugguuuuauugcauuuugcagaucuucucuuugccugggagaauaugagcagaucucacccuccccauuuccuccuaaguuguccuuuucagagcaugggaucuggaccaaguagcaucagcauggcuuggggcucccuggggagucaguggucaggacuguggcccccagugcugauggaacaggcuggugcucagcucuucucagcuugagcuacaaucccugccuuccccuggcucuuacagaaugcaagguuugucuccacagagcugggacucaaagccuagcaucaaagccuagcaguggcccagacuuagaauagcuaaccgagcacagcaaggcuuaguaguuggguuggagauguagagacuuaagugggaagagggcagggauuccuccuucaguguugacuguccacuggaccugucugcuacaugcccaacccaagagaccuuuuguuguaugcuagggcagagugagguugucacugguugggcacucuuuuaagccauauacaccugggcaugcuaacuccuccccacuccccuuaucuagaggacucacucagggcuauaccacaggccuugcugugcaguggucuugggacagcagccaagucucauagcuuugcacuuuccagguccccugcagcuucgucuaguacucucuucgugguuuuacacacaaacaauaaaaaguuccucugcugucuuuaguggguucuacagaaaacagaucaccuuucacggcugagcaaucuggccugguacuuggcuauugggaugaaccagaguuaucagaaggggccaagcagcucacugggaguuagggcagcacuagcaacagcuacaaagucacccugcacagcgggaagugauucuuuguuaguuggaggggcacacacugcucaguugugcuuucagaaucagccugcaggguucccaaggaucgcugggaagaacuggccucuccccucuccuuuuggcuaguaggucagagcuuuaagcaggggcugccauggcacucugaaugaacuggggccuucacguuggaugggcucguguucauggcacuauuucugacauuggcaugagcagcaguucucacucuuguaugcugcuggguguuuucagaaucccaaagaaagcuuaggggacuuaggggacugugaugguuuguauuaucagaaguggcauuauuagaagguguggcccugugggugugggcuuuaagacccucucccuagcugccuggaggccaguauucugcuagcagcuuuuagaugaagauguagaacucucagcuccuccuacaccaugccuaccuggaugccaccaugcucuugccuagaugauaguggacugaaccucugaaccugaaagccagacccaauuagauguuguccuuauaagaaaugccuuggucauggugucuguucacagcaguaaaacccuaagacaggggaccauggagaaugagaggcaaggaaaaucucccucaaccuccaaaaccuagccaaaauccuuccugaaacccuaccaaguuugguaagagcuaugcugaauucugagcuucagcaccugcaaaguggagaucucuggcaccugguacagccaugggaauagggccucugacaucuaggagacgacaauaggcuguggaggacagauccacuggagccuucgagggcaguuaccagcagagcuguggccgggagaaagggggcgaguggagggagacacggacugugugguggcauguacuuggaauccuagaaaugaaaaggcugaagcaggaggauuucaaauuuaaguccauccugggauacagaaugaguccaaggccaagucaaucaacauggcaaaacuguuucaaaaaaccaaccaacuaguaauggaaugugaaaccccugcuccccagagcucugcuguggcccauucaggccacugaggggauuccccagugggacaggccacuaaagcagacgagaacugggauccacccgcccagccuauggugugguccuggacagugugaaccaacagcaacccggaggcugcaaagcuauggccuugacucugcuugucuuccagaggcacugcagcaggaaaaguggagccaggaacuugcuacguggcgugcuguggccggggagcaugacaggcugaugcagggcuggaggaaggcauggguauguaccuggccagcagggagcuuuuugcccacugcucuuuggacacugggccccucugacuuccucuuagccuacagacaaguucugcuucucuauugccccaagggaauucugggcuguuacugaggcuaguaggaucaaggauaugacaauguuguaagaggagaccaaaacacauuuuaggucacguacaggccaguagcuuuuuccuaggucccaaggcugccccagccccuggaacucacugcuuucaugagagcaggagacuagcugcuguugaagaacaugggaaggugggacugucacuacguacaagcuuguggaagaggcuuccucaggaagggugcccucacauaggcucaagucacugugcugccccuuggcuagauuuacccugcgguuagcugccacacacaagcagggagcucuaaccuuggggaggccuaaguaugugcaucagauaacugccaggcugucacagugaguguugcuaguccucucaucagagcccaugcaaaucuccccuccaaggguccucuuugacacuaggagacgccaaucaucucagccauugaccacagccucuuucugaaggcuaagcagcaugggcucauaagcaccugucugaaacgagagcacacagugcugccuuugucucaagaguccugagagauggggcuggagagauggcucagccugacugcucuuccaaaaguccugaauucaauucccagcaaccacaugguucacaaccaucuguaaugagaucugacacccucuucugguguaucugaagacagcuacaguguacucacauauaauuaauaaauaaauaaacaaauaaauaauuuuaaccccccccccccaaaaaaaagagagaguccugagagagaccacuugcauacucuuaacuugacgcccuggggguugggauggggggggguuuccaccauuccaccccagagcagggaaggccuagucuacugggccaaucacucagaaacuaccuugaauucuuguuuuuguucuguaggaaagcugcagcaaggauaccuucuagccaccagaggcaguucuggacugaucccaagugaccuuguugacaccagcugcagacguaccugaugaacgcacagcaccuacugcaccaagcuauugugucuuggcuggcuccacacugccauucgccacagccugagugucccuuccuagaggcugggaaucucuaggccugaaccccaguaggccugagacagaacaagaccuuucuacauuagcucuuauguagcagaaagaucagucugccuggcagaaacagaaggcuccucacccaagcagaugacagagcagcaggucugucaugaaggcuaaccggauggcagacacccugcauucuccccaggacuucccugcacuccugucccucccccagggccagaacagcuaaucuccacuccccuucuguagaucuaacucaagucugcugcuguggccaccuaggaaacagguuguuccaggggcuaagcugggauaggagaggugggguccaugugagaaucuuuugccuuaaaccuugagugacaugaggaaguugcucuucgcuuaucucagagcccaaggcuguuuuccaaagcacagugcuucccacccguuuacccugucagcgcuccgcuucugagguagaaaugccaaacaggccaauuaugcaaaccuucaggugccguauuaaacuguuuuccagugcugaguuagcaugucucuaggucuuuauaguacaguuaaucuuugaagcuugugggugugugugaccuggggagguguggcccaagaccuacucagccuuuaaucuccacagacaagucucuucuugucaaucauaaaaccuaaaacucuguucauaaccaagccacgcccuucuaugauaccuggagacacugccuugcucagccugcucaauguccuuucuuucugggacaaaugaaucagguaagcuucaaggugugggauuagcaggucccucuuggggccaguucugggcagagacagacacacugauggucauguguacugucuucucaucuaagcacagccuggccccuggucacucaucuggcuaaugcacacgagccaugcuugcagcacccucacacccuuggaacagaauuuucuugugaacuacuuucacugguuguauuugagguguggcuugucauugcucccuguaucuuccaugaagacuggauuugucaggaccugucuaugacacaaagcaaucauacacugagguggcagaggaugcucgggcaggaaguauguuuaguaagauucccugcucagcugcaacaagagugggcaucugcacuuguguucagucuggugcucauuccugugacccuguccugggcaccccuggcacagugggcccaaggaagacuagcugacuucaccugaagcacuggccucugcaggagugccaagagagugauggcacaaccagggcaccccaggagaggaugugcaaugucaauggcaaggauuucuggaggcagaaugagaacucagaaguccagcacccaaggguucuugugugggccaggagccuggacuagcagacgugcgccauagaugaggcagcucggggcaggaagccuucaaaucacaagacauuucagaccagguuuuguuuuuguuuuuguccuaucaaauuucaaaauucuagcugcuuaaugcagcugauaggguucuuuuaaaaaucccuauaaauucauuuaagagccuuuuuuucucaaagacucuauuucuaaacuuacuauaaccagcuuguggcuuacugacaugagggggagaaaagcugcugaccuaauuccaccaaauccaucccaggcugccacaaagucaacaacagggucaaccaggggugagaacuagccguaggcuccgaacggcaggccacugggaugccguucugacccagucucccacuuucucugcucggcacaagccgcucuguccucagaggcuauguugagugcagcugcauuccugacauggggcagacucgggcaaaagagacgcaaaggucuauuagggaugccauagucccugggucuggaacuggguaugaugacugggcccgucacaccaccgcagugcaaaagaggaccaagucaguaaggaacuccauugcuaaccugugagacugauaccacucaccuaagaucacaauagccugagaugaaauuaaauaaucacucuuuauucaaaacaaauaagcccucuugcuugcaggaaaauauguuaguaagcucuguccucuaggacagaaacacauucauccuauguucauuaaaaagauuuguagacaccaaacugaaaucuacaaauuugauauauacugcuucuuuggaaaauaaaaacuaaaagcauu

SEQ ID NO: 7039 - RNA, 45195 nt, Mus musculus
cgucacuagcucgcgccgcgcacuauuugacacgcugcgacccgccugccggaagucggcugccugaccauggcgacaguggcggagcagugggugcugguggagauggugcaggcgcuguacgaggugcguucgccaccggagccucccgcgagcccgcgggcggaggccuagcgaucugcgccccggguccgcagugcuuuguguuccccgggagcgcggcggacagggucuuggcuguaccugccuccuggagcccggcagggucuugggaaagcagcuccugggaggggugccgaggacacgcaaguccucagaacuacaguuggaacugauggcgagacggggucggugggagugggaggucuuaggugugagaaaugccuucucaucuauuguaaacuuuacccaggguccggagagagaaguuuaaguuuagaauagcagaguaauagggaaaugacgaguauggaguagccuauccuuugcccacaauuucuaugcuauaagcauuuaacuuuuugaaagauuuaaaaaaaaacgguugaaggucuugagugguuucauucagcuauacaagacaauaugaaauccagaugccggucuugggagaaggcugauuugacaacugagcuaucuugcuguauccuauaggacauaucugugucaucucucucagagacuacucauuacagaagucucuaaugccgcguguggcaaugaauuuguaauugcauuuuaauguaaaugucguuggccaaauaugacuaguggguuuguauuggaccacauagauccaaaacuuggagaucagacugagcaagccgacugaucacagugcagagagaagucaccuucauugaaagugaauuucaguucucuugcuaacauuccuaaaguugcugcuuacuaggaccaguaaugauaaugcuccaucauaagagcuaccugaaauuucauuaugaagaauauucgagagagcauacuugauuuuccucgucuauacugagguucaauauuaagcuagcuauggcuacuaaguuacucaaauugacauuuuguuuaaaaaacggugagucauuuuuuguuguacagugugacuucuuacuccccaaaaggggccaacacagacuugggaaaauucuuggugcauugcauuuacugagaagagagagaaacaaaaacaaacaagcagaaauauaaaaacaaaacaaagcaaaacaaaacccagugcagcuccugaugguuauuugaguaaucccuagacggguaguuuuucaucuaaggguaauuucuuugugggguugccuuuuugugggguugagcagauguuugccugcagucauccaguuacugaaaaaaaaaaaucaagauuauuuggaguuauuccuaacuuaauuuuaagaggggucagcaaaauuuuuaauucauacuaaagagagauuucuguucuuguucucaguuucuguauauuuuuguacaguuuugaugucacuauguaucccugaaaaguaaagaucuguguauucgaguguguguguguguggucuauuuaguuuuagcgguauuuucacauuaacuugaaaguuugucugugauucugucagcaguuuuccagucuccauaaucuggguguguuuuuguuuguauguuuguuuguuuguuuguuuuaauuauggugaaauaccaucauucaugauucauugguaaucuguuuuucuauuuaaguuuguaaguacgcaucugcauuucaagauaagaucuugcugaguagccuggguucucugugaaugccaaaugcccccggaauuucaggcauaccccacuaugccugacuuauaaaugccugagcuugcggguaugguggcucauuccuucggucuagcacuccugaucuacagagugaguuucaggccagccaugacuacauagugagaccugucucaaaaacaaaacaaaacaaacaauggccuggguuuguauuuuguuuccuuuguugcuguuuguuugagauaggguccaacuauggaggccaucuuggcgugaaacucaaagaucugccuucaugugcuucucaggugcugggauuaaagugauaugccaguaaagggaugaacugucacacccagcuuaacaugguuguuuuaaaugauuuuucugguaauaacccacuggaauagaguaucuagcacuaacugacugauggguuauuggugugucuagauucuucuauguaaacucagccaaaccucuauccugaaaauagguagaaaacaagauacuagaacagcuaagagaccaucucagcaguaaagagcacuuacagcuccaucagaggaucuggauucaauucucagcacccacaugguggcucacagccguguguaaccaguuccaggaguucuggugucugcagguaucaggcacccaugagguauacagacagacagaauaccauacacaaaaaauauauuaauaacuucaaaugaaaguaaagccaucuuugugccucucagcauggaacagguuggcauucuuugaacaacuuauagaacagagaacugaguuccuuuaggcauuuguuacugcuaccccacccacauuccacacugcacugucucuaagauuuaaggagacugagccugguguggugacgcacgucuuuaaucccagcacuugggaggcagaggcaggcgaauuucugaguucgaggacagccagggcuacacagagaaacccugucuugaagaaccaaccaaacaaacaaaagacagaaaagaaauuauuuuucuuguuuguuuugugucucucucuaacagccuucacaguucuggagcuugcuuguagauuaggcugguuucaaacucaggagauuuaaggagauuuagcuggguacaggaaauacagugagguaugcaaaacugugacuuauggaagcugguuuccauaugacuuaguuaacuuaucugugggcgggcugugguggcagaugguguguucagguguguacaguucucuuauagucauuuccugcccaucgaaguuugaauuaucugaaagauaagagaguguuguuuuaaguguugugauuguaaggcaggucucagucuuuucccuuucuguuaaugggagcuuuuaaagcugacaguguugggguuuuuaugugcuggagugauugucuguuaaaugggaaaggcuugagagccauugaggaagcucuggcugugagguuugugugguaagaaugugaaggucaggagaggcagcacuguggugggcuccauuucccagcagacuuugaagcagcuucuuuggucucuuuacuuugucuugcucuucucccucacaggcuccagcauaccaucuuauuuuggaaggaauccuaauacuuuggauaaucagacucguuuucucuaaaacuuacaaguugcaggagcguucugaucuuacagccaagguaagaaaugaagcuuguuucacucgagguauguuggugcuacaucucagaaggacucaaacuggacccuguagugugucaaaaugcuucaugaagggagagcuggggguacgaagugucagaguagacgugugagcuacagugaggaggcagcagccugcucagaugguuugaggaucacaugcgcagcugcuguacuucagugucuacacacaggcugggaguugucccugugucuucagaaaggaaguucagaguuggaaauaaucuuaccuacguacauucgaaguggaauuuugauauguuauguuugcuagggaagaggagauccugagcacagaauuaagauuuuaaguugucauguuacccaaaaacugcauggaaaagagguuugagcuguggugggggaaggugagggagguaaguacgcugagcucagggaggguggggagagguuucugugcagcacuguugaauguggcuguguuacaauguugcaguaaugcugggcugcacucuaacaccaguucuucugcaggaaaaggaagaacugauugaagaguggcagccagagccccucgucccuccagucuccaagaaccacccugcucucaacuacaacaucguguccggguaacuaucugcucaagcccgggaaauguguggcgucccuuguuaagacauuugagucaccgcuguaguuuucagaauuuucaagggauggcccaggaaucuuuuaaacucuaauuugggcuuaucuuuuuguuuuucuuuaaaaagcaaaucucucuuccccuaacuugcacucuuguuucuugguucccccuuguucugaguuuuuauuuuacaacuggugguagaacuaaguacuggcuauaaauacacccauacuuacuguccccaggaccacagcauucucugucaggucagguccuugguaccuggcagggacagcagcaugcuguggcccucuacugugucucggcaccuagggugccugcagccggggcccugacgcugcgugccccagccuuguuccucccuucccuacuaauucuggcucuggcucuguugccguuaaagaggccagugcugugcggcuauguucucuuucuccugcacgucauccuuggcuuacaugucgguucucucaggcaguccacaguucaugcgcauuuuucucuaggacucuucaucuccguucacucauguuagccaggaggguguucuuuacuuuuuucuagaaccuucuguccuuccccaguccugcugcucagagacuccuuguaaucuuaccuaauggcuagaaaauuuggucucucuccuauauuggccucuuucucucuuccuuccucucuuuccuuacccucucucuguucuuagagagcuaagugggaggcagguacacacauccaguguguacauaugcaaauguuugcaggucagugggccagugccuuucucugccucucuuuaccauauucccucaagacaguaccucaccuaguauacagcugucacugguuucuggcgaggcugccugauccagugauccuccugccugcacaaaacucugcucugggguuauaggcacccucuguucuaggccucacuuaaauuuucuccuuuauguaauuagaggauagacagacagagucuggaacgugucucaugcuuaucuuaaaauuguguuuauuucacauauguacacucugcugacccucgcugccuguuaauuuuuccacaauuuuuauuaaagccaagagcauugcuugcauuguuuacaaaagcaaggccuggggacacaggaguuccagcuauucaggaggcugaaucagaugggucucaaguucaagcccuaccugagcuauagagugaauuuaaaacagcccgucuccaaaacaaaaauugaaaugaugauaaauggucugggguuguagcucagugguaaggaauuaggaggcgacaacacauuagguaguuuuaaauguuuuaguuuuggugugugugugcgugcgcgcgugcgugcgugcauauaugugugugugcaugcgugcgugcgugcgugcgugcgugagagagagacagagaauaugcaaacguguguguaugugugggugccuguggcggccauaagagauuguuuggagcugcuaaguauggacacuaggauccaagcucuggucuucaccauagagccacaaguccaucacugcucagccaucucuccagccuaaccuacagagauugacuuguuuuugugguacuaauuuggaacccaggccuugugugugccagcugaacuaagacccugucugaacugauguucucauugaugcacugagucuuacugcaguugaugggacuccuguuugcuuuaguucugagaugacaugaaagugccacuuuaguuuucucuuuuaaaaccugccuuacugagcuaucuacagagcacagaauugauucuuuuaaaaucucaguuaaagauaaauaggcaguuuucauuguguuaacgcagguaugccacuaucaccaguaucuaaauucuggagcauuucaucucuccucaccucccucccugcucccaggcccugacaauguuuaucuacccucucuacugacuaggcauuugguaugaaagguauucuggguuuuugguaugaaagaagucaugcaaagggugacauuaagcuuagggccuuuggggccaucuuugcuauagcaguuaucaguguguccaccccucuuuucugugucuucuaauuuuuaaagugucuuuuauguuccauaaagucuggaagucaccuuuguguaugguuucucaacguagacaauagaaaaacccgauagcuugugggucacaugcuuuaccaagucugagcagaugcacaguugucagcaugccagguucccaguggucucugccuuccugccccagugcugagcccaguguuaaccuuccugugagggaaagaacuucccaccucuuucuaaacgcacugaacccuguguggacuucccacuucagugucauuacugaaguuugugagauuuccuuggaaacccuaauagaauuuucauuuaagcaguacuuucagaugaacgucauaccuuccuuaauauuuuucuuaguauugcacauuuuauuacauauuucauaagcuuuccacauugguucuaguaguuuuaugagucuggaguccaugugaugugacccaagccuugcaggugauaaugugacugcucuuguuuauguagcugacuucugcacacagucccacuauacacaugguaacauuuugugauaagcugagcaguaagaaaauaaacagcuuugguuucuguucuuagagaaugccuucauugucuuccuuguuaccuacguauuuuccauauagugucuuaucugugugaauaucuccuucugaucuugguuuaagaguuuagauaucgaugcugaacuuuguccaauguauuuccauuucuguguuuuuaaaauugaguagucacacuugggauuugccuuuuugcauuuuuaagaugcacuaaucuagugauugauacguguuuacuuuucuuuaguaacaauccugcccuuuucucugauaccuuaggagcaggcauucagaauuguguagaucuugaauuacacaguacuugcuucuuccuuaagagagagagcacugugcguggccugggacagucucugcuugcaccacucacugggaaaggcgcagcucugcggccuccucucugcucaggauggcccugccccugugggacucguugcucuggagcuuuagagguuggagaugagggacccguccuuugugaguuccgucuagcugcagccugugcuuuuaaugugugcuggaaaaagaguuggacaguuuuaagcagaauuuuuauuguuuuaaauauguguguguacaaauacuccuguguguucacgagugugugagagugcaugugugagugcucguaugccuguggaggucagaggacaacugaggggugaguuugagauugagcucaggucaucaggcuucguguaagcaccgugaccacugagcugucucaccagccguaauacuugcucuugauaccucgauaccugagcguucucaacuuuuuacuuugauuuucuuuaaggguuuuuuuuuuuuuuuuuuuuuuuuuuuuuaaagaacacugcuuuccuugaacugucuuuuuagugguuucugacucauugccuugauuagggaaguauguuccuuucugaacgauucuuguguccuugcugaguuuggcuuugugucuuuuacucauugaauaucaugauacacaguguugcugggcgugguggcacacagcuguagucagucauaacacuuggaaggccggagcaggagggucaggagcucaaggguggucugggcuauauaauaaguuugagaccaucuugagcuacaaagucaggcccuacuccaaaauaaaaaagaaaaugccauguuucauaguacuagguauuaugacaugugucuuuuagaaauuuuauaauaaaguaaacauuugcuuuauuucaggugucuuguauccauugcauucauuggugcucagauauuucaucucagauacuuugugucugcucaacugacaaguggaagagaguagacaggacucccucccucccucucucccuccuuccauccacugccacaugucucuguuuuguuuucucccccacucucugcuuucuggucauugcccuuuugaauuuuuuccuacucugugucccuuugugcucuuuuauauuuuugugaguuuuuuuuuuuuucuuuuguuuuguuuucuuaauacaggaucucucuauguagcccuggcuagccuggaaaucacuauguagaccaggcuaaccucuaguugacagaauuccugccacuuccucccaaugcugagucuuuguccauuuuauaugaucuaguacaugucugugaauuguuuucagauugucucuuuucuagcuuuucagaauuguguaccucuuuccuucugaguugccagaucugcuuaaacauaaauaaauauugucccugagugcagugugccaguucucucuggcucaccauaaacacagccaagcagcagugcagcagaagccacagcucugggcacagaccuuuuccucacucgggcaggcgcuggauagcaucguugcguuguguugcguugcauugcguuguguccuuccgucagcuaagggcuugguguuugucuccccgagagccugccuccuaccucagcugugcccccauucgguucucagauagccggcugcugugagaaagggugaggggaccuuucaaggaucauuaauucagagugagguauucuucaauggacugcuaaagauaacauuauaaaacacuuuaagaucauaacucauuuugccuauucuugccuuugaucuugaucauuuuauauuucuuccaucauuguuuuauuaauaguuuuagacauuuuauuuaacuacuuccuccuuuuaaguuuuagaauucaaagauuuaucauucaucuaucuccuuuuuuuaaaaacagauuuuacauuuauucuuaauuuacucuuaugaauauuugccugaguguauguauguguuugguguguauaugcaccacaugcauacguugcccauaagggcuggaagagggcaucaagucuccgggacuagaauagaagcagugggaacaacccaucuuugcugagaaccaaacucuagucauccacuugucuuucccacaaucccccacuuuuucuguguuaaguuguaagggagcguauuaaagaacagagcuaauggaaaggugucugacuuuuaacuuaccauucucugacuuaccagaaggcacaaaggaaagggguggagagcaaauagggaaggcuggcgccacagccgugcugugccugcugucccgugcccaggugggugcugaaguaaaccucuccccugucuuuuccccagcccuccaacccacaacaucguggugaauggaaaagagugugucaacuuugccuccuuuaacuuccuugggcugcuggccaacccucgaguuaaggugaguaacaaugaaugccgaaguggcugaacacacugcuagccagagaaaugacaugaaagacucgggggucaucagagggggacagcguuucacaguccugugucugacagaaucaaaucuggacuuggaccaugcagaacgcucuggugggcuuggugugggugacagccagagcaccuaggacaccagagcuggguagaaguccgagagcauccuagaaguugccccagcuccuguuaggaucaggacuagcagacauccuccaggaaagucuggcggccauugggcuuuuagaaguaggcaaaugacaccucacccuuccuucagucuuugucuguuauuaaacccugguagcauugcuguaguuacaagaaggaagggaaagugggagcagggagaaggagccauguagggccaagaauagggaggguggucugcacuguguacaggaagucauugcauguuuacuuccauacaggccacagcuuuuucaucuuuaaagaaguacggaguggguaccugugguccucgaggguucuauggcacauuugguaagugcauuuugucagacuccauugaggagucuuagaaguauucuuaagugucaaauugucugugagcacuuuucacuuaguuguguuugggagcacgggugggacauagcagcagagccguaagagccagaggaugugcaguaggcucuacuucccagcgcauggugcuaggaacaggcuuucaguugugcauggcuguuguuggaugaaagggccaacuucuggggcuccaugucuagugccugcaaaagggcaggcaacagugcguucccgcaggacaggcagcauugcaccucccuuucccaccguccacuggcaagaaguaacagcaggccacaucugauccagaggcagggcuggcagagagcccugggcaacaaguaccauggagaaagugggaacacauuggcuagguuguggcuguagcucuucucuuuguaugaugaggguggaggucaccagugucugugugugagcuccugcucacauggcagggucagaggccugagcucaggccagucccacucccgggcagugugggagaccagucuaaggcuggcagagggcucgcuugguucucacuggcagggaauuguuucuuugguauaggacuagaaaacaggaaggcugcuuuuuacuggggugguaggcugucaccugguuuacaaggcucacucucugugaguuugccagcauaaagaagcugcuuucuccucuucuccuccucccccucuuccccuuccuccucuucuccucccucuuccuccucccuccuccucuacuuccuccccuuucuccuccuccucuucuccuucccuuccuuccucccucccuccuuuccucccucucucccuuccucccuccuucucucccuuccuuccuuccuuucucccucccuccuccuuucuucuucuuugccuguuuggauuaaaggugugcuugcaccuuuaguccaccgccaccacccuaaccagaaacuacuuucuuccaagucucuuuugucauguggccuugauugcugcuuaggaguuaaucugggaagacagauaagguacauugcuauaucagaaggauuucccagagcugugagagugugguuagaguacccuguucucccuggugacacucacacacuagauguggucacuuagugcuccucacugaggaacccaguaggagguucagacuucaggccuuaaccuaccugacccucuuaggaagccuccaccgcacccuuaaacagccauuucuuguuagcucugcugugggcuucucuuaagcacacacaguugacguccauaugugugcauuuuucccauuuuugcaaaaauaaaacuguuuuacauguucugaguccuaauuuuucuuugcuuucuuuucaauuuuuuuuuauuucaauaguuuuguauaguauauuuugauuauguucccucccccaacuccuccuagaccccacccaacuucaguucauuuucucucaaaaaagaugaaaaggaagacaaaaaaaaauugccuaaacaaagcaaaacaaauaaagcccaccccacucccccaaaacagucugauuuguguuugccaacuacaccugggcauaagccccacccuggaauguaggugcuauacaagugacaugccacuggggacaguggcuuuuuuauuuuuuauuuauuuuuauuuuuugccaaacaggugucaguuacaaauagcuucuguagauggggugggcuauaauuuuuguugguauggauguguuuggguuuuugugacucuaggguaaagccacacacagccuguguguucugggcauacacuuguccucugagcuguaccccagcuccacaaaugaguauauuguaaguuuaaauggccaccagaggcauauagugaauauaaaguuuuagagauccuuggagaggacuuuauagaucagucacucccucugucuaugacugaaggcucauuugagcagggcugcaggcucauguaaggacccucuucuuuguacuuguuagguuugcuugaacucuguagcucagaacuuagcauuucuuucccuaaccacaaagguugccuuuaauuugaccuucccuccuuuguguacauuuaaacaucuguuuucaaaguucacucccucuuuuaggucuucucuuaccuuguagacaaugaacauaaaccccuuauagggaaguaacuaacucuccuuguuaaagcauccucccaggccugugagauggcucagcaggaaagggaagagagaacucacucucuuacaucagauccugacacaugcacacguguacgcacgcaugcaugaaaaauaaguguuuuguuuuguuuuuaauucuuuuugcccauuuucugcaacagaaaggcuguagagcaaugaccaaugaccgaggaaaaguuuauguaaaauguggguaauguggcccuucucccagaagccugacugagagaacugaacauugaguucuuacaauggucagcacacaacaugcaugucauguguagacgccauacagcaaaucuacucauuguacugcugcuauguguuguuaaugugguuuaaacgccgcuacagagucaugaugccucccacauacgucugugugguuugggccgagagcuucucccuccagggugccuagaccuguguguucaggagggugugauggugccuguugguucuagcguuucccuguuugccuccugugccgcccucugcugccuugggaguggucuaaugcaggugauccucccuggcuucugggucuacucugagucuaaagaugucacuguauagcagugaaccuccugugguggucuucaaaaugccugcucuuugugagaguagucaucugggcugccgcugagagccaagaacucguguucuucagacuccuagaucaaccgcugcuuuucuucuggucuuaagauuaugauuuuuaggugaggguagcaccucuggcacauagcugcugcucagagcauuucaguaagagucacaggauccaagcauucaucaugacauacauaaguacuguugguuuuacuuuuaggaaaaaguaagugugugcaugugucuguuuguuuugagucagguucuuacuaaguuguccaggauggccuugacuugggaucuuccuaccucagccucccagguagccaagcuaauggcuccuauaucucaggaguuccaaauuuccacuuauuugcuuaugugugggaagggcguaugccacagcuccuauggaggguagaagccaguuugcaggaauuaguucugccccuucaccauguagguagguucuggaaaccaaauucagaucaucaagccugguaguaagugccuuuaccugcuaagccaucucaguggcgagggaauuuuuuugguuuuuuuagaauagauuuuuuuguuguuguuuguuugguuuugguuuugguuuugguuuugguuuugguuuuucaagacaggguuucucuguauagcucuggcuguccuggaacucacuuuguaaaccaggcuggccucuaacucaggccugccucugacucccgagugcugggaguaaaggugugcgccacccaacugggucaugguggcacaugucuuuaaugccagugguacagaggcaggggcaggaggaucucugaguucugggccagccuggucuacaggauagccaggcuacacagaauaacccugucucaaaccaccacuuccaaccacaaaaagaaaagaauaguauuuauauaaacauagaaaguucucaauagaaaaugucauaaguugaauuugaacuauugugaaguuaguuguuuccuaggcuuuccuuuggaaaccaaccgacagggcaugcuguuucuucauuguaaaugaagccagacaagcggccuacagaaaauaaguguuaacuacuaugaauucacauaacuucauuaaaagauaagggauaaccggacuuuucuuuuuuuuugagguaaaaccuuuucuccuagauauuaguuuauugaacagucuuucagagcuggguacuguucugaguguuuauugacauuaacuugugugcccucccaguggcccuuugaggaagauguggcuguuacaugcuugucagaggagauaugcgaggcauggaaaagauucagacuuguguggcuguacacccaaugaugggugcccagccugaaccuagaaugaugggugcugcagccugagaucugggauaucucagugaucaggccuccuuucucaggcucuggugagguuugacaaaggacuggagggucucaaagcaucgauggcuuuagggaguguggagcacagaccuccuaggacuggccucaucucugcagauugaaguuauaaaauguagcuuuugaguuguacuccauguguaguuggagccucacuggccuggguggauguacacagaagacagggcugucagcagucagcgaacagcaccugguaucuuuccugcugcccccucccuuggaugggaguguguucacucacaagccaacaucaagaggaacgaguucugcacuugcccauguugacccaucacagaaccugcucugcaagacugacgccauccaaaaccuguguuguuagauagaagggaaggccacagcuucugaaacguugaggauuaggcaaguuguugauuucucucucugauucuccagcccagcaugcugcagcuagcuauaugugaguggccaucagugagccaguggugagcaugcucuccuucaucugaauguauguggguuuuguagcacacagugaugagcaugcucugacacaauuucuaucgcugggggccuuccucuaaggcccugggacaagcccugguaugggccagcuucucggccccaucucucaacagugacaggaaucuggagaccugaggggcccuuucaguguuaguaacaguauuguaucugcuucugaagugacagacugcauagcaucugaaauggaguucucaaacaggaacaguuccccauggcccgguagccuggacuaaccccuccagccgaaugcugaaggguaugguagacucccaggcagaggcaggguuguaguugaagggggucuuuugucuggaccucagaggcacaggcuaugaugcuccagacccgaguagagaauggaaggaaggugugccucagacugaccugugcuuagcaacuugggggggaaucuguugcuuucuucuuucuggccauuuuaucugaagccuuuuccuggugacauuucucuggguagccacaugccuuaggcucugucuguguuaaugucauagaucuaggacuugcugaggaauuuaguuguauggaagccacauuuacuuaauguugaggaaaguuugucuaugauuugacgguggccauuggcaguguauuccuuccaguaagggcaugcuguuccucccagugagguaaccuauagacaguguggccagugaguguggacgagccugcuguuccucacagugagguagcccauagacaguguggccaaugaguguggaagagccugcugugccacugcuugcuugcuugaaauggaaucugcuguuuguuuucaaaacucuaggaccuuuuagagaaucuagcugaucugggaucugccauugccacucccuacaaucucuugaagaagccuugcccuugccauuacuuagagucucugcaguugacacacccugacuccuuccuccccugcuuuggaaucugccucuacuccccugccuccuccugccucguuaguggugaagaucggguccaguucccucccuagcuggaaguccucccugcacagagcggguggggaagcucucugcuccuugaggcacgagcaugcacaggguaaaggaguguuuaugagucagcucccucagaaugccucauuuuuaaggggccuugaugcucuaagacugagccaguugguggugagcugucucagagacugauagccauccuccuggacaugaauuaacggcucagacugcauugaaagacuacaaggaaccaugauuuuagggugacuaaauaugucagcucaugauuaaaauuuaucuguuauaacagcaccccuuuuucccacuuuuauuaaaaauagauuuuuuucucauauaauauauccugauuaugguuuccacucccauccagaucaacuuccuuucugucugucauuagauaacaaacagguuucugagggauacuaauaaaauaagaugaaacaaaaacuaacacauuggaguugggcaagacaaacaguaggaaaagugcccaagagacggcacaagaaucagagacucgaccucucugugcugucugcuuguggguuguauuaaugaggguucucuagaguaacagaauuuauagaguggggcgggggcggggggcgggggggggggcggagaaagcacacguaucgugaagauuuacugggaugacuuacaagcuacaauccagcuaauccaagaauggcuggcugugagaugaaaauccaaaauccaguaauugcucaauccauaagacuggauuucuuggcuagucuucauuucaguaucugcuggaaucccaaagaaauaguuuccaaugccagugagggaaugaaauauaugugcuagcaagacuggggcaagcagacuaugaacagcaccuuccuucuuccauggacuucgauaggcuucuaguagguguggcccagauugaaggugcaucuucccacaucaagauccagaucaaagguguguguguuccugccucagauauccagaauagaagucucccaucucaaaccaagcuaaaauaaucccucacagaugugcacuccauuucuggauucuaguucauuccagauguaaucacguugacggcaagaacagcuaacacaugggucucuaucuguucccaucugcuauaggaggaagcuuuuuugaugaugacuggguaagagauugaucaauaaguauggugcuuggcccuucaagcaguguuguguauggaaggagccuuaagucaaaucaaguauuagcugguuguucccaccaacuuugugcuaccaucuuacaugcaggacagcauugcagauuagaggguugugacuggcguggugguuacauuuucuuuugggaccaugcaagaguacauuuguuccugugccaaagaugcuagaacauaggaaugaaggcucuauguagacaccagcuagacuucauguucaaugaguuguguguuagcaucagucauggcaucaguuuguggagaauagccuauaguauuagcaacagccuggguuguuugggguucccaugggauccuuuuggccaacaacuccauuaaauguaacccaguccugguacuggcagcuucauuugguuacaagagauggccagcuggagcucuguuccuucccccguuguuuagagauuucauuuggauugccuucauauacguauacaucuuagaaagcuucuacugcauacaguugucauacuaccccucaaauggcccuuauuuagcuauuugucccuguguucccucccucacgcucuucuccucuccuccuuacuugcuccuccuguucccauccauccauaacuaucuauucuauuucccuuuccuaugccccuuagucccuuacuuuauaccuacccucugugguucuguggacuaauaccagcauucuuaagcugugucuacacgaggaccugguuucuguuggugcugugaauuugacuuuccccaguguacacuugcugcaccugagugcuaaccugagcuauuggagaagaguucuagcaugucucugugcagaguaggucaagggaagaugaaguggguuagguaaguaaggccgaugugugugggauccuggaggcagagcugaggagguaaagcuguccugcuccauggucugccacugcuccguucccagugggggcaguuguuuaaugccuagcugcuccgucccagugggggcaguugguaauaccuggcuuagggagguagggagcugcuuucaguucauggucucacaagaacuuugagaccaaagcuaucuuaaucuucuaaggugguggggggaguuguuuuuguuuuuuuauuccauuuugggcucuguagguaagcuuacuugcugccaaacaaguguuugauucuccagagcuaaaauacuaauggagacagugaacucuuacaaguuguccucuggccaccacacauggacuaugacgcacgcgcacacgugcaaguaauuauguauuuuuaaaauuccauuuugucuguaaggugaaaggggcaguaauuaaaugacuauguacuuuuuaucauuuguuaguaaaugaaaaagaauuacaagacaguuuaacuguuuucacuuuugucuuaaaauagauguccaucuggauuuagaagagcgccuggcaaaguuuaugaagaccgaagaagccaucauuuacucguauggcuucuccaccauagccagugccauuccugcguacucuaagagaggggacaucaucuuuguguaagcgcucucaccugcacuccugaccacauuccgccagaaacugcacagcgcuggcagccaggguccgcagguccucgauggaacuuauaagcugaaaggaagaaggaaucuucccggguucuugguuuuguuuugcuuguuuuccuggucaagacccuuccccaugagaugcuggacagugcagggcucacgcuccuggcaccgugauugcuuuugcugauguccaaaugaggcaugccgucuccuucccgucagcucuguggcccugccaugcgcugagucauggucacagccucacauugcuuacugugccuggaaaugucacaugcuccucaucacccauccuuccugguccccaggucucuauugagcuugccucagugcucauuaaggaugggagcugaggcaggggcaguggcuccgugcuuaagcgcuggcugcuguugcagagaauccagcaugguucucggcauccauauacagcagacaacugucugcaacuccaguuccaggaucucugauacccucuccugguuccuuggauauaggcacacgucauguauguacguaugaucagacaaucacucauacagauaaaauaaaaauaaauauuuuuuaaaggaauauaagggccaccagguagggauaccccugacugcuacggcaagucugcagacucaggcgugucuccugagugcauggggugcuguuuacugcaaggggaaagcugcuggccaugcagcuggcaucaacaguuguuagcaucuugcauugagguuuacaaaacugucuuuucacuauagcaagcuguuuucaaugacuguaacuuacacaucauaaacauaaggacaggaaggaaaugaagauaagcuaguaaggagaugcucucucgcaucccccucccauuuccaugugugcguguguauguggaagcccaggguugguguuuggagucaucuagcaguguucucccauacucaggacaaccugagcucccugagggcuagucuggcuagcugauuugcucuggggagcucuucuccucacagggggcauuuacacagguucugagaagccaagcuccaguccucacgcuuguaaacaagcacucuaacugcugcaccaucucugaucccuaaguacacuucuggggauauaguuuauaucuuuucuugcugacuaucuuaaccuacuaaaauauuaucauuucaggggcuuguucccauuuuuugguuuauacucauuguuuacaggauuggccucucugugcauaugcggaacuauuuccuugagaacucuuucaggcguucuggguggagauaggcucuuccugccauugguuugcuggaaauccgucuccucaccuucaccuuuguuaaaucugacugaugaugaccuucagucuuccugucccuuugugugugcagccggccuuucgggaaguuuucuacccuguuggcauucucguauccuuuucuacccccauuggccuagauacuugcuuuuuaaugcugccccaaagcuccugugagccaucuucaccauuugcgaauggccuguccugagcucagggacugagcucuguggugcugacgccucucgccacacuuucuuuuccugcucagugugcucuuuuagcacuucacaguccguguuucuuccugucaguuucuguuagaacacugagaaguuuauccgugcuuccucugagcuuggguuuccugagaacgcuguugugaguugcgugaguucucuucaucacugauuacuguggaggcagccucugcuaccuuauuuugagguuuuacuuuuuaagauuucuauuuaacauguggguguguugucugcauguauucacaccauguguguucagugccuaccaugugaguguagugcccacaaaggucaggagaggaugucagaucuccuagagcugggauuaaguaugguccucuaggcaucgugugcuguugggaauugaacccagguccucuguagagcagcagugcuugucacagcugagccagcucgcccaacccgaggucuuagugauugaaagcucuugauggugugaaaguucugggcagucaaggauuguggcuugucuuuucacaguggcuuaacuagcaugcccaagaggagguguacuagaagugaucuguuguauugccacucuucgaacacuagagggcaauccaagcccaaguuccugucaaguucauagauggugguuguguagggaugaaucugaaguaccuagaaagguugguaaguuuucacaagccccugccauaggcccaggaagcuuguucugggugucaccggcauacagaauucuguucaacauggcauaaucauugugcauagauuuacucugcuuccugggccauacuuauacuggcaacacugacaaacuaugugaugucacaggcccuaaacccacacaucacuggugacacgccagagcacaccuaccagaguagucuggacugacuaaggcagaaauggacuuugugacccaugaccggugcaacuggcaugggugauccugucucuuacggaaguuucuuacaccaagacauccucuguuacccagguguuauccucagaccugaggcagagagucaguggaaugugugccuucucaguguuacacucugaagucaggucucugcuuuucuuauuguaccucccugaauagagucuuggaccacaguaaugggugaaggugaucccuuggccaccuagacaggugcuaaaugacugaaagcaaguugagcugugcaugcauuugaagccucgagaaccugcggaggaugcacuguagcccuguaauucuuuugaccucaccuguuugggguuugcccacugucuuuaaccuguggguuuaaguuguuuuuguauuaggguuguagccagguucuuugugucauucugcgguucccuucugugacuagugacauggaugccagcucccuugucauagcucccuggagcucuguucucuucuuccccucagcuguuucucccuggcagugacucguuucaauuaugucuuccugguuacugaucccuucccucugcuccuuggcuauuucuuuuucagaguuccaucucugcaggauuuccucuguaacuucuguuugcucuggcugucuguuuuaacuggcuuguuucagguuuguuggucaugcucauugaagcauuuuuuauccuggcugcuuugaguucacucauaggucuucuugggcccugucagcuuaguggcaugagggacacuugauggagcugauccucagcuggaaccuaggcauuuccuguuacguggcuccccucuguguuaugugggucucuaucuaacugcugccuguaggucacauacccugagggagcuguaagugcggccccaugaacaacaacacugagauuccccuccuaacucagucauguuucuggagcaugaauuuugcagaugacaguauuggggugccgucugucuggguuggcuuccacugacacuggggacaugggagggagggagccggccaccaucuuguaccugcuucagcuuggcacccaaggucagagauucuccauugccacugggugacggugacaggucugauuuccuugguguuaccacugacaacacccauugccucguuguuaccaugugggguggaagcuuguucccagggaaggugcaggcugccguccucauauuccucaaaggccaaaggccaaguucuucccuccccucagcggggggugggcgagugagguuagaccagguucccugugagcuagguuacacggaucccugugcugcuugccuaugcucagugcuuguuguccggaaguuccgcccgcagcuagacugccaacauuucuuuuuaaaauauuguuuuuuaaaaaagacauuuauuuauauauuuauuuuuuauuuaauguacauggguacacuguagcugucuucaggcauaccagaagagggcaucggaucccauuacagagguugugagccaccaugugggugcuaggaauugaacucgggaccucuggaagagcagucaguguucuuaaccacugagccaucucaccagccccugccaguguuucuuuauggagcacgaugaagugccaucagguaaacagagcugccacuaagggugagauuacuauugcuuuccaaaguucuuagcaagaggagcacaugaguaagcucagaugccaugcacagcaugggucaugaguugagaguggucaggaugcagcuagccauguuucuuggaagagauuaagugaaguaaguccuguggauaggaugugcagcaugaagagcaaacaguggucaaacgcuuucuguuugcuguguuccagguaacagcuggaggcuggucugcuacacaagcaggcauucuucugagaauguugacaaggcccuuuaaccccaauuuggugccucucuuccuugcagggacagugcggccugcuuugcuauccagaaaggauuacaggcaucaagaagugacauuaaguuauuuaagcauaaugauguggcugaccuggagcgacugcuaaaagaacaagagauugaagaucaaaagguaggauccuuuugaaggaaacugugcagcucuuuguacuuccuaagcagcuaaauuauagaugaaaugguaauuugucauugaaaacuugccugcggaucgcauuuggauguuagguaaggguguuccugcuuauuaaauguaucucagcuuggagagccuugucacguuaugcagacggggcagcauucuacggaggccgagaggagagcagcagccuccccuucaggagaugcagaacuuuggguucuacauaugagcugcagaacacacuaaggcuguaauggagugcguggauuaaauuuauaauauacuuauuuaugccaucaaaccuuagccuccugaaacugcaggcagcugcuguuggggacagccacccugaagagggaaugccugggugcccugaggaucccuagugguggugauuggauaaugucucccuggcaucgcuggaguguguuuaaagcaucauugggaggagugugccuuacuuuucugggcaguguggaugggaagucaagcugguuggagacucuguagcaggacgccaugaugugugacugucuuggaaacccaguugucacaucucaggcaucccuuucuucaagcggaccuugcucaugcaacucauucaugacaagaggaacuggugagauacucaccgccgccuuugguuugguguucauuucaguuuuuccaauauuugcauuauucacuuagaguucugucaucuguguuuaggagucauccugugcaauagacacuuaaugaauaugcacagucauugaauaugcauaagcucagugugcugucagccagugugccauauuuacucugucaagaaagggcuaaagaagucugaaauugagacugucccacagaauaauucuuucaauagacuaaagagacaacagccugcauucuaaguacuaggucccaaccaucagaauaaauccuauuuuggaaaguaugacuaaggaacaagucugccugaguuuuucauggcuaaauguuggagauuuuauacuaagguuucuaaucuauggaacuucuuaauggauuuuuuaaaaaguaucuuagaaauuaaauuucacuuuuuuauuauauauuuauauuuuuugcauauguacaggcaaagcauucauacacauaaaaauaaaucuuuuaaaagaacaaaauaaaauuguguuuugaguaaaacuuaggaaugaccacaacuuuaaaauucagauucuaaaauuacugcaguaaaauccugguuuuagaaaaagugaugcauggguaguuaucuaaaagaaaaacaaacauuaccuguguguaggaugacugccuagucuuucuagucuuuagaauccuuccacacaauuuugcucauccuaagccucuuagauugacuauuuugaaaucucaagcagauacggcaauggggaugugguagaacacuugucuaguguguguaaggaagcccugcagaaacuaaggaaagggagaugucaggaugcugugaguagaauugcaggcauccaguuucccccgugucccugacagagcuauacugucaucuugaaagcauuuagcugugaauuucaggagauuggcaaccucucugauguauaccucugcagagcagaagugcuucugugcaggcagcgcccgcuggguccugaaaugcucacagcauugcuguaguaaugacucgagcacaguauggagucugaguaggaagugggaaugaguucucuuuggucuuaguguucuccaguccaucacaccugcagguucucaggugugauagcuuaguggccuguuggacucgagguauagggagauauagugucugaguuaggccgcucuccuccaccaccuuggauuugaucagacaagucauguuuggauuuuacuuggcugacugaugggugagcaauggugauggagguuacagauggccaacacacagaggaaaauaguaauauaauauacacacaugcacagagacauagacacacacauauacacauagagacuuagaauggucuucguuguagauuuuucacauuuccuccuaggcugaaauguguaauuccuaacugugucaucuugaaugguuuuaccuuauaauccagccaugagucuguguuucaucauuaaauccccugggcuuucucccagcuguucugggcugggacacuguuuuaauacugucagggugccuccaguggugugugaggucaccuggcugauguuggucauugaaaacugccuaagagugaacggaaacugcuuuuucucacuaguguuucugucaaaauaauaggaucucaagaguugaguuuuaauucaucauggccuuuuuuuuuuucuuuuuaaauaaauuauuuaugaggugcaaguucuugggaguaacaauuuauacuuggaguugcgacaaugaagacgucugguuuguuugguuugucguagaauccucgcaaggcccgugugacucggcgguucaucgugguggagggcuuguacaugaacacuggaaccaucuguccccuuccagaacuggugagucccugcgguagugugcugaugaucugguacuuaggccucuugcuugggaccacaugugaagcauggugcccggggcacaggcuggugcuguaggugaaggggcuuguggcaagucugaccucagaacucaccgggcggagagaggggaaggaacccugagcgcugggcuucagcuccaagauagagaaaggaguaaauguauguuuaaaaagauaauaaagaaaaucaugauguggagaaagggcauaaauauacucuuacauuaggaaagucaguaacauuacugguggauguggccuucaaagaggaacccauguccaggggguuguuuuuaauuuuacaucccaucugcaguuuccuuuucuccuucuucccaguuccuccccuccccuuccccuaccccaccuuccuccacuccccgccaccccccauccacuccuccauuucucuucagaagaagucaggacucccauggcuaucaaccagccguggauaucaaguugcaguaaaacuaggcacaucuccuauuaaugcuggacaaggcagcccaggaagggaacggccccgcgggcaggcaacaggaucagagacagcgccugcuguucccucuguuuggagucccccacaaagacuaagcuacacagcuguaacauguacagcaggccuaggucagucccaugcaggcucccuggcuggcagcuuagucucucugagcccagguuaauugauucuguggggcuuuuuguggcauccuugaucccucuggcuccuacagccccuccucccccucuucugugggauuccccaggaucugccuaauguuuggcugugguucugcaucuauuccaucaguugauggaugaagccuuucucaugacaucugggcuagacaccaaucuaugagcauagcacaguaucauuaggaguuguuuuguugacuuuuuuuuuuuccauugguguuugguucuauccuagguaggucucugggcaauccagccuuuuaguccuggcccuccaggcagugucaagggugggcucccucucauggcaugggucuaaguugaaccaaucauugguuggucagucccacaauucugcaccagcuuuaccccagcacaucuuauagacaggacaaagugcagaguggugguuuuguacaaggcugaccugguggcucaauccuucuauuggaagucuugccugguuacaggagaugacugguucaggcuccaaauacuuaauuucuaaaaacaaauuuuauugagacaaaauugacaugcaaaaaugcacccacuuuuaguauguuauuagauaaguuuugauagauauguguugauauaugcucugucaccaacacagucagaauacaggacccuuaugcuauucuagaaguucccuuauacccauccuugaccccaggcaaccacugaaauguuuucuauuccuauaaauuaguuuuaaucuuuguaaauuuuguauaaaugaaaacaaauaauguauauuuuauaaaccagccuuuaacaguaaaagcaauacauuguuuucagaagccauagccacuguagcuuuccuagccaagaugagauuccuguacuaaacugcacagcucagcacagcacagcauaguacagugggcccccuaugcaggcagcagccccaucuagcuccaacacauaguagagcccacgucuguucagcugucagcauccaccuccccacacccuuggcuccaccagucugucuccguggcucugcuggcucugcgcauuuccuaugagugacauccucucuguaccuggcuuucuucacugacaggaugcuuucuagacagacacacgucauauugugaaauacauccauuccuuugacgugcuguuaguucauguggguucagccuuuguguacuugucuguuaugcguguucauauacaaauauuuuuccaaggccuguuucacagcauuguguguaagcagcuguguccccugcauggugacuguuacagugagcagaggucccaguuuguucucaugacagcacuuauuuuuugugcugcucuguguugugcauccuagcaucuucccauggucuuuacuugcauuuuuccagcaacugacagugucuguguauacuugaugggcaucugucuucuuuugagaaauggccaucccagugcugugccacguuuuugguugacuuguccgcuuauuauguuguaagaguuauuuaugugaucugaaagcugggccccaggugcauacaggauuuggauaguucacccauuguguggguugcuuucaguuuuuuaauacuggauuuugauuuuuaaacuuuuuaaguguugcccacguguggugacgcccuucuuuaaucccaguauuugggaagcagaagcaggugacucucagugacuuuggccuauauaagccagggcuaugcagugagaccaucucacacacaccaaaaaagucuugaauuuuggugaagugcaguuugccugccuuguuggucauaagauuuggguuaggguuuguuuguuuggaugaguguuuuugguugguugguugauugguugguguuuucuucuuuguuuuguuuuuuguuggugguggugugucauuucuaaaaacguuuuuguaauaaaagcuacauaaaaucuuuugcuucuuuccgucuuaaagaugagguuucccucguuuucuucuguuucuguucaggggaacguuuugugugugcacugcagugcauggcugugcagucugucgccuucuguggaggugccugccuaagcucccggccaugucacugggaucugucugaacuugggguuuagucacccaucugugucgugucgagccuucggcuggugcugugucaugugguugcugugacuuagcccagggcucugaaaucacgaccccugaggucucuaacuuuacuguagauaugguccuuccaucugugugaaucucagaaugugcuucucagucucugucaaaucaacucuggcuuuguagguuggcucauggcacaggacucacuggguaagucuuccuucuuugcugagguccugcucucguuggcccuuagucagccuucagccggcacagccucaccucugcauuaacuucaccaugaaaugucugguagacucuguuuuaaauggaauguuuucucaaauccuuuuuagaucauucauugcuaauuuacaggaauauaaccauuuuuauagaucuaccuuuuauuacauuuuagugagcaaugcuguuuuaguauguuauauaccucaaaucagauagauagauagauagauagauagauagauagauagauagauagauagauagauagauagauagauacugacugaccgaccgacugacugaacaacagugucugggcaaggcaugguguccaagaggaucagaaauucaaggucacucucaguuacuguuaaucccaaagaugggaggagaaagacuucugaccuaaauuaucauagccaaauuaacucaagcaagcaauuaaagccaaccuuuugauuugugcaccugggcugccuccuucuaaaggcaaggacaggagcacagugagcauaagaagucaguccugcacaggcuucugaaacaaagacaggguugcaaguuggccauaacacgguagucauggucggaaaggucauucaucagagcccuaacccggacgucauagguggccauagaaucuuuagaacaaagguaggcuugcaagaugguuauaaacuuuuuaaaacaaagacaugguugccauuccuggaacaagaagaacagaaccacuuguaauuaaaguuacagaugggacauagcccaguccuugagaaacagagguuuaaccaugaacaggaaugaaccuagucuuuacuuaaaauggcuuucaagccuaagauggggacaggcugguucuaacauuacauggcaguuucaaggcuagccugggcugugugagacgcugucuuacaaaacaagagaagaauguaauuuguaaaguuuuucuucucccucaaguuuccacugucucgucuuuucuccuuugcccgcuuucucuggguagcgcucccuccacagugcuuaggagcggugagaagagaacccuuguccuggucugaggggaagcuuucugucucucucaacugaugaguuuucugcagcuuuucacagacucucgcuagcaggcugauaaaaacccuucucguuccuaagugcaucgaauguauuugccugagagagugucggcuuuucucaacagcuucuguacgacugggacgucuuugcauuucucccagguccgacgcugugcuccccugugcuccugacgcugugcuccccugugcucgcggcccucacguuggacucuugcaucuggacagagucuuaauuguuaacuaaggacucaaguuaaggcuucacaggggaucuguaaagcuuuucacugcuauucuaaauacuaacgcaagugauggauuuuucuucaucuuccuguuuuuguacgggugucagagacugacaggauagugggagaggggagccaaaacuuacuacagcaggguuuucuauuuauuacacuuuauacguuuauuuacguggugugggggaagaacauguaugucacauugcauguguguggaggucagaggacagcuugaaggauguaccguguggguccuaggauuguacucaggugggcuugacccacugagccaucuugccauccuuagagcugcuuuuuaugggguuacagucucagggcguuccccaggacagguacgugguggaacaaauaccgagaagcuagcagcaagugggggcgagggugaaagugcucguuguguggagaugauggaaugagucagguugaccugggacccuguacucuucuacugcuuuccuucaguagagaugaugggcugagccggggugaccuuagagaugaugggcugagucagggugaccuuggagaugaugggcugagucagggugaccuuggagaugaugggcugagucagggugaccuucgagaugaugggcugagucagggugaccugggacccccugugcucuuccacugcuuuucuccgagugcuggguuauuguuacuguuuuguaaauauguuuuagaacuugauaucucauuccuguuaaggaaggaaaagucaguguugaaguacuuucccuuaaauuaguguuuuugaugaaaaaaaaaaaauccaacuaaaugcccagucacccugcccaccuaacagugaugaucagaagcagaccacacuacucucuuaccagggccuuaggaggugggacagcgaaccagcuuaugucugcugggagagucugugguuacaguggaaaggagaacuuaggaauuagacauguaguaguuaaaagugugacuccauccaccaagcagacagacgugugaacccgaggacgagcuucacacagcuccucacugcaguaaaagcugaguaacuccugaugcuguccuuuaauguggcugugcagcugacuacaugcaaauuacauguaauuaaagugcagaugggggaauaccuacaaauaugcaugcagggcuuccuaccacauuguugguaacuuuuuuaagaauacuuuuuagucuacacagcuaguuccaagacagccagggguacacagagagaaacccugucuuggggacuugggggcagggaaccaaacaaagaaauagaaaacgaaacaaaauaaagaacaaaagaccaacuuuucuacagugcuuacaucauaauuaaaacauuacuuucuuagcuguuuaaaaaaaaagaauacuuuuuaauaauugcaugcaugucuacugccagguggucauggcacaugcuuuagucguagcauuugggaagcagaggcagucagauaucucugaguucgaggccagccugaucuauagagugaguuccaggacugccagggcuacacagagaaacccucuuucaaaaaaccaaaacuugaggggaaaagcuuuacuuagaagccugauggcagaaacaaaccaaaccaccuagcaaugcaugucagcgaugccugcgucccagcggggggcacgcacacagaaggagcaacggacgcuucaggccauccugcucggcccuguuugcucagggccuccucugagcucaggauggagccugcacaugugugauucugucuaguguggacuguugguucauucccacugcgcucuugcccacagucucacaguucuugcugaagagagguucgccaauguacauuuucccaaaaggcauuuuuccaauuucuguaucugagaugcuagaaagcacauuaguggggccggugugagcagugaagucacuagcaaaggcacaguggcgugacagugcacaguggugcaaugcaaaggacacuuagagcacagugaccucucuucugcugggagagcacacuagcagguagcucgcuuuuccuucuccaccuacacugagcuucugaaggauguauggccacccacacuuccuucagaauguauugauuuuggagucacagguuuuaagaaguaggugaaauuuuauaaguuuaauuuuuuucuccaaaagacauucuguaugcugcuaacgaugauaguuuuaagcuuguuuguuuacuuuggucuuuuuuaaaacuagguuaaauuaaaauauaaauauaaagcaagaauauuccuggaggagagccuguccuuuggaguccuuggggagcacgggcgaggagucaccgagcacuaugggaucagugugaguucucucacugggagcucccccugucggaagcccgucaaggaaagaacuucaccaaucagagcucaugaggcuuccaugucuggguggaucuggucagcccagucaggacccuacccucccucuggaguguucuguuucucagggguggggguaguauguauaacuuggcuuuucaugucucuucuaggugcagcuagguuuguguuacauuuguuaagaucacgaagaauugccuuaguagcuggucauagagacacaugccugugaucccagcaguugggaaacugaggucuuccugggcuacccaaaugaucccacacccaaacagcaacaacaaaaaggauucccuuaguccuucuaaagacguuuuuaguauuuaaaauucuacauaugguuuaugggaguacauacauacaguugugugugagugugugugugugugugugugugugugugugugguggcagcauguguggccauaguugauaguaauuuugacuuauacaugcaugcugucaaaaacgccacugagaauggauucagcaaagcuacuaaaggcccaaaaguuggaauaagaacgccaagugcccuggggugugcucuuggugccucaggcuggugauagcugccuugcaggccaccguggguagaguuacaaggagucuuuucuccaaaaugugcuuugcuaccugugucaccuaguugauggauaaaauacaaaauucccuuaguuaugugcacugagcaccagaccaccccagagaaaagagugcagagcgaugcccaggaaguuagacgauggcugacaucagcaaguguggggagggaccugggugagcuguaacugugugaaauuaaugaggaaagccaccguccucaggugaaccugucggugacuggcuuucuguuuuuccugauagauugaugauauugaccuuaucagugcuaacauggagaaugcacucgcuucugucgggggcuucugcuguggccgcuccuucgugguugaccaucaggugaugccucuuagaaaugaugcacaguuguagacaguuguccccaccaccccuucagagcgcagcuuccaauauaagauuuaacucagaauuuguuucacggguuuuauuuaaaagccuggggguguuauuuuauuuuguuuuguuuuauuuuuugucauuguuuuaaagguuuuuguuuuguuuauuuauaugaauauacuauagcuauacauaccagaagaagguauuagaucccauuacagaugguugugagcccccuuuugguuacugggacuugaacucaggaccucuggaagagcagucagugcucuuaaccacugagccaucucuccagcucccuaaaaaaagccuguuuuuaaagaauagcucaaaguguuuacagauacauaaaaccgcuaucucgugagaaagcaucuugguuuuguuacagcugcacccugugguugagucaguaugccugcuagucagaugggugcccuacuguggggccugggugccuuccaaaagucccucuccacagagagaacaucuuugucuuuguuucuccuuagcggcucuccggucaaggauacugcuuuucugcuucguuaccuccccugcuagcugcugcugccauugaggcccucaacaucauggaagagaauccagguaacagugcuaggaaagguggggaccugggucagugccaggccucagugcuuucccaagcauaauggcugccaugacuuggagaaguuagcuaagugcgcugagcuuuaguagauguccuuccuuuucuaucuuguuuucccuucagccuuugaagcaucaacugauaacaaugcuagccuguucugucagcaaacaacucugggcagaggaaaaaguuaacugggaauugcaaguggccuuugacuguaauagugcagccuuuaaaaccaaaaaggggcuggcaagauggcucgguggguaaaggugcacacaugcaaccauggcagccuguguucgauccccagaacccagaugcaggugcuagagaacuagcuccauaaaauuguccugugaccccccacacaugcacaguguugcaugacuccaaccccaaauacacuaauaaugaguacuguuaaaugacaggaaaggagaagaggcuugcuuagcuggcacucccaaguucccagcagaggugucagcucacacggucacaugugugucucaagcuuuccuugaauaaaaggaaaacaucccaaaaaguuaccaugcuacccacugguuuagguuagcagaguaggaagugugcacccagugaucuuagcugggcguggguggcucucucaguaagggcgaggccugcacuuggcucaucgaggagagcaagcagcaccagcgagaaggagccaguuggugacaucaugaagcccaggcccucaagcugugcauagcugaguguuuguucacacccaucgcaucuacagcguuucaaacuaaggauuugggcuuuuagaggaguccguaagcugguaccaacaaaugucuuaaguauaccaucaaacuuuucuuuucaacgcagauauuuuugcaguuuuaaagaaaaaaugccagaacauccauaagucucuacaaggguaaguguauggcuuccagccagcagagcacacgucuccaccacgcucugcagcaguguagcucugaguuuuaugaggucugggcccuucaaccacacagcaacuacaaaagcaaaaacucagugcauguagcuuugaauacaacuggaccagcuguucgccauguccuaaagucaaggccuugcuuuucuagaagucacacaguguguuaguggguacuaugugcaggaggaaaauaaaugacccuacaccugcuacccaggaugaccaagugagcgugaugagucucaucucgucagauaggaacagcccugcucuccacagugcucuuagugaaugugacagagaaaagaagucagucagucaugagugcucucuuuauaaaaaugaaaagucuucaggcugaguuuuggugccacaggaaaugaucucacauuguucuagaucuuuccuuuagcuccuuaaggcuaugugugccucuuggguugugaaagugccaacucuuguguaagaugugggaauagacacugcugaaagugacggcaggugagugaguggucacaacuguucugugagcaggcagacuguggugcucugugugucuacuguguggggaguggcucuugcaaaccuauggugggagggucacugucacuguguguauucauucucuggcacaguacagcacaugggaagauugcacauccacagcagcagccugaggugaccugggcuccagcuuucuccaaggcccauccuaccacuggcucuguccagacuucuuuccucuguaccugaccaucuguuucuauccacccacucuaguggauagcuugggcucaugcuguuacugccugcaugcucauggacagcugccaacauaggugugugugugugugugugugugugugugugugugugugugugugugugugcugcauucugcugucccuaacuuguaggcuucuuuuuaagauuucaaaugucuucaucuuggucuccugagaagacuuucuuccacacccugcucuuuagaguguagccucagauuguuuaauaauucuuguauaugaaucuccuuagggagcuaaaagaaagaucuagaacaauguaagaucauuuucuguggcaccaaaacucagccugaagcuguguguguuuacaaacccacauaugugcguguauaugggaagaaccacuugcuuucauuuccuaguuaccuuccaucuuaguuuuugagaaacagucucucauuggccuacagccugcccugcagguuuggcuggcuagcuaguuaacucaaggguuauaccuuuccccaggaucccagcaggcaccaccacaacccagcauuuuuacauagguucuggggauucaaacugaguccuugccuacccuuuucuguuuuaggucugucuucucugccuugucuggcccuucccuuucccgggucauuauaguagcuccacuccacaucuuuauaacccuguccaugugacucccucccucuuucugcucuguguugcuugucuagucaggauuugugccugcucuuuccauguccauguccuccucuugaccuuccacuagaagcugagagcugcuuguuccuuuuccacuuggccagacugcagguuaacaguggugacagugguacagaacuaacaggacuccccucagggcucagcugccaugucucgugguguucaggucagaccacccugccuuccucugcauucugcagucccuaacuuguaggcuuccuuuugagacuucagaugucuucaucuuggucuccugauaagacuuucuucaacacccugcuccguaggguggagccucagauuuuauucagaauucuuguacaugaacagcucagguuuuuguguuuucucuguggcuugcugaagggcuccauaguccagucaaacuaugcacucaguagcuacaccaggucagcaguguggaagggaauggcaaauaaagcagaaaagggaguaagccuaguagguggggacaugguuugaaugaagauggaaccuauagcuauuggccuugaaucuuaacaaaauuguucucuguggugugcaguaauguaucagauggcgaaagagcgccagcgugccaguuaggauacguaugcagacagaacaaccucauaguugccgagaacggugcuuagccucuagauguaaagaaggggaaaccaacaggcucuuucagaaauuuguuugcugugugagugagacagaacuguagcuaucuaggccuuucaucugaggguuucugggaggagguucugugugugguguaugacaggcuucacccguccccaagacagucacuggagagcagccauggauucccagguuuauauuugaaaguccugcucuggagcggauuugagucauuagcacacagguauacugaaaguauucccaaguguagagggcaggaaccaucugaggaggaagaaaaggaggaggaggaggaggaggaggaaucgccuccuucgucucugagguuggguuugggaaagucaucuaccugcugguggccuccaucagagccgggagaucuccacuguguguauggagaccgcauugauagcuuacucucuuccugaacuacaggaugaaggccauggcucugagccuaggagcaagcccagugcuugcuuuucuccugucuggguacagugaugguuaccaaguguguaguagguucggaagcaaagugccucaguuucugaacuagaacuacagcucugucugccuuagcacagacaggcauugucucauuccucucaccugcccuacccaugcaugacucauccgcuuauugaggggcaggugagucaucugagaugcuauuugaaacaugagaaauuggugcugcuuccugcacccauucaggagucgaagaggauaggacuugggagcgugcuguuuaguuccugcauugaugaaaacuaccguaggccuccccauauggcagaugcccuagguucuaagggucuaaacucagagcuguaccuugcucuaucgagagaaccuaaugucuagaauuacauuccaguaaggaagauacaaguacguaauguuugaguguaagccagugagagcagcugccagcaccucacacagugccucuguuccaaguuuccucacuaagugcaggcuccaggcaauucacugauaagcuggaagagaguuuucuucacagcucugugguucuaauccauaguuuuggggaaaucuggacagagccaaggcacagaagaggcaguuaggcuccacauugccuuucaggaggucaccccugugaccucagaacucugcacuuccuaaaggugcaugacuucugccaguagugcuuagugggcccugcacaguggggacagucauccaggccacagcaguagucaguaaaagcugucgaacccugaguuaacauuucagcacugcccagggcuuugcuucauccugagggaaaccugggccuaagaacaaggagcugaacgaaagcagcagaugggcagcccagucucaaaggcauggacuacagcuguaucuuuggagauggacagcgcagugaaggugaaccauagaggaguaaaccccuggcaaagcagaucucuguguguuaaucuaagaagaaaaucuuaauccacacaagauuuaaaguagacugcacagauaagacaaucaugccaacuuaaaccuauuguugauagucaaaauacaguguugcuagucagaguguaacguucuuaugucaugucuccauggcacucuaaaacuuagauaauaaggaaggagcaugcaucauaguccauacacuugaaggaagcaaacaggaaaaaugauagaaaauugugguaugcauccugcuguaagugggucccaagggaaccccuccccccaagaaaggcuacaugaauuggaucucacaauggacaauuuucuuggggacaagagagcaguguauauuaggugaagagaugggggaagcaagcccagagugagggggcuaugagaggggugaccaugagggacaagcaacaaggaugccuagacccccaugggagucuggaaaggagagaccacagcaucccaugaauagcagccuuccuccccaugcacacagaaacaguuucacagguguuuccuggacgggaagguaccgauugcugcucaagauggaaucccaccaugcagugggacguucuugccggcauccccaguucugcuuuuaguucagugggcuuugacauggcuauuuacuuauuuauguauuuuaucugugguauuaggacugaacccagguccuuaccaugcaaugucagcaugaugcccuaacuccagccagugcccuaacagcuacacuguguggggucccugugagcccacaguggaccaaugucacguguguuuguuucucuaguguuucggguuuaaaaguggugggagagucccuuucuccggcgcuucaucuccagcuggaagagagcacgggcucucgggagaaagaugugaagcugcuucaagcaaucguagaucagguaaguauacaguuauacagucggcacccgacagcccccacccuugcuuaccucacuuucacaacacuucccuaccccaaaaagcuacaaaaaguaugccacagcugcugcucaccacacucauggcggcccucccagccagcccugggagcugacagggagccuggagggcaggcugagggcuucucucaccuugucagccuagcuccugacguugugaacuugcugcugcauugaguauagcugugcucagcuucucugcuaaacagcccugcagaacacucauccacucaccacuuacccucuugagaccaggucucacccugucacuaggcuagccuggaauucaccaucuagcucaggguggacuuccaacucacagaccauucuaacuuugcuuccugagcgcuggauuugcaaaugugagccacuaauccugacuaaaugacuguuuaugaguuuugcuaauauuccacuuauuucacucauuucugcuaaguugcugaccccaugugcucacugggcgguugcuuggccgcccucccagcaggagcugucucuccagaagccgcccugcccaucuuccaagcucuugcccaauccuugcagaaauccagggugcugcagcacugcgggaggggggugcaugccuggggccaugcagcuccccacggaaccuggcacagguuuaagccuuugugucuuuaaggaguaaaggcuuuaucccacucugcugcugcucugggacaaugccacccggcucccuaaaguaaagacauugucugccaccuguccccgucaucccuguggcaugugugaucuggaguaggaguaagaaucuauggaggaaugcacacgguacacaaugcacaugguacacacugcacauagaacacacugcacaugguacagaaccucuugggaccuacugucuuuaaaaaaacaaaccaguuggguagugguggcccacgccuuuaaucccagcacuugggaggcagaggcaggcggauuucugaguucgaggccagccuggucuacagagugaguuccaggacagccagggcuacacagagaaacccugucucaaaaaacaaaacaaaacaaaacaaaacaaacaaaaaaaaacaagaaagcaaaaaagaagaagaagaugaagaugaagaagaagaaaaagaacagaaaaaacaaaaaaacaaaccaaaucuaagauucaaaauuaaagacguguauguccuuaucacauuauggugaucaggcuaagaauacuuggcuggcuggaaaagaacacaucacacauguucucucaggcccagcucugcaggccugcggaaagacaggcuucccuaaagggacccagcauccuccacaguuuuacugccucagugucuuaccccagaaauacacagauaugaaagucaguuuguggguagagguuuuagaaaaaguaagacagauacacauguucagaacgacccaacggacagccagcacagcuaaggauaacauuacauccuguggcugcugagccugcugucucccacaggacugcucuuacugguaggcucacugccuuagcaaacacugcuguucagagacacagggcucacuugcaagcagugggugugagcaagcagacuacaugcacacacauucucagaacaaagccugaaaaugggggcuggagagauggcuuagucgcugaccucuugcugugacaaaccaccaagacaacuucagagagucagaagccaugacgguggagaaaaggcauaguggcagcaacagccaugaauuaacacucaccuugauucacaaguaggcaaagagcacacugggaguagcaggaggauuugaagccucaaagcccaccccaccagugacauaccuucuccaggaagaccacaccuccuaauccuucucaaacaguucaccaacuggaggccauguauccaaauauuugagccuaugggggcuguucccaucaagccaccagauccagacaucucauaggcucuguagucaccaucacaggaagucugaguccaaaagaaggguuugccuugagaacaguaggggugcauaagcuuugucucuuagaauucuaaauggaaauaaaaauggcagguacuuuugaggacagcauaucuguccaccaugaccuaaaugacuguucuguccccuuucucccugcagugcauggauaagggcaucgcauugacucaggcacgguacuuggacaaggaagagaagugccuuccuccuccaagguuggugaauauuaaaagggcagugccgcuuccugcuuuacacucuuuaaauguguugggaaaacuugaaauauugcaggauaagaaugucccuacaguacagcacacauccugguccauuuagcuacaagauauuuuucauuuuaacugaaaagcaucauaggacugaguguccuccuaggugacucaacaaugagcuucagugacagacuauucggcagcuguaacagcuggaguccaacuguagcuugugcuguggagacgcucaauggagaagggaggagccuggauguggucaccuugccaauggugcuugugggucugcaugcgucauuuugcagacaccagcuacagcaggacggcaaagcaagggggagggguaggcucuugaauaggcuguugaaguacucagcucugacccagaaccugcacugugaucagaagaaaugaacacuccaaucacuguagcccugggucagaaaucacagaagacacuggcaugaugcuaagacuuccuagaacaggugacacccugaccucagagaauuagguacagaccuuucccagcuucugauaguuucccuucagaguuaccaugaugggaaagcacacccauaagagcauucauuuaguggugucugauagcauggcauauaguuaguuuguuguauguggcuuucccacacuguaggcugaugucccgaacucagguguuacaguaaugccugagcacaguggggaacuggccaaaguggauuggaucuguagaggauuuguugggguguggucccacccuaggcuaagcaguaucugcucaggaggacccugguagacaacgugaucuucagcagaucacacuguaguuugcuggggugugcaguggccugagaaccuccaggacagccuggagcacagaguguaagacgcaggugcacuagggugcaaagcucccuguguccuaagaaccagaaaaccuucugaauagacguucaugucccggcugaguuauuaaguaggggcgccccggcagaccagugugagaaauggugacuucccgcuuugggcccaggacugcuuagaguaguagaucauugagaggcuugguuuccagccucaguggcuuccccaaaagaaaauacuuggacuugauacaggugaguggggauggccgagaggcauggcuucugccuguggccacagagaaccgguguguuaggcuugcagguugcaaaucccucacagcuacuuccuccugcugcaugguaggaaaucagcagcagguagaaggcuggcucccuucagagccggaacagucugccgcacaagcaugugaccucguguuccugugcuuugucuuucucagcaucaggguuguggucacuguggagcagacggaggaagagcuacagagggcugcauccaccaucagggaggcggcccaggcugugcuguuguaggcuccugcccagugcuucagccaugucaccugcggacggaacuacucagagaccuccagcugcccaggguguggcugugcuugaauacacagccagaguggaugguuguauccagcaggagcugacuuguagaggaugacagaugacagcauaucccugguguuucugcagugccgugugcucugucaggaugcuucacugucauuuguauucgcuuuuguuuaaaacuggagcuuccauuuucccucugucgucugugggaaugauucaauaagcacuucuccguauccauagaaaaggacuuugcagcuaagagggacucuccauguauccaguuacugugggagacugagagacuguguccuccccuguccucaggcagagcucagugguggcugcuaugcagauacucuguguguguuauaaacgucauacaacauggugauccuaggacucuaugugcuccaguuacugauacuguccugucuaaucugagcuucacuaacagaucuucauaccgcuuccuaagcaauaaucugaaucaaacguuauuuuauuuuuguguaauugacuuuauauuuuuuauauauucucuagucaguuuugggaagaggguuauuauucugauccccaaauacaaaucaugcccuugguauuuucuaauauguccaauguccuuuuucauggugguuuuguccaggagcauagaccugugggcuuuuucuaagcugagaaaaaugagaccuuuccucuuucacucuauaaauuccagaugccuccgaaaaauagggaugcucuaaacgugauuuccgagcucuacacuggcugccguuguccuuagcgagcguguugagugauauaaaggcuugugacaugugccacggaucgugugcauggaaggccuucucuuguugcacgggcagaggagucaggucauuuaaaugucauuuucugaugugcguucaugugaaccaugggucggcaucuucuuaagugaucugugacauuuuuaauguuucuauuucauacgugccuugugauugcugcugcugugaggguacacuccugucggggaaaagucuguuuugguuugguuuuuaaugaaauaaaccuccaagagcuuacauuccugaaaaggagucuguuuggauagcagcuugcucagcucagcagucucuugauuuuaaccuucauuuuccccuguguguuuuucuuuuguuuuagaacauaacuaaauuucuuagucccuucuuccagcccaaccaaagacuauguacuaucucaaaauucguagguuccuucugauugaacacugucuacuucggacuauaagaaggcuggaguggggccagaagacuuagcuccaugggagaguucuugccugccaaacacaggcccuggguuugauccucagcuggggaaggaagcuuggcuaaguggcagggcaguugccucuaaucgcugggaagaggcggcccagaggcagcacagcgccuuaggugcuggccaccaucucuguugguguacucccccagcuucccaugaaaccaucccauguccuucaccauggagcccacacagaaccaacaugaaguucaagccucaggaucccuguggccccugggucagacccaguuaccaugucgugggggucggcgga

SEQ ID NO: 7040 - RNA, 477 nt, Mus musculus
auuuuuuuuuuuaacaaaaagcacaggguuuuauuucucgcccuuugggcaggguucugcaggccuuugcagggcagggagcaggcucuacuugccagcaaugagcggguuccgcagcaccacgaugaaggaguccccaugcaggaacaucuuagagauguagcaguucuuguugacaggcuuggacuucuucuugcccuugccgcucuuggggaccucaguccacaucuccuucacauuuuccagcaccauguugcagugccugucaaaggccuucacccggcccagcagcuucuucuuguugcgacaguuaaugagcacuuguguguuguucuugacugacugcgugagcacugagaggggaccuguguugaauuccuccuccucccacuucugcagcuccucuggggucaucucacucuuggguuuauugaggagacucauaguguagguuucgcucgcagaucacucccgccg

SEQ ID NO: 7041 - RNA, 743 nt, Mus musculus
cucauuggagauguucuaaauguuuccaggauguggccuugcuagagcuugcuugcucuguguuguuguuguugcugcuguuguuguugcugcuguuguuguuguugcugcuguuguuguuguugcugcuguuguuguuguugcugcuguuguuguugcugcugcuguuguuguugcugcugcuguuguuguugcugcugcuguuguuacugcuguuguuacugcuguuguugcugcugcuguuguugcugcugcuguuguugcugcugcuguuguuacugcuguuguuguugcugcuguuguuguugcugcuguuguuguugcugcugcuguuguuguugcugcugcuguuguuguugcugcugcuguuguuguugcugcugcuguuguuacugcuguuguuacugcuguuguugcugcugcuguuguugcugcugcuguuguugcugcugcuguuguugcugcuguuguuguugcugcugcuguuguugcugcuguugcugcugcuguuggugguggugcugcugcuguuguacugaccuucaccaguacuuuuuugcccccaauuuaacuccccaugguccaccugugcccucucacucacuccgaguuugcucugugccccgccccacacuugcuuuucacauacugcauccacgcauccuguaagaugcaacauagauuucguuucagccauuggccugacuucuucacuaucauuccugaugguaacagcugccauu

SEQ ID NO: 7042 - RNA, 36506 nt, Mus musculus
ccugggggcggcgcgcggggccgcggcgcuuccggcagcuggaggcggcgccgaacgggaccgagcggcgcggguggcggccggguaggcggugaguggcggggggcugcggagcgcgcgcggggagccggaggcgcgcgggauggcgcaaucucgggggcugcaggggacccaguaggguccacugugcgcgcugggguaugccugaggcggguuacguacgcccgggaccucgugaguccgcagcucuagacuggggcuagggaggccucagcguggaacugaucuuguggaacagaugugaaaggggagcaucacgcaccgugccacgcgucccuagccaccgcgugacgaaacaugcugggugcaggcggccaagauggcugccaggggacugucuccacgaggaugggcgcgcgcaauugccaggugaccagguggcucuuaguagcugggacccggagguccgcguggagaucacuugguggccgaccuccagcucuuaaucucuucaagggaccgaagugucccagguagaaccgugggacccucacccucagcucccacaucguguuccugcugaucaucucagguucaaccgccuccagaaugacaaugaccacacuaaggucugugccuccggaguuagaucucugacuuuuguauucauccaaugcugccaaauccauaauccagauuugaaaacugaggcauuaaaacuugaauaacuugccuaaagugucacagcuggccagggagaagagccaggcaauccgaguauauauauuguuuccacuuugucccucagugacgaugugacgauugagagaccucguggaaaagcguaguucugcuggauuucagaauuugggccuuuacccgggacucucccuuuauaguuuucucacacuccugaucccucaucugcugcaccuacuuugggugccucuagucagcagcucucaacugugguugcauaucagaaguuuacaugacgauucauaacaguagcaaaauuauguuuauggaauggcaacgaaauaauuucauaguuggaggaaucacuaaaccauguauuaaaggcuacagcauuaggaagguugaaaaccacugccuagauuuuucucuccguccuuguuccaggcagaggcaggaguagagaggcgagcacugagguaaagaagaggacuuugugggucuuagaaugcuggacucaggcuugcugugugaaggagagcuguuuagaggacaaauggaaguucagcaggaagucccagaaccucaggccaccccuccccaccccccaccccaccccccucccaggacugagguugucacauucacagcaauaacaguguuugggaagaguuuguuaauucccacccagcucugauaaggaauugcuccaucuguguacucaagggugcagccaaaggucugcaaaauggagagaguugugcuuaguuuucuguaaaaguuuggugaaacuaucccggggugugcagcaaaagcuggcugagaggaagcauccccuuuccccuccuaacuucugccaagaaagcugugaagacagccaggccaaaaggacucauaaagcaguggggccacuuucucuuuuaucuaaacuguguguguguguguguguguguguguguguguguguguguguguguaggaggaggaggaguaguaguaguaguaguaguaguaguaguaguaguaguaguaguauauauguaguauaugucugggugcaagugcucuuuagaggccagaagagggcaucagcccccccccccccuggaauuggaguuacccacaguggcaaacugccagauguggcaaauucagguccucugaaagaguaacaaguuaaccacuuagccaucucgcagaccuccugcugccugaaaaugaaacaaaguaucccugcagaaauggcagcuuuaguugugcaaacagggugccuuuagcuguguguagcuguugaaaaggugguuuggacuucaagguaagaaaucuagauuagucuguaauaaucuguuucguuccuucauuuccuuugcuaguuauuaauuugaaaguaaaaacucauuguugccaggcgguccauaccuuuccuagcacuugggaggcagaaguagauuucugaguuugaggccagccuggucuacaaagugaguuccagggcuauacagagaaacccugucuccggaaaaaaaaauuauuguuaggacucuaucauuguauaaacuuuauauaucacuuagugaggggugggggagggagaaaacacccagguccuuuaucuguacaaaguucaaauuuauuguuuaguugacacuauuaauuuguaacauaauuuuauagacuuuauuauguguaaucuaugaguugauuuuuuuuccuggagcugaggacuaaauucagaaccuuguacuugcuaaacaagccuucuaccacugagcuaaacucccaaccccaaguugauucuuuuggauggcaaaagacucuuuuggauggacugaauauguucgauauauucuguuccuuguuggguaguguguuaucauuuuugcagacuagugcuaccucaucucaaagggaaauuauaauauaauuuccauuguuagucuuuagccaggguuaaagguuugucaccagucacuggggaaguucauuccauguuccuugucuaugaaacgucagagagagaauuccuuuucaaaaccaguaaucaaacguagucugguguauaucuaaaggucugaaauuugguuuauuuugaagaaaguuccuuuugauuagacacaugugaggaucucuggagagcgaaugcagccccccuccauucucugccagccacugccagugaggacagcuguuuccgcucuccaucacuacauuucauuuaugaggucaauaacaccuucuacguuacagucuuaugggcucugugaaaucgcucccguggucgguuucuucaucaggaaaaugaaauguaggaugaaaaguaacuccuauguugugggauuguagaguccaugcucccauccaugucauguuugcuuggcucaguucccauucuguugauugucccaggguaggugacaaacuggggauccucucuaguccagagccagccuggaaaaacaggccaguagcagcagagacaaagagcugggacaucacugaaauauuuagacugcacuagcucaggccuuaaaggucuuccguaagacugagucacuugguuuauauuuuaauuuuucuccaacuguguuucccgguuugccuggucuuaggauauucccaguguaccucggacacacuaguuuuaccucaacucuguccugucagacucucuacauccaugcugucccagaguuacaggcauuucucaagggggcagagauguuggcagcaagugacuuggguucacaucugggcacugccagaguaaaguuaaugaacugccuuccugugcccaaugaggguagugaugguucuauaguuuagauggggaugcugucuuaggguuuuacugcugggagcagacaccaugaccaaggcaacucuuacaaagacaacauuuaauuggagcuggcuuacagguucagagguucaguccauuaucaccaaggugggaacauagcagcauccuggcaggcauggugcaggaggaacugagaguucuacauuuucauguaaaggccacuagcagaauacugacuuccaggcagcuaggaagaggcucuuaggccacacccacagcgacacaccuacuccuacaaggccacaccuccuaauauggccacucccugggcuacucauauacaaaccaucacagaugcugugaagacagcuuuuggaguaagugguuagcaaauauuaguacuuauugguauccagagcuccacguuuauaaauguuuuaaaguuguugaauagcaugcaucaguccuccaaguaguuggcagagcugaguuuugagcucagguuugcucugcccacaagcauagguuucugccuuuacccugguagcagcucucaugcaugucuaacuccccucaucuaggacucaagcuacagaacagcuggcagaggugggaacugcaucucaagucaauucaagugacuagcccacugguugacagugcccagucguaacaaacuuaaccuggagucguggagguggacaugugaaggaaggaccccaggaccuaggugucaagggcugguccuuucccuuacccagcuguuugcugccuguggcgcagggaaggcggugguauucucaccgaauugcucaugaagauugggccauguaguguuguaagcacgagcaaucugguuccccuguuaccuagugaggauaagaacaggagguagggugacagaaacaaaugaacucuacuggcaacaagcuggugaauuggaaggcggaggaguuucauacucaguccuucgugccaggggcugcagauacaaaacucacuuggcauuccuaaggggucuaauuuuagagccagaugagugcccaaguggcuacuaauucuuccaguagccaguuuucuugauguggcuucugaauuguccccugguccucagggagcccugaaguuugaggggucccauaacaucuaaaaaaaaaccaucauggucagggcggauggggaguguugguuuuugguaguuucuuguuuucagguaagaaucauuuucuugguuaguuauaauuucuuuggagagaauagucugacagacaugggcuucuaaguuccagcggcaaguuaauccagucauugcuucaguuaccucagguggugcugggagagaacugacccagccauuggccuuacaguaucaugugcugaggauagaccggcuuucugugcuccucguuguggucugcaugugacuuagcugcugugaauuuuuuuucuccccagacgggguuucucuuuguagcccuggcugucuuggaacucacucuguagaccaggcuggccuugaacucagaaauccuccugccucccaagugcuggaauuaaaggagugcaccaccacugccuggcagcuggugugaauuuuaagguaguuugagcccauugaaauaaggaguaccuuugaccaguguguggauucgaacacccgucaaugcgaucccagucucagacaggguuugcuggguuacuggucuuacaacccccuucagcagacguggaugaggccuaugcauagacagcuugcugugugaagggucucugcaugcguauuuaaagagauuaauguaggacauguuccauuauaaucuguuugcuuuucaaccugauguuuugcguguuaagaacauuggacccgagccuaagccagugaaacugccuuagugugcacuggcugcguuuaaccauguuuguuaaugaguaucuacagagaccagagaaauguguucugaugaggcuuccugagccuuggccaagagaucaaauguuaacacuaacagaguguucuuguccccuuagaaaacuguuucgaggucuggagcaaugacuccauagguggugcuuagccugauggccugagguagaucgccaagaucuccaccuucaggacaaccaccuauugcaaguuauccucugaguugugugccaugacacacacacacacacacaugcacauacauacaugcaaaauggguaaacuaaaaaaugguugccucuaugaauaagaaagacaacuuauuauaggugaucucugccaacaccaggaacagcaagguaauaaugaucagcgugagccaagagggaaaucugguucaacacagcucaguacucagggcugguucaaaguuugcaggucugacgacaggcaauuugucucaggcauauugaagcacagcaugauuuggaaaaaaaguuugcuggugacaaucaccucaaucccacgugcacaagaaagcuuaaggcguggaaugacuacaucgagauucucuguaaagcgauuaugacaucuuccauaaagaugaguucuauagacugcaugugccaucguaaagguugagggguggaggaguggagagagucugguguggucucagucacucagauagugcaaaggucuccaggcuauaaaccacccccacuaucugccuuccggacagaaaacagguucuccagucucuucuuuugaagaacugcguguuuaacauuccuggcuuucccuagugcuucucugugagcacaaggaccuccgugccucccacaacuuacugcucaugcagagcgccugaguucaccucccagcacccacaauggcagcucacagcuaacuguaauuccaguuucaaaagcagcauaaugcuauaauauuaauuaaugcuccuaguggcugacauccuaaauuguuugugagacugagaaagaaugacuuguaaaagcuaaugauuauucauagauaaagagcuugaaaucacuuugcuucuuaguaaacuauagaaaaugcuuuacaccuaucugguugguugguugguugguugguugguugguugguugguuucuuauaaaagcggguguuucuaaaaggcuaggugcuaaauguaaggacuaaaaucacucauauaaaagauccuuuaauaggaauuaauacuuuaacugaccagugcagucaggcauccgugggacagacuccauucaaaacuaaccccaagccagccaaaacucuaggaguuacaguucaguuuuugaaaugcaaggggagaccucuugccccaaaucuuucuucuggugcgucugcugcgggcgggcuagcgugguuguggcacuaauucccuucagacuguggaacaugagaaaucugccagugugcuacgugaaccccccaguaccguucaccaccagcuggcagugcugugcuguggaugccuccuggcugcucuauggagugccaccggcaugggguguggcccugaugcuccugcaucuuugcugguugucuagagggaugcauuuuaacagucugucguagccucggauagaugugacgagaacguacuggaagccccuugucuccugucucuccaggguaccuuucauuugccuccaguguaccaaagcugaacauucuuugcuauugucugcaauguguucuuuugagcuauguauggcauuuuuccuuacccgugccuccuucugccguuuggaaaguguguaucuccuugaacucucuguggcuaagugagcauccacaccguccccaguccccaguauuggugugagacugagcaauagaaggccuuucugcaggcaggcagcagccucucucagcuaacuccucuguuagagaacccacaucacugauuaccacaaaucucuuguuuccugucucaagaauacuccucuaaagaguaguuugaacucugcccagucucaaccuucaggacaaacaagccuuuaacuauagccauuggacgccugcucucugcaugcuaaccaauccaucccguuacuucaccuagccaccaccacaaccucacuucucaaaaguugugugugugguauucccagucaggaugaucagucugugcgaagagggcaccccaucucuguaugccacucgggccgcuaaccccaguacccugugccaccaccaucccagcugcaguaggaccugaaacaaacugaccaaaugggcaggaggaaggugguaugcccacagucccacgcaacagccccuuccuuggcccacucuugacccaaagugaagcuggccaugcuuccuccaccugacauacacagggcgccugaguaccaaguacaaaaacaacccuguuccugcccauggcugacccaagugaacuugggagucagagucgggguggggcugggaggagguagguuuuucgguuuucuuuuuguuuuuuguuuuguuugggguuuuuguuuuguuuuguuuuaaauaaaacuaaucgguuccugaagaaaauagaaguggagaaagugaaagcacugcuugccgauggaaauugauacuuuaaaaaggguuuggcuaguagaucauaguaaauaguuacauuguaccuggcccucuaucagccgugucaggcaagaugcugaugcagcguuacugaugaaucugguggccuuucuuuuucugggcguggggagcacagguuacugcauccaguuugugccgguagaaagccacuuggacucacagugagggaauggagcccuguuuguucccuuugccacacuaacaaaccacacauuuaguaccuaaaacaaguuuauuuacucucuuagugugcuggaggucagaagucagacuggggcagacuucccccugggaagagucacuuugcauuuccagccacuggaagccccugcucugcucagcuguccacccagccucacuucagcuccagcuugugacucuggaccuacucagauaaucacaggaucuggagccaaaaccccugagccaagccucagaacuaugaaugcagcguuuccucagcuccugggcaccauacuguguacuuggacaagaguuucuguggggcuuugcggcuucugagaucugacaguuucgccuggagugugaaggucucugugcagagaaagccgccuugcuuucuuccuccguagguugggaauagccucugaaaaucuuuccucaucuguaagaagucuguaauguguagaaagggcacagcuguuguggaaacugagcuggcuuauuucagcacuggccugaggagagagcacaugcucucaagcauccaggguaccucuggguuuaauaggaaaauguucauuuccugacccaucuuugucccguagaagggaaauuuuacaaggccucugucugcaguguuccuguggcucuguugggcuaugcucugugaaguaugauguccacgguacuagaaguuucuuucuaagaaguuuucuuucuuauuuaaagggaaaagggaaccucagagacuccauccaguacucuauagauaguaacugauuuuauccuuaaagggaaaaaaaaaagcuaaagagacuagagagaaaaagugaugugcugggguccccucuccccuucagccaugucaccugacagagcauuuccuucccuugggucucagguuuccugucuguaugauaagcuuguuggauaauucaguuguaauguccuguauaguucuuaugcaauacuaccacaaaguauccacuaaugacaugguguuggcuacaauuuagccaaaauggugcuuguacuuaacacauuggacaaaguuuguuguuaagaacugguacacgccuuuaaucccagcacuugggaggcagaggcaggcgaauuucugaguucaaggccagucuggucuacagagugaguuccaggacagauggggcuacacaaagaagcccugccucgaaaaacaaaaacaaacaaacaaacaaacaaaaccaaccaaacaaacaaaaaacccaaaaaacaaaacaaaacaacaacaacaaaaaaaaaaaaacccuggaauucugugaaagcuacauuuaaaauauugccuuguugccucuauuaaacauaaaagagagagaaugcucuugagaaaaacuguccccuggggaagaguuuaccccagccugagaacaucacagggugggcaggaagggaacauuggccauguagccauauuuagagcaugguccagugcccacccauugagcugaagguuugcuagaccaccuguggagucacauguccaggcagccucagccaggccuagugugugagaaucucuaaaaggccuguguguguuguuucuuuuuuuuuuuaagauugauuaauugauuauauguaaguacacuguagcugucuucagacgcaccagaagagggcaucagaucucauuaugggugguugugagccaccaugugguugcugggauuugaacuuaggaccuuuggaagaguagucgggugcucuuacccacugagccaucucaccagccccguguguguuuuuaaaagcucuccuucacccccauguauccugugguuuagagcuucugucuuugccagugcuguuguaggaacaaacugagccuuugaugugaugugccuuugcuuuugagcuucucugggcuacugaaccaucccuuccaucuuuagcuguaucucuuacuguaguuaucuacuacgacggcgacgacgacgacgacgacgacuacuugccuaaucaguagagauuccuuaauaaccuucaucuccaaacauaggcacugaagguagucagaccagcuggaggugcagacaaccuuuggguuccucuccauuauggagggugcuuagaugucuuggcuacccucugugagugaaucugaaagcaucccuacauauaaacuggaguuuuuauuuacuauuggugggcuaucuaaauaauccauguuuccacacaaugacccagccuuuuguugucuaugagacccauuuaccuguuagcuaccaaugaucaaucauaauccaaaaacauugaaugggaaauuucaaaaacaguaagauauuuugagagagaacacauucccacagcuuauauugucauauguauuguuccacuguaaguaguguuaacuucuugcugugccuaguuuaucgauuaaccuuauucugaguauuaaauauauagaaaaauauagggguccauaccaucugugguuucagauauccacugugaggacuugcaccccucaaauaaggugaauugcgauaugucucugucccuggauuuaacaugcacaacuguuuauuuuaauuuauacuuugggucuguuguguauuauaaccuuaucaggcaacagccagcagggauggagcugcuguccaguggaggaguacuuccaggcucauuguaguaaggaagaucacgaccaggggaguuguaugggcucuagccaagcagagaaggaaggguuaucuuagcacuguagaggacaguguaacuuauuucugcagcauuaugaugagcacaaaccaugacuggggaaagaagcagacccucgucccuguuuccuuggaaacuacgguguugagauggacuuaggaugcugaguccagaauuucccuaaugugaugccugggcugagaacucggugacucuggugcuggggagcagaggaggguggguugauucacucuuauguuucaaaaugcaaaguuucugagcaucugugauucugcaaagccaggucucuccuaaguggugucacucugacauggagcuguugacacuucacagcugggagaaaagugguuuccuguuggcuccccaccuacuuuuaucuggaucugcuguccuagccuguuuuaucaauagcuagauucacugcuggcugcgccgcuucaggcaugggugccugacugacguggucaauuuugacccagugaucagugaugcauuauuacggacaaaggguagggugaccuagcauuuucaucuuaugccuuaguggucccuagaauucaugaaugcuaaacaaaacuaugguuagaacuaauguuagaaacagaaauaaaaaaguauaagaaaaugacaugaguccucucuagugauuggauccuuugacucgccaucaccagagaauucauccaagagaaucaccagauaugacagaagagagccccagacaggcugugguguuauguguaacauagagagcuaacacaaggcaggacuaaaaggguuauugugaguccacaguggagagcugacaccucugggggauuuuuaugaaacaaaguagauauccaagaaagggguggaaagauugcaagagccaguaggggugggaagugcugggcugagguggaauaagccugcagggaaaugguguccucuggauguagugggcaaauugcauccacuuacucucaacaauaugggcugccugaaugagaccaugucagucaacauuccagaugagggaaggacuugucagcuguugagagaaggagguuucuucagagugaaucaugugauaggcugcccaugccaaagugguucauaucacacauauguacauacuuggacuugagcuauguauauguguguauauacacauauaugaauauguaacacauacauaauauauauaugacauauuagaagaacaggucauaaauuugagagggggacguagaggggacacaggacaguuuggagagggauagauacaaugagaacacauuauauucauguuuggaauuauaaaauaauuaaauaauaagauuuaaaagauagcacaucaaauuuuuauaugcuuguagauguucucaggaaaggaauaucugaagacagugucaauuaugacagagaggcuggauugugggaaauuuacuuucuuugccuaguaagguggugguuuucugcaagccagaagcauauagcauaacauuauagagcagcucugaaguaggcaauauucuucggaaguaaaugagcaaauagucauggaccagagagcaggcgugcucuaaggggaggggagcaggcaggcucuaaggggaggggagcaggcaggcucuaagggaaggggaggugccaugucuggucuguggggcugucggcuuguguugcuugucucgguguuucugguaaauuaaagaagaugaucuuuaauuuuugaugagcagguuuugugcugaacaggcugaaagaaccugccaucucuuucaguuuuauaauuguuagcauccauugucauuauuuauaguuuuguauucuuguguauugucuguuacuuccauuaggaaaugacauuuguuaggccagaaugcgguaacuuugacaucagcugcuucgcucaagggcaugugcaaguugacaucaagugacuuccuagaucauucucgcacccccccccccuuuuuugagacaggguccccugcugagucuggagcuggcugguuuggcuccaggaagcuccagguuugggccagcaugcuguauugcaggcaguuuucuaacugagccauccccuccccuccccgcccccaacccuuguuaaaacuuuguauguuucugccuuaucuagagugauucugacuuuccuacagggaagcaaugaugaaauacuauguacuuuagagaugagaaagaugugguaaauuucugaagucuugcugaaauagacugagguuuguaaacagcuugcuuugguuuagaacgguuuccagcugggcaguuauggaccacaugcaccccgugauagcuaugaaugugaccgaagaaaagcaaaacuuaaacaugaaguauuuguguguguguguguguguguguguuuuaauuaauuacuuaaauugguaugagcguaagagcaagugugugcacugugugggggaggggguuaagcacaugcaaaggcacuccaguggcaaucagaggguaaauuuguggaguugauucuccuaccuuugacguagguuuggaaugcaggccaccacgcucguguggcaagccuuugucugccaagcgucuuuacacacagguuaaucgugaacugcacaauaagcuuguaguaacugugucacuucaucugacuugucuuucccuuuucaggaucugggacgaugucuggggaagugccacccaacauuaacaucaaggagccucgaugggaccagagcacguucauuggccgagccagucacuucuucacgguuacugaucccagaaauauccuuuuaacgaacgaacagcuagagaaugcgaggaaaguggugcaugacuacagguaaugcuggcgcugcacggugcacgguugcgcagugcgcaauuauggguaaccgccgccagccggcgcuacauuucccagcuuauugcaugauggauucguugcuguuuucaaauggcuucgugauuuugcaguacguuuuuucccccaguaaacugcugcuuaccaaaacaaaugagcaaauaggaagaccaaguagaaccacaaaaaaauagccaguguucguuguagcugugaggucucuuuccccagcauccugaaaccuuuucucuaacaccagugucucaagcaucuuucuaucuuuguacagaaacagcaucauucaggaaacuggcuccugauaacuaggguagggccguggcugcugagaaacagccccagugagaaagacuuucuagguguaugcucagaugggaaggaaucuaacgggaguucaggcaugcagauuugagaugcaccccaucccugagagagccacgcaggauuuuaagaggaugcuacccaugcagggacagucuguccuccauguucaucaauuucccuggccuugccuuuaaccagcucugguagaaaccucuagaaaaaagucuuccauugauauuggacauggacagacuuuucuugugacuauuccgugagcaauacagucuaacuguacagggcauuuuuauuucuugaggugugacagguaaucuagagaugauaccaacguauaagagagaacgcagacaugaugcuaccugccugagucucagugacucagaaggcugaggcaggagacucaccuagccaguguguaagacaagcuugagcaauguuguaagaucccaucucaaaaauaaaugaggaacauuuggaaugaaaugcaaauaaacaaauaccaugcauucuauagacaguacccuaaucucagaauuuguaugcuuggggacagcuaauucagcaguagacuuauuuuucuauaaaagacuggauaaggaauauuuuagggacuggagaggggcuuacauuuaagacuuagcacuccugaucuugcagaggacuuggguucagcuccuaacacccacguggcaguucacagcugccuguauguccaauuuuaggagaucugaugccuucuucuggguccaaaggcccaggcacguaugugguacacauacaugccugcucuuauaaucauaaaauguuuugaaagaauaaguacuucaggcuuuguauacuucaaggagucucagucacauaauaauuuuguuaacuuuuuauaauccuuuuaaaauguaagaucccuguaauccaaggggcaucuaggcauggacacuacuuggcugacuucugcuuuagggaaaagccaaucagauacagggaaucggaccaucaggagcgcugcaccugaacauuccaggaauagcgcaccucaggcuaggcauuuagaaagggaccaguaaagaguaagucugaccagagucugcaguaugucaagagaggaaggaaggaagggguuaaaaggaacacagcaagagccuaggaacuaaaccugcugugccuuacaugccugcugauagaaaccagccaacuagaaauaagacuaagcaaugauacauuccuacccaagagcuuuugcugccacagccugcagcucggguccuggaacccugaaugaggcagagagggaaggaagaaaagacagacacacacauacaggaaagcuggcauccaguggagcugugcgcuguguuggagggcaccuaccaagcaacccggaaccucagguguuuauuagguggagcacagaggagggccuagcuagucuggguaggagggcucuguggauuagcaggcuggggcugcaaauguccuggggaaggaagcugcagcugcuaaucuuugcacacugaucacucauacuuagacucacccuuggccaucuccccugagccuggcccauauagggaucugacuuugucaguuucucaugauuugaggccuggccuuuguuguagacauucucccaggggaauuccuccaccuccuacaaacucagacucaugugcaaaggauaaaagucauaggaacauuuaauauuuuuacauggcuguugcauuagcaagauuuucucauuucuaaauaaucuuggauguggguagaauucuauuaugaaagcuuauuccuacauccuuuucuaaguggaaaagguaggacaauuaaaaucccaacauuaggagagugauuuuuuuuaaagcucucucucuuuuuuuuaaaguaaucuguaguguuuagaggaugggucugagucacagaagggucacacucccucugaagauucucaggaagggucccccuugucucugggaauugccagcaucccuuggcuuguagauacgugauuguacccugucuuuucugcuuguacacagacacuauuccuuagauuuaugacuacuuauccaauagcauuucccuuuggcuaauugcaucuauagaaccauauccucuuugauguggacaucaacuugggaguuaacccaauguagauggguagacuauuacugaauaaagacccugguuagagagcaucugguuugguaucauaccuuaaacaccuugaaagacuguauuuccccaaauguugccaauggcaaacaguauauacgcucugggcaauuucagagcuccacuaaauuugaauauuuucuaaauuucugacaaugaguauuucauugaugauaaaauaugacaaauugugcaccaagcccuuuauuugcaccaaagggucccuaaccuguucaccaacuacagguuugaaauaaagcaauagcguugagagccaucauguuggucugacggcuaaaaaugguucagaguuugccaaauucagauggcacuuuuaacacgucauuuaaaacaaugaauaucuucaaguugaacacugcuugguagacauguuacuuucuguuauuuuccaaguuauggauaaucaaggugaguggguuugaggaguuugcuguaguuggguuuuuuuguucuuaugcucuaggcugcgagcaugggucagggauagcgugcaugcucaguaugugugaggcgcuggguucagucccucguacccagaacauagaaauauuuuaaaaaacaauaauuacagcccacgcucuaacaggccugccaggucccguaggcauaguaaagucgagcaaaccauguaguucaugguuggcgaugcccgaaaggggcggcaguugcuggaccgguuguugucaucuucuaggcaaggaaucguuccugccggccucacggaaaaugagcuauggagagcgaaguacgcguacgacucggccuuccauccugacaccggugaaaagaugacucugauaggaagaaugucagcucaggucccgaugaacaugaccaucacaggcugcaugaugaccuucuaccgguacguuccagcagggugcgcgucacggguuagucagugugcuuuugcagucauucaaagaauauuuuaauaugaguucuacggaaauaaaaugccacagugauuauguuaacaagaaggaugaauucaucccuaugucagaguauguuauaccccauaaauauagucaguaaaaaaaaaaaaaaaaugaaagaagauauaggucaggcgagauggugcuuugaguaaaagagcuugccaccaagccugaacacaugguuugacuccugggaaccacuuaguggauggaacaagccgaauuguuauucauucucugacuccacgugugugcaugcgcacaugcauacaaaauaaauaaaaauucaaauuaaaaacuuuaaaauaaaauagaaccuaugacagcuggaaauacgguggagguggauagagagguucaccccuggaacuacaucucuugggagacuaagacaggguuuugaguuugagaacagccugguaauacagcuagcaacugucucaaacaacaacagcaaaaguaacuacuaagauaagaugaggcaguguugcuuuuacauuaagaaggauaucauuucaucuucacuucugcucuaagugaauguuaccauucucuucagcagccuuuagcaugaugugcauaaacaaacaucuguuuuaucuaggcacggaggcucagaccuggaaucccagcacacaggagacucaggcacucagaggccaugaguuugacuuuguuccuggcaaacaagauaagauuaaauaauuaugaugauaauaauaaauaacacaauucauuuuauuuaaaugcguguuuugccucaaaugcaaaaucagggaccagagaaguggcuccauggcuaagagcucucacuggcugcucuugcagaggacccuagcucaguuccuagcaccgcaugucagcucacaacugucuguaauuccaguuucaagagaccaucaccuucuggcaggcacuguacacacacggugcacacacauacaugcaggcaaaaacauucauaacaccuaagacuagaaauaaagcuuuuuuaaaaagauacuaaauaauaccuuuguuuaaaaggaaggugacauuuccccuaagugugaaagucuuaagaaaaugagauaggccgggcaauggugacgcacgccuuuaaucccaguacuugggaggcagaggcagguggauuucugaguucgaggcagccuggucuacagagugaguuccaggacagccagggcuacacagagaaacccugucucggaaaaaaaaaaaagaaaggaaggaaggaaagaaggaaggaaaaaaaugagauaggagaaaaaaaagagucuagaaacaaauucugcucuuucucucuguagaugcagaaguguuuaggcacugugauagacaaugauacagcauccucaugcauuaaaccgguaagcagagccaagccugcuuugcuugcaaauaguuuuguuuuacccaagagaagauccauuuauuaucuacucuguaccagguuuugcguaaaauuuauuuauuuacuuacuuauuuauuuaauuugugauaaguguccuauauaaucuauuugucaacucgacauaagcuagcaucauuugggaaaggaaacuuucaaauaagaaaaaucuuaccauaaaaacugaccuguaggcaagucuguuaggcauucucuugauuaauaauugauaugggagagaccagcucacaguggguaaugccaccccugcgcugggaaacagacugagcaauccaugagaacaagccaguaagcagcaccccuccacggccucugcaucaacuccugcccccaggccuuaaguuucugcccugacuuccuucagugauggacuauaacguguaagucuaagcugagcaaacccuuuccuccccaaguggcuuuuagucaugauguucaccacagcaauugaaacccagagacaggagccuugugagcuugaugguaaggaaacggagugucaagguagaugcucuguggcccuacaucuguagcccaggcuaucucccugcauugugccuuuccuugcugauaguugaugguuaacaucucuuuacgaaccccgagggaugcucacuggugcuagugguaugugacaacucugcuguguuuuaggaccacaccggcugugcuuuucuggcaguggauaaaccaguccuucaaugccguggucaacuacaccaacagaagcggugacgcuccccucacugugaaguaaggcuauggggcugaccuguccuccaugagccccugcuccuuguauagcaaugcacuuauacacacugcuugcucaugcaaugucucuccuccucccucucgaacugucugcuguugccugccuccucugacgacaguugugccauuuguuguguagugcuguguaaagcuguguggcuuauaccccaagcucaggacccugcagaaugccaacuuggcagcccucagcccugccucuguuaaauaauucccucugggcuacauaagucaaagcccccugccucgaaacaaaaugaagggacuuuguaguugugcgaccuuucuagaugcuuugcuuuaaaaagcgccucauuuccggacuccaaagaaagcaaugggcuuaugaauuugucuccuguuuaagaagauuucagggaaguggaggggggacaaacugagauugaauaaauaaaacuauagauaucacuugcacuguauuugaaagagaaauaguuuuccuguuuuauuuuugaaaauugccuuugacuccucuaauacuuugauaucaucaaacgaagcaagggacacggaaaccugccacccaguggaguuucucacaaugagcagaaugguucaggcucggcugcacauuagagauaagcuuggacucuuuuuauacagugagguaacguuguaagaauggcagagcugcccuuugcuuucuguauguccguuaauauuuugaguaacaauuuugauuugugcaaauaugccucagacacugcccagaggcucuccuguguccgugacuuuccacacccucucaucccugcuccuuccucacuuuccaugcgccucagcugcaugucugcuuguuugggguuguagcccaguuuuagggaugucuuugcuuugucuuugggugcucacucugacggagugagcccagauuuugcucugcagacucuugguuucuuauucauuucuguguccccaguuucuuccggucauaguucaugaucccccgauguauaccugucauuuacacaguuucuuuuuuucuuuccagugagcugggaacggcuuauguuucugcaaccacuggcgcuguggcaacggcccuaggacucaaugccuuaaccaagguacuuuagcuuuguuuccaugguaaagugucucaaccuguucucaccugucacuccgggugcuucugucacuucucaagauuucuagucacuuggcuugcuuguagccaucuucaaccacauauuuuaauuguaucuucuaguggcucaaggaaggguuguaauuagaagcaucauccaagacuggucuguucccagcucugagguuuaacuauuaaaugccuuuucuaaaaagcccuucugagacuggaaugggaguccggggaugugccuugaagagguagagcuacuaucucaaaucaaaguucugguauuugaggacuccaaagucugugugcuuucagcagcugaucuaagcuaucaaagugucugagauggauagauugucacuguauguccuugccagagauacagaaauacuucuaagcguuugagggccucuuagccuggcucuauccagccaggacugcaguguuuuuaggagaauauaagcauuugcauucaaccauccaggaaaguaagacgacgcuucuggaauuaucuuuccuacagcgugucuccccacugauaggacguuuuguucccuucgcugcuguagcugcugcuaacugcauuaacaucccacugaugagacaaagguaagaugaaauaugugcacugggcaagagaauagaguuuagaaaggacgugaauucugagcucugcuuugaaauacucuggaauggcugacccguuggguuuucacuuacugaagugggccgaagcagaggugugucucuagccuacacccucugcaaagagagaauucuguaugaucgagaccagagagaaaaaccaagcguuccuugaguuuuccuuggaauuuucuuacggugauuucagucucuuagaacggauaggaauaaaaggagaaaaaaaagagugcgcauuuauggauggauaacaaaccaaagcaauaacaggaauugggcucccaucguuaggauccaaagcuaaugaauaucccacagggcuguguugcaaugacuucacugcuugaguucacucaaaaacaguauguacuguaucuauuucugauuuagaaaguuguucaaaucuguacaggaacauagaaaucaaccucgccuuugagcuggcauauccaccccucaaaucuaucauuauugaaagguacauccgugaggggugaggggggcacuuguguuauuuucccuuccugucuaucacgggaggcuugaaccuguucgugguauuuaaaaauaggcuuaucagugccaaaaaaugacacaugagugggaaacugggugaaggaggcacuugaucucucucaacagaguccuccuucgggaugcuccccgaaggcaucugugaaucccuguguguguguguguguuccauccuucagggagcugaagguugguauuccugucacugaugaaaauggcacucgcuugggagaaucgaccaacgcagcaaagcaagccaucacgcagguggucaucuccaggauccucauggcagccccgggcaugggugagugagcuuggugguccugccuuguaguucauuccaagcuuuuaugugucgguaaacggaacagcaaacacaauuccccuuugugaaaauugccuucugauggaggagccaggaaugacuaaauaaaauaugcucuacaaaugcuuggggcuuucaaaagugucccagauauuggauuuguuuggguuuuggaacauuuacacauauauaaccagcuuccuugaggauaagguccaaaguuaaauuugaaguuuauugcugauacauauacaucuuauacguguggccuacacguacaauaauaauuucaugcaauauugcuaaugguuucaaaauacuauaggugugugucccagcugauguguugugugacuugagaguggcugaggacaucauuugguuuucaacaaguuucugauuugggaagauuucagagcugagagcuaaggaagggggaugguagggauagaagaagcaaggcuggcaggcgagggaccgggaagacauggugaaucagagguccagcgggcaucagcggggaggcaggagcuugccaagugugugggaggcacucuguaaagucaggugcagcuggaggagagagggggcuuuaugaagccucaaagacuggagucagcuccuggagccaacccugggguuggguacugggacauuccaagcucugagaaguggaggaccaugcccaguuuugaacaugguaauuaugugaaugugggugcugggugagacuggguuaaaggggugcugcaggggugaguggagacuguucaggaggcugucucagcaccacaggaagcaaaucauggucacgcugaggacagcuuuuagaaaaugugugccugaccacuagccugguaacuauaugguguagggucagcaugcacugagcgaacaucugggucauaguaagacccuuugagaauguccagucuacccagugggcugcucagagggccuagagaagguacucagacacugagaaucacauggccugggagugacagcguucucugcaggaaaaacaaaggaagagagagagccaggaguuaaugugccuuuacuucaucaccuaaccucgguguagacagcacuuggcuauuaggagacgcucucgcacgaugcaugucugccagcugcugccuggcuugcaugcugauuuguuugacuguugucacgugauacacugagcuggcuaguuugaaugagcaacagaaguugaagagaaguacaggaaguaaaacugaggaguuuuugcauuugacccugugucugcagcucagcauccaaagagcccaccaaccuuccaaaaggaaaagacuugugcauugaacacacucaggcuuucuuuuuaucccucaaugauacaauguaacuauuuacacaucauuuauguuauacuaugugcugcaagucaccuagagaugaccgcagcugugaaggcggaguauccaugcacuguguaccuauaaggagucccggagccaguccccuguagauacugagagacaagcaaugcugcauuucagcuaacuaggggagauugccuuugucuaaccguacagaagaaccccucuguacucuagcaggaugccaguguggucugugaagguaucuaggaaacuacagucccacaacauacagagacucuaauccaagccaagggugcuugucacugccaaagagaaggcuaugagcccccgcacaccucuggagcccugauuuccagauguccugaaaacagcaucaugccucugcguccacucagcucccgcucugcauuugcuuuggcuugagucuuuccuguuucugagaugcccuccucccagagucggucagcucacuuccugugcuuccagaagcuugguuguuuuccacacuguuucauccccauagaagacccaggucucucggugccauugacaucugugagagucauagguuuacugaaauagucaacguguuguuaagcugauaaaggcucugagcuaacgaacgggugcugccucccacaguagagccaggcuaauguaaugguccccguuccauaaaugggaaaacaggaaacugaggcucugagaaauuggauaagugcuccaggauccccagcagccaaggcgccucaaaugcccuaaacaguuuuuuaucugagcugaagcaggacccuuccaguuacccucccugcaugguagacacccaagaaaaaugacauuuauuuugcuaacagagaagaaaaaaacauuccugguaucuaguauuaugaauuugaggcaaaaaguacuuauuuuuauuuuuguacauguuguaugugugcuacaugcaggcaaucauguguguagaagcuaaagauuucagggaccuaaaguuacaggcaauuugugaguggccgggacagggcagggugggugcugggaaccaaaccagauccucugagagcugcacacaucuucaccacuuagccaucucuaagccuccccgccccguucccuucuuuauuauuauuuccauuggauaaaucugugaggcaugcugggauaauucagcuuacaucugauguauaacaaucaguaacccuaaauuuaaucauuuaaagauugcuccaggagauuucauucugccaguguaaaacuagccuaaaagggacacagcuuucuaucggauaguugcaggaaacucagcugaaaagagguaguaagugcagauuuaaguggcucugucuuuauuucagccaucccuccguuuaucaugaacaccuuggaaaagaaagccuuuuuaaagguaaggcaaguucuucuguuuuuuuuuaugagcccuuuucuuucuuuucuuuucucuucuauaauucuuuguuuguuuguuuguuuguuugucugucucucuguuuuuugagacaggguuucucuacauaguccuggcuguccuagaacucacuauguagacccccgcuaacuuugaacucacagagauuuaccuacaacugccucccaagugcugggauuaaaguugugugccaccccagcuggcugugaguccuuuucgguacucuucagacuucacacugaacagagugguuugagugacugugagugccugugcucccuuccugggccaagaaagauuaccugauguggcuggcgagaaaugaagccaggcuugggcuggagcagccucagcaaaacugaggaugugacaaguuuauugcaugcaaccagacuuugcauaccuuuaucagaaacagaauauagugaaaauugccaggauugacacaguuguaauuccaggauacaaugguguuugcaagcuauagagaguacacaagauuaaugucuaaacuguccuguccagcuuccaugcuuccuugacaucuaagggaacagagaaacacaacgcuucacugccugaaggcacacaaugccccaggagcaucggacucuaaccugaaaacauauggugcgugucucucaaggcagcuaggccagaccaacuuugugauuuccuacaagugugucuuagaaaguuacaaaguugcuuccaagugacaguuugaaggucaguuucccuugaaaaguuacaaaguugcuucugagacggucucucuacucugcuggggugaggcuggucaucccgucaucugcugcaugccuaacuggauaaaacugggaugauggcagggacuuuggaauaugggaaguugcacuggaaauggaaagcucuggagagguagcuucauggaucauugaauuuaguauuucucuuuggugaucgucucuaaaaguuuauuaaucuacugacuguuugcccugacggccuggaaauaucacacaaggaagugcccacugcugugugccuucucuaugcccuccagaguguguuuuagagguuccgauuagcccaguugggauggcucuugcguaugaugcugugugcagagacauacucagcagcagagguccuggcccucucuggagcucucuugggaugaaucauuugagucuuaaaagcagaacugugaaaacaagggagagccaugccuaaaaguucagaaagggaugcugccucgggccaggugcuucugggugagaucauuauguguauucguaagugcauguacuccauuugggcaccgagggaaaggaaguccauaugauggcuggaugcuucauaaacacuuucucuguguaagccaagaacacacgcugggaagagacagcaugagcaccucacagggccccuguaaggaaaaggaacucucagcccuguucuuagaaccucuggggacauggagaauuaaaacccccaagcuauacucucugaaacaucaaggcucugucacucuaauguggcaaugugcaguagugucagagucacuggauacugacaaaaugucucuucacuccuggagcguugucagagggaauccuccugcuucucuggaaagccguacccgggaggcugcuggcggccuuagccucaaguuaacaaaaaggcuaaaacaguagcucagacuugagcagcgagccugucagcauggcaguggaucccuuaggucucgguuacccgcaguccaggaaaacuaaaugggaaauuucacgaaccagcaaugcguauguuuuaaauugugaaccuuucugaaugguccucugcauccugucuagaauguaaaucggccuuuugugcagguuguccaugcuguucauguuaucugccuguuaggcacucagcagccgccucucugcucaugucagcuaccaugguuucauagugcuuguuucuaaguaucccuuaauuauucaguaauggcuccaaagggcagguagugauccuggcaguuucaugauacuauuuuguaauaauucuuagucuuagaucuaauaauugugugauuagcuacugccaauauuguuauuauuagcucaguaucucugauuuauguuaaauguggucauaggagacagugucuaaauggaaacaugcuacaucccaggguuauccaagguuccaggcaaccacuugggggcuuggguaaggggaguuggcauauagaacaaaaugccauuguauccucucuugacaguuaaccuacuucaguaaauuuuuuugaggauacuaaagucuuuuucuagaacaaguuuaagaacaguucucuuugauaguuuauaguaagcaacgcacaacuccuaucuauaaacuaccgaaugauggcaucauaugcaguuugcccaucagaaaucuccauggcuuucagauaaucuaaaaacaaauccacaugcccuucucuguuggucucugcuugaggucgaggggcagauacagacucugagguagugagguggugagggagccucccgacagauccacacaguagacauggagucaguauccugagcucucgaucuggaaggcaccaggccuucauccucugcacugaggauguacguugacccaaucagccucuuagcucacuugguccuaucuuaaggcauuggcauaaauaagucuaaaaauaacagagaaucgagaacauuuuaaauaaggcaaaugucccuuccugccaaaggcaagugauaccgaccuuuaaaagcaaggcuaggccuggagauguggccuagugguuaagacugcucuuguugagaacucaccuccucccaagcacccacauccuuuaaccccagcuccgggagaugcaaugcccuucuugcaacguccucuucuuuguaagaaaagaauagucaaugcuaguuugaccugcaggucauggucaucaugauuuugggucacuauggaaaguuugcaggcugccuucaauagcagaaucacuccguguaagcuuuccuggagucaccccacacccagugagcaguaaacgccuacgcugcaguuauauagggucacccacaguccaaacauauuaaacgggagacuccacagacagacgacgcguaaugcacagcuugacaguggcgcagaggcugagaaucuugucacuuuuaggaaggacauuauucagaagagucugauuccagcugaggacacagagcacgcuggcugccaauauguaucugauaucauggcucgggauugcauccguucauaagaaaguuugcaucuuuuugauggaggacaaauggcuauggggggugagggggacccaagacaggaagucgguucuuuggaauuccaacucauucgucccuuugaacuccuggggucucagugguggaacaguuaccaugguaacucuaaucuuaccauggcaggcacuggacagaagauccaguuagucauauugcacauuuuucuggcugugauagacaaaguuccuggguguauacauccugacaguuucuugcaagaaaggcauuagaugaaagaagugcucugcuccccagagcuauaccguccacaucgcccacaucauccuacauuucuacauucuuaaaaagacauacaugucacggacuuaucccaccucgcccuuuuuaauuuuuaaaaauguauuguuauguauguauauaugguggugggcauacauguggaaaccugagggcagcuuuuggaauugcuucucuuucuaucuuuauggcggcuccugggauugaacucaggauaccaggcuuacacagugagcaucuuaacccacugagccaucgcugcccuccgcccaucuuacuuuauagguugcggcaugacauguguccacacccaucuguaauuuggacguauuccacucacuuacucuuccuaagaagcccuccaucacaauccccaaaagggccacuggcuuuggaauccugguggcaaggugguuccagguguggccagaauaguuccaggucauuccaugagccuccauagcaacagcaagucugguuguagcucuauuuccaguuccaagggaacaugcugcuuugaaaccaucaaagccaaguguucuugaaagaaccacauaugugcagcacucccaaguucaaaguugacccacacauacccaccacucccaaguucaaagguggaguucuccuuagguaucaucuuugcacuuggggcuuguuuaauagugugaccauuaugcaagcuuacacuggggcagaauacaugagcguuccuauuuggagcuugaagccuuuucucgucguuuuuggaaaugcagacuuuucugugaugaccaaacuccucuaccaacgugaaaccgaauugaacauucucagcuauuuaaacaauucucggggaacauucagcaugacucauccucccccacaucuuaucuuuuuccaaguggaaggcuaggaaaacaaaccagcuaugggcgggugacucaucaaaaucccuaagcuaaccagaaguucgcugccaaaauuacaauguauccuugaauaguugucuugaaggauaguucucagcugccuguacuuucauugggaguaaaaccgauugguuugaguccccaaugucauucuuaggacuuuucauucuagauauuucucuaauaacagacugcuguguuugcucaguagcuguuggggaucguuugcuaauggacacgagugugguguucuuuacuuauucauagacaguguuuagucuugagcccuuugcuaaaugccugugguaagcaguauucgguaguagaaucagagaagcagggcaccggccuugcucucagggcaagauuaaggugcaggaccagaggccacggcacagggugacuucagcuugggguagcagcgaaugcagaggagcuguggcuggcauagacucacagaggaucagcuggugccacauguccaguagaagcuuacugagaagagaacauguggcuucauggggaccugugggugauugggucacaccgagggaauugauucuacccuguaugcaaauuacuucuccacaguuuaugucaucuaaauguaaaagcucaacuguaaaaagaaaauaucauugaacaacagcgugggcaaagauuucuuugaauacaagaucaaagugugggggggaaacccaaaaauuuagaguauuucaaagcauuuuugaauacugucuuucaaaaacuacagagaaugagagagaagaaccccacacagugagaccaguagcaaaguaacucuuuuugguaagaaaguaaaucaagaauuuuguuaagaacuuaaaacacuccuucaagaaacuaacaccgugcagaaauaggcagaagaggccagcagaagccucacugcacacauacaaauagcacauagaaagugcuuggaaugcuuuagucauuggggaaauucaaaguaaaaccacaugaaauaccuguuggaauggccacgauccugguugacaauaauaagugcugacgagucuggguagaaacuggagcucucagagcuugcugguagccauguaaaauagugcagccacuuuggaaacuaugcuagucauuuauucaaacauaugcuacaaagcaauccagccacuucuaaguguuucccuaaaagaagugaaagccaaugcccauaaaggagaaaguuuauagcaacuuuguuuauaucacccucaaauuggaaacaacuccaaagucaacaggaaaguguaucaacccguucacuggaauacuucuuaccuugucagcaaaaagcaaggaaguauugaugcgugcagcagcaugaacaauucccaaaguaacaacacaaaaauguagacacuguauaucaagccccagacucagaccugguaaugugugccugucaugccagccauugagggguagagauaggaagaccaggaguucaaggucacucuuggcucuguaaugaguuugcuugagccacccugggguagaugagacucuuaaaagggggaggggguaaacucaaacccucaggaauauuaauauauagugagaucaaagcuacaacuuuacccugggacagagaccaggcaagaagaggaaucucugaagggcauggggaacacggcaagcauuuaagaugauagguggacucauuauuuuuaauauggcgaugcaucauagcugugcauauaggugacaaauuacauuuuauacaguaauugauucauaucauugauugugugucaauaacuguaauggaaaaggagcuauuaggagaaagaaauugagacucacauuaacaucaagaaacauagccacgucacucuguaucccaagccauaucagccugaagauauauaucuucuaaagucacuguacuaucuuugauucaucugaaguuuuuuuuuuuuuuuguauaauauacccacuuuuacagucuguuaagaaagacaugucccaacccugaaagauuguguguauguaguaaaagaucgaccauccucaguucacucguuucugggccucaggccaaauuguccuuaaggaacaggcaggauaagguaguggagacagagucaggaggauggcugaugauggguucgguuuugcaagccagucagaauuucccaguguccuugucacuaugaagaacccucaaccuaagcuagccuucaguuugugugccucuauccugaggugacacacaagugcacucuuucagauaugucuggcucuguuuacuugggcaggccacuagaaaugacagucuggucaggaucagguuuacccacccuuacaggcucacucaacaguuaaccugcucucccaacccuauggcugggugcuauccugggagucucaaguccaggaggaucuugggugagaauuuaucaucuuccugugaaaaucccucaucaaacagccagugauuugcauagagguaggaggaccauauuguguugaaaucauauagcccagugaccugaauuuagaaugggugcuaguaaguacccagaccgccuggccccaggaugcguuucucaaaauauauccugucuugaagugucacaugacaguagguugcuuuuucaaucuuuuggguuaaggcgccccagcauagucuauguggguugguuucauuuugaugauauuuuucucuuccucuuucuucccuuucccuccguccauguugaccuucaccaaaggagucuccuugggcacgaggguaugccuccuaugcacgugucucguaacaacggugugacucagagcugaggugucugauuacaugccagucaacucacggcucuugcggaaacuccugcagucuuacuuagaucacccuguauccuaucgcacuuuguguuguauguuucccucuuuuaaagacuaaguaucuaacaguuauuuguuuucugaaauaccaaccuacacccucauuacccagauaguuaauucggggaauaguuuuaaccuacugacagcggcuaaauccaagaaagaacgugcaagggaguggaauaugauggcugcuaggccccucucacacuugaccacuguccugggcucccggcuugucugcauccuuacccuuagaaggacuguuauuuuguauccuaacgaauccugggcacugccugcuuucuccacaguuagucuguaguggugaggcagagauuuagugcaaguucaugucucuucaagcuuguauguugggcuccucugccacccuagcagcagauaaaccguaaguaaaugcuagcgcaauaacaguugggcgugguggcugcugccuggucaucgcacgugaagucagaacuaacccguguggcacuuuuacccugggucucacuaaucccaucucauugggucugcugccauguggaugcuguuuagucagcagaggacacugccuugaggaagcacaugaaaaguacucacgcuugugucuuucucaacacagagguucccguggaugagugcgccaauccaagucacguugguuggcuuuugguaagugggaauuaaccauuuaaaaaauugacuacuguuauuuuuguacauguauuuuuucaauaggggugugugugucugugugucugugcaugucugggcuguauaugaucaugauagucaacacagaaauuacacauauauugucuuaggguuucuauuccugcauaaacaucaugacuaagaagcaaguuggggaggaaaggguuuauucagcuuacacuuccauguugcuguucaucaccaaaggaagucaggacuggaacucaagcaggucaggaagcaggagcugaugcagaggccauggaaggauguuccuuacuggcuugcuuccccugacuugcucaacuugcuuucuuauagaacccagggcuaucagcccagggauggcaccacccacaaggggccuuucccccuugaucacuaauugagaaaaugccuuacagcuggaucucauggaggcauuuccucaacugaagcuccuuucucugugauaacuccagcuugugucaaguugacacacaaaaccagccaguacauacauaauuauuuuuuaugccuacggaagguugggugauacaagagaaaacuuuugaaaauagcaccaaccccaggugccuagaaaguguggcuccaguaauuagaaagauggaaacuguccauacaggaaucuauauauuuagcuauuuaggugaucuccuguaaaugccagcuaacccuaugguuuuguuacuuuuguuugucauuuuggugaucgaacagucaguauuuguaaggcaaucucucgugcucuaaagaaaggaaagagguuguuauuaaaauacguauagagagaaaaggaagcuggaagugaccccuucacccugcugacccgccauuuuguuuuguucuuuuaguuugguauucgccaccccccugugcugugcucuguuuccucagaagagguaggugcugggguuuuuuuguguuuuuuuuuuggggggggggauucuugucaauuuugauccuaaaaaacaagcuacguacacagugcagauuucagugguaagaagcugggacuuuaaaggucccaggcagaccaugccucugaaaagaagaggcuggaggcuaguuuuggucgggggggggggggggggggagcuucaagacccgcucuacccaagucuugucugcccccuacuguugguuacauuugggaccgguuuagccuuugugagaaucgggcuaccuccugcgugguuucacuuugauaaccuuuagcgugacucguuucauuggagccgcgugcaggcauaucuguagcguucaucccugaccacagcucugcucuucacuuggguagcugucuauagucccagugccguggucauccaggacugugaaugucauugccaugugcucuuaccagcaaugagacauuuucaucuagaaaucagagguaaacaggcuuagccauugacuccuuacaguuuuucguuagugacggcuaauuucccaaagagaacaggaugcucgguuuuuguagccagaugcaaccuuucugcugugugucaugcagcagcccugggucucugaaacuguucgcuuucccuguccuuccuagcucaggauuuaauugcccgugugauaaccuucuuccuucuaccuugucccaguuccaugucugugacaagcuuggaggaugaguugcaagccagcauccaaaggacucauccugaaauacggcguguguacuuuaacaagggccugugaagccaagaucaagugcuggaggccggagccaucugugagccucccuaagccacagcagugaggagauuugugugcuggggcacucaaaagccucuacaagaucuucguuaagagucaagcugccggucaggagucugacauuugaaucguguugugauuuacaaaaaaaaaaaaaaaaaacccuucugguagauuuuaaugaugccauuuuuccaaagcccccacuguaagguuucaaaagcacugguaggcauagcauagauguuccaguuacacacucaguaaacacugguuaucagucauuggaaagguuaccugugcaaccaccagauuccauuucuacuucucuuccccagaggucucagcaaugaaucgggaagacacgaaaggucuaagacuaaauauccaaauuauaaauacuaaggaaacuuuguuuccaguuuggcaaugauccagucuaaaguagaaccucaauuuaaaagauugagguucagagcaucaacacuccauacaccuccccaagucagccauagacuguuuuuuuuuucagaagugaaaccauagucccuauaugccucuuuuuucccccucuuuuuuuuuccauccuuauagaauucucccugcuuucaggaagauacaaagaaaccacaugaacuagaccagcaucugugaacauugugcuauguuccaccuuguuugaaaacugugaaacaguguggcaugccaacaucucuauagugauuuuuacacgugauguauucgguguagcugaggucacuuuggaagucuguggcuguuccauguccuaggcaagccacuuguuaacccugagugacaaucuuuauaaaucauuguuaauucagagauuuguacgugagaaaacaacaacaaaauuagagacuaucuaguuucuguagguuauuuuucccaauaauguuuccagaucgaauuuccucauagagaaaaaaaaaaaggugugccuugugucugugcuucuccgcucucugaaaggauggauggaucugaaguucucagcccucaccccacacugcuggaaucuucuguagagcugccugccaagccaccugaaacacaguggcucccugugacacucaggccucagaugagccucgcuugccuucacugcuucuguuuuaaacaguaguaaaaaacuggcguucaaggcagaguccacaggugcuuaaaggacacuuucagaagaagcugaaggccuugaggucugcccacccagcugaucucggaguccuggccccaguccauguguagcucuaagaacaugaaguagcugguugcaagauggaccaacucaccaagugucagcccagguagugagaaacuugcaguagacauggagcugggcucuuuuaaauuuguuuugugaaguuucagccucuuaaugcuuuuguauaggaauacucacugugugguuuaaucaugauuuauuaaaaaaaaaaaaaaaagaacaaaugaacgaaaauuggcaaucuuugcugaucuucuaaaaauacuuuuuuuuuccugaagaaaaaaaaagccacacgaagugcaauaggguugugcggcgacucauugauauuucucugaugugagauagagcugugugugugugacuggcuagcagcuaucaguauuagcgaggugucuugccgauaucagagucagugugucauuucaguuuaacuggaugaacugucaaauaaagaaaugcagaaugaaaacaaac

SEQ ID NO: 7043 - RNA, 10017 nt, Mus musculus
cagaguauccagcuuccggcgcgcgguccgugaggagggaggcauggcggcgcccgcugcgguccugggccccucggcccucggccagagcggccccggcucgauggcgcccuggugcucagugagcaguggcccgucucguuacgugcucgggaugcaggagcucuuccgaggccacagcaagacgcgcgaauucccggcgcacagugcuaaggugcacucggucgccuggagcugcgauggccgucgcuuggccucgggguccuucgacaagacugccagcguguucuugcuggagaaggaccggcuggugagcuuguagggcacgggcuuggcggagaagagggcugugugcggagggagaaaaagcaggagagguagggguauggccugucguuggcggugaugaggaagggguuuggggcuggaagaguuggaaugacgaagggggugaggcugccuggcggagagcagagagcgaacuuaguggcaguaaagagguguggcgacguggcugcgggccgggggagguugaagucagguggcagaaaguggugagggucuagaagagcccuggugacgaguggcuagggacuaauggggugguagagccccuaggguggagaggaaggcuuuauuugaaaaugauagcgcaggacagguugguugagguggugguggaaaaagaaagaagggaggccaggaagggccaaugucaaagcucagagagguucaugggggggggggggaggggguguuguaguuuuggaaaaagaauuagauuucuguuuugaauuauccagaucuuugcugguuucaaggcaccacuguuuggauaaaaguggcaucuggauucuguucuuuuaaggucaaagaaaacaacuaccggggccacggagauaguguggaccagcuuuguuggcacccaagcaacccugaccucuuugucaccgcaucuggagauaaaaccauucgcaucugggaugugaggacuacaaaaugcaucgccacugugaauacgaaaggugaguucagagagaggggguucuggaggaaaagcuagugugaucugcagcaagcaucuuuguagcaagugcagguuaucaggauggguuguaugugucugucuggagaagacaggaacagaacagagcacuuuucuggcaggcuguagauguauaggagagcaguggaaacuauacaagaguaguaugugcagaggcguggagaguuugggagauucaggcagguuacaauggcugagaaaccaugggcgaucuggaaaguugugcguuuuguuuaaaggcuguguucaaagaagcagugugguaguuugaguaggcuuggcccagggcauggcacuauuagguguggccuuguuggaggaagcgugucacugugggugugggcuuuaagacccuuauccuggcuuaccuggaagccauucuucuguaugccuuuggauuaagacguagaacucuuagcuccuccugcuccaugucugguugaaugcuaccauggucccaccuugaugauacuugacugaaccucugaaccuguaagccagcuccaauuaaauguuguucuuuauaagaguugccucggucauggugucucuucacagcaguaaaacccaaaguaaggcaggcaguuuuguugauuuuagauuuuuuuuuuaauuuucaucuguguguguguguguguguguguguacguguguacguacacguaccacauguguauaggugcuggaagaaggcgucuuguccucuauaaauguaguuauaggugauugugaauuguggguacagggaauugaacuugggucuccagggaaaaaaacccaaguguucuuaaccacugagccauuucuagccccacaggggagaaaauguguguguguguguauacacacacacauacauauauauacauauauauguacacauauauuuuugagggggagacaggguuucuuuguguagcccuggcuauccuagaacucacgguguagacuaggcuagacucaugaacugagagauccaccugccuuugccucccaugugcuggguuuaaaggcauguaucaucaccaccaagcucccacaauagaauucuugauacaccuucugauagauuuuuaacugcacuauagacaguaaaguacaaaaaaaaaaaaaaaaagguguuuugaaaaaagguuuaaugaaguugaaaauuuuaaccuguguucaguguggacacgcgugacuuugaugagacuggugccagggguuggaguggggaggugcuuugacaaaugucuagacucacggucgccucuuggucaucggaagcuuccuuccauugauuuggugaggaauaagugcugaagguagcucugaucuucuuuccaggagagcagaauaaacucuggaggccgaugggcaaaggugagcuugcugacggauuauaucuggguucccaggggagaacauuaacaucuguuggagucccgacgggcagaccaucgcugugggcaacaaggacgacguugugacuuucauugacgccaagacacaccgcuccaaagcggaggagcaguucaaguuugaggucaaugagaucucauggaacaacgacaacaacauguucuuccugaccaacggcaaugguugcaucaacauccucaggugaggcacuggccgggguugucagaccucugcaauggccacccugccuugcagggaggaguuaacugugagccugucccaaaagacuugaaagauagagagaguauuaaagaaaaaaauccuaccuucuuuuaggcauucuggauuuuaugaauucuuacugauacugauuauacauuuuucuguugauccugagggaacugaggcuuguaaacauucaauuauuagucagccagcccaggauacuuugaugcaccuugaauuguggcuaauucucucucuaaaaguuucagcuuaaauaucacuuucccucuagcaaagucacuuuauccucuccucuccaagauuagaggguuuuaguguaucuuaaugcccuuccuauuucuuuuuuuuuuuuaaauuuuauguguauggguguuuugccugccauguaugucuaugcaccauuugugugcuugcugacuggagugucaggucuccugaaccuggaguuagauacagcugugagcugccaugugguugcugggaaucgaacucugguccucuggaggugcauccagugcuuuuaaccacagagccaucucuccagcccccuucuucuuuuuaaaugauuuauuuauuuuauuuaauuuguguucuuugguguuuugccugcguguauguccgugugaggguguccuguccccuggaacuagaauuauagaugguugugagcugccaugguugcugggaaucaaacccgaguccucuggaagagcagccaguguuccuaacugagucguuucuccagccccaggaggaagcauuucuuaauucuauauucuaaugugcacaucaucucgguuucucauugcacuagcaauuucaugguggagaggacuguguuuguauuguuuuccauugaauugcuaaugccuuccuagugccagucuuaauaguggaauuucagugagcauuuguauaaguaaaugaaaauguaaaaugaagaaucagggccauggggcucugcucgcugcugugccugugaguaaugcagggcagauggccaucgccacuucgauagagagggugacguuugcugggagaccaguagcuucucauuuuucaaagcuuacuuugaaugauggcucuuaaauguuuuaaccucccaucuagccaacuacucacuagagguaguggaaaagaaaggauacgggggaaauagaccuuuuuagaaauuguucuuuggagcaauucccaucuguguugucaggaaaucagccguucaguucacaggucagcagcagcagcucgauccacuaguaaaaacuucacgaauauaucaguagucuaguucaguagagucaggcuagcagcaugaauuagcagcaguggcaccaccuagcagagacagcgagguuagcagaaucgacaugagucagcaggaggaaacaggauaaguagagaggccaggagaaguucucuuuuggcaaaacagaggucagcaaugacgugagaagcguuauagagcuagcuuucuacaagcagaccccauuccucuguugagucuuguuuguacucccuacaacaucaugcguccuccacaggucucaucacgugucuugccucagcacaugagucugucuuagcaaaacuccacaugagucuguaucagccaaagaacaugaguccuuggaagccacagcacaccaccagaaguuuuuuggugugauucuccauggaguccugacagacacaucauuagugaagaauccuuccucaccaguccuuucuuguguuugcuuuagcaaaacauccuuucuccugugucugcuucaggaaaaaccuauguuauguguuugccccagcaaaaccccauccaacacaacugacuuuccaaagaaccuuuaaguuuccacuucagaaccccacguuaaacaaaacaaaacgaaaaucauauugauggaggauauugaaggaguuauauacucuguagacuuguagauacuguaccucgcuuuuuguguuuauguauuggauaguuuugcuagguauaacaguccuggauuugcuuuuuugcuucugugucuuaggugugcugcccuuucuuuugccccagaguaaugcucucaagaagucuagagcugucuaauuuucugugaggugcaguaaucucacugguucaucuagaugcuagauggucccugcucauguauauguaggccuguguugugcucuuguacuugagcaaaccuuuuguuuuauuccuuuagggaaguuuuguuacuguuuuuucccuugguaucauaaugccuuggcccucuucuacacauuaugcuaugcgucuuguuucucagcuacccagaauugaagccugugcaguccaucaaugcccauccuucuaacugcaucuguaucaaguuugaccccauggggaaauacuuugccacaggaagugcagaugccuuggucagccuuugggacguugacgaguuagugugcgugcggugcuuuuccagguguguaacugacggucuuuuccugugggaaaucaaccuuuccucuuucauuuggggauaacucggauguuuugggggguaacugauguuucucuccauccugucauagacuagauuggccugugaggacccucaguuuuagccacgaugggaaaaugcuggcaucggcuucggaggaccauuucauugauauagcugaagucgagacagguaucuuaauuugaauccuuuguguuuaguauccggccuaggcuuuuucuggucacguuuuuagucuguacacugcuacuucaccagugguaucagauggguuuguguuguugagacauuuguugauaggacugucaguuuccugucggagggaaggacaagagcugagcgccaggucugaagggagcacuuugcuuuugcaugauuucuuccacuauuuaaaaauacggcuuugccgggcgugguggcgcacgccuuuaaucccagcacucgggaggcagaggcaggcggauuucugaguucgaggccagccuggucuacaaagugagguucaggacagccagggcuauacagagaaacccugucucgaaaaacaaaaacaaaaaaaaaaauacggcuuauaaaaaggugguuuguuuuguuuuguuuuguuuugagacagggucucacucuguagcucugacugaaaccccugaugaagaugagacugucuuugaauuuacagagaggaucugucccugcuuucugagugcugggguuaaaguaggacaucccaagcuaaaauguucucaaauuagacacaaagaacaggcauuuaugcgaacuccucccaaaccccacugcccagcucugacaccugucaguuuccaguguuccuuggucauuuguaaauacaugauuuuacguauuuauaaaauuuaggacccccaaaugagaacaaacauggaauauuugucuuucugaugaauuuuguuuaauuaucaccaaguugugauaaucuuuguuuuguuuucuuuuccuguggcugugauaaaaugcccuuaggaaagcagcuuuguggggaaagggcuucuuuggcucacacuuagguuacagcucaucaugucaggccuggcagaaccuuguuugugcucagcugcccuccuccugucauucaguccaggguccccugagauccacagccaucggggcuucccaccucagagagcucaguuaagacagccccucacagucaugccuaaucuagacacaaauucacugaggugcccuuagcagauaguuuucaauucaaacugaccagcacagucuuacugaacugcuugcaccauguaggcuacaucguaaagggccaguuauugaucuugggucagcaacacagggccuuuagggcagucugugcucaaagggcucagacaaagcugccugagaauuucacgugaccuuggguauaucagaauguggacaggguaacaaccaguuacugacaccagcguugggggugagcucaggucaccaggguugcuuggcaaaugcuuuuaccucaugaacuccuuugccagccuugccccuuuuuauguccauucuuuagugauaacuaugacuaacuuuuuguacacuucuuuucagucuuuuuuucugucuaugcauuuuuuuuauuggaguaaauaacauuagguuuaauuccugaauauuuuuuguaguuaagucugaaagaagguaagaaugaguuuugauuuugauugauugucuauagacuagaacuccauuuuaacaguuacuucagcguucagacacaccacccaguuggcacuggucugucugcguuggucaccugggaugguggucucagccucccacgguuagcacugcauaguuuagggauuagcuuugcaguaagcuaucagggguacuuauccuaguuaguguuguuccugcugugaugaacaccacagaccaaagugaccuugggagaagaggguuuauuuguuucacacuuuuuaucacacuucaucaucaaagaaagucaggacagaaauucuagcagggcaggaaucuggaggcaggagcugauucagaggccuuggaggggugcugcuuacuggcuugcuccccauggcuuucucaccuuguuucuuauagaaccaggaccaccagcccagcaguggcaccacccacaauuaauugugugucaucccuccccaccccuaucagucaccaauuaagaacauguccuacaggccugccuacagcccacucuuguggagguguuuucucaguggaggcucccgccacuccaguggcuaguuugcuguuaaguugacguaagcuggcucacagcacucaagucugcaaagcugugugguuaccuggggacaucucagguguuuucaugauugcuuugguuuucuuggguuguguaaauuuuuaucuuaaccaaauccauaacaaaugauacagaauuaaacaccuaaagaaaagugcgaguugugugguagugacaccaggaaccacagaguguguccacagagccuaggaggaauucagagaagcuggagauggcugucccugacauagaauuacuuuaaacacuucauauauauauaaaacuaaaauauguacuuacacauauacaugaauacauuuuaauaguauacaauauaauugguaggccauauaguuggccuguuagauguguaccauucagcauauccaggaacuuuauauugguacuacacuguacgucuauuaaaaaaccaaaacccaaaccauuuauuugcugauuguguguuuuguuuugccuguaugccuggcauuacagugugccuucugcucauagagaccagaagagggagcuggaucccuuuggguuggaguuaaacagguggcaaugagcugccauguaggugcugggauuugaaccuggguccuuuagaagaaaagccaauguucuuagcugcuaagccaucucuccagcuccucccacguuauaagucuuaacucuuagggagaaaauuuggagcacaccugaaagaaaucauguauaauuucaacaaauuagaaguaaacuuuugggaaaagguuguuuucaaggcuuuaugguauaugagguguacgccuucguuuuccuuaguugucacuuuguuaagacccuacuguucccucucauuuaagaaacgucucugccuaacaggccugucacuggcaaucaguaaggacaggcugucuguaagguguuuagcaaaccauagcugguaauugucacuggcauucaguaaggacaggcugucuguaaggugcuuauuagcaaaccauggaaauuguuuuuccagggaguauagaguagaggccuagacucauaaguuaaucugccugucaccuacuugugugugacauaucuauaugccaaauauguaaugaauguguuacuuaguaacauucuguucuuuucuguaggagacaagcuaugggaggugcagugugaguccccgacuuucacuguggcuuggcaccccaagaggccucugcuggcuuuugccugugaugacaaagauggcaaauacgacagcagucgggaggcuggaacugugaagcuguuuggacuucccaaugacuccugagagggccgacagcgagaggagagaggaggcaggaggccgggcggacuauuugggcuaccuaaugacuguaccuuucagggagaggaggccugggcuuccuaaugacuccugagaggaccugaugggagaggaggcugggugcagaccuuccuuuuguauaguucaauguagucuuuuggacuuguaggcaccauaaauguuuauaaaugucauaaaugaccaaaaaaaaaaaaaaaaaccaaaccaaaaaaccaaaaccaaaacggcccaaaaaucuuuggucaggcugaguguaccuuaacccucucugugauacuggagaacugagcuagcuuuacuguggugagcaagugccccacauuagcuccagccccagccccagccccaccuccuggguuuuguguugguguauuuguguuagcaguucccaucccuccccgcugcugacagcuagcuaaugaggauuuugcaagugcaggucauggucuguuuuguuuuaggguucucuagaggaacaaaacugguagacuaucugccuaagaacagaacugauguggaacaucuguuugucuguguauauaucugugucuccguaugggauuuuaucagaguggcuuagaggcuguggucuggauagucaguccagcugucuccugaugggaaggccaaggauccaguaguuguucaguuguucagacuggaugucucagcaguguuacucuggugcuggagucccgagggaucccuggagagcugcugaucguggucuguguuggaauccugaagaaguagguucugugguuagcagcagaggaggccccggcagcaggguagaugaaccaggcggugagagugagggcaagcaggggaaaagccauagcuugcuuuuucccuguccuuuuauauaggcugccaccagcgugugugucccagauuuagggugggucuucccaccucaaaggaucaaggaaaaucucucacaggugugcccugcugguuggguuucaguguuuccagaugccacagucaaaguugacagccaagauagcccaucacuugaguagcauagcaugcccucuccugcugggagggcccuguuuucuggauuugaccauggcagaguuuguuggacaucugcuuaggcgguacugguuuaaagggaggguagcagcauagggaugggauuuuugaaaagcaauuuugagaacagagcauucaauaaaacuggcuuucauuauga

SEQ ID NO: 7044 - RNA, 14626 nt, Mus musculus
uccuagccuauucaaauuuggcuuaaauauacaagguguauauauuuuuuauuaaauuauuuaucuaugcuuuugaaacaggcagugauaugcacuauauguccaacauuuccaugcaagaugugaaagaacccuucugcacaauccaucaguguuacacuggucaagauacugacggcccgcucggcccagcucugaaaaaaacauuaguuuuuccugaauagaccauguucuauacuagacuuuuuauauugcccauaaauaugacucuguggccaguuuauuaagucuaacaaagcaggcaaagaaacaagagccugucaaaccugugguguuaauaagauagaauaagauguuuacagugcuugggcuccacuauggggcaggcagaauggacaagacagaccugggcuugagaaaguaguaaagauuuuuauuugucaauacaagauaacacaaauaaauuaauuuuuacaacaaucuuagacuccagggcuucucucugagguuagcucauuauguaaauagccuacuuacuaucuaaagugaucgagcaaucauauguugaguguucgagaccaacaggcugugaacaaugaggagacacaaaagggcacuuccuugccuccuuuccucgguaagauguguuacugaacaaaugaggcuaacuugguggaaaacggucucaauguuaucagaauacagccaaguucaugugaaccugaagacuauauaauccagccauaccuaucgucuucuuuaacaaaaccuuaagcugguguggcugugcacaccuucaaucccagcauuggacggcagaggcaggcacaucaucucugggcaucuacugauugaguuccaggauagccacagcuacaaagugagacacugucucaaaacaaaacacacaacuaaaaaagccuacuauccaggaaguaggggugacucccgcucagugguagagcacuugccuagaaugagcaagucccugccugggcuuaaucuucaguaauggaauuagaguggggaaccauuugccaguaugaaaccagcaucauacugaauuagaaguuaaauuaaugucauguuaaaauucagggggaaaaaagggggcuguauaagaccuaguguuuguccugugacacagcagauacggcccaagagaacaaaguggugugcuggacuaaccaagagaaagaacuugagcugggcugugguggugauccccauuagcuccagcacucgggaggcagggagguggaucucuguaaguucaaggucagccuggucuucagagcuaauucuaggucagccagggcuacacguagaaucccugucuugaaagaaaaagaaaaagagaggguggguggaagaacaaucugugguucagcuuagaaagccaggguccugcaagcugugcccagcucucagagaaguccaggcuaaugcaugucagguggccuccacugugcaaacugguuggugggcaccucuaccaugauuugucagugcucauaguguucaaggggaaagaaucaagaggccuuaguacuggaagcacuccagcauaauuuaccuaggaaagcaaggaucagaguccuucucuaggauaaaugauuuaaaaaaaaaaauagugagguccucaacacuacaccacugacauuuuccaccaaccugaaagcaaugcaaaguguuuuuucucacucacccaaggacaaucuacacacucacucaggccucaguuagccacaucacuccuaagucagagcccagggaaguugcagacccuggacagagcauucuagaagccagugggugugagcacauucaggucacgggguuugagauuauggguucgaagugguugcuucuuuccuucuaccauugggacauccaucuuuggugguuugaaaguugcuggaucuucaccuacucguguggccugggcacgcaucaccuccauaggagagggucuuggggcaccuuuguaagccugaauagcaaaaccugccaaggaaaacaacagauuauagccccagcccacacaguagccugaugccuugauggucuuucugaagcuaccuuaccagaaucagauuucugcaggggucgugguccaaagaggcuccauuugucugcugaguuccuaucauuuccacucccaggauccauggugugaggauucggagcagguaaggcuguggaggagccagaugggaaccagccucuggaacagagaaguaaaugcauaauuccuguaugccaucuuccccugucacuacaagugucuuaccccaaagcaacaagaacccagaggcaggagcccagcagcaucucagcacuggcuuccccagagacaccagcucacaggcuccagggagacugaccuggacuucugcuuaggggacgcgugaggggugcugcucgggguggacugggcugaugcagggugcuucucuucuuuugcugucucuccacucugcagcuuuaguuucugucccaaugggugagaucagauacacagcagaucagccugggcaugagcccuauggugcccauccuaaccugaggcagcagugcuucuguuucuuccauacgacauggauuuuguguuuguaaggcgcuguacucuacagcaucccaagcauuccugugcuccaagcuguacacuagagcucagguuucuaacaaagccaaaucauggaagagccaccaggccgcugaccccuuaggccuggccuucaauucugcuccugucuuucaguacagucucugcccuucucagacuuugaaagccaagucaggcuugcuauccucuuuagugaaauacucugagaaaccuaccccauucucccuccuuucucccauaagcaaccaccuccacagcauuaucaaaagacugcugacagauugguggcucagcagggagagucagagcuguuucuuaggucuaaguuguagcuccacaguaguauguucuccaugagggacaugccucugcuggaccuaagcugacuuucaacacagcaauuuguguaaguuaacaaucugaauggaaaaaacagaguaccagccuucagaagcaucugucuugucaaaguucaaaugguaucagcucaacaugauuucucccaggaguggcuuuuaaaccuaaccugcagacucaucuggaauacucacugcacaaugcaaaccauccaugguguccuauaucuccccccacccccacauacacacacuguacaccaacaccuguuucugauggucuuccaaugcucaaaggaacuuguaauggcuacuuggauuuuauuuucuuucuuguguuaaagauuugucuuuacuuuuuuaugugcacaagugaucugccuguauguauguacguguauguacugugaggggaagguauguauacgaugaucaaccuccugucacuauucaauagccacccaccuuauugguagcuuucucuuuuguuuggguguuuugacacaaggucuggcuguccuggaacucacgacauaaacaaggcuggccucaaacacacagagagcuggcugccucuaccuccaaugcuagaaguaaaggugugcaucuccaugucugagaccacuguggaucuuugucucggggguuguuuugucuuguuuugcuuuauugagaucaucucucacuccaaucuggagcugauuagaccagguuuggugggccagcaagcuccaggaauccaccugucuuucaggucugauuauuuccuuuuccccaguguacaguuacccuuguaaaaggccguaggucccucuggggaagaacuggagaaaggguaacagcaaaaccuuugggugucuuaucaagauccuuccucagcggaaccuggccaccccuucauucaagggguuccggaucugcaaacugucucaagucuggaaauugauucacuggccgagauugcuguuuaccaugaucuaauguagccuuucuuucauuuuuuugagaauuuuucugcuuauacagaucaaacaaauaugcaguaggcuuccuauguauuucauuccuggaaacaccaugauugauuagccagugccaaagguccaagcgagucaugccauuauaaauuucaccucuccugugcugcccauagcagugagguggccagcacuaccuuaucugguuucuagggacugguccucaugcuucuguaccugacuggcucgccuugccaauagcuucuuucuuucuuccuuucuuucuugcucuugcgcucucgcgugcucucucuccucucuuuccuuccuuuuaagauuuauuuauuuuauuuauaugaguacacuguagcugucuucagacacaccugaaaccagaagagggcaucccauucauuacagauggcugugagccaccaugugguugcuaggaauugaacucaggaccucuggaagagcagucagugcucuuaaccacugagccaucucuccagcccccaauaucuucuuucuuuacacaacagacuauaguaucuacuccaaggaucaauaucaagacuugugaauguguaagucacacagcaucauuuaauagaaaguggccucucuaaaagaaucaugugaacaagccaagcagugguggugcucgccuuuaaccccagcacucaggaggcagaggcagguggauuucugaguucaaggccagccugaucuacagagugagucccaggacagccaggacuacacagagaaacccugucucaaaaaaccaaaaaaaaaaaaaaaaaaaaaaaaagaaaagaaaagaaaagaaauacuuggagacaaaacaccaugcauagaaaauaaauccauaagacaagaaacagugggugagaggcuggagcuguaguuugaugauagaacacuccucaguaggcaugaggcccuggguucaauuaucugguagcacaaaagaacauuuuaaccaucauuaaauaaacucucaccaaaauacuguaaccccacuccaagacagguucccucaauguccuggcuggccuggaacucacuaagcugaccaggcugaccuugaauccacagagauccucaccugcaucugcuucugccucccaaaaacugggauuaaagaugagcacuaucacacccagcuccugaacagaagguuuaaaaaguuaagaauucucugggauggcgguacacaccuguaaucccagaauuugaaaggaggaucacaguucaaagcuggccuggauuuugauuuuguuguuuuuugaaacagguucucacuauguagcccuggcuagccuggaacccucaugcucacauguacacuguauuaaaggaauaugccaccaaaccagccugaguuuauauacaaagaccagacccuaucucuaaauaauggcgacugaguuauucagcugaguuauaaaccaugggaaccgugggagucuccucucccuccgucacggccaaccacccuggcauacauagaaaagaguucaguucagaguucucauacaugucauauauaaguaaagcguggccucacucuccagaccagcaagcaagauaucugcagcuaaggcguccaggccuucagccaggagugccaucuuagcaggacagucccggucugccugccauucucuucuugucacucuccaggacagcuaagcuggaaaaaguaaagcacaacugcagaucaagucaugauggcccugcuugcuuacauggagugcuucugccacucgaagguacuuggucuccuccgugguaaggcccuuaugggguguguagccagcaucucucaguccugccuguuguucaaaacgcuggaugcucuccugggucugcucugaaaagagaggacaggucaugcucaacccucaccaguggcaaaccagccaaaaccagcuaggacagaacaggugucuuguucuccccagaggcaagaggccacacugagcacuggagacucaggaguaccccagacgcaaagguucccucagaagccagccuucucucacagcaccccaaaaagccgacuguccugaagggagcuggaugccuuagcuccucacacucagccucuugacacuugacauucagcaacagccccugacauauggacacaguaagacuucccaaagcacucagcugcugaaucagcaccuacacagaaacucugccaaagggaagcauuccugccagcuggcaccaagguaccagccagagucgcagcacaacaaccugccuuggcccagcccaggccuaaauaaagacucuuaaguuucuuacauauggucuaccuguuacugucccuggcccaguuaaccauguccuuucagccugacuuauuaugucacaagucgaucacacuacagaauaaacaagagauuuuuuuuucuuuuuaaaaagauuuauuuauuuuauggaugugaguacacucuguagcuguacagauggccgugagccuucgugugguuguugggaauugaaucuaggaccucugcucgcucuggcccaaagauuuauuuauuauuauaaauaaguacacuguaguugucuucagacccaccagaagaaggugccagaccucauuacgggugguugugagccaccaugugguugcugggauuugaacucaggaccuucggaagagcagucagugcucuucugcacugagccauuucaucagcccaauuuaagcuacaaacuuugcacacuacacaugagcauggcagcuauggacugucccauguccacaccagguggacuucggauuuagacuucccacuuccuuuuugaugugcaccacacuccugccaggagaacagccgcgcuguaugacagucaagcuacaaaaucaagucacagcugcugcugcaaaugggucaguuacagaaaaccaaagugggucuggacuuugacuguucaaguaaacuuuccacaacugacaagacaaacugaugcccuccuggagaaaaguaaagaacucugacagaagagccagccaaggagaagcucugugcaccucagugcugguguggguguuacugcagagccaugggcugaauaauuaacuucccacacuugccagaauggcccuugagaaggaaacagcuuagguaacuugugaaagaagucuaaaaugaagagcugcagacauggcucagugguuagaagcacuugcuccucuuucagaggacuccgacucagauccuguugccaacacuggauggcucacaacuauaucucuucugcccuuucaggcuuacaugcgcgugcaaacacacacacauacaccucugccuccccacucccaaacacucucaagcacacagacuauauacauaaauacaaauuuuuuuaaaaugauaaacuuaaaaaggaaaaacuggcugccauaucaagccucacuaggacuaucaauggcacacucuaaagaagcugaagcuccacaccuggacuuccugguggaccaacaggccuuggucagcacuaucaaaaacucauuuguaaaaauauauauacauuaucuauaaaugcuauguaaagaaauuuaaaguagcugggucagugguacaagacuauaaucccagcacuuaagaacacuaaggcaagccaggcgugagaaacucugucucagaaaaaaacaaacaaacaaaaaagaacacuaaggcacuacuggagagauggcucagagguuaaaagcacuggcugcucuuccagagauccugaguucaauucucagcaaccacaugguggcucacaaccaucuguaauggaaucugaugcccucuucuggccugcaaguguauauucgaagacagagcacuccuacauuaaaaaagaagaagaauuaaaaaaaaaaacaacaacaacaacaaaaaaaaaaccacuaagacagggacuauuuugaguuaagucaaaaggggcacacagcaaaacccucucucaaaaccaaaccaaacaaauaugcauguaauaguggaaggcccuguucucuacaacacacccagagcagcagguccaagcuccugcuaaugaacuauucaaccucaccaacaaccugccagccagaucccuacuucagaaaagugggaacagugcuaccauugaguaacuuggccaagaccacauuggucacaacaggaaaaugagacuguaucaaacaacaauuggcuuaggaauacaccuaggccaaucagauacuuaggaauacaccuaagccaaugagauacuuaacaccuaagucaaugagauccuucauagucaacaauuuaucuuccuucuugcuguaucugaugccaugaaagcgacaugccugagaaucaccugcagcugaggcccaacuucucccucacucccuucacucugccaacacugaagggcgcuuacuugugaucagggaacucaugaugacauggguagcuuuagccuucaccacaggggccuugucugaacugucaguggcuggugauggagucacagcaagggaagagacacuggccgcgcccuccucugucuguucaagagagggaaggaagcacgugagcagggcaggggagccacacagcuaaacuuacgucuguggagaacguuacgagagugugcaaccuguuaagagaagaacugcuugaaggggacaguucuacucgccaaagugacaagcagacuggacuuaagggaagaaccuggaaccacaugaggaaaggcaguuuuuggaguccugaggccuaacuuucaacuucugucugcccauaauacuacagauuaaacacuguuugauggcacacgcguaaucccagugcuagagacacugaggcaggagaauuggugugaguucaagucuagcuugggcuacauagugaguucaagacaagauuggaauaccuaccaaaaccuugucuccaaaaugaggaaacauuauugagggauggagagaagaaaggacaaacagggcagaaacaacauggaacagacaccuccuacaagcaagccuuauuuagcugagcagaacuuccucagacuucgccccugagugcuagccaaacacacuucaggcugcuuggucggucugggcuguggggaggugagacacacagacacuaagagugaauacagagugugguaaugcccaucugcagugccagcacucuggagacugaagacuaccaugaauuugaggucaaccugggcuacauaguaagacccuaggucaaaaaagaaaaaaaaaaucuguuucuagcccagcuuaugugaagccuuggauauccagcacacagaaaauaauaguaauagaauuuuuaaacaaacucccaagugugaugguuaguguuaacuugacagaauguaaaagcacuuaggagaaaggucucugggcacccaguaagaguuaucuagauuagguuagccuuugugagugucuguggggguuaccuugcucuguucacugaugugggaagauucaucuuuauuacaggaggcccuguucccagcccaggcccaggcugagggcugaacccaggaccuugcaaaugcccagcacgcacccaccacugagcauacccgcuguccuuuuucucaucuauuuugagacaagaucucacuacauagccuggacuugccuugaauucgcucuguagccuaagcaggcaauucuccuguacuagccuuggaaacagcuggcagguuuuuucauguuuguuuuuauauagguuuuuaucauaacuguuuaggggucuuguuucuuuaggcaggggccuuugaauaaaacucaggcuggccucagacucaagaccuuccuuaugcuggcugccagucccuguagucuacccucugucuuaaacacaacauuuucucuucaacagcugucggaguuggauuacagcagacaacuaacacaaggaguucuucuccacacagcagugcagacagaccacaggaagaagucccuguucugagaauguaacaggaaaacagaaaggaaagcucagacagcacccagcucagcuaccgcccacgccaacccagccucuaagucuccuacuuuacucccucaacauccacucagacagaggcacugugcccugguacgacucugagggaucuaccccaguuugcuuacacagacccucacugcacgcuuccucucaggcccacagaggcugcagggaaauggcuuuaccucagcuccccgcugacucgggcaccaggcugaccuucuuugggugacgggcaucagggugacccaugcccgagcaacaacacagcaggcacuagagagagaccugcgcugaugccaaucacaaaacgaaccacuuaaaggguuuuugaacucuaugccagaccuucauuuuaaugcugcaauacaauauaggccgagaaucacuacucaaaaaccuaaacucucaagugccccaaaaucugaaacuuuugcacacugccaugacacaagagacaguaaaauuucccgguguaaaauuucauuuagugcauaaaaaucugacuacauaagggaaaagguaugcauacaacauaaauuaauuucauauuuagacuugguccuuucccccacuaccucauugugucuaugcaaauauucuaauaauacuauagcuggauaacagagaagcuauaaagagacaagcaggacucaucagaacucagguaugcagguucuggaguuuggcuucuuaguuggggaagcagagucuagaagaaucucuuguagauaacacuacuauucaaguuuuggauuggaaaaagggacagaagauguacaaagggaacaacugcugccugguuuuguagggacugagaaccacggaagcuucuggaacaggaagaaaaauggggugaguuugccagaagccgugagcagggugagguaccuugucaagaugcugauacuugcgcucuggaaucacuggcuuccaggggaugcugcccauguccgauggaggaggagucaugggcgcaggguccucuagggcaucaucauagcugaaugcccgacggcacaucccgaugggcagggacaucuugccuagaggcccgcugggagcaagagcuaagaacagagauaccugucaauaugggaugucaacugaacagacuuuaaguucaucuguagauaagaaagcugugacacuuaggggacagcuaauccauuuaagggaguaauaacagcccugcuaucagugcucauugccuucuuugucuacuacacuggcucagcaacacaauccuguuagacaaggucuugcuacguaguccuggcuggcuaguacucacuauauagcuugcacagcuggccucaaguucugccagucuuccugccucagcucuacccaagugcuaggacuacaagcacagacaaccacuccagggcuucaucaacuuuuacagaauaaagaaccugaaccucaaguuacuguacuuagccuaugcagagucacaacuucaaagcacaauuuucagucaaaaaucaaaccuaucucaaaacucacaugcuaacucucagucauacaagacugaggauagaaagugacuaaagguaucauucuauguuuucuucccucagucuguagccugucacugucucauuugaugaggaaacuaaacccuagugaugaaaggagcugccucaguucauagagaaaauggcuagcuagcugaggcucgaccuaguuuaucaagagcccugcgccuucuguguccccccuccaaagaaaacuacaaggaacaguuccucgucuggggccuggcaugcccucuaguuccuagcuuucugaagauuuaaacgucuccaccacaggcauuacugacaggcacucucaucaacaccgccagcuugagccugccauuccugaccacgacagcugacugcuggcacguccagcugugacagaggcgucaugcuucagcuguguguacucugagcugugccagagcagagagcaggcuucacuugucuggucacugauccagaaccugccuucaaggugauacuuuccuguuacauaaucgcacucgucaagguagaaaccugccuggcagcaaggcucaaacccugccaaguuugacuuaaacagcaaggggacccagagcuaccaugugaccaucaccaauacuaauaacuaacaagcccaagaaguuacuaguugccaagggccagggagagggcaaugagguguuucuccuaauggguacaaaguauuucugggggcaugaaaaugcuuuguaaguagauuaauuugauggaugcauaaccuuaugaacacaccaaccaugaaaucacccacucuaggugaauuuacaguauguacauugcuaucucaagggaaaaagacaugcaaacacaaaugaccuggcacugagagcccuccuucuaucuacuccucucuaaguaaacucuuucccauuucccagcucaggaaaccgugcuacggaaccuaagcacuaccacacggcuagcaaaugcgcaggagacacugagccagggcucacuccuugcugccagcuacaaagccuuaagcucaugagcacacacauagcucugcauggugacaagggcguuagagaguccaguguaaguggaagacacacgugaugguagagacaaaugguauuaggguacauggaggaagcuuccauuaaccugccuaacuggggagcgacuucaaacagugucuaacaccuuguccaauggcuucauaaagacaauaguaauaaagccgcuggcaucuacuuuuuuuuuuuuuuuuuuugguuuuucgagacaggguuucucuguguaacccuggcuguccuggaacucagaaauccaccugccucugccuccuaagugcugggauaaagucgugcaccaccacugccugcccaaaaacuuuuuugagccaggugcaguguacaugcauuuuaaucccagaacucaggaggcagaggcaggaggaucucugugaauuccaggacagccaagucuacaaagggagacucugucucaaaaaaaaaaaaacaguagauguagauuuagcagcaacucugaacuucacuuaugauuucgccuuuaaagacagcacuugggagguagaggugguaagaucucugugaauucaaggacagccuggucuaaauacagaguuucaggacagccagaaccacacggagaaacccugucucuggaaaaacaaacaaaaaguguuuacucuucacaaaagacacuuauggcaagaggcuguaagccaaggucaggguguauaccacggcugagaaggugaugaccuaauacuaaagaagaucaguacuaaggauucugagaaaauaagcucucugggggauguggguggggguacagacuuaaccaauaagaacuuaaguuuaccaggcacuucugguugucuugaagccauugaaagacagggauccagguguuuuuuucuauacguaauucggagcugagucccuuccaccuaauaaaaauaacauagggcauuuucuuauguugcacagcagagggucauuccagugcucugacagacacgcagagacuuauggcugguaaguaagguugacacauacacacgcuagaaccaaugagugacaaacacacccccggaaggauaaaguccacuaguuugccaguauccuauggcuggcuccucugaacacccgagaggagaaagccaaaccucaguuuagacagacaccuuaccacagugaaaugacgccggacuaugcagacagacagauguuaaugaggagcauugcccagcuucugcaaauuagcgaagcuucugaggaaggguccauccagaggcucuaaguaacaauaaacaagcaagguugguacagcgccccuaaguccaccgaacauccgaccacuccccagccggauuacauagcagccuuuccccuuggcagaaaugagcuaugccagcauagaagaccaacucggcaucacuaaaagucaucgcauucucacacaacccuugucuugaaaacaaacccgcggcgcugcacagcaggcauuauugguccagauuuuuguucaaguucacugcgguccuagggacauccgcaagccagacacacgcccuuucccucucccuuagcgaccccaagcccacgacucucucgcaggaggugcaaaacaaagccucugagauguguaaagccaaucccgaccuucccacggucccaccccucaaggcgaagccggcugguucgcagcgagcagaugcuccgaggcucacugugcgggucuuucuggugucccucgagccccgcuaggguggaacagagccccccuccaggccccccaggccgcggcgccccggaacucaggcugcccccagcuccgccaggccgcggucgguuaccugcucgcccgccgccugcggcccgacuucccgcacuaaagaggcuccgaggcuccagauggcccaagaggcugcugggcugaacagagcagagccaucgugagagcgcgacgaacgcuccccuacggaggacagucgccggccggcaaccgaacccccaaaccaccccgagacugucgcaggucgcgcgagaccugacucgaagauccgcggggcaugcugggaguuguaguccgagaucugagcgugccuccg

SEQ ID NO: 7045 - RNA, 8642 nt, Mus musculus
uaguguggcgggguccggcgggugggcgcggccacagcuccaucuuccaccgcaggcuggucggucuugcucccaggccaaauggcgccgcggccgcugggccccuuggugcuggcucuggguggcgccgcagccgugcugggcucugugcucuuuauccucuggaaagcuuacuucggccgcggccgggagcggcgcugggaccggggcgaggccugguggggcgcggacacugcccgccucccucagugggacgagugggaggugagugcgagccgccgaggucagggaggccuacgcaugcugugagcgcggagugcaagcgcgagggcccgggcagggcaucgggcucgguagccccgugggcgcgguaggagccagccaggcgacagugcaguaagcgcaguggcgccgccccggggaucccugguagagcccucauucccggugccggauaaucgugagaucuugggauugucuuggguuuacuguucguggaagccaaggauuuaugaugagaaagauugugcgcgaaaucaugaggagucaaaaagaaaagugagacuuuuaguuuaggacucaaaaagcagcuccugcccugcaaugucagaccacaggugccugccccgggacgcguggauggcgugcaggggcaccguggugcacuucguugucccuagggaagggagggucaagaaggagguuggggauugcagccuucgucucugucccacagcccgaggacgaggaagaugagccggccuuggaagagcuggagcagcgggaaguguuggugcugggcuuggauggcucagggaaaagcacguucuugcgcaugcuggccgggaagccaccgguggaaggccacgucccuaccuggggcuucaacucuguucggcugccuaccaagaauuucgagguggaccuguuagagagugagcaagagacacacucccccuucucccuguccucacugaugccccagggccuagauuauuuggagauuaucauacaaugcauuucuaaucaggacauuuccccuuuaugaaacccuuccugcuucucuucagggcacaagauacagaacauucuaacacuuaggauuuuuccuuauccuguguauccaaaugguccaccuaccuuucaccacacaugccuuacacuggcagacuaacagcuaaggguucauaugccagguauuugacaaacacugcuuauaaaauaccccacacaacuccacaaaacugccaucaguuaaccugccuguuagauacauguacaaacagguuucugacaagcuagaucacgaaagguuucccccaguguuccaguguucuggcugccugaagagggcaucggaucccccuauagaugguugugagccaccaugugguugcugggguuugaacucaggaccucuggaagagcagccagugcccguaauggcuuagccaucucuccagcccgguguucucaugcagcagguccuccuggcccucacgaaggggacuuguuucuuaccuguucuuugcaugcaucucucugcuuggaacacuugacaaacuacuaccacucauucugagcuauagugucuuuucuuccauuagucgggguuuugucauuuguuugagaugguuucauggcauugaggcuggucuugaacacucgaaccuuccuucuccaccaucugagugcuaggguuacagguacacacggccacaaccaagccucaagugugauuugugaaugacaucuuuugaagcuuaccuuugaagucuggccucugccugacucugguccccuccugcugcaggauuugucacucacccucugucccugaugaggccaggaacacuguggucacagaguguaugauccauuucuggcccaaaggcucagcccucuaauagguacccgagggggcuuauugagugaguggucugagaggcgacugaggagcccuaccuguagauguaggagucuugggauuuuggacuucuccaccugggucuagccucagucucugaggaguuaggagggacuucgaggcacaggacuaaaacugugaagccugggugugcuuauuuaagcacuagggauagaguugagcuuugagagccgaacucuuagccugagugggucucguucuuaagcauuuguggucuggucaugccuggccauaccuuuucucccaggucguagcaaacauugaucuuuacuuaggaccacccaucaagcuuucucugucucuucuugagccaaaggacaggaauucagugagugccugacagaaggagcguucacuuucccacccaagugagguguucucacaaacccauguucugacggacaucaggauucagacccaaauggcugucaggccuguugguucacaccuguaaucccagcccuccggaggcgguggcaggaaagcugucaaucaaguccuagagcuuuuuucccccacaacagucccuucacguggucucggcaucguggcuuggggaucagcugagaaugcacacuguggcagaacuggcaagggagcacauuuauuacuggcaacaccuuccuuagugcaccaccuaggaaaucgaauguaucgguucuguccgcgguacacuugcauagccuggccuacuccgagggcugcugucugcuucaagccccuuucgucucucccauuuagaacuacaguugcucccuugcagaucgucccauggagucagcgacugguaucuuucagaaacauggucuggacccuuuucuccucucucucucucucucucucucucucucucucucucucucucuggaggccccuugcuugucacguuuucccuuccgcgcaugcguggagcuuguucuuugugcugcccgagaugcuugcuuuugcuucuuccuguggcuagcuccucauccuccucuccgcucacacccagccuccuugaggagacauuuccagaucgcccaacccaagaccagcagcacacuccggccacuuccccuuguuuucccuugguuuugauuccgugcuuucuagaauaugucuuaucugguugccugguccauucuggcuagggagggaguuccuagagagccgggacuccagccugauacccagcacccaggugagugcuuggcaccugguaagcacucaguaaguauuugaugagugccuacugugugccaagacauugugcugaggcuuuuggggggauuuagaguggagagagagagagaagcagaaccggauuggggugcaggguagccaagaggaacugagcagaggggcaaagaggaacagaaaggcagcccaggcgcgggcggacacuguggcuaaugucguuuggcacgacucuguacaguguucccgagggagggagaggaagggaugacaagccugagugggacugaguuggggguagugguacacuggcaaggcaugggacucuagcuuuucuaggcuuagggaucccugguuucccaucaguuaucauugaccagggagggagcuaggaacugauaagaggcaaggaagcccagcaacuacggcccaaugcagccggugccuuugggggucugcugagaccucuuuguucaguaagagacugguacacuaggguagcgcccucucaggagaucugacuggcucugggcuguggcagcuucuuugucccugacuaguggacccuuaggauccggaaguggguuggggcuaugggcagagccaugcuacagggagcucugcucugagcugacccuuggccucucuucaguugguggcagccagaaccugcgcuuuuacuggaaggaguuugucaacgagguggacgugcugguguucaugguggacucgacugaccggcuaaggcugcccugggcucggcaggagcugcagaaacuguuggacagggauccggaucugccuguuguuauaguggccaacaagcaggugagugcuaugggaggugagccaguuggucuucucacugaugccugggcauaggauugcauggcauaaccagccagugccugacauacuguccccgcccuccccuuuccacuucauccuuccuuccgguuucuuuucucagucccccuaucuucuguuacccuuuacagaugugaugccagccgcagucuucaguacuuuauuuuccuggauuuuuuugagacaucugucuugaauacuuuaugcaacccaggcuggcuggaacucauaauucugucccuaaguucugggauuguagguguguaccaccacaccucccuuaaaugacauuauuggccuuaugcaagguauacaauacuguuuccgcuuuauugguggggccaccacagcucagggugacauaauagaggaugguggugcugggaugccugcacugagcugagaagugggguacauuaaguaaugggagcacaauguucaggcacagugugaacaccugacagccaucaccccgcuuucgucccgccacaccccaugauaagcucuguuguuucuuuaaaaaaaaaaaaaaagauuuauucacuuacuuuaugcauaugagcacacugucgcugucuucagacacaccagaagaggccauuggaacccauuacagagguugugagccaccaugugguugcugggaauugaacucaggaccucuggaagagcagucaaugcucuuaaccacugagccaaaucuccagccccaaugguguuuucuuagagccucagaaguacccagggcacugaacuguuagaccauuauaauugauagcugauaguuuauggcauuuugaaccgacaggaggugucuccguuacuuaccugaguuaucuuaguuacuuguuguaaagagacaucaugacugaggggacuuacagagaguguauugcuggcucacaguuucaguuuugaaaccuugaagauauacacuuuucccuacaaauccauaccuccuaaccaucccaaacaguucacugaccuuggaucaagcauucagaacugugagccugugggggccauuuucauucaaaccaguacaggaggcaacugaggggucuuaccauggaagaauugcuccagggaucccgaaccaaugaugaacuuuaaagggaucagcuacaguaucuaguagccuuuuuucccuuuccccaaccccagauugucugggaguuaccccaccguaugcucuuacauuguagucauaagacagaguagggauuccagaagguucaaagguguggucauuaggcaggcggauuucugaguucgaggccagccuggucuacagagugaguuccaggacagccaggucuacacagagaaacccugucucggaaaaaaaaaaaaaguguggucauuaaugugaccuuggaaccuaaaucugcuguuuaucaucgugaggagcuaaaugacaucacugaaccagcuuccucauuaguuauguggauccugagaaccaaggacuugguaggcagguaccaucuuggugccuaacaaguuagaaagggcuauuucuugugacaaugauggauuacuccaugaaaaaagggugccacaaaaugaugaaggagggcaccgaauuucuuccacaggaucuagaggcacuuccugggauuugggguccagaguaguagcugaacauuuaugucuguuaucauacugggaucggucugacauccaugcugugcuggcuuguguucacugcaggaccugagcggggccaugaauaugguggagcugcagcaggagcugggccuccuugcuaguuauaaccagagggagguuuuccucuuggcagccagcauugccccugcaggaucuggcuuuggggaacccggcacugugcacaucuggaaauugcucuugcagcuucucuccuaagcuggacccaccugccugcugcccagccuugaauaccacauuucugccuucuuccgcauuguuguugcuagccuaggccuugggcaggagcaucauagcaacgcuuccucucuuccucaagagcaaggccaaauccgugcagaagucuucccggugagguagacguggggcugaggcagggaggacgccauaguguagcuccagcuugccuugccuugccuuccugcagugugaugcucagcaggcucagugccccccaaccccccuuugcaggucccacugcuugcagagcaguguggauaucacagguacuucugagccugcgucucccgucucaugucucaugguucacuccugguaacaucauacauuuaacauguggaaagguucuggguacagcacagcaaguccucgcuccuaguccuucauuauccuccagccccugcucgcucugucuguggccuuguguuccugccuuucuagccccggggccauuauuuuuaaagggagaugauuuccauguuuuuuuuuuuccuaaaugccaucccuggcagugccaaaccugaaaaccuuagcacagaaucuucucgacaccuccccacuguuacuacagccuggccuugccagucuuuacugaccacaaagugcaguucacugaacagggugaagggugguuuugcccaggucuggagacaaccugcugcuuuuguacuaacugugccaacacccauguuuacacaagucuagagaaggaaggagccggaguccuggaacaagacuggagcuaggggguugggggggggggggucagccucagaauggcauuuuauuuauuuauuuauguauuuaucaaaggaaugggccaaaguucuagguucuguuucuaggugcuguaaugaaaacccuaggagacugucagaaaagcugaagcuuagaacuguuuggaauuaugauugagauuagguaaccuauagcugucaauggagacacagaacuguagcuuuccccuccccuccccuccccucccccaaacuggccuugagaccauaacuggaagcaaguaccucaaggagaccuaguacucaugguccaggacuuaggauaggacuagacgagccaucagaaugacucuuccugugcccacggcgggcacaucaccaagccuucugggaccauuuauuugccagccaaaaacagacugaaauucuguauucucugaagugaacauuccacgacugugaccgaugcaaagcuggaccccauguugacccuggugcaggcaaaagagccucggucugccagggacacugaaugacaacagcacuguuguuugagacagugucacucuguagcucaggcuggccuugaauugauggcacuuguccuuccucagccucccgugcugggauuauaggaagcacugugccaucacgccuggcgcauucagucugcuguuugagaaucacugugcuguuugccaauuguccaacauacagcccaggaaguggaaagcgucguuaacgugagcacaaucaucagaaggggggcgggcugugcccuuggacuccagcccaugagaacagaauuacuacaggacaaagcacucucauuacaagggauuguccugcuuuuguacuaaauauuuaaagaaugacuaggauuuuaaaguaguugaaauuuuguuggacauuguaugucuguucugaggauuccgccucuccccagugcuaaagcuuaccuuacaaccagacuuauugagagaauuucuuuuuccuaacugaaagaccuuugucuaaugcguuuuaucauguacaauugucauauuguccaaggggugggggaguguuaagaauaaacaauuucacugugucuccugaagugacuuuacuugaggcuagaccuggugguuuaugaucccagcugcucuggagaacgcacagucaaucaggcuggaucaguagguaaagccugaugaccagaguuugacccauauaaacauggguagagaggacugaccccucaaggcaggcuucccagugcuagaaaacaaacacucucugggcacucugcaccuacacuaguuuaggaggaacuaucaacacaagccggcugcaggacgaugacauccacccccugccacagggccagaccucagacuuugauucgggucuuggcagauacuuuacuccacaaccucagaggccaaaguccuuucuggcaaucaacuuucuccugcccuuauaccuggaagaugaugcucuccagcccaugagcuagcagcacggggccaacaaggacaacuuguaaaguggagugucaccagcucucuacggugaaaguaacaauaaaugccagaauggcauuauucagggcaucguccucaucgugaggacggcugauacuuacaguuccucagacagugagcuccagucacuuacccucugaccuuugggacagugaguuccagucacuuacccucugaccuuugggacagugaguuccagucacuuacccucugaccuuugggacagugagcuccagucacuuacccucugaccuuugggacagugacuuaaugccuuuuaacccucagaaagggaucuagcugauguccccagaaaccaaaaguuuucugccagcugggcaaaauggacaagucuuuaaucaaaggacucaggcagauggacccccugaguugaguuagaggcuagccuagucgacauagaguuucagaacagccagagcuacauagaccaucuca

SEQ ID NO: 7046 - RNA, 954 nt, Mus musculus
caucagaaggcgggguccgguguccggauuuguguccuaccuauuucugugcugguggguauggcggcucccgguccugugaguccagaggcgccuuuugauccguccaagcccccaguuaucgagggcuucagccccacggucuacuccaacccagagggcuuuaaggaaaaguuuauucgcaagacccgugagaacccaauggugccuauagguaagugugugcuguaggaacggaagaccgagaggacagcgguuucguagggaaaggaaauagggguggaucaaguaagccugggguuugggaaggggagcggaccagaggugugacgaaaugacggugcgggguggggggugacugaaacgaaucggaaugcauugcggggcuugggacuagaugaagcagacuguagaacugcccuccuguuguggcucugggaaagcugggacgggcuacauccuuaagggaccugcaggacccgaccuguugccucccgcguguguuguccucuccccaggcugucuggggacggcggcugcccucaccuauggccuuuacugcuuccaccgcggccagagccaccgaucccaacucaugaugcgcacccggaucgcugcacaggguuucacggucguagccaucuuguugggguuagcggcaucugcuaugaagucucaagccugaguauagccgggucuuaaagcgccauggaaaccauuacaaaacccaggaacaacagacaucccugucagacuugcucccuccguuucagaccggaccuuauugucauuugggugaggaaguggccgauuuuguaacugauuugcgcuuccaccgcugcccccucccgcucccaaaaucccagguucauuucaguuggguugcaugcuucuauuugugaugcguccccuuaauuacuuaauaaaagcuuauuacacuuguaugugaugaac

SEQ ID NO: 7047 - RNA, 954 nt, Mus musculus
guucaucacauacaaguguaauaagcuuuuauuaaguaauuaaggggacgcaucacaaauagaagcaugcaacccaacugaaaugaaccugggauuuugggagcgggagggggcagcgguggaagcgcaaaucaguuacaaaaucggccacuuccucacccaaaugacaauaagguccggucugaaacggagggagcaagucugacagggaugucuguuguuccuggguuuuguaaugguuuccauggcgcuuuaagacccggcuauacucaggcuugagacuucauagcagaugccgcuaaccccaacaagauggcuacgaccgugaaacccugugcagcgauccgggugcgcaucaugaguugggaucgguggcucuggccgcgguggaagcaguaaaggccauaggugagggcagccgccguccccagacagccuggggagaggacaacacacgcgggaggcaacaggucggguccugcaggucccuuaaggauguagcccgucccagcuuucccagagccacaacaggagggcaguucuacagucugcuucaucuagucccaagccccgcaaugcauuccgauucguuucagucaccccccaccccgcaccgucauuucgucacaccucugguccgcuccccuucccaaaccccaggcuuacuugauccaccccuauuuccuuucccuacgaaaccgcuguccucucggucuuccguuccuacagcacacacuuaccuauaggcaccauuggguucucacgggucuugcgaauaaacuuuuccuuaaagcccucuggguuggaguagaccguggggcugaagcccucgauaacugggggcuuggacggaucaaaaggcgccucuggacucacaggaccgggagccgccauacccaccagcacagaaauagguaggacacaaauccggacaccggaccccgccuucugaug

SEQ ID NO: 7048 - RNA, 19083 nt, Mus musculus
cucccgccgccgcugcagccgcagugacaggcaagccgggcgggugacgggaagugcgggccgcgggcgcgggcgggaggugacagcagccacgcggggaagauggcugaggacuucggcuucuucucaucgucggagagcggggccccggaggccgccgaggaggacccagcggccgccuuccuggcccagcaggaaagcgagauugcuggcaucgagaaugacccggguuucggggcaccugccgccagccagguggccucugcgcagccgggacucgcgagcgggggugagucagcgcagcggccuggaaccggggaggcugaggccaccaccgggggcgggaggcccagucucggucagacccggccugggucccugcuguacucugaguccggcuauccagggugaccaaggguaccucggggggcuguguguauccgugaggccugggaaaagaggaaggagccgggagaugaguuggaaucugcgcugagacuggaucugcugacucuggggacaggaauuuagucaugacauuucauccccaggccagcuucuccacccuggcucuggaacccucccccugcucaguucugagacugucccaguguccuagcuaagugauacaggugugggacggacacguccuccugacguuagcguuagcguuccuuucugcagggaagcagggggcgcucagagaacucgcagcucauccuuuggggaucaccugcaguccugcagcagugcgggagacaauguuaauuacauauaauaauuucauacacguuacugaacccauuuuagaacuggcuucaaaggguacacuauuaaaacaacuaggaaguagcaauaaagaauucaaccccuucuuucggaugcugaauucuuccuguccagaccucacaguccuucaugggcccgacuguaagucuaggcaggggcacaaauggccaagagcugugcccuuccuguuuguaacuguuuguuuaguggauuuacaaagguggcccggaccucugcguguggcuucagacauaaggguucaggaccuuuuuccugcauuguuauguuuaucauugauacuucugccccaaggaacaauuucuuauaaauauauuuaaauauuuaguacaaauauggaccuucauggugacccuccuaguagaccuuguuauuuuuuggugucauguuaaagagguuuaaugguccuguuggaaauaaauauuguauguauacauucaucuuucuuuccuuccacacuugcuguguugccguccccacugggaacacagaaggaagaaacuguaucuauggcccagcguuugaagaaacucugacauaaguguaauaagccuuuuguaacauacacggaacuggaguuugaggggcuaucaggauggcuugucaaguaaauguaaaucagcccagccuggugacaccugagcucacgcccuggaacccucauggcgguagauagaacucacucccacaaauuguccccccgaccucgcauacaugccugcaccacacacacacacacacacacacaaacacacacaaguaaagaaaauauaaauaauaauaauuaaaaagaaaaaacuggaguuugaaugucuugccuagggccacacagccgugagugauaggucuggggcuugauuucaggccuccuaguuaugaucuuccaaagggcagcugugcuggucuccuuaggagaugauuggauacagcagggagaagcaggggccuauccaagccagccaugcagcucugaaauagcagcucucagucccucagcccuucauugucccugggaaccuccuaaguuccuguauggaacucacuuguccauggucaccccuugggaacaguccuuucccucauuaggaggucccaaguuguuagcaacucaggagaaagacagaugcaguuccagcugaggauagccacaggagccugggauuuugcaaguuguagucuuuccuagggacuuacagucuggguggguagggcacugacuagcccuagauaugagauaaccgggagggagacaguggugauaacccuuagggaagcagccagggacuugacccucugagggucucccggacuccaucaagcugcaggugcccagcugcccuucugaguggcaguuuggggaacaaggaggugcuucaggaggggagcucagcggguguucaggcauaaauagaacagaccugauucuccuaagccuagacagugggagguacccauccuccucugcguuugcagggaaugauaggagccuggguggucugaggugaacugucugggcaauucugggaguuggaaagaagcuaguucuaacagcagccaccaaugcacaccucugagucaccucccagagacaaugaggucuucugauagcagcucucgagccaaguucaaugccgcuucacugcugcuggcucucaggggggccuggggaaagcugugucuggcguaggccugaaccggaaccccacugagccuucccucugggcggaucugcagccggccugagcugcggauacuuuguuuccauucaucagccuugggcagugcccaaaugcucuacacuuucacacccguuagcugggcucuuggccugccugugaccaagcacuguguaauccucuugccccugcuggucucaguaagcucacaggaauguucuggaucuuuugccauuauuccugaggugaccacacaccaaaaagcuuauccuuggaacauguuauuugcuuugcuguauuuguucugcgggcucuguuguagacucggaaucauaaaugugcaagagcccugugggauacaggcugguauuucuaagaguggguguguaugcagucccaaagacugaaaggaggaugaugcucauagccuuuugggaccacccuuauuuagagagcaggccaccuguacuguagaaacccucccagagugggugggaugagagcugucauagugaaucaggauuaaucacugcuugacgauaaauaagcuauaauuuauaucugugacacauaauugacaugagacugcaaggcccugaugaaucaggucaggcuuaggccagaagcacuguugcucuucagaggccagucuaucccauacagggcuaauuguuuaucuauggggaccauaugaggccugcuguggcucgcagcuaggcggcaugacaguuucagagaggccuugccaauuacagugaaccccaagaacaguccagcucucauuuggccaacugucucuguucauccauucuaugcaggagcccuuaacugggaauauauauacacacacacacacacacacacacacacacacacaccacacacacacacacacacacacacacacacacacacacacacauauauauauauauauauauauauauauauauauauaugcauccagagucugggcaugcuaagucacuauacaggagagugggauacccuguguaguguuccaguguaccccagaaacgagacuuucuuuuagugccuagggaaguagaggaagcaggcuaagguucccuguaggagguaacuuacacaccaacuaaaaaaaaaauuaaugagccaagugugguggcacaagccuuuaaaucccagcacuugggaggcagaggcaggcagagccugggaggggcucuugcacauuuaugauuccgagucuacaacagagcccgcagaacaaauacagcaaagcaaauaacauguuccaaggauaaguccaaccuggucuacaaagugaguuccaggacagccagggcuauacagagaaacccugucuuaaaauaaaaaacaacaacaacaaagaauuuaauuuguuuauucagcaucuagugaccaaacuuguaaagaagccuaggccccaugcauggguguggcucugagccacggugcucucauuugucacuagcaggacagacaaccaaagcaggaguguagguuugagaugucgagggcacaggcugggcugggcaugggagugaggggaagguagcugugaaggucgcuguugcagcagaagcuacaggucguuuguggcuaacuggauacuggauaaagggauugugcggugucacugugaagccaacaugaaacccugggaggggcacagagaggaaaaauaggccaagcguugcccagggggagcugugaggcugcuugcccaggcagaucgguugcucaagguuccagcaggacaugcagagacacagaccccucucuuccucgucccugauggccucucccuaaacucacagucccccugucuacuuaggaggucccagcuccaugcugaacuucagguugguaaggaauggugcacugccaggugaucuggagcaaucacaguagccuuccgagccuccacuugagaaucuguaaaaugggucacuguuucaucauagggcuguggcaaauauuagggaugacagugaaugcacaugggaacaaucagggccugagccucguugcuuauauauccauuauaucucagggggugggaggagggcgguggguaucaguauacccauggguguaugcauagguuggcuuaagaagcaaaaaaauaggaccuuuguguguuuguaauauggacugugaaugaaacugucuccuugcucuuuccagcugguucagaggacaugaguacuacagucaauggagauguguuucagguaagcagaggugggauggacugucucaggcucagugacuuguuucuccauuggaggucauuuagggcucaccauguuuccuacacugacuauuuucuugucguaugcugggggcagggacugacugaggagucgcucagguugucuucaggaguaacuagcuuuaggaaggaguggcgugggauggagggaaugaaagcugugccgggcaggugucucuggugggaggcuggccugacuggccaucauggguauuuuaacuggauaagcucuuuggucaggacauuacauguggaauuuccccuaagcaaaugauuggaaaagggcacccaguuucucugcaggaugguuugccacagcagacaaacuagaaauagcuuacauguccagaaucggaaggccuaggucgacuguucuaaagggcuaucggagcuuccuguagacaugcauguucuuauuaaagcaacuugcagaaugaaugaugugccauuauuuuuauuuuugguguuugcacaaaauuauuuggaaaaggcauuccaauuauuaacagugguuggcccugagaguacgaggcccuggcuuccucuuuccaccacaggggcugguacaguauggaugggaagguaaggcagucuggggauggggcucaggggagaagcuuugaguuaagcccacaggaccacagaaacagaacagaacaaaacacacagacugagagagcucacacaccaauggcauccccaaaccccacauagugcggagaaccccaaaugucuaggugggaaugagccucuacugccugagcuuuaauucucaacuugggcaaguaagacucggauguuggggccugcagcuuccggaucuccugagccccacccugaggaggaguuggccucuuggauucugggagaauaaacaauacuuucuuauguaagugggaugggcuccuccuaauacaggaaagaaaacuggccuaaccccauuucuggaaaaugacucaacagacaaugaguuagaaaagucucucccuaggacccaggcagcuucguguccaguugaguauagcugagcuaaggaguaagcguugcucuuguacucuuaggacuuuggucaggccguuucugggcuccaggaacacccacaaagaccuuacuggcucaaaaggccucuguucugcagugaaucugcuggagcagcauuuggaacugcaagaguaucuggagcauucugagccacauacucucaccuucucaguugaagagaagcuugagauuucaacagauagugaagaaauucacagauggaguuuuccucacuugaaucacuuggcucuccuggcccuggcucuccuggcccuggcucuccuggcccuggcucuccuggcccuggcucuccuggcccuggcucuccuggcccuggcucuccuggcccuggcucuccuggcccuggccauugcugccuccuuuagcaucacuguccauuagaggaugugaagagugcagucucaggaguaauucuuuuugguuuuucgagacaggguuucucuguguagcccuggcuguccuggaaccuggaacucacacuguagaccaggcuggccucgaacucagaaauccgccugccucugccucccaagugcugggauuagaggagugcgccacugugcccggcuucaggaguaauucuuauucucugcuaucacagugccccgaggcagguugaucugugaaucaugccacacacugcuccccuagagcucuccuggguaagggaaggucacagaagaggcaguuuauuuggcuuagcagcgaagcuccuuccugccugcucugcguacgcucugcacugugcuuugcucugccgcuggacccagaagacuaucuguaggcuaggcacagugagcaguguguggcacgcacuuucagggauaaaagccuuagccugugcaagcucgacacauccaccacccuggguagagccuugggucgcagucuuuucuaggagacuaggugaaugaccaaguacaaacuucauccccagcagagcaggaggguaagccucauagcacccauuccagcuccuuuggcuacugggggacagggauggggcuggaggaccccgcagaacccaucuccuuucuacccucccucuccucgucuccccgccccacucucuuugcaucuauucaucuccugugagcuacuuagaggaauccacagcucagcccagcuuagcuugagcugcccaauccugaagauggauaaauuggccaugaaguuuuagcaugcacuuggccagcaugaaaaccuagcccacucacguuaaaaagcuucauucauuaugugagccuuauuaaaugccuugaacaggaugcugucauuucacagguuugaaagcaggguugcccagggaaggggauuuuucucagcagccaucacccugugcaugguagaacaggcacuguaagccaggccucucugauacaguguccagcgccuuucuggucccuccccuagcuuuauaaccagccguuuguccauucauuucucagcucucauucuuugggggccaggccugugcugcggcggugguggaugugaaagcaaagccaacggaauuuuuguccccggaguuuacuucuaauggaguucugggaaggcccgagaaaccuggaaagaaaucaguauagcccaggagcuuggauuuguggguaacuuugagacaggaaggucagaaguuuaaggcuaccauggggcacauucucauuuugaggcccuuaaaaaaaaaaaacccaacucuaacagcuugaguucuuuuugugucugaaaacaacugagggcuuuacagggauuaaccuacuuaauccucccaauacccauuacagugucuuuuauuauccccauuuugcucaaggagauuuaauaacuguucuaguuagacaggagcuggaagccuggaagcccagcagggggcaagugacagaggaaguggguuucaaggcugcucuaagggaggcauggcuggcccuggcugagagaacagcauguguaaaggcauggaagcuaagacaguugguucaggguucaucauccugacauccuauggagucugcugcauagagggauaugucaggaaagccccaagaggccacagacacaggccuggauaggauugccuaaccuaacucccaaccauagcguaucaguggccucucaugugguauaggagguggucccggcuuagguagacaccauacccuggaccuggaacuggccacaucacuuccaggcaugggaggugcuguggaauccugagccuugugcccugggugugcagugggauccugagccucgugugccuuggguguguagcgggauacuaagcaucgugcccugggugugcagggggacugcuccaggacugcccaggcuucauacccagacaucagacagcggaggaggccgaggcuucgguuucuggcuuuucccugcaggaugaccuugaauuaguaacuuaaccuuucugagccugguuucucaguuguaaaauggggauucaaggcccugcccuguuguucccacgggguuguugggaaaagcacucuguaacugugacagucuuauacauuacugacuugugcacuaaaugaguuuaggaguggccugggggcaggagagagguguguguggguugagggagguagggacccugaagggacaaagucuuuaaucuugaggucacuuagcagcagccaggcugggacccgggagugugagugggugguacugcuugucuagcaugccuaaggcccuggauucaguccccaccacagggguggggguggggggcaagaggaccaauugaagagacaagggcaguucaggagucaugcagaguuccuguaagcuguucacacccagcuagcuauucggucugaaccuggcucugucacuggcuugccaagggugacuguggcacuuuggaacuagaguccccuuaccuauaaaacaagggcaauaaaaccuuccgaguagaauuguaaagaucaaaggcaucugcuugcuagcaagugcucuggaauccuaacgugggcccaggcuuagggugccagcccagggaugcugcuccaguguuaugccucuuuccucucuuccuccugcaucucuuagcaccuaagacuuucccaaaggcaccugcccuguuugguccuuuagcuugcuggaucuuggugaauaaugacuucucucauucuuugcuguucucugcucccaggcaagaauggccaugccgguuuuuuugucuggccuuuuacuauaguauacccgucagcuaugguccucaucucugagggacuccccaucucagggaaccagaagacaggcugucuuguccaucccuguccauggccuccacacuuaggaauuuaauguucucucuuccucucacucaucuuccuuuuccuugucccuuggguuguacuugaacucagggccuuaugacagguagggauacccucucccauugagcuaucucuagccucaauaaaccucccucgucuuggcucuccugcucuggaugcugugugguggcagccagucucugguuuuauggaacauacuugggcuagaaagauggcucagagguuaagagcauugacugcuuuuccagagguccugaguagcugacaacuaucuauaaugagauccgaugcccucuucuggugugucugaagacagcuacaguguacuuaaauaaauucuaaauauauaauauauauauauacucagauuggcaacucagaacaaaacuaguaugaaaaaaaaaaccaauagcuuuugccucuccucucucucacucucuuauggagcauacuuucuuaggcagcuagagggcuggggugagggaguaaccguguaaacagguaagccauuucagcaacaggcacucuaaggacaauaaaaugugguguccccagggauccagauggcaucaguuccagcaucccugaagauauaaaagccugaauauucaaguuacuuguauaauaaauggucaaguagucaggugguguguggcucaguaguagaaacuuccaaggccuauggugaagauuucaguggcuggaggaagaaagcggggcacacugcaguagaagcccaauggggucugugcccacaggaacguggaggggagagugaaggugccaggcaugguagcagugcccggacucccauccuucagagagaaagggucuccuggaccaggggugucccauccacacugacccaagugcacaacccccaacauuucugucucaagcuuuaucaacucugucaccagagaugaaaccugcccacuacgucuguccaucuuucuuggccucaguguuccuucuguacaaagggaaugagaacugacgacaaugggcuggugagauggaaaagcaguaaagauacuuguugcuaagccugaagaccugaguucaaccccagaacccgcagagggaaggagagaacccauuccccaaguuguccucugacuuccacagagucagaaacacaaauugagaaauauaauuaaagaaaaagaaugauaaugcuaaucccaucuaccgagcuaccagucauccuguggcaggcagaguugagaauguagcucaguuggaaggguggcuugcuaagcaugcacguuggauuucaucagugcaaugaagcacaacaggacauaaccccagcauagcagcccacaccuggaugacgcauuuggaagauggaguuagguuaaucagaaguucaagguuaccugcagauguagaacaaguucugggcuaucaugggcuacacaagguccugucgcuacacaaagaauaacuaucuuauagauuauauugcgucaaaucccagaaucaggucugagagaccaucuuacuaugaccauuuuuagugaggaaaacauaaacacaucuugcagcuuuaacaaugggauuguauggcuuuagaguccaaguuuaccacagcagacuuuaauuauuuuauuuuauguguaagaaagaguaucuuuuuuuaaagauucuuuuuucuuuuugagacaggguuucucuguauagcccugacuguccuggaacucacuuuguagaccaggcuggccucgaacucagaaaucugccugccucugccucccaagugcugggauuaaaggcgugcgccaccacgccugacuaaagauuuauuuucuguaugugagugcauuguagcugugcagaugguugaagccuucgugugguugcugggaauuggauuuuguaggaccuugcucacuccaauuggcccaggucgcucuggcccaaauauuuauuauuauacauaagaacacuguagcugucuucagacccaccagaagagggcgucagaucucauuaugggcaauugugagccaccaugugguugcugggauuugaacucaggaccucuggaagagcagucagugcucuuaaccauugagccaccucucuagcccuuguucuuuuuuuuuuuuuucgagacaggguuucucuguguguagcccgggcuguccuggaucucaaucuguagaccagacuggccuugaacucacagagauccaccugccucugccuccagagugcagugugcuaucaucaacuggcuaugacagaguuuuagucaugguuguuuugccuguugcuggucugcagguucacuugagaaagucuguuguuuccuaugugcauuguggcaaggaaacaccagacaagugucacaaaggugacacucugaaggacaaaugaacacauuaguaaugagguccuauuagacuguguacguuuuaucacaugacagaacuauacuagagauaaauuuuaaugaugguagcacaaggcacauaagcauugugugcaaggcauggcauuuacagguguuuuuaagguuuauuuuguguguaugagugucuugcuugcacauguguauguguaccaccugcaugcaaaugccuucagaggccagaagcagguacgugguugcaggcaguugugagcugcuaugauggugcugggaacugaacuaggguccucugcaagagcagcaagugcucuuaacugcugagccaucucuccagccccccaaauuuaguuuuaagauucaucucauuauuguaucaauccuaugggaguguuauaauuuauccucuuacgaugaaugaaggggagugucaagaaguuggccaggcugaugguaaggcucugagagauugauaggccugaggccacauggggagcaguguugcuggcaauggggaacacaguguaaagguaggguguagucaccagaggcugggugcugguguggguugaggcugccugcugccuccugggcggccugcuuugagugcugucuugguaccaguaagaacagcaccacagcagggcaggcacgcuggaccaggaacgcugugcuuuuguuguaggaggcuaacgggccugccgauggcuacgcugcgauugcccaggcggacagguugacucaggagcccgagagcauccggaaguggagagaggagcagaagaaaaggcugcaggaguuaggugagggcacaccuggaggagggugacuccaacagggauggcucuggugccugccagguggccuuggaaccuuggcuauccaaggcagguccacgugguuaaggguggguccuaggggugcuggcuagggccagggguggagcagccaggguggggguggcuguucugcaaagaaaagcugcucuaugcauucuccugcggggcucacagacgcugccucgaaggugaccgaacaggaguggcgggagaaggccaagaaagaccuggaggaguggaaccagcgccaaagugaacagguugagaagaacaagaucaacaacaggugaaugaaggccaggggaucugagcagagccaaggaggccuagagaagccaaggggacauaaugagaacacaaagggaaucaaagaacacaagggcaucucugaggagauggaggaaggagccaugggggcgauggguggggugguggggcugggaaauggcuuugaauggaugauacagcgaggacacagggaggagggcugcuggaaccguaggguucuugacagcacgcaaacuccuaagccuguacccuccccgugacugagaagcagaauauguaccaaggccuggaguauaccgagacucuccagggcccuaaguccucugugggcaacucagagagggaacagggagugaagagucagccugaauauuugaugucauuucuguuagaaauggcaaaugacaguaguucaacccagugugucuaagggaugaagggacgcuaguggccuguguggaugaaaaggccaggacgguggcauugggucauaagugauaucagucagcguucacucucccugccacuuagcucugcuuccuuccguucugguucuaccaguggucuuaggccccuguauggggacagcagcaucaggccucugcccuaugauccaggcaagcucgguaaaaauagcaaguaucuaguggcuccugccagaguugccuugggcugugugacccugccaguagacaggagaaggguugccucuccugcuuuucagggugaaagucccauucacuggguugcucugggggccaguccuaucgaaaccguggggacugcaguaggagcagcugauccugcagaauaaaagcaagguagagcauggggacgagccagagaacacauuugugaaaauagauauucuccugcuucggaugcugugcccuucaagauaagagaucuucccugaagcgaaaggcaaucgaacugcugcaugcuaagcugggcuuuggguguccagugaggacccuucuguauccucagaguucagugagagucacaugcauagagccagacuugcauccaguggggcccugugcgugaagaccauagaagcaaaguaccugcuggagaagaaccauugucuagagcaguagguggcgaccccaggggucacauaccagauaguucugcauuacaauucauaauaauagaaaaauuacaguuauaauguagcagugaaaauaaucuuauggcugggggagggguuucaccuuaacaugaggagcuguauuaaggggugauagcauugggaacguugugaaucacugggcuagagacuugucuucgaggagugaccaugguucaucagaagagaagggcuaauguaagggagaacauucuagaccugggagcaucgugggaggaaagaggggaugugguguguugguuucagggagucaaagcguagagggaaugguuuugggaagacuucauugagcuguagggggccaucaacgguuggggucuccccacucucuuauggguaacuguuaguuuuaaacuguacuuccuaacaugucuccucuuggagguacuaacacacuguuucucuuucucuuuaacccugugccugccugucuggcugucugccuucccccaccuaacuccuccuccuaacgguuuuccucaaggaucgcugacaaagcguucuaccagcagccagaugcugauaccauuggcuauguguacguggcuccuuggcucugcaggggcagcuguggaggguggccuggcagcagcuuuucagagucucuugucugugugguauaaaugaaugugguugggcucugagcagugaccagugcaggaggcaagcuccagggcuccagggcugguauggguagcagcccuugccguacagccauccaucucuguccugcuagcaaacugcagggagcuuugcccaguagaguucccaaguugggggcgaaggaaggaaugcacuagccagccucacgugggaggggcaaagggcaggcagccagccacacuaccccugagaagccucccaggaaggggagggguaugugagaugaaggggucuuuuuggggguagggauaggggcaaacaccaggcacagcuugcugaagguauaaaggagucuuuacaagucuacccuugccccaucccuaagugcacugacuugggcaugagccauuccacagcuccucucccaagugucuggguuuggagucuggcuggaaccgugccugcuccagaucuggaaugucagucagguuuucucucacgccagcuccagaugacaggcagugcguuacugacagaaggacuggaggagaaguuacagggaagacacagugguuucugaguauaguuuacucacagcacaccuuacuguacugauccugcuggaacggggccucugaacugcgccacugcagccuccacugcccucugccuucgcccucucuugacacacacagggcguggccggcccuggcuucucuuccuucugcccacuguuccuccucccaucugaccuguaccugcugacacuuauccuaucccugucacuggucacacuuagagaagagacagauagcccugccaguuacucauggauuggaauacaucaugaacucuggaagccacacucucugcugggaacccaguguaugcuucagagacucaugacccucaguuacaccuuaaaaaaaaaaaagaauuugcagguaacaaggggugaugaggacacucuagaugggagaaacagcuaggguagaggccuggagaggacugacgggcuggguuuguggggacggauggaagucaaagcugggaggcucuacgugggagcuggacucucugugccaaacugagcagcucagauuugacccucaaggcagucggcagccauggaggcaucuaacgagggagagggacaccugcggguguaggugcuguagaauacugcuggguucggugcucccauuggacccaaggaaaugguccagagaacccaaggaggcucugaaggagaaagaauuggacccaagacuucucagccuuucaucugcccauggguuugccaggggagcuugagcaaagccgauucugguuccguaggaccgaggugaggugacacuguguuguugggcacggaugagcaguaaaggcacaggggaccucuugacccugacaggcagcugcaaggauaaaacccaucauccacacucacugucugacccucacagcacagagcugucaccacacuggucgcucagccagauaugggcucagaagaguggaagccaugcuucucaccucccagguuagcugagcacacagcggaaaggcaagcucaugauggagggucccaccuuugagcccaggccaguuccaguacacagcacagugggaucgcuuggagagcucucugauccaccucccaacugcuccccaacuuuggaucccuuuuucccuucccaaauaacugaguccaguguucacaaacuccucaguguggaccuaucaggagccacacccuuaaagaaaaccgacuuucccuccauacuucagacugguggcugcuuugaaccugugcagguaagcgcagcuacuauguguucacaacacaagcgucuggucaaguccagaagacgcugccucucuccaucccuccugaccucugacucuggaaaaccuuucugcccccuuuccacuauggucacugagcccugguguguguuugccccauuuauggcuggacacucuuaagucagugacuuucaaaacugucaaccaagaauucugaagggcgguagaguucuugccuggaauacacacagacagaaauacccaguacccaguaccaucaaagcaggacuccugaagaagaaacaaccccaguuuuauccugauauaauuccaaaugaagcaaagcuuccgauagaaccuuuccugagcugugguuccauccagacacaacuguucugggcucagaacauuucuguagucagauaugcuugcgauguggaggauuccacauccauuauaaaguugauuaggugguuagucaguguccucucuggagaauaugagguagggauggggacacagcucaguuguaggcugaguuuagguacaccauugucugaggccuagguucuuucaaucccuagugauagaaaagaaggaacaccuguaaucucaguaggagcaggaguucaaggucaacacuuggcuaugcuuuaaacaaacaaaaagaacuguagggaagugacugaacagggaauacccagacugggaaggacuuucugaggagguaacuccuacucugggaacuaaaugacaagcaauaaguuagccaggugcagggguacacacaugaucucagaacuggagaggcaagaucucuagaguucaagaccaacuugggcuacguagugaaccacaggcuccagcaaaaagcagucaucugagccggugagcaagccucucuggaaguuccacagcccugagucuagauggcuuccauacucaggucuagguuuccuacgucaaggcuguuccugguggcugaagucacagggcacagggauggggagccuucuggcuaaugucccagaguaggcugcacaccacgggcuaggagcaggacacuagugacaacccugaaaaccugucuucucuaccuuuaccuucagggcaucggaagaggcuuuugugaaagaauccaaggaggagaccccgggcacagagugggagaagguagcccagcugugugacuucaaucccaagagcagcaagcaguguaaagaugugucccgccugcgcucggugcucaugucccugaagcaaacaccacugucccgcuaggugcccgucacgagaacggccgcgaagcacaugggccuugcuggggcagaggagcagcugcuuccgccagaguggaacuuccucuggcagcugccacacacagccuguucuguuccucugaaucucugggagcuaggaagugggacccuuaccccuuucaccccacaacuccuuccugguccccuggcccagccccucaugacuccugucagcccacucaauugugacugucccuccugauguauuuuucuuggcuuaaaggguguguuaacucuuuuuacacuuauuuauuaguauccucauuucucuggaagccgcaacuggugucagcgcucaguuugugcauagaauuuuccuagcuccguguccuuaaaaggugaggauguagucuuagaaacccagagcucgcagcuggaagcaggaaccccaaccugucugugucugcugucugcccuccaagaagaaaggcaaauuuucacgagacagggucugcaaccuugcucucugugauucuuuaacaagucugaagguagggacucugcuguccucauguauagcugagaaaacuaagacuccccaaacagaauuggcuuuuguguagaaaggaagugaggccagcgugcucuaaggcugugucuaggccugaguaaggguggcaaauacagcauccgcccaaccuucuuccucgagagugaccaagacccucuuaagacaugcaggccugcugcaguacagaugugccucccucuucagcuauuccccccuguggacuuaggauaagcaacagugaccacaccuucuuccccuucagcagaggccguauaacaggacuuuaagccauuacgaucuacaugguguuugaaaagauuuggguaauugcuaacaguauuaguucccuaagauugccauuaaagaauaccaaaaaaccuggcugccuuagagcaucagaaaucuguugucucaauuccggaggcuaaaagucccaaauuugggaacgaccaagccacgccccccagagaugcuaaggcaggaccugugccucucguagcuucuaguagcucagguauccuuugguuugcagauauaggucuccaguuuugcuuacacccucacauggcugucuguguucaucauuuucccauguauaauuuguguguccaauuuuuuuucuuuuuuugguuuuuuugagacaggguuucucuguauagcucuggcugucaaucuuuuuuuuuaaauauggauacgaggggcuagauauaugguucagugguuaagagcacuggcugcucuuccagagguucugagaucaaugcccagcaacuaacuacauggaaacuuaaaaccaucuguaaugggaucugauacccucuucuggcaugcguguguacaugcagagagagagaggggaguggggagaacuccuaaauaaauuuuaaaacaauggauaccaguauuacuggauuaaagcccaccuuaaagacuguauuuuaacuauugauggucauggcuguaaaguccuauugccaaauaaggccuaaaaaauuaagaguuggaguucgacuuuuaaauguauuuuagggggugggg

SEQ ID NO: 7049 - RNA, 42853 nt, Mus musculus
ggcagaugugaaugcagcuauaaaaaccauacacauaaggguuaaggaaaguggcaccucccucccacucccuuggagaugcagcagaguggggugaaggugacaaggagccauggauuucucugaaugaguucucuguaccaggaaagggcagggaagacaagggcugaagcucggacacaggaacggaccgcuacucuuccaugacaaugcuccugucgagucugcaccugugggucagggugcacacauguggugugucugcuggguguuccauacacagucaaugauuucauuuacucuucaaacuucuaagaggcaggaagguuagcuucauuuacaacuggagcaacucaauuugacugaaccaaagcggauacaggacagccgaaaccugauccccagcaggccccucuuccuccacacaccagcuagguaacugcuucucacaggauccaggcuguguguggaaggucugguuaaaucacuggaccgaugcuuuuccacacuggcuuucacccuucccuccacaugggaaagcuuccagacagaaagacccacagcugguuuuauaauuuuuuuguuauaaaacguuuaauguuaaccuacaauacaauguaaaccuuuaugaaaaaauuuaaaguacacuagauuucuucaggaaauuauuaacuacucaggugcaguacaggaggggcacugcaucucuuguggaugcauguuuuguugcugcguucuccccgagacaaacagagaagccaaccagcuguaagguggcagucccugcucagcgccaggcgaccccucugauuaugugcucugggggcuacugcuccuucucagucaccucccgacauucuuuccuuggccuuggcaccauuagcaauuuucauaauaacucaucaguuggaaauucuaguuaauuuuuuucuauuuuaaguuuuaaaagaaacaggaaucuugccuucucuucugucauaguggaagcaagcaaggagaaaaacagaacaaaaacaaaaccccccacaaaaccuaucugccacagacgauucugcagaggaagaaaagaccagacugaggcuguaaaacuuacucagguaugguugcuuggucacccccauggucauucagcugaggccacuucagaggggaaugaggggcagaacuggaaauaaauccuuccauuguccaugacuugacuuuggaacaacuggcagaauauuuuggaagcaauuuaagcaauagcaaauggucacaggugucuucaagcucacaggucuuugggagucacagacugaacuggccucagggacaaaaugugaaguccacaguucacccagggagagaaauggcacccagacagcagaccuagguacagcaagaaaacugaaguguuucacagcuacuggcaagccuaugcaguggugcauacccacaugcccacuacaggaaccaggagcaggaggggaguucaaggccagucuuggguguggagaguuugaggccacuuugggccaucagaaccucucucaaaacuaagggaggggcagaugaggagagcuggguagguauuucagcacaagccuccaggacaucaacaggcugcccucagaguuguagcaacaggggacccuauuuuuauuagccuggcaucuaguauccuuuugcaguuaucaaaaggcaaagggcauaaaauuaaaagguacacauuacagaaagagauuaagagggagaaaucagaauuucuccaagcagcugugaacaagauacguucacaguccacaugcccaugugccaggcagacagacaggcagggacuacaaucugggagggaggcucugggaguggggaagucccucugcaucacugucagcaagacagacuucaucugaggguccucucaaccucacuguagugccagcaggccuagcagcgcuaacauuucccaagguagaauucagggcccugcgcuagggccucggggauagucauggguuuucugaauggcuucacgagccuuccguccucaccauguucccucuaacaauggaaagcagcagaggacagaagcacaggacuauuagagagcaguggcuuuagagggcucuuggaggugaccaacacaagcuaugcuuucucucgacuggaaugcccacugucuccuagugacuacaguaacuucagagagcugcagugugccaagccuguaccagccgagcuaguccacacuggaauacuuaucagugcgcgcuggcaugugggagcacguggaucaaccacauauccacuacccaacauucagucacagaugagacauuucgagggggggggggcuccugcugcuucaccacggcaagagcaaggcugcaaacugucucugguaccacggaaugugcuuuccaacacacaugggcugggaggccaacuucucuuucaaaguuccuggcucaaaacuugagacagggucucacucuguagaccaggcuggccuggaauucagagaucugcugccucugccucucagugcaccuccaugucugcaaugggucuauccuuagacacuguuaucacacuugcacugaagcaggccaagcauccacagguggagcggugggcccgggaaggggccgcuaguccucuggaaggcaccaagcuuggugagugaggggagcugggaagagcagcaguacagccagaggggaaccaggagcugcuagccuuugguucagaccccuuuaccaccaccugguacagaugccaaggaaaagcuguacuuguguguaaaggugagcacacacccacacacagccuuuugugggucacaauccgagacuuccucucauugcuccaaaugggauacacaaguggcagaacuguaccaaaccaaaugaccacucugggaccaccuggagaggaacaguggcaaaggaugcgcaaaugagcccagggcaccuuuauuacgcggccccggccucgccucggagcccagggcauuggcucuuaucaaaucuaagggaaaaaaauacaccuaagucagccucauuccuuuggucauuaucauuacaaagcaaacagaaacaaaguuauucauaaacugugggcagucuguuccgggcucuccucccuuccuccacaagugggaggaacagguccucaggagcugcugcuggaggguuucauuuguacuuucuacaaaagcaagaaugacugcgaacagugggaaugucuccuuccccacgagggccgccgucucuucacugugggaaggcgagucugcugucugccgagcaggcaaugcucacugcugaccuucugcacacggaugcacgcagguugugacucuugcaggcagcaugguuucugauccuuccauaggaugcagcaguguuuuuaaaaaaaauauuguauuauaauaauaauaugaauuuaucucuuguucucuguuuuuguuuuuccguuucuuuuagggauuggggugggagaaggaggcaguaaagugucauucgucugucagguccuggacaaagagaacuucuguguggcugagucccgccuccugcaguguugggggguugggccauuccucugaaggaacacagggaaguacccgucuuggaaaauuggcuucaaucugaaacuuuucagggcuuuccuucaaggagaauaagaagucauggaugaccuguaggugccacagagagaaagaacgcagugaggagagacccacugugaagucacaugucccaaccuuccccaggaagacccaaggugacagcagccacaaucagugcaauuccauccaaguauuucuaguucccuggaaaacacuguuguugcucuuuuaaaaaacucacaaggagaguguggcugcaaaugccuuuaaacacagguguaagccgggcaguggcggcgcacacuuuugaucccagcacuuaggaggcagaggcagguggauuucugaguuugaggccagccuggucuacaaaaugaguuccaggacagccagggcuacacagagaaacccugucucaaaaaaaccaaaaagaaaaaaaaaaaaaaccaaacaaaccccagguguaagacugaggacccgggcuggugagauggcucaguggguaagagcacccgacugcucuuccgaagguccauaguucaaaucccagcaaccacaugguggcucacaaccauccuuaacgagaucugacucccucuucuggagugucugaagacagcuacaauguacuuacauauaauaaauaaauaaaucuuuaaaaaaaaaaaaaaagacugaggacccuuccacccucagaguuuguccugcaaacacccccaguuagcgaaaucccacagugggaaacuugaaguaccauuaucagugagcgccacaauuaaauaugcacagucccucaguucccuagugagagccuuaaaccuuuaaaggagacaggagacugcacagcccagcacuuuugcagguagaagcaagugaguuuaaggacagacuagucuacauagugaguuccaggauagacagggcugugccuuagaaaaaaaggaaaaaaaaaaaauucacacaagcuaguccucggaauuauggacuuuccccuuugagaugccauccucagguaaagucuuacuuguuuauuugagggucucauauguagcucacaguggcccacccacccauucugccucucccaagguugagaucaaagucacgcaacagcaugggguaacuacaacuagcaaagcuaaacaacacuuauucagaaauaaccauaguuucagcaacgcugcaaguuaguguacagaauauuucccuuugaguuaauuuuaaguggucugcuaaccugguaucccauuaccccaaaagacuuuaaguaaccucaaaaucagaagauuuaaccaauacauuacaaaauuaacuccaccuauccuucaauaccauggagguuucaggaucccucccccaagccaaaauccucagacauucagcuguaacucaugcagucuccugucgccuuaaaaugguuuagaguacucacacuggugaacugacaggacuaugaacauuuaauuauggugcacaccaaugacgcacuucaggugggaccagguuuucucuaccuugagguguuuguuagggauguacucugaaaguaugggggggagguuaaggauccucaagucuuuuaaacuuguuuuuuauuuuuuuuaaagauuuauuaauuuauuuuauguaugaguccacuguccgcugucucagaagaaggcaucagaucccauuucagaugguuguuagccaccaugugguugcugggauuugaacucaggaccucuggaagagcagucagugcuuuugaccacugagccaucucuccagcaucacuuguuuuuguauuaauggaggcuccacuuccuguuuuauccaauaggcuuuaugcuaugccaacagcuacucuaauaaugcucacaccaucuuagacgggcuagcuucugagccuugugcacauguccccaucccucugggaacaagccuugcuuccugacaagcuguccuagguuucuagccuaaugcucucuuucuccugguccagccucagaagcagccauuuccaaggacagcuguuuaaagauuugcgguuuuauguuuuugagacaggguuucugugcagcucuggcuguccuggaacacagagaccguccuguuucugucccccagccucugaguauugagauggaaggcagcccuccacauacucagugguucauucucuuccaucuuuguacuguagcaggggagugggggaagcagggggugggggucacugcagaggugucacuccuaagauuauaugugaaggcagaguucacagggcagcacagguuuucaagaacacuaaauuguuugcuacauguuacucucagggaauguuuaauuccaggccagcauggaauuaaccugugugucugucuccuuuaaaugucauucuccuugccaagcuauuuuuccagcgaagcauuucuuaaguuuuuauuuauaaggccauccagaugucuuagcaguaaaagcccuugcugcucucagggcuaaauuucagcuuucagcacuguugagcaauucacaauuauaugcgcguguacacacacacacacacacacacacacacauacacaaaguaagccuuuacaaaaagaguggcuagggcuagaaagacaaaccagugcuaagagcacuacuugcucuuccuggggaccuggacuguucucagcacccacauggcagcucacauguuuguaagcucuguuccaggggcucugacacccucuucugagucugcagacacuacaagcacgcaggauacagacauuauuccuguaggccaaacccuuacauacagaaaauaaagaugaaaaugucuuuuaaaaaaauaaagaugggccaggcagugguugcacaggccuuaaucccagcacuugggaggcagaggcagguggauuucugaguuugaggccagccuggucuacaaagugaguuccaggacagccagggcuacacagagaaacccugucuggaaaaaccaaaccaaaauaaaacaaaacaaaaaacaaaaaaauaaaaauaaaaaaaggaagaggggcuugacagacaguuuaauaacccacauggaacccacauggcagguuacaacucucugcuacuccaguucaucuccuggccuccacaguggagacuagaugaacaggcagagagaauacaugugaaauacaagggaagugcuggggagagaggacaggaggaucccugggaccugagagcaaaucaguguaguacaacagcggccccaggucccaggaaagaaagagugucucagaaaauaaggaagagaucuugagaagaaaacaucugagguugaccucugacuucuauaugcaacacacacacacaaauuuuaaaacaaacaaaugaaaagccuaaggguucuugcuggguuucacauauagaaacuuuuccucugaguacugaauggguagaaacuucagaaaacugcagaggaaaugaugaguggaucuguaagauuuaugugcaaaguggggcaugguggcacaugccuuuagucccagcuccagaggcagaggcaggugaucucuaaguccaagggccagccugguuugcagagcaaauuccaggccagccagggcuacacggauaaacucaucuuaaacccucagcuguccccucaaagaucuacauguaccuguaguuagugaacaaggggaaucaacaucuggugagugaccguguacuacacagcagguacucugggagacacaguuacgguacccaauuaaaaaguccaggguaggggcuggagagauggcucaguguuuaagagcacugacugcuuuuccagagguccugaguucaauucccagcacccaccugguggcucacaaaccccuguaacaguagucucauuuaacucucauaguggcucacaaccacccguaacagucgucucauuuaacucuauggaaugugauacccuucucuccugugcagaugcacacgcagcugaauaggagacccugaauuccauccccaacacuggaaauuagaacccaaaaagcagcugguugugguggcgcaugcugguaggauuugcugaaggaggcaaaggcgcaggaggaucacgaguuugaggacagccugggcuacacauuuugccaggcagugguggcccaugccuuuaauuccagcacuugggaggcagaggcaggcgauuucugaguuugaggccagccuggucuauagagugaguuccagaacagccaggacugcacagagaaacccugucucaaaaagacaaaaaaaaauacccaaacacaaaacaaaaacaaaaccccaaaacccaacccaaagagcaggugugagccuuguucucagugucaucggcuucguucccagccacgccuccucuucacucugugcuaggucuuuucaucuuaccuugugugcuuccugcacaugguguaguucagaacacgguuagaggggugggaaggaggccucuguccagccugaagguuccaucccagggacccacacagaggaagggaagcaacggccucccgugguuuguccuccccucugcaugcacacaucuacagcccaaaucacagcaucauguggcuuaagugauccuuacuguuagagacugugagaaguggaaucgucucucuacucuggaaucauuggguaacuugaaaaugaucuugacacuuucaggaucaucaggggagggcucagggggcaggcauuccagcuuccucuccuuuuccuccugcaaguucuagagacacaaagcacagguaaggauguggcucaaacagagauaaagaaaccagaauauagaggccaugaauguuuacugaaaauucaucaacaauuuuugaaaagaaacccuccugaggccaacaggauagcucaggagguaauggugugugggcucugaagguacaaucgaaagacagccugagcuccacccuccccuaagguugucuucugaccuucauagaguaccacauguggcaugguguuauguguggaucaaugcucucacagcucauacacauauaauggauaaauaaacucuccuuuauucgcugguuaaggcagggucucauuaaauaucccuggcuggccuaaaacuugauaugaagaucaggcugacaucaaacugagaaacuggccucaauccugccucugccuucugagugacaggguuaaagggcugcaccacuacaucuggcuggacaaaaauuuaaaaacaauaaccccucaaaaaaaaaaacacacacacacauacacacacaaaaaucccaaacccaaaaccaaccuucuugguaacaaagaaggaacaaaucuacugcacacacaugcacgcacgcacgcaugcacugcuaguacaugcaggcacugagcacuggggaaagggugugcccuggcgggaagcaagcagcaauaggaaagacaaggaacaacuguguggcucaccugucgucuucgcuccuccgccagcuucuguugcugcaccuccuccuccuuccggcguuuccgcucuuucuccucccucuucuuccucucuuucuccugaucugcccugagagaagccagguaggcuucauccugcuguugucucagcaccuggguuugguuccuuucuucccuguggauggaaaccaacuccaaauuucacauuguucucccagcccagcuuucuccugcugcucccugcucccucuccaggauagacugcagggccaagugcaagcuggccaagagcaguuccugacugcucccacuucccuugucuugagauccuccugcuucagccuuucaaguaccaagauuagagaaauguccaccacgcccagcuccuggcuucuauuuuauuaaauaaucuauuucuuaaugugauaaguauccugguuguugcuauuuacuugugaauuugacacaaguggacacgcuguuaccugagaagagagaaccacagcugagagaagaaucccuggccuuccuuugggaagccuauugggcacuuucuuaauuagugauucaugugggagggcccaaucuaccgugggcagugcuauccccuaggcagguggugagcaaggaggagcaacccaauuagcagcaaauaaauggcuuugcuucugcuucacuuaguucaugaccugacuucucucaggacuguucugacuaguuuuuuguuuuucgagacaggguuucucuguguagcccugucuguccuggaacucacucuguagaccaggcuggacucgaacucagaaaucugccugccucuuccucccaagugcugggauuaaaggcgugagccagcaccgcccggccugacuaguuuuuaugucaauuugacacaagauagucuucugacaggaagaacccuaaucaggaaaugucucuauaagaucaggcuguaagcaagccuguagggcauuguauuaauucauaacugaugugggagggcccagcucauuguggguggggccaucccuggccugguggucuuggguuguauaagaaagcaggcucaaaaagcagguaggcagcacuccuucauggccucugcaucagcuccugccuucagguuccugcccuguuuugaguuccugcccugacugccuuggaugacgaugauacagaacuguaagaaaauaagcccuuuccuacacagcuugcuuuagguccuggugacuuaucccagcaagagaaaccuugacuaggacacagggucuuauauaucucaagguggucucgaaacucacuauguagccaaggaugaccuugaacuucugaucuguuccccaacuguuaggaacucaagugcacuuccugucuauuuucucuucuacugaagacaacggcauucugaagcagagcacagcaaacuccuguggaauuugggaucaaagucugggcaggccuuuguagcagguacugcuagccacugagcuaucucaugaccugcacuuacugucugacaaucucaugcauuuagauaauggacuuuagucauuuucaacuccaauccacucucauccccuucauuccuccugacucuguccuuccauauguggccuguggcagaggguaguugggcguuauuuacagaaacaaggcaacuacuccccacugauggccaauagucccucagggaggggcgggggcuuugaguguggugacucgcucauccucugccuuacucuccuucugcuccucuucccugacaccccugagccccgaggcagggccacagcugucccacucagagccaagcacuccagcaccucagugguccacacugaggucagacagaggccagcauguuuccuucuacauuuacuuauucaaauguacaugguacugaagaaggaguaagcgugccgcacaacauguggagggcaguacucuccuccuaccugaaauuaagugugaucuugcugguugguccucaaucuuuaaaaaaaaguuauucuuauuuuuaaaauugguguguuugugagugagaggaaagaaucggagaaagauagagagagagagaaugagaauauauauauauacauauaugcacacacacacauauacucaggugcccaugaaggaguuggaucucccagagcuggaauuaugaacugcccaucuuuagugcugggaacugagcugggguccuuuggauccuaaccgcugagccauccccagcuccccacguuguauuuaaggcaguuucucagugacccugcagccugcucacugacuagccugacugaccugcagagcucgggacccuccugucucugcucugcucaguguggcagcugcuccuagcuuucaugggggugcuguggagcaaagcucaggucuuagcucccacagaaagcccccauggacagccaucuccuugcuacccuggaguggcugcuuaugugugcaccaugcuccugcaaugacaucuggaugagaucccagaggaacagaacucaaacaacuucccgagaguugaaacaagugaagcuaacuaagugcuaaccaagucuacuaaacugucugagcccagucaucagagcacaagcuguggcgucuuggucugcaguucuaaaaccacacguaaagcagugcagggugaaagcagugaaggugagcgacagccuugggcuugagcucccacccagugggaucugaugcugccucaggggcagagguuggaacagaacugauaaacuagacaccuagcuguuguccacugcuacacaacugaucugcuugguguguggaaaaaaccaccuauacaucuggugccaaaugugaucuguguugaguaugacaagguaaaugggccuuuuguuuguuuucuguuauuaucuucagaguaagcagagagugugcacaagugacuacaaaucuagaagcacccuaaaauuaugaaugcuuuaaaauuucuucuuugacuuuaccauuucaauuuuucuguaacuacuguacauaauccauguaaugagaaaagcuauaaucaguccaccuucuucgcauuaaguucuauguucagcauuccaagcuauucuuuuguuuguuuguuuuuucgaggcaggguuucucuguguagcccuggcuguucuggaacucacucuguagaccaggcuggccucgaacucagaaaucgccugccucugccucccaagugcugggauuaaaggugugugccgccaccaccgcccggcccaagcuauucuucaacaugaagcaaaggcuuuuaaagugcccaagacacaggaaagaagucuguggagccccaagucaguccguuuuccaagcacacaucuccaguaccuuucuagacguucugacaccagguaagucugguuugcauccaugaugaaugucagcugguugaugaggucaucagguugaaugaggccuucuagccuuccaaccacagucauucgccgauccuucaacauaaucauagcuaggaauggauagguguucucccguaaggccugggacacugacacaaagacccaagagaucaagcguaagaguugggaggaaacacaucaguccuuagacuuugcacacacugauggaaauacccucagagauuuauuucugucuccugugcgucagcacuugucuccaugcacacgugcaucacaugcaugcauggugcccaggaagacuggaggaggcucagauucccugcaucugaguuacagacagcugugagccgccaagcggguccucuggaaaagcagcccaugcccuucgucaccgagccaucucuccagccccucugcuguauuuuuuccucuaaagaugagugcagagauuagaagacagcuuucuagaguugguucucucuuuccccuguguuugauaaccaaacucaaauuccaucucauaagcccugccuggucucuucauuguuuucugucacguuuguauuccuaaacugaggcgagugcuuagaccagggugaggcuucuugguaagcugcuguuaugcugaaaagguaacaagguucuaggauaaugucuacugaacggaaggaaaaggcacuauaaagagccauguuacacuuaaguauaauuucuccagauguuaagagucaaagccacuggggacaaggcugaaauucucagcugcaugcugguggcuaugguuuuacagcgcauacacuuccugucuuuuccuccucauccaauuccuuccaccccucauuuucuucccuuaacaauguuagcuuucugcuccaaguaagaaaguuguucuguaaauaaacaaauuuuacuaugauguaauugcaucuauguucuuuuuuuuuuuuaauuuauuuauuauuguaugugugaguauacuguugcugucuucagacacaccagaagagggcaucagaucccauuacagaugguugugagccaccaugugguugcugggaauugaacucaggaccuauagaauaaaugcugagccaucucuccagaccccugcauccuauguuauaaagaaagaaauuuuauaacucuuuacaaaaaguauccuuuguguaaucuaccugcuagccccacagagccacauuagaauggcaaaacacaggcugcaggaauauagcccauguuuacaaaucaauuaggaguaaagauuaagaacuaaggugcaagagaaacagcuacauuguauuauauuuaguucugaacaccaggcacccaaugccuagguguuagcauauacagagguugcuggacaaagaggcuacaaaaugacuguauucucaccacugggaucuuuguaucuucugaugauuucuaaaaacacugacuaagaguugcugccagaaagacugaacucccugcauuggcugucugcgcucuagcacucaacagaagacucauuaaccagaguucugcugaaagccuggauagagaagacaaaugccuagcaaaagccuguuaaaauuagaacugagcugcugggcaggacugacugaaaaucagagucucuggcaaugguuagcuguaaagaaugggccuuaaacuugcucugcucaaacacaaccguacgcugacuguaugcucuuggaucugucuuaaugucucuguuguuguuucauuaaucucaaagaagaauuaauacaaccuuuaucucucagacuguugacaaaguuaaaugacagaaaguaaaaacugcaacuagcauuaugucuaucagagaaccaccacccaggaaugcaacagcaugcuuuuccagacuuccccaaggauacucuaaccuucucaguaaggcagaggaacacgacuuaccccuguaccccucaggcuuguuuguagaacaagcccagaaaagcauccugcuguuuaucagugagaugaccucaggugcgcagagagcauugcuguggaacaagauaaaacauugugagagcaauuugccaacuauaaaccaucagcaaaaaagucagagaagaaagaaaaugacucaucuacuuaccggcagaacucaucagaguccugguggucaucuccaugaagauaaaccaaaagaaaucgaaguucccgcuuggcaucguuaagugccuuagagagacaaaagaucaugacuuacuacuacuaaggucuggaacuacuauuuaggcuaaggguucagaugaacauaacuuuuaaucaacauuagcaacuagaaagaggggagggaagugggguugaaggggaagcaagaaacuaaguacuucccaggcuucuaccuuuacaucuaucccuggcaucuuucuccuuauaaagcccaagccaacaacuuuaacgcaaagccuuucgugcuguuagaauuuacgcugcaucgggcacaugaggauguaagaagugacucaaauaauuccugacagucacagaaagucagcuguucucaugguuuaaagguaaagcaggacacugugacuauguaaaagcaauuuugcagcuucaaaauucuugcuaauaaaaaauuagcugcaaagaugagugggauccagcaagaacacaggcaagcaggaagcacuagggcacccaaagguuuccuaaagagcacaggguucagaagaucugagacaaagcaagugucuugucacgaaucuugucacguaugaaugguauacuccugacuaacugccuguaauucccugcauugcuaauguagucuacccucaagaucacgcaaagaacugcugucucccucacccucacucucugcggccccaagcaggggaucuaacuguguacagcagguaggugugugauguuugcgaguggggagcagcagccagcaugaagaucaacugugagacaaagcagaagcaagagugagcugcccccucuccagauaagaaucaggaauuccagauacuccacaacagagccaccuuuuaacacaugucugugcugcucuuuauuguucucuggcaaacuacauaugccuaaaauccagcuuuccucccuaaaaggagaaaaugaaaggucuuuguggcuugguuugaaucaaaugagcugccuugagccuauggucuaaauccuauucaguuuguaagagaucaaaacaaauucugcucuugccuugaagguguguacagucugauaacacagcaaagacaugaacacaaaucauguaaggaggaauguaaaauugcuauaaauuuaagaacagaaggauggaaaacaaaaaagaaggaaggucaguacuuuagaaagcaagguagggugcgauagggaaggaauggaguggccagaacagcccgagcuggugugaaggacgggugcggaaggcaaggcacccguuagccaaaaugauagaggacacuccuugugggaggagcagcaagagcaggcacugaggggaaguguucggggaggggugcggugggaaucuagggaauggaaacaagcuaugcagaaaggacaucacaagaacggggcuagaccaggaggcuagagaaaaggcuugguccugccucuguuuacauuucucuaaccagugaggaacuaguuaagucuuuugugaguguaagagcaacaugaucacagcuaagcuacacuuuccuuugaggacagaaucauauugguacguuggcaucuauuugguucguggcacugaccuggcuguacguucccugguagaagacagggugugcccucccauauuucucuucaaaagagugcauaaaugaaacaauguccccaacagggucagugacccggcugcgagggucaggccguauaaaacgaagagcaaaccuggggaggaaggaauaaauaucacaugaauuggcuuacuguagcgcauauggagugggccaguuuguacagacuuuucuaacagagccagagggugguagcaggggaagugaguggugagugaguggccauuaacccucaagggagaguugaggacacugccaaguguccgcucucugcucaagaagacugcacaccacuagacagcgacauuccagugcagggcugaccaagaaagauccaaaccccagacacugucuaacguggcagcgacuaacuauuuauggcuguuuuaaaugcguuaaauuaaacacaauuacaauucagugccugagccacaccuaccaugucucaagugcucaacagacguauguggucagugauuugcacaccaaauaaugcagacaaagaacgugucuuaaucaaaaaauaagaaaagaaagaaagaaaaggugcaaugacaaacacugcugcagaauagacgaccccuugcugcaucuccuccucccagcauccccugcuuuauguucuucugggauucugacuguucagcuccuacucucaaguuacucaaguaucaacaggggcuucacuucaaaccuggacuuagucacaauguauuuguucuucaaaggggcguguauauuugcuugauauguuuacagugauggcauccaugggaggagucauaaagcugaccaagauguggaacacugguggcuacuuuagaccuaaggaugcagugucucauggguccauacacuaucccuaaagagccuacgcuaccaugccguaucacacccauucuuacacucuggguguccauacacgguuaugaggcaaagggggauguuuuacauacacuucacaggaaguugccuagaugacaacauugcauuacaauuaguaaaacaugccaugcauauuuucccaaggaaagcaaacaauguucaauuuuuaguauagaaaaaggugagugaacucugauaacuuucuuuaccaguucuuaagccuauucucucuccuccccccgccccucccuuuuuuaguuuuugagacaggguuucucuuuguaacagcccuagcuguccugcaacucucucuguguagaccagacuggccucaacgaacucacagagaucugacugccucugucuuccuagugcuggaauuaaagguguaugccaugaugccuguuaguucgaggccagccugguugagagagcaaacugcaguuacagcaagggcuacacaagagaaaccacgucucaagaaacugaaccaaacacauugcccacgaguauuuuuccuaagucaucaaaccaaauucaucaauaugaacaauccaagaaaaugaaagacauaauaaagcucuguauauagggaaguaguucuaagugcuucagaaggccgguacuucgacuuauuucucugaaaagauuauuuaacggcugucugaguauccaaauucuaggaagaggcaaagacuugaaguccacuguuucuuacuacaauguaucucaacagccaacauagucuaagccauacaugucaacucaguuuucacugugauuuuugaaaauuguguaguuccacauacccauuccugaauaaaacagaaauggaaaaacuacaacucagguagacauuaaagaaguuugcaaugagccagguaauauggugcaugccuuuaauucuagcacuugggaggcagaggcaggcgaauuucugaauucaaggccagccuagucuauagagugaguuccaggacagccagggcuauacagagaaacccugucuugaaaaaaaaaaaauguuugcaauggccagcacuggagaggcaagggcaguggaucucuaaguuugaggccugccuagucuacagagugaguuccaggacagucagagcuacacagagaaaaauaaauuaaaaaacaaaaacaacccccccaaucaaccaaauaaauaaaccauaaacagacccaacucaaaacaaaacaacaaacuuugcuacaggaaggaugccacugagcgggagaugaaggagaagcuauuauccagucccugguaauaguuggguccauauuccagcacuggaauccggaaggggcacucugugaacguucuuuuagcucaucgcuggccuggacgucaugcucuccuacucccacucuccccacccuguccaaacucaacuccucuugccucauucucaagaggauuacagacugaugcuaccacacccagccuccaauagacauuucagcuuuuagcaaagcccaggcgggcauugcucucgcucauauucuaugcuaagccugaucugccggcaagucagguuauacucaacauuuccuagcucuggacacuaacuugcaaagguaaguuauuugaaugguacacaaaggaagcuagauggugaagguaugaaacaagugggugcauguacgaaaggguuccaguguugguaaccuaagcaucgccagggcagagggaaauguacaaaacacugccuagaaagaugccaacaaucuauagcuaaguagguauagucuugagcgagaaaaucuacugggauugugcauagucagaggagaagugguuugggacaaaaguuccuggaguaugaaaucaggagacagauaaggugguuagaaaggaaagggcauggggauucccuugggaauguagcagugacaaacaugguguggggaggagaagaccaauaaauaaacacaggcagauccaugugguuuuacacacaacagccaggaccaaagugaagccgaucauaacaccuuccacuaggcaacaauuuacaacauuuuuuccuacaguaaaagaaagugcaggaagaguaaucugacaaguaggcuacucaaaaaugauugagcgucaagcuuacucuaaccuaaguuucagccucaaagccuaccuuguuguuagaagcauauaaacagagguacauaccuaaauauaucaaguaucguguaauagguaaaccggaauggaagcauuaucaaguaauaaccccauccaagcaggcccuggaauuccaaaaacaaaguuagagaccccauucucucaauguucaauacuuacagaauauggcuaguucaauuuccacgagcccaccccucucuagugauuccucucuauuacaaugcucuucuugacagucucauuauuaaaugcuacugcuuugguaucuaucauuucaucuaagacuauuguucuucacagaauuuuugcuuuaaaucuucauaacauucucaaacaacuauuuagauucauggucaacgauuuucccacauaacaaauauucauucuuuccgucuuauauuuagacucacuauauggcacauagaaauaacaagagauaauuaccuugcuuuggacacuuguaugcaaccacaagacuccaccacaaggacauccucaggugucuacuaaucaaccuaucuuacugcucucacacacagacagcuucaugucagacugugucaaaugcccugcauggucaucgcagugggcucuaaagcuaaauggggaucagggucucaaacacaaagugagguccaguccaagcugaagaaacauggggacacaggaaauuacuuccugaguuauggauugcucgaggaaucugguuuguuuauuguuuguuuuuccuuuuguuuuugaaacaggguuucccuuuguaguccuggcuguuccagaacucacuguagcggaggcaggcugccccaccucaggcagcuaauguuggaaguucagacagguacuuucacuuggccaaucuguacucaucuacuuuagucuuucuucccuuuauuuauggcuuuguuuucuguaguuccaguuacccucagucaacuggggucugaaaauauuaaauggaaaauucaaacccuaaaggguuccuaaguuuuaaacugcaaauugagcaguguaacaaucccgcucaggaugacucuucauccagccuucuucacacgacagcugccuaccaguuucuugguagccauccugguuagcagaugucucaggcgauugcuuauguucaaguaauccuuguuuuacuuuaaaaauggacccugccagguaugaugaugcacacuuuaaaugccuacaguggagagguagaggcagguggaucucucugaguuggaagcagccugaucuacacagcaaauccaagaguagauagggcuacauagcagaagccugucucaaaacaacaaaaugaccccaaagugucaguccuagaaccgauguggcaaaggaaaaccacgaagugaucccauuaagaaagguuaagauuugaggaguccuguggcgaggacagguagugugacaaucuuuuguucauaauugggauggaagagaagucugugauagcuuugcugcugcaucuuacauagcaaaagugacagccaaugcuucaggaagacauuaaauacgaaggcuuaguuaguaguucugggggcuuagggcaucuacugaagaccuugccaagugucucuucuauagaaaaugcauaauugccaggcgugguggcgcacaccuuuaaucccagcacuugggaggcagaggcaggcggauuucugaguuggaggccagccugaucuacagagugaguuccaggacagccagggcuacagagaaacccugucucaaaaaaccaaaaauauaaaagaaaaagaaaaugcauaauuaaguccuacauuuaucugggugccagcuguacuauguugcccaggcuggccucaaacuugugauccucuugccucagcacucuuuuuuguugguuuguuugcuuuuaauuuaacuuuauguguaugaguguguugccagcaugaugucuguguacuaugugugugucuggugcuugaggaggcuggaagagggcacuggauccgugagacuggagcuacaggcagucgugagcugccaugugguugcugggaauugaacccugguccucugcaggagcagccagugcucucgacuguugagccauuucuauagcucgucuuuuuccucccugagauggugucucacaacagagcccaggcaaucucuccuaucucagugucucaauggcuaggacuacagacauguacuacuaugucugcucucaaggaauucuugaaacauuaaguacuccauauacagacaugaaaaauaugauaauggagucacuguaauugcucuaggauugaauaaaugcuuaauuuucuuuaaaacaauucuaaaagcauguguaagaggugaaugccaucacucaaagauaagaaagaaaagcaccauuaaguucuuuggaguucacaaucagcuauguaucuaauuuccuuaacuagaucgugagaaaucagacugcaacaggaaaacuaagaugaaaagguccagaguuugaugacagccugggcuacacagugagauucugccucaaaaagaaaccaaguggggcuugcaaaguggaucaacagguagaggcuccugcugccaagccugcugacuggaaucugaucccugugacccacaugguaggagagaacugacuuuucaagcuguccuccgaucuccaugcaaacacaauaaauaaaaugcaauggaagaugguucugaaggagggggaggcagugagggagaagaaaaggaaggagggagagaaggaagggaaggggaaggaaaaugaauggaaagggcgagggaaggagaaacugaggcacaaauggcgcuuaaccucagcauaccacagcagcaguuaacuaguccacucuagaaccacaucuucacuaccagucuucaggaccaaccucaaaacagugguucagaacucccacaaauucuaagcaccuccuuaaaaguaccaagucgggcuggagagauggcucagugguuaagagcacuucugaagguccugaguucaaaucccagcaaccacaugguggcucacaaccaucuguaaugagacuggaugcccucgucuggagugccugaagacaguuacaguguacuuacauauaauaaauaaauauuaaaaaaaaaaaaaaaguaccaagucaagggaacuugggucacaaagaacauaucagauuuuaauuaguggugggagguugccagcuacgguaugcaguucagcagcccuguaaagauaggaggaauguccaagguuuggggcagucuguccuacacagugagcucuaguccagccugggcuaucgugaguugccagucauucugggcuacagaguaagaucauuucuccaaacaaaacaaaaaacacacaagagggggagggaggcuggaaagaugguucagcagucaagagcacuggcugcucuuacaaaggacccaaguuugguugccagcacccucaucguugcucacagcagccuauguccaguucccagggaugcagugcccucucaggcuuccauggcucauguaugcaugugggucucagacaugcucagaagagcuccauucagccugcaguagacauuucaaaagcaagcugcucaaaaugaggcccaggaaccacucccucaguaaagaacagaaaaguaguuccuauagcaaugcauugcaaagccaagugaaauggaugaacacauaagucuugccaaggcccacagcuaacauggugauacugugaacauuucuguugcuccaucacacacagauaauaaaaccaaauuaaaaagagguuauucuagcuacaaaacuugcccuugguuguggucuugagacaacauagcuguagauccuguggucagcuguauuaaccuguaggggccgagcuggcgguggauugaaaacacuugguacaccuuccugcucauucagucuguccuggacagcagccuguggaggagaaaaaacacaagggcagaacuuuagugaugcucaaauaaacccacgaggaaacuacugcaucaugucucaaaacaagacaagcauugcauaaugugcguggagagucuaugcccagggaccucucuccugcuauacugugggguaaugggaagucucccacaguagaagagaaccaagaacuugucuugaaaccucauuaacaccuaauaaaaaauuggaaaaaaaaaaaaaagaaacgacauuuacauauagcaagcacacuguaacuacuaguauaugcuauucagaauagcuggaauauaaugugcguucccauucaaucccagaagagcaggacacagacgcaguaugagcagcccaugcagugcugugcagcaggcaguacugauuguugguaucagauagacagcuuuggcaaagaggaugcagcccagaaagagccuaacuuacaagccuuagaucaugcgcaaaaaugaaggaaacuucgugcuuagaauuaaucuggaaaaaaaauauguauuuuuuugaaaauaaagauacagauuuguuaagaaaaagugaggaauaaaaacucuucaaagugggaggaaugugagggaaggccaacuuaaucugaaaaucugacuauucgggcucaguugcuuuaaucacagaacucagaauguggaggcagaaggaucaaaaguuuguggucaucucgagcuaugcagggaguccgagguuagccuuggcuugagacugucucaaaaaaagaacaaaacaaaacaaaaucacuucacugucucucuaaauucuaauuucugucccaguuuugugauaaaaugggccaugcccaaagaaaugccuggcuuccccuucuccaugauccacuuguaguguuaggggaaugugacagugccagaaagaccagggauguagcuuaugguggagacuggagcaacaguaucucucaauugagugaggucacccauauaggcagccaaucaaaucaacuauuacuaaaugaugaagaccaaacaaccaacaaacaaacaaacaacaaaaccccaagcucagcugugucuuggcucagcagucugugcccauggucacucaugcacacccugacccagcagaagacggguguacaaauauuugggagccuuggauacccugucaauucucuuagcugguaacuuauaguaguccuaucacaaucuaacuguuuucaguguguugcuagugaacuauugagccugaggcggguaauguacuuugucugaacuugcugcugguaucagaagggucuuuggcagguaguaacuagaccuaaccuucaugguuugacuaacuccagguagucaaaccauacucaguaggguaagaaugaccuuucagggcuggcaugcuggcucaguaggugaccugauuagguuuuugucaacuugauucaagcuagggucaucugcgaggagggaacgcaacugaaaaaagugcccacaugagacuggcaugaaggcaagucugccguguauuuucuugauuugugauugacauggaagggcauagcugcccugggcagguggucauguucuugguauuuuaucacagcaauaggacucuaagucaguacguaaaguagcuugcugccaaccccaagaaccacgugguagaagaugaaacaguuacacagagaagcaagucuggaaggacacacacuaaagcaacuguauuuaucucuagaaagcgugagagcuuucuuguguuuaaaguuauauaggcauauuuuguuucuauaauuggaaaaagacauuacguugggaaauaaaucuuucuagccacauuuaugcaaugcaagguaaaucucgccaaauaaggaggacuaaaaacaauauagauaucuagcucacaaaauauaacucuccaguguuuggaaaacacacaccuguuaacagcgguuacccuaggaaaggaggaagagaggacaagcaagcaacucagagacaaccugucuuguccgugucagcugagcagaaauuugaaacuguuacagaacaugucagggucagcagcugauagguaggcacaugauuguucuacuuaucuuccucccucccucccuccauccguccguccguccgucuguccgaaccccucguuucuuugagacagggcuuuacuaugaaaaagcugaguuugaacuccuaaucuuccugccuuagccucucaagcacuggaauuacagguaugugucaccaugccuaguuuauccauuuccccaaguauacuuguuuuuguuggaaaacauuuaauuuaaaauauacuuguagauuuauaaugucaacagaaaauuacuaaagagccaaacagauagugaaaugaaauaaaaugaaaagauuaauauuaaaaaggauaaaaaaacugaauuauuaugccaaagggaaaaaauaaaaguuuuaagugaguguguguguguguaucugagccaguucuacaacagucaccgcuauacacacacacauaaaaaaaaaaaaaaccucuugaaaacagcaacaacaacaaaaacaaucuaaauauguaaguuuuaugcugggagcaauuaagaaaacuaaagugagaauucuauucucacaggacuuccccuguagaaguaccucaagguacugauacaggcaguguggcagccagagcacuugaugcuaaggaaacagaagggaggagccacaucaacacaguccuuuacuuucauaguucccacacuucuuuuuuuucuuucuuugguuuuuugagauacgguuucucuguguagcccuggcuguccuggaacucacucuguagaccaggcuggccucgaacucagaaauccaccugccccugucucccaagugcugggauuaaagguggugcgccaccaugcccggcguucccacacuucuacccgaguauuugaaacacaaagaagccauaauucugaaaucaauaaacaaaagcagacacccccccucagugugugugugugugugugugugugugugugugugugugugugugugcaggggguguccuguggcagcaggacauuaaacaugguaggagugggugcccauaccuccauguuccaguuaugcugcuccaaagcaaggcgacacugcuccauggacucuaugccagucagauccugaaaggaagagaagcacaguauuacuauggcgccgggaccgagcuggugaggugcuugcuaguuuagcaugcauaaagccuugggcuccaucuccugcaccacacagaccagguauggcagcacgugcauauauuagcaacugggagguguagggagaaggucauggcuggcugcaggaaauacuggugagacagcucauuuaguaaaugagagccugccucaacaaggccugaccuuaacuccuagaaccuaugcaaacccucuacaaugagcauaaugagcacucuauuccuucauaaugagcacuauuucccuucagggguccaauaaccagcgaaucuaagaauucagaccuaauugccuaaaaauuccucacacaauccuaggcccuccaccacaguacaaaagucacaggccucccuauucacaaaccuuccauucggcaaaugcuuaugaguuaaggucauuuccacugucaagucucacacuggcaaccacaggaacagagggauuuauuaucucaaacagacugauaagucaaaacucaguuucuugccuugauuguauacucuguacccaaggacaagauguucaacucuggaauucaguuuucuuuucuuuuuuuuuuuuuuuuuuuugguuuuuuugagacaggguuucucucuguagcccuggcuguccuggaacucacuuuguagaccaagcuggccucgaacucagaaaucugccugccucugccucccaagugcuggaauuaaaggugugcgccacuaacacccagcaaauaaguacuguugauccauccauccauucacuuauucauucauucauucauucacucacucacucauuaugacagggucucacugugcagccuuggcuguccuggaaaugauauguagacaagacuagcccuaaacucccagaaacccaccagucucugccuccccagugcugggauuaaaggcacaccaucuuuauuuuuugagauaagucucaaugaauauagggaaccgagcucaucuacugugcuaggcuacauuugugcuuugguuauaggugccaucacccuccagcuuuuaauguggacacugaggaccugaacucagauccucaugccuaugccggaggcacguuaaccaacugagucaucuccucaucacuauuaauaaaaauguuuaaaugucugaaauaauauaaaacaauuucagggcuggagagauggcucagugguuaagagcaucgacugcucuucugaagguucugaguucaaaucccagcaaccacauggugacucacaaccaucuguaaugagaucugacgcccucuucuggugugucugaagacagcuacaguguacuuggauauaauaaaucuuaaaacaaacaaacaaacaaaaacaauuucauugaucuguuaucccagcacucugacagaggaagucaagucugaggaaaaccugagcuauacaaugagugagagcccaccgcacacacacacacaaacacacaaaucuuuuuuuuuuaaagauuuauuuuacuuauuuuuuauuuauuguauauaagcacacuguaguugucuucucagacacugggauuugaacucaggaccuauggaagagcagucagugcucuuaaccgcugagccaucucuccagcccacaaacaaaucuuaaaauacacauauuuacccucuugggcugaagcacuagcucaaugguuaggagugaauacuggggcuggagagauggcuauaauuuaucuauaauaauacauaaaucuuugggccuaagcgagcugggcccaaccaaagguccuaaauucaauucccaacaaccacaugaaggcucacaacuuucuguacagcuauaguguacucauacauuaaaaagggggggggggcgugaguaccucucuugcaaaggacaugaguucaguucucagaacccacauaaggugacaaucaccuguaaccccaacuccuaggagagucagugcugcuguccuccauggacacuuacacucgugugcauauacacauaauuaaaagcaaaaauaaucuuuaaaaaguacauauacaagccagaaauaguagugcacaccuuuaaucccaacacucuggaggcaaaggcagguggaucucugaguucaaggacagcacgaucuacacaguaaaaccuuuuucagaaaaggagaugacgaugaugaugaauauuauauauacauuguaugugaacacauaaaugaaaucuuucuuuacuuuuuaguguuuuuuuuuuuuuuuugagacaggguuuucucuguguuguccuuuugauuuuuguaggacauccuugcuugguuuagaaaacaacuuuuucucucucaaacauucuuaaguuuuucucugugagauccucuccuaaauauuuauacuuuugcaucucuuaauauaucaaauauauaccuuugaagcugggcagugguggcacacgccuuuaaucucagaccucgggaggcagaggcagguggauuucugaguucgaggccagccuggucuacagagugaguuccaggacagccagggcuacacagagaaacccugucucgaaacaacuagaaaaaaccaaaaacaaaaaacaaaaaaacaaaguaaguuccaggacaguuuuagcuacacugugauacccugucacaaaugaaagaccuguucacaggggcuguccauggcagucagaaaacagacuuuuauacuuuaaauuuacaacuuacauuguagaaaacguaaauguagcaaauuuacaguucugaaguaagaauggaaguaagguaugguuggggucaccaugaggagcuguacuacaaggccgcaguguuaggaaggcugacaaccacugaccuugaucaacuacuugcuuuuuccucccugucaggaacaggaacauuuuaaaaccuugauagcuacugccaaaggcaguacagagucuucauaaaaacaaucccaguuaacauuggcuaaagcugguuccagugcaaauuaaaagcuaccuuguucccauuuagugccaacauacacuuuccagugccagaguggaguucuagagcagaucccauuggcuuugaugccaccuguguuaucgcagcagaaacaugguuacuauuauucaacuuaagaaaagaaagcuagcuggguaguaguggcccacgccuuuaaucccagcacuugggaggcagagguagaggcaggcagauuucugaguucgaggccagccucgucuacaaagugagugccaggacagccagggcuacacagagaaacccugucucaaaaaaaaaaaaaaaccaaaaaaaaaaaaaaaaagaaaaagaaaaagaaagaaagaaaaggaagcuauccugucucccaguuagagggagcagucugcuguggcagggacuucaccggguaggagcaucaagcaggccucacacuguauccuuagcugcagaaccauuuuuccaacccuagccuaucuuucuuggguuuuaaagcaauuuuuuuuuauuguguuggggauugaauccagggucucacccaggcucaguaugcccccagcucuggcugcuauauuaggaaauauuagcauauauuaagacucagccucauggugguggcacacaccugcaaucccaguacugcaaaggcagguagaucucugaguccacagacagccuggucuacagugcguuccaggacagguagguuuauauagagacccugucucaaaagacuuuauaaaaaacuaaacuaaacaccaaucaaaaaacuaaacaacuaaacuagaaaauuagcaacacauuucuuuuucauagucucacucucuugucacauauauguaggugugcaagccuguggagccagucacaggacaaccucgagagcauucaccuuuugcuuuuugagacaucucuuacuggccucgaacucaccaaguagacuaggcucguugaccaguaagauucuacagugcugagauuagaaguguguccguaugcgcagcuguuuuuucuuuuacuaaggguucuggguacggaacucaaguucuuuaccaacuaaguuaucgucccagccucuuccucguuucuuagcauuccuccuccuccuccuccucuucuuuuuaagauauauuuuaugaaugaguauacuguugcugucuucagacacaccagaagagggcacuggaucccauuacagaugauuguagcuacaaugugguugcugggaauugaacucaggaccuuuggaaaaggagucagugcucuuaaccgcuuuuguuucuauugugcaaaguauuguggcuauaucuucacuauguugaguaauucuaugauaaaaauauuaccaucaugcccaccacgaguuaaaaagacacacugauuugaguacaaagucagugaaugauaaaggcaaaaucugcaauuuccuagcugcuuugcucuucagaguggccuggcuauacacagauaccugagugacugagacaacacuguagaaacaagugcaacuggaauaaagguaaacuucauaacuacgguucuuucucccacuaaccuaccgugccauaaaucuaaugucagcaagugcugcugcaugcacgcgcacacacaaacaaacacacacacacacacacacacacacacacacacacaaaaccagccaagcccaucugagugucucacccccauacugucucagacauaauaauuccuucccagugauuuaggagcugcauucagauacaguaauuuacaacaguagaacugguuagaaagagaugaaugguauuuauuguugggggccuagagucugccuggauuucaaucaaucacaaguacuuuguaggauacugagagcaugugagaacugcuuuucucuauccaacccuguccuaacuccaucuuguuaagugaagggggugccaaucaccggcaaaaaaaaaaaaaaaaaaaaaaaacaaaaaaaaaaaaaaccaagcaaacaaacccugaauguuauaauuccugaccuagcucguaggagaguauaauucagagaggaaacacaacaggcugggagugugacaacuuaaccaggugcuguaacaaauuacuuggcuagagacuggaaaagcaggguauacucaccuggcuuuccuaagugucucucuucccauaucucaaguucuuauacuaacacacaaaguagauagcuaagugcuuugugcuccaauuagcuugcugaggcuucuuuuuucccagaguaaaagcuggcaaaagucagauaaccuuuguucucuccuucccaaacaagagagcugugcuuacucgggagaaaauggaauuuaaaguucauucacaaggugacgaccuguaaccaggcuuugaccuaaaaccaaagcucuuagagaaaacuuguguuguuuacaguuaaauucugacacuuucuuaaagguuuuucaagauaggguuucucuguguagcccuggcuguccuggaauucacucuguagaccaggcuggccucgaacucagaaauccgccugccucugccuccugagcgcugggaucaaaggcgugcaccaccgccaggcuuaaauucugauacuugacaacagggaggcagagcuaaaagugaaagcuagaacaacuuccaguguccaggcucuuaugaagcaacgccuccuauuauuugaaaaacucacaauugaaaacaaggucccaauucuuaaaucagaaaauuuaaacguuuauugaaaccucgguaauuuggcugggugguauugacauaaaccuuuaauuccaacaggcagaagcagguggaucugaguucaaggccagccacagcuauacagucacucaaaaacuaacaacaacaaaaccacuguuaaccucccuccaaagaaguuuuauuuagaaucagaauggaaaucacugguuagcccuuuacauguuaaacuaaaugccuuaugccaaccaagagacagccguauggauucacauuguggcuucuuaaauauuuaguauuucauugaacccaaaaguuucauaggcaaauauuuuaaccuacuuaaaaaacuauaugagggcuggugagauggcucaguggguaagagcacccgacugcucuuccgaagguucagaguucaaaucccagcaaccacaugguggcucacaaccaucccuaaugaaaucugaugcccucuucuggagugucugaagacagcuacaguguacuuacauauaaucaauaaauaaaucuaaaaaaaaaaaaaaaaaaaaaaaaaacuauaugaauacuaggggcagagcucagaguaugugcuuagcauguaugagauuuucccacaaaugaacccauacuaguaucuuaucaagcaauuaaaaauagguggaauaagaggaugaccucuuguuagaaguuagggaauacuggaguccucaguaauuccaaccacuuuuucagucccauucacuaaauugguaauugugagccaucuuucuuucuuauauauuuuuuaaagauuuauuuauucuauguaauacacuguagcugucuucagacacuccagaagagggugucagaucuccuuacagaugguugugagccaccaugugguugccgggaauugaacucaggaccuucggaagagcagucggugcucuuaaccacugagccaucucuccagcccgugagccaucugucuuagguucagcuucuucagguuccuuagguuuucuucagguucuucuuagguucauggcaacaugucaggaagugccuaacaucucaggcuuagagcuuucugucaccucagugucuuaucaaggaugaaaaggauguauuuauuuauuuguuuauuuuauugauuuuuuuuuuuuuguuguuuuuucaagacaggguuucucuguguagcccuggcuguccuggaacucuguagaccaggcuggccucaaacucagaaauccgccugccucugccucccgagugcugggauuaaaggugugugccgccaccgcuuuuuuguuuuuugguuuuuuuuuuuguuuuuugguuuuuuuuugauguauuuauuauaaagguauuugugaggugcugugaaaugagccugagcuugcuuacaauauaaaguacuaugguuaaauuuuaggaaaaaaaauaaaauaugcucaccuuugacugagucccacucuaguguccugcaaucugaggcauuucgcuacaacaaaaagcagaaucacugugacccuggccagccucuaaaggugacuccucugcucagaaucaauccaagaggccaccucaccuccccaccuuucagcuucuccccucugggaaaauuugcuucaacauguuucaaaauaagguuuuaaauauuuaagugaaaaagccacccaugaauuggaaaaaaccuuuuaagccuuuaaguauacagguguucugcaugcauguuucucugugcaccaagucuacauaaugcccacaagggcaggaagaggguuucagaacccccagggacuuggguugugaacuuaugggugguggaaauuaaaccuggggucucuggaaagcaucagugcucuuaacagcugagcucucucuccaguuccaaaacauuauuauuuagucacaaauacuuucuauccucaaaguggguuuaauucuaucucucagguauaccugugugucaccuugugccuucuuguugcugugaccagacaccaagggaggagugguugaauauacacauggcucauggucuuaggagacacaguucaucaugguaaagaagucacccugcaucugcaggcagagaggacaaacccugacgcucagcugaucuccuuucucuuuuuacucggugugggagccauccuaugaaccuuuccuucauaguuaaaucucucuggaaagguccucauagacacacuuuaaaacaacaacauccauagguccauucccugucacuuaauaccuaaacacauuauuuuaaauaacauuccaccucagucccccaaagugucauauucacuccuaaugcaaaaugcagguggggggcuggagagauggcagggcaguuaaaaccucggacugcucuugcggagggccagcauccacacagcagcccucaaucauagauaacuccaguuucagaggcuccaaugucuucuucuguccuccaaggucauaguacucagauguucacagacauacaaugcugacaaaauacccauacacauaaaguaauuuuaaaauuacaaaaugaauuuaauucauguguaaaaguucuccaaaucagccaggaauagugguccaugccuuuaacccagaacuuggaaggcagaaggcagguggaucucugugaguucaagguuagccuggucuacaaagugaguuccaggacagccagggcuauacagagaaaacccugucuuaaaauaaaaacaacaacaacaacaaaaauuuucucuguguagccuuggcuguccuggaaccuauagaccagauuagccucgaacucacugcuuccugugugcugggauuaaaggcaugagacaccacuggcagucuaguguauaggccuuucaaacuuggacuucuuggcccucagaauuguaagaaacaauuuuuuguucuuuacaaaucgcccagcuuugaguauucuguuguaggggaacaaaauguaccaacagugaggcugguccacaaagaaaucaugccacagagacaaaugaaaaggauaacuugcccagagcagaaaguuaguaacuggagagggcagaacucacauccgggcagccucaguccagaaucagucuucucaggcacucacacacugcugauuuucaaguacacacaugucccuguaagagaaagacacucucuugcccaaugagaaugggaacuauggccaagucgauuaacugagagucuacagagggagucgagcauugcaacaccuuaacaagcacagacauccaggcagcgaucccagauaaacagaacaagcccacuaacagcaaaagcauauuggauuucuuuuaaggagaaugcagccuuaaacaucugccaaacaggaaauauauaaucccuuacaccucagucauucuccucaaagucauuaucuugccuacaacuaacucaaaaccaauuuucccccagugacucgucccuguacagccuuuucaaagcaguuaauuucauauagacaaaacaguuuuucaaguauuuuacucauucauaauguuuaauuaaauguuuaugacaagcaccaauacacaauggcucgagcacacacauaggugacucuugucaacaguccaauuuaaugaguaggcaguaguucagugaaaggaacugguuacugugcacgaggcccuggguucuaccuccacuaccaucuuucccaaauacaacugaacucauaaaagcagaaauacuuaagcuuuugagauaguuuagugggcugacauccugccacacaagcccgaugcucaaucccugaaaacccauguaaagguaagagagaaaaauuaucuguggccuucauacauaugcuggcauaagcaauuauaguaauaauaaaguuuaagaaaagagaacuaagugaguguguuaaaacuguacaugggcuggcaagauaaugccacaguuacagccccggcacacaaaugaagacuggacccacauaaauaccagguggguacagaggccacuuguaauucuagccccagaggcacagacaaggauucccagagcaagcaggcuaagaggaccagccauaucacugagcucuggguuccacugagagauccugcaacagugaaugcaguagaacagcaacugucagugaucccuaauaccaacuucagacccuccacaugcauaccacacauaugcaaaggaaagccugcgugugcacacacacacacacaggaagaaauaaacaaauagaggcuagagagcugguucagcuguucaagagcacuguucucacagaagaccuagacucgauucuuagcacccacauggcauugacaauuacccaucacucccauuccaaaacgaacgauucagacaugcaugugagaaacucauacacagacauaaacacuuaaaauaucaaaaaauaacauuuaaaaaaccaaagaggugggcuggagagaugucucagagguuaagagcacugacucuugguuaagggacuguucuucugaagguccugaguucaaaucccagcacccacauguuggcucacacccaucuguaaugagaucugacgcccucuucuggugugucugaagacagcuacaguauacuuacauauaauaaauaaaaaaacaaaacaaaacaaaaacccaaagagguaaaaacuagaccuuagaaaaugggaacuagggcuggugauauggcucagugaguaagagcacccgacugcucuuccaaaggucuggaguucaaaucccagcaaccacaugguggcucacaaccauccguaacgagaucugacucccucuucuggagugucugaagacagcuacaguguacuuacauauaaccaauaaauaaaucuuaaaaaaaaaaaaaagaaaagaaaaagaaaauggaaacuaucucuuacacuccaugaggugaggauuaaggcaagaaagcuucaaaauuaugcauuuguacauacagaagaaaaaaguccaggaagaaacacaacaguccugagacugggaugagagaguaaaacgugauuuaauuacuuguuuuauuuaaugucauauugccuaggauauuauucauggauuacuugguuguuuuuuguuuugaaguaaaaauaagccaagcuugagaggcggaggcggaggcagacagguaucuauaaaucuauaaauucaaggcaagcuuggugccagagagaacugcacaguaagaccugucucaaaaacaaaagcaagcaaacaaaccaacagucaaguguggugggcgugccuguaaucccaguucauugcagucaggggcagaauuuuuagacagucgggaccauuugugacaccugucccaaaaugaaaaaaauggggagauaagggugggguggauguggguuaaaaaacaagcuaaggacguagagaaucccuuguggagacucacuaguuuuaaaagcuagcuacaaauauauaaagggggggaugggggagaagagguaauucuacagcuaagagaguacaccgcucuugcugagcccaaaauucaguucucagcacccacaucaggcagcucaagauggccuggaacuacaguuccaggggacccaacauccucugugguuaucugcauucauggucacaaagucacgcaaacauucacacauaugcauaauuaaacguuaaaaaaaaagcaccuguugagugcucaacuucaaacaggacauuuccaucaccucucucccacaaggcacacgcagcaaacacugcagaagagggaguagaaaggaugugaaaagcugaagagugcacuacagguugucuucuggacacgacauggcccuuacacucaugaacucacugcagcuaacugcacaaaccaagccagcaugugucaguguuacugcaggcuggggguggggguggggggcaugaaaguggaaagagaacugcuggggggugucugacugaggagaggggagacuggggaugaauagaaucaagauaaaugcauaggcugggcaaggugacacacaucuuuaaugcuagaacuuaggaggcagagucaagggaucucugcauuuguagccagccagugcuauauuaagaccaugucucaaaaacaaaaacaaaacaaaaaggcacauuguauaaauauaugaaauugccaaagaaaaagauuguuuuuguuuuuuauuuuggaaacauuuucaguguagccuuggcuauccugaccaagcuggccuugagcucagagauccgccugccucugccucccaagugcugggauuaaaggugugcacaccacagcccggcuauaggauuuuucuucuuuuaaaggauaauuuaaaaaaauggauacugucaaucagacagugcccauuacacacacacacacacaaacacacacacccucaauguaagaacucacccaagacuuauaaaacucacuaguagcuuucuuugccaggaugagguggaaaaaucagaaaucaaacagaucaaugugauuuuuauuuuuuguuuuucgagacaggguuucucuguguagcccuggcuguccuggaacucacucuguagaccaggcuggucucgaauucagaaauccaccugccucugccucccgagugcugggauuaaaggugugugcuaucauuacccgaccacugugauauuuuuaaacggacaaaugagaauuaucagguacucauaacccuaguccccaaaaugacauaaauuugcuucuacagcucaggguccaggcuuuaccuuaaauaaagagaaugcgagucaugcucuacuugccacauuuuuuuucccccgaguaggcgguacacacccgucaucucuaucccacagugcuagcugaggugagccuggcccacaugggcuacccagcgaaauucugucucaugaacuaacaggaaugacaagauggcucagcggaugaaggcgcuucccgaggagccugaugacccaaguucacugcucagaaggaucaggccucaucucacaaguuuauuugaaugugauguaugugucaugccaugugugccccagacccucacaauuuaaguaaauacaauacauuuuuaacuaaacaaagaaagggguaaaugucuuauuucugugcaagcagaaagaggucauuuccuccuauggaacauaggacaucugcuccuuucucucugaccaugccauuccugccauggugguaaaccaccagcccagaggcagugaaccaaagcaugggagaaaucuacacauauuuggaaauucagggacacugauuccaauaaaaguaacuuuccacauacuuacaucagcucuucuuuaaaucuauacaccuauuguuuuccaguagaaauagcucaaaacauaaugucuacauuauucuacucaucugguuccaaagcaagccagagccaugaguuacacauacacacaaaaggagcuuggaaacaucaaauggacugagaaacacgauuaguaugccuuagagaauucuaacccaaaauaugucacauaaagaaacaaaucucagacuuccugaaaugcuuuacuuuuacuaacagauucauuuaggcuuauucagacagagucucauccuguaggguaaccugaaacucacuauauagcccagacugucuuugaaccuacagaaauccucugaauuaaaccucuaaagugcuggcacuggugugagcaaccacaccuagcucaacugugauacauaaaauguggacacacacugaggacuaacugggccaccuuauucugauacccacagagagucuaagcacauaccccauauugcaagaguagcaaaccccaaaccugguguuguuacuccuguguuaaaccucuccugucugugccuauacaagccagcacaguauugacaggucucuggaaucugacucguuuacuuucucacucccaagucucuauuuauuacgacagccacagccacacucuuucccaucaccauaugugagcaacucauuuucucagcuuucaauacucuccugcccaccaucugcugaaauccuauuccuccuucaaaguugcaaggcauugugcuaagagcucacucagccuuucaggccagagcuagacccacuagaauuccacuaauagcuucaguauccuuagcaaauaaaucaaggaaucuguuuccucaccagauaccacagcagacauagcaccauuuguacuuuguaaaguguguggguuaugcauacuggucauaaaugaucuaacauuguacuuaaggcagagagguaacaaacuaagcuaccuuucuucccuccuucaacaucaacaaguugucccuucccuaaacuccaauagcaaagacaaagauggaugguuagauggacggacaaauggacacacacacacacagaccccccaaagagcuuccuggcacucucauuauucauguuacauacccuggcuucaacauuaggauacgaacaagaugcuuacaaauguggacuuguaaauauauguacggcacuauuugugugaauuaucugaccucucauaucuguuuucuucaguauaaagaauggaaguuaacuauagucuccuaaagaaguuuaagguuauaaugcuugacauuuguacaugucaaacauugucuaacagagucugagauguugaccccaggcuuguuuacagaacauaaaaacacaaaaugcauuuuuucaauauagucaacuugguaaaacuugacacuaagcuaacuaaucugaccucagugugacugaccaugcuagccacucuucuucugauguccauggaaaacaaggagauccuuaggcacuuuaaacucccauauaguugcacucacaaacuucuaaguguaucacaguuuacccucauuucacagguggcuuaacacuaagagcuacaaaguauagucugcccaauaaaacccugaaagaaacgcucuacaaagcagugaaagcugucuguuuauucauucuuuaaugcuaaucuggugucaucaauuucucuaugcuaagccuacaugagcaauuuaccacucagacacauccaccacaucgauuaaacaugcaugcgcacacacacaaacaucucagcgguaacacccgacucuuaagacgguacagcagaggcacuagaagcccagggaaggcccugggaaggccaugcuuuaaauggacaccaccaauuuaauagcugaguaaccuaaguaagccguucccuuuuuguuuggaaaaggcuggccucaaacucagcaaaacugagauuauagucucaggccacacccacugaugcuacuucuuacaauucauagccaucuguaagacagggccuguuacaguauggacccuuuagggcugugcauucaaaaagcuaacaugcuuuagucaaguucucacgacaucacaaauauuuagugggcggugucuggcauuaaggcuuagcauaaaaagugcuaaaaaaaaucaauauuuagcacauuuccuauuagaaaaugaguucuauugacuucaauuuaucuggaaaaugauuauuaauaguaacaacuguuuaggcacauuuuacaguuuacaaaguugucuucuucuucuuuuuuuuuuuuuguuuuuuuuuuuuuuguuuuuuguuuuuucgagacaggguuucucuguguagcccuggcuguccuggaacucacucuguagaccaggcuggccucgaacucagaaaucccccugccucugccucccgaguacugggauuaaaggcgugcgccaccacugcccggccccaaagucuucuaaauaccguguaacacccauaaacucaguuuaccuccuaaaacauccgcaagggaauagacauuuugaaguuauauguaagaacuaaggauacggcuaaugccaugguuaccaccacccggguggcauccucccaccagacccuccaccugauuaaagugcuuagagccuuuuuuuuuuuaaaacaaaacaaaacaaaaccagaaacauccacuuaauggggcggguccugcagguugccacccuccucaagcagagucagccguucaggagcaagccgaagggcaacaaauccagucagaggccuucgaugauacuucauguuacauuguuuccuccagaggcguccucccacauuucuagggcaggugccaggucugugugugggcgcuucuuuuccccacuacaaccacccaacacgagcccuagggaccaccgagagacccccagcaagcgucggugaauaacaugggauggugguggucugcgguccagcccugcaagcugaugccaacucugcgauuggggaucugaguuaucucuagcacauccccaccaaucgaugggcggagagggucuggcggguuaaucaggccggcaaggauugcagaccagcgacgcuacgggaaaucaaggcagcugacccacuguggucgagcccggcuagcagagguggcuggaaggcugaggacccacagagguugggcgccggggaaauccgggcaguuggcgucugggggggagggggccgccugcggguuugaaacuggucccaaccccaaccugaggaugguuuugcgcuccucuagggucccacuccccaucccgcggcggccugggcugcaccgagaacucgcugcuaccugaaacugcagcagcuucucggucugcuccugaguuagauccugcuccucaggcgccgccauuuugccgccgccucuacgcuccugacccguccgcaccgucacccgccggaagugaucu

SEQ ID NO: 7050 - RNA, 7401 nt, Mus musculus
uggagggcggggucggaugagggcaccgcacuccggguguggcuguccgagcgccgugggcggugccacagcgggcggggcagccggugagcuguguggcuuugaccaugaagccgcagccaccgggcuaggcccggggcugcuccaggccugggcggcccgcagagggcugggccggucaccggcucggguucccgggacggcagguggccgcucaccaugcccggcaagcaccagcaauuccaggacccugaggucggcugcugcgggaaauacuuccuguuuggcuucaacauugucuucugggugagcgcgaguccgcuucucgcucugcgcugaggauagggguuagggagucucaguugcuggugagggagaucccgucucaggagcuugcgaccagggacugucccccacccccuccaccccgaugccccguccccaacuauucuggggagcuacugggauagcuggggggcgggacccagucccagcaggaggugcugggagucucucuuugcagccccaaguuugggcgaaaaagggggcggcguuugccggaagacugcaggggcgcgguaguugcggaccagccccgccccgccucccggccacuccagcucccagcauggugcggugagguucgcgaggcuggguccuagccccgagucuacccuacagacgcucagaagcuugugagccaggagguuaggagagaggaaagccaaggccucugccucugcagggagaggagcuccaguugagaacagggaacugucccuugggaacagaauucagcauuccauagcugaccaaacaaacagaggcuuccuucuguguggcaucuguguccugguccugccaagucaucuuucucuucucccucccccauccuaucgccaaagccgggcugugcuugcuguccuuuaugccaggccuuucccacuugcauucagcaggauucagcggcucuguucuccacccacgagccgucggguuugcccugugguggguguccuuggaugucagcagucuucuguucuguagggugugggcagcuacagggagcgcuggccuggaagucaaagggccugaguguagcaggccuuguccagaggcuuuugggcgagccucuuugcucucugggcuuuagcuuuccagccuuggaggagccaguauuggaguuuauccuucuggguuguuagauuaaacgagaguuuuuuguuguugagacagggucucacucuagcccauucuggcuugcaauuugcugcaguuuuccugucugaguuucuugggugcugggauuacaggugugagccaucacacccagcuuaguaacacaugaauucugaugaggcacauucucccgacugccuuauuauuaucuguaguuuacagauaggggacugaaugaauagacgguaagagcuuaaauuauuugucucgagaaacaugauuaucaguggguggagggaaggaagagaggcuaaguaacucuggggguagggggaugaaagucccagcuuuguuccugggcaaggguggggcgccugggcaggggaguaaagauggacagaacauuaagguccuaugcuuggguggcaugggggcaggcaggguuuuaaagcagaguuggaucaguucucguuggcuguagguguaugaaaaggugacagagcaucuggagaugggaaggaaucugggaccuuggguuccugaugucccaucucccaaaugugggauuauaggucugugccucucuguccagcucuacguaugccaucuggacaccaccuaggugucgucugggcagccuguucucccgauggcaccuuaaucuuucucauugucuagccucaguuccuugcuuggagagcccugauggucaaggcaagccacccucuuaucucugaccccuagcagcucauuugaggaaggcacaccaucagagagaguagagaguagagagagagacuacuaguaccccacccccacccacccuuuccuucccuggugcuggguucuguccccuacuguauccucccugaaaauggcuucucugugcuggcucugggggcuuaccccaagcaucaugucgccugucucaucccgucugauucaucucaucuuuggacaagagaccagcuaauguuuuguuuuccccaaaccccuccuuguucaaccuagccucauuccuccuccugcugcuuugacaaaugucccagccuccugaucagccucucucugccucuucugugcucuucaccccggguuuagccucuuaccuaguuccucuccacaguuauuucagcuuuccgggacccugacaucucccuggcuccagacacgcacgucuacaccccacccucaccuguuucagacaccucagugcccuagcacuguuagcccugugagcacacuagaggacaggcuagcccugcucucugcccucucugccccugcauagaggaaauaccgagcaaauaaacagaugccuaagugucuggagagggcggugggcagcugggguuugaguggcaaggagaaccaagagggugaagaguuccagacagagcauccagaaaaggcaaagaucccauggccaucacuugcuaccuagugaggucaaccuugacuacugcgaugagacccuaucucaagaagccaaaauaagggcuagagagauggcugggggcggguuaagagcacuaacuguucuuccagagguccugaguucaauucccagcauccacaugguggcucacaaccaucuggaaugggauccaaugcccucuucuggugugucugaagacagucacaggguacucauauacauuaaauaaaucuuuaaaaaaaaaaaaaaagccaaaacaaagguacaagcaugcuugaggccagauguuuucugagccagacuggggccucucugaauuuuccuccguguugagagaguccucagagacuccaggaagagucugcuguccagccugaggcuugagguagcuucuguuccugcgggaaagacgcccugaacaguguccuugcuugaugcacuaccaagucccaugcacagcuuugggagugggggcggggcuaagucccauucacagcuuuggggaugggguggggguggggcaugucucucagcuuucugauggccaaggauggaucaaggguggucaagagcccuggugcugggucccagcccugaacucucccugcuguuguaggugcugggagcccuguuccuggccauuggccucugggccuggggugagaagguaagagggaggggcugcccaggggggagggggagggggaggggugucacucccucacacuugucugcuccccggugcagggcguucucuccaacaucucggcgcugacagaucugggcggucuugaccccguguggcuguuuguggugguggggggagucaugucaguguugggcuucgccggcugcauuggggcccuccgggaaaacaccuuccugcucaaguucgugagucuuucucuaagucucucucuaccccagauccaccagagacuccuaaccucuuuccguucaguuuuugccuagucagggugaccagacaaggaacagguaaaaccgcgcugucuuuuagcaacagaacaaggugcuaaggggcagggagcaagcucagugguagccuagcagggccgguagggggcagcacuugaguaauagaggguggagccugaagccuguggcagagguagugggagcgcuucccuguccacagaagucacgccucuucaaugcccaucaucugugugcccccaacccaguucucuguguuccucggccucaucuucuuccuggagcuggccgcggggauccuggccuucgucuucaaggauuggauccgagaccaacuuaaucucuucaucaacaacaaugucaaagccuaccgggaugaucucgaccuucagaaccuuaucgacuuugcucaggaauacgugagugugggccucaugcgugugaccccugauggacacacgagagagggagcaaguucugugugugcacggaccguuuccuaacccacccaggccagcggaugccagggaaggaaccuuugagagacccugacccaggagaagccagcugcugcuuauuccgcaggcuuccuugugccuaguccuagagagacacaggcuugugaaacuguggccagaggaggaaauggaguauacagugcaggucucucuuucuauucagucugcgcccagaguaucugccagggcuauguugcugaugccccuugacuguguguguguguguguguguguguguguguguguguguaccuagugcucaaagaagccagaagagggcacuggaucccuggaauuggaguuacagacaguugugagcugcuguguuugugcugggacuugaacuugggucuucaggaagagcagccagugcucuuaaugacuaauccaucucuccagcccuagccuagcuuauuuucauccagcaucaugcaccaucuauaacugcaugcucuguacuuagagccauggaaacccucuccaccugcacauuccaguccuuguaaucccccagggccaccccuugucacacccagucaccuucaccaagauuuggcccuggggcucagcaguacccugaagcugugcaggccagaggcaauccugucgccugcaguuccuuucucuauucaguauggaauugggacaggccuggcauacaccaggccccgagccaggugcggggagauucaguguuuuaaaaaugugcagccuguucccuucgugaaggcaguguguuggggagaggaugcugaacauauaaacuagggcugggggaggggcagcgggaugggggcaggaggagagaacguaccagggaggguggaauuggagccagcaggguggggcagccucugaacugugugaccuugucgccaacggugaggagggguguaaggaacaggacggcucuccaacagagacagcaggcacuuggcaggugacagggcaggugcgggcucagcugugucugagaccugcacacacaagccacauggccaggcgucacgcccccggcugugcucauaggguccgagucuacgacuagagcugucccacacucaccugggagccuuuguagccucacggccagcuuuucagcagcuggcauaguucacucggggcucugcccugucccaggcucuugugccacagacucgggcuugccauggccacaucuggcaagacuagcaagugcauucugggaggcgaacuggggcuccaccaggaugccagcaagcauuuguggaguggacugggauggaaagggggguagggagggaaaucugucugggcuucuucuccuguccacacagugagucugaaaugccucgauccucgcagggcuuggccuugcuccugacccucaggggaguccaugaggaagccacaaccugcaacucagugccucaccucucgaggucuccuuacccacucagauucuuaggagcucaggccuguuuacuggggggaguggaagcuggcucucccagccagccagccagccagccagccuucuccuuugggugagacucuaggguugggccugguuuccagcuguucccucuggacucuucucucccccuaguggucuugcuguggugcccgagggcccaaugacuggaaccucaauaucuacuucaacugcacugacuugaacccaagccgugagcgcuguggggugcccuuuuccugcuguguuagggacccagcggugagugggcccugggaggagggaggaucucuuagcaguagggaggugcauaucagugugcucccguguccgugagagaacgaagaagucuggaguuucacugcaguugagcagacaugguaaacccaagcuuccguuugcuuuucugugaaggaggggcacuagaguugaggacccgggugagcccgcugguauucccuuagcguauugcuaauagccugucuccccucaggaagauguccucaauacccaguguggcuaugacauccgacucaaacuggugagaaggguggggacaggguugaggguagccuggaguacagggggugacauggggaccucuccuaaggucuuguggaaaggucuaagggcuucuucaggguggaacuggcccuggguagguuugagguauuggguugcucauuccacuucuguggagcgccugcugugguuggcaccgcucuagaccuugcuugauccagagcuaaggggucaguucugcacucagggaaucgguggagaaaaaugugacauuguaggcucauuaaauggacaguccugagauagcucaggugagagaauuuagaagguugacagguagagucugagucagggaaagccucuucagaggagacagccaggcugugcaacggcccuguggcagaauuccaaggagcugacauugucagggagggcacuggagcaggggugggcugaucaagguggaagaggggcgggggaucugagcugaggugggcaggccgagcuuggucucgugucuccucaggagcucgagcagcagggcuccaucuacaccaaaggcugugugggccaguuugagaaguggcuacaagacaaccugaucgugguggccggggucuugguggggaucgcccuccuccagguacagccuuggcuugcccacccuccuccugccugaagcucuuucuucuuccucaccugcucucugucuugcagauauuuggccucugcuuggcccagaaccucgugagugacaucaaggcggugaaggccaacuggugaggcugccaggggugauggccaugugccuggcccguggggcucuagugggggccucccaggacacucugccucgcucacaauggcaaggccugugggacgucuguuacgaccugagccggagguuuugugaccuuggugcucauuacccacugaggaaaccauuggggacuagacuggggcuguuugccacagagcucugugucggggguguguaccugugugugugcaugcacacucguaagugcaccuggagucucuacccugcugcugugaggugguggcccuuccagagcucguggggggggggcagauggaggguagggcaggcaccuguguccccuggucuacugugggauguaucuguguguggcuuaggagccugcugucucagaccucuccauacucaccaugacuuugagccugccuggagcuugucuuggccucagugucacagccucugaaauggguccaagaauucucucucucgcuugccucucaggaucacacuuggcgauggcuacaaacgacucaauaaacaacacuuugaaaaacag

SEQ ID NO: 7051 - RNA, 1242 nt, Mus musculus
uaguugcuuccuuucuacuguuaguacaccaggaggcuggagcucaagaagggagaaagaugacaaacggauugggaagguaggggaggggcugggacgggagagaggggagggaaggggaggggagaggagaggucugcuuagccgcuggagaggaggugagccuauagcuggaggguggccaggaacuugaaaugcuaacacauuggacgaagguucuauaaagcaggccgaaggcuaaaucugacuugaguauauuuuauuugcccuacacagcaguuaaaaaauuuuuaaucagcuuccuacauuaaauuguucauguaaaauugugcuugaucagcuucucccgagaagccagaagcucugguuuccugagcccacguucuaugguguccaacugguuuggggggagggggacuagguaaugaaagacccuucccaguuauccccacccccaccccauguucuccagaucuacaggccaagaacucacuguuaauaucuauuaccaguuugauuugguuuagaaucaccauggaaacacagcucugggugggucucuaugagaguguuuccaauagguuuaacuugaagagagaagaccccugaaugugugugugggggggagcaccacugggggagguguccugggcugaguaagaaggaggagggagcugagccccaggauucaucucucucugccuccggacuguggucacaauguaaccaccugcuucacaccccuguuaccuuaacuuugccacugcacucaagucuugaggcagaauaaacaccagcucucuuacugaagucucauuggauuugcuucuguuacagcaaggugaaaaauaauucagagagagguuggggagaucauggcacaggcaucaggaccugaguuuggacccuagcauccguguaauggcugagcucuugucuccacacuccugaagguagggaagaagaaacgugaauuucuggaauccauuggcacguaugcccaucuacaugagcauguaugugcaccucacacacagagaaagaaaaagcgaugaauccaucagccaggaugaccuugaacaucugggcuuccugcuuccaccuuccagaggcagguuuuacaggggugugucaccaugccuggcugggcaguugacauuuuuucauggagacuuaaaaagcaacgaacuauaugucucuaaguugcucuuucucaaaaauaaauaacaaaguaucaagaau
